United States Patent 9,328,346 (POLYCOMB-ASSOCIATED NON-CODING RNAS) - sequence listing, part 76

SEQ ID NO: 14145 - RNA, 39327 nt, Homo sapiens
gcggcgcacgcuuccugcgggcgcggccgcugugggcgcggagcugcgaggcggagccgggcggccgagccgggagcccgcgagccuagagcgcgucgguccagccgccgggccgcgccgccgccaagcagccgccccgcgcgccgcgccucgggaacaaaggcgcccgcccgccgcccgccgcccgcgcccgcgccgccgccaugaagccggggccgccgcaccgugccggggccgcccacggggccggcgccggggccggggccgcggccgggcccggggcccgcgggcugcuccugccaccgcugcugcugcugcugcuggcggggcgcgccgcgggggugagugacacgcgcccggauccccgccacggcuccccggggccgccccccgcgcggggugccgguccccgcccgcgacccccccuccgggaccccgcucccucccccccggcugcuucccccggggccgcggucccugccaccccucgacccucccccgagcgccccuuucugcacccugcuccccccccuccggaaucucccccuagcuggcauccgcggggagaggccgcccccgccgcuggucaucuucggggggcgcaucucuccuuccuuuugggaccccuccccagagggaaucccgggagggaacccgaucgcggguccucagcccuguucccccaccucccaguggcuccgggaacugucuccccggggacgaagcgggaccccugcgcuggccugggaggcgcgagaaggacccggcggcgggcugggggucgccgucccggcugggugugucuuggggugggagugagccuggcuuuugccucgugggugugcccagaccauggccacuuuuugggaaucggaucgguuccccuuccgaggggagggugugcauuugguucuucccagggucgcggcagccggccagggcagugggcccgggaaggggagguggagguggagggugacuuggugaaggugaccugaggggggagugaggguaacccugugugugggcgugugugggcguguguggccaacucagugaggggugcggggaccuguggggcgugugcaggugaaggaugugucugccacauggguggaugccagcgugcccucccguccguggucgugggagggugacccauugugcaugaugugugccugugccuggcugggccacuguuggcuauggccguguguggcugcagugggugagggugugugugugaaagaccucuggugggcgugugcuuggacccaugaaugugugugagugcacauagcagcgugugcaugcaggugcaugggggacccuggacauaggacgaggaccccugaggggaaccaagcaugugcagguggaggugaugguauguaugaggugacccuugagugucccuuugagugaccguagcagccaugcuuggucccagcuccgucagggauggcagagaaaggaaggaccucaucccccuuugagggauccaggccccagaugaguucuuguuggacaaguguccagguucuggcucaggcgggcuggggauuucuagguccagccucccagguugguuccaggagcuaugcuguccugcaucccccaggcugaaaaggacccaggccucucaagcaacacugggugcccagccgcccucugcaaguuccuucccuuucccagccucagugggccagucaguaagacaggaggaggacaggcaggggcuccaagcuugcuucuuggauggacaggccccuccucagccuuccccaucuagggggcugucagcuggagggaggggaaguguugagggcugaccugugugaagugccugcuggccaggaugucucauucccagcucuccccuaaguggggugagaggaagaggucccugggagggauagagacccagcacacccuagcagcuggggucgccuucucagccaaauuucugaaagaccauccuuaaaaucaaaggcuugggaaucacacaacccuggguuccaauccugcuacccccgccgauucguggcaugguuugggcagguccucuuacuucucugacccuugguugucccucugugaaauggggcuaaugaccccuuccucagagggcaaaaauucaaugggaugacugacgaguguccugagaaggagcucaggagucauguggugugcacaugaaugaaaggggcucaggacagaaagcuuuagacuuggaggccagguggagcgcugggcaggccacuuuccuugcugaauaaggcuaauaauucauacuccacgaggugguggaaggacuuagugagagcauuuaauagccucaugcacaguagggccucgcaacacgggugaccugaaucugagagguguggcucagacccaguguuggguggcagaucaagcagacccugggagucugagcccagaggcugaaaugguggguggggccugggggagggcagguacuggggcgccuggugagguggugggaaguggaguguccuccaggccucacaucuucccaugggucaagcugucaaggaggggcaucaucccucuuguccucaucugacuugggaggaaaaggguuaaugggugguaccugguugccgggguuccgcaccagagggagagggcagugccugcagcaggagggacugagguuagaucagaagagccccagccagggaagcuccagggguggccuugguagaugagcgguggcuggcacagggcagggaagggcagggacaugaugacccuugggucaccugccagccuuugugugugugugugugugugugugugugucuucgugucuuucagcauggggauagcagggagagcaggccucauucacacugcagauggugaauugcaguguguguguguguguguguuugugugucugugucugucuccuggcaucuccuuugaggagucccucuucugacagaccaaguuaccaggacucugagggacaucugccuuuaaggccaccucagcuacuguacuuaagucaccacucaaaguuuuggagugugaggauccugaacauuuuagcuuuugaaacauguucuuucaaaaguccagggcuggaagggaucuuagguguuagucuuguuugaauacucccagugaugggagaccacuaccuuguggcugugugaccuugugaaaguuaccuaaccucucugugccuuaguuuccaccucuuuaaaauggagacaaugcgagaauggaagggcuuaauuuggaaagcuuuuagcccaguggcuggcaccuacuaagggcucaacaaauauggauuucuuguucuuuuacaaaguugcuguacugugguugggaaggcaggagggguggggaguggaagggugggagacguguguguguguguguguguguguguguguguuugugagagagagagaguacggaugggggugggggugggggugggguggggugggggaauuaguagggaauucuuuugaagcucagccccaggccuggugguuuccguuccuuccucacccuguuucaagcaucccugcucuucuccccuccaggcuccccugggugacugugagccuuggguuuccaggaugagauaguccucaccaaaaaaauggaaaguugggggccccugggcuguucugggccaggcucuugggugaaccaucuccccuuccagcauuugggggacaggcacagggacaccacagcuguaugcugccuguuagcucccaagguaccaggggcucuggggacagacaccugcugugugauuuccagugagggauuucuuucugucucaaaguccuugucuauaaaaugcggacaguaauggugucagccucacagggauguugugacuuggaaaugagcugcuugaguagaccgagcacaccugccacguagugagcucucaggagaugggaccuuucugggagggagcauggauggggucagggaaggcuuccuggaggaggaggguuuugagcuaagcaaugaaaguggucaucacaugacaguagcaggcuguaaccugcccugacccucagcuuucuuaccugucaacugggggcaacaaauacuuggcuuuuagaaucacuacugggggcugugacucuauccucaaggcagggcugggauuugaaccugaagccuccugcucucuggggaggagugagcacaaugccuccagcugugaguucaguguguuggggguuggugcgaggugagcugugcuggaaaaaaaagugaaagaaaacaacaaacaaaaaacaaaaaaaauggccuuuugaaacccaguggcuccucccaccucauacaagcgggcauagggucccugggggguccggggcagcaggagugguggcagugguggggagagcgagggggggcucaucccaagugggagagagaggucauguuuaccgagagccccgcccaccaagcacuuuacauguaucggcuuauuucauccuuacaauaauuuuuugauguaggaauuauuagaauccucauuuuaguauuuuauuuuauuuagagacagagucucuaucgccaaggcuggaguguggugguaugauccuggcucacugcaaccucugccuccugaguacaagcgauucucccaccucagccucccaaguagcugggauuacaggcaccugacaccacaccugccuaauuuuuguauuuuuaguagagaugggguuucaccauguugcccaggcuguucucgaacaccugaccucaagugaucuucccaccucggcccccgcaaagugcugggauuacaguugugagccacaacccccagccagaacccccauuuuacagaggagaaaacugaggcacagagaggcucagugacuuacucaaagucacacagccagaaguggcagagcuaguaugagccagggccugacaggcuaaugggacugggcugcaguccuaaauuuacccccucuugcugugugaucuuaggcaagcugcuuuaccucucuggggccucccuacccccuggauuaugucugcauuagcuacuguuuaguaaaugccugcucuucuggcgggguggggcugggaaggggguuggucccauaucuuuucucacuuaauucucccacagcccuggaggucagugaugcugucucacccugugggagggauuggccagggcucuuccucaucuaccgccucccaaggcucuguagcccauaaaagcagcuacucugagggccacuggggguguaugggguggggagagagagcuuuauaaacugcgaagggcugucagcaagauugugugugcgugcauguguacauuugugugugugcccacacauguguaugcggaagggaguuuaugucugggucauguggucagggcacaggagaggggaaauguuuggaaucucaggaugagaggggucuaaaaagccaccauaagcccugauaugugccagaugcccccaguguuggggacugagucugcagaggugaccaggccugccuuuaacccccucuggcccuuagaaaguguguggaggccaaauccguguuccuccugcuccaucucugagcacuggccccauugcagccaagauucucucuggccucauagugauugaggcuuagagauggggugugacuuggugggggucccccagcugucaggagugaugucagugcuuucuugauagacuuugagcuuccugggcaggcucguggcugccauguuuucucacugaacccccagggaccacucugugcuuggugcaggcucgagugaaugauucaaaggaaugaaugaaugaaugagggaauaaaggaaugaaggaagccgggacugugagcuauggagcccaggcaggggcuuguguccuuuccuguguagguggguuggggacagugaggcuggcagaguccugcugcaugcaaggcaugugcccgugggcugggaggcgccagggggcugcaucgggcgggccuucagucugagugccaaggcacugccaccaccacaucugggcaggaccgagggacuguggcucuggacuacagcccagcugcuuggagcccuuugauuuugugucucaagggacaggguggccagagccaggagcugcccaggccccaggcccuugcucccaucauccccccaaaccccugucccagcagggagcaggguccuggacuuccugaccugucucacuggccccuccaggccucuguccuccauaacaucacauccugggaacaucgggcuggcucuugguaaauauuuguugauggcaccccccacacccucacuccccuuggcucccagccuccccagauuccaggaggccugguggccuucacuuccggccccccucccgccauggccagaggggcagccacuccccucccccacuggccaagcccagucucagcgccaaacaggaagccgugauuacagggggagccugagcggccauggcugagggcccagcaguggggguggcgguggccccaacaaaugaucuggcccuuuuuuuaccuggcugcuguggguggagggcaggaaacgccuaugcuggccuuuuauaccagguggagaggguucuacaaccccuguugccccagcuggcugaggccugccuucuccccaccccuggccuuggugcuaugucuguuuuggggugucccaagccugagggggcagcuugaagucaucgaaggaguagggauccuggagccagcugauucaggguugaaauccuggcuuugucacauuccugcugugugaccuuggugaguucaccuaaccucucugaacccgcagucuccucuucuuuaaaaugggaccucaggguugcuugagaauuaguaauauaaaguaauaaaguaaauaaaguacuaaaguaaauaaggagcgggcugcuccugcaaaucuuguuuuuuuuccauucaccugccuugguuuuuguucuuuuucugucccucucugggucuuacugaagaacuacugcuugggggugaggagcaggguuuucuuuuggagagagggggaacuaaguuugaauaaucauggauggccugaaggagaacucuggggguggggguacccuuagaaggagaccaagggccggacucccaguuggagccagcaggacuuaagccagaugagaggaagcacauucuaggguccguggugcugaguuucugggggcugguucuccagagcuguugagcagccugcaguccauccugcaugaugacucuucaggcccuuccacuccuggaacuccagagaggccuuguuauuugcagcuugagcccaggacuuggugagacugggugcuuuccauuuuccucccagccagggagcaucucggcuguguucugucugucacaugggcccuggcccagaguaggugacuauugauguuuacgcaggaucucagggguggagaguccuagagagauggccagcccuacagccugacaucccacagcugauggcccagccacagccuggggccuugccaauggauuggggcuggcucuccagccuuagauggucccacugagccucccaccacucuugaggggcuggugggauuccccuuauuuagaggaaggcucagagauguuaggccaccugccaaagcacacacagccaggagcugguggagccugguguucauuugccccuucuccuacccuggagccccaucugaucuugucgucacauccccuacuuagccaggguuuucugggggugcagcugggacuggggauaacacugacuugggccuucauccugcuuuuggaugggccaugggcuuccagggugcugucuggugcugcuucacccugggguuagccuuggcccaggcgacccuagagauuccuguacccccugcacugccagcuaggacccccccauccauccugcccucccccaucccugccugccagcccagacuuuaaugaggguaauuuagaaucaaucaccagcgggaucugggaaaucuaauugcagcaaacugauugccaauucgauugcgggcaccagggggcugugggcggcucauuagaccugucccccucccugggcuggggcuugggggugcuccgugggggaugcagggccugaguaggcaaggcuccuggagagcuggggggagguggacuguuguuuugggagcaggggaagggcauuuuuaccugacagaagccauacacuauucccuguccaggcccacaguugggguauaggugccugugucagucuuuacccucugucauccaccccuugcuuaaugcccccuccucaaggccuggaugccauuguuggggggugucugcagcugcaucuuaccugguuccugccuucaagaugcucccugugucagggagacagacacaagcacagaugaugacgaggaagaugaugagaaagauaacggccaauacuuacugcugcaugucaugugcuaggugugguucuaagugcuuaacaugcuuuaucucaguggguccucacuauggcccugugaggcaggcaugguuaccccauuuuacagaugggggcacagaggcccugagagguugagcaaugugcccacaguggggcaguuagcaggacucugagccuggagccugggugcuuauggagaugcucguucaagagcguggggaaaagaaagggcgaucagacuguuacugugucuauguagaaaaggaagacauaagaaacuccauuuugaucucuuucuuuuccccacacaagggcaucaggcagacgugugggcuccugcaugggcgccugucuugauugacugcguugcucacucagcagacauuuacuaagcaccugcuguauaugaagcccugugcaagggggcugucaguguucaguugugucguguguguccuaugucuugucuggccaugucuugcuucaggcagguuuacugguggcaggugcaugugcuuuugugaggucucgaggggggaauugaagagaagcagggaggaagcccuaccccuccucccugacaggcugagccccagcucugccauuagaaguggguggauuuuggcugggcgagguagcucacgccuguaaucccagcacuuugggaggccaaggcggguggaucaugaggucaggaguucaagacccaccuggccaagauggugaaacuccaucucuacuaaagacacaaaaauuagccaggcgguggcaggugccuguaaucccagcuucuuggguggcugaggcagagaauugcuugaacccgggaggcggagguugcagugagccgagaucgcaucacugcacucucgccugggugacagagcgcgacugucucaaaaacaacaaggcaggcuuggugacucaugccuguaaucccaacacuuugggaggccgaggcgagcagaucacaaggucaggaguucgagaccagccugaccaacauggugaaaccccaucucuacuaaaaauacaaaaauuagcugggcaugguggugcacaccuguaaucccagcuacuccagaggcugaggcaggagaauugcuugauccugggagguggagguugcagugaacugagauugugccacugcacuccagccugggcaacagagcgagacuccaucucaaacaacaacaacgaaacgaagaaguggguggauuuggcuaagugacucuugacucagccuuagucuccucuucugucagacagauccagugaucccugacccguuaggugguggugaggaguggugggaggugcagaugguuaaaaggaaccugcugcugggugaugacuuuuaauuauuauacauuccccaaggugguugugucucagaggugaauuugccacuagcuugucaagugguagcaggcagccuguucccucucugggccuccacuuccacgucuguuaaaugggaagagugaauggugacccaggggcccuuguagucuucagauuugaggaacuaucagaaagaccugaggccagagacagggccugaccuagaguuggcuuaguggggaagggcaggcaggacggcuggccuggguggggaggggaggccugcucccuucacguggcuugucucugguuccucuugggccaggguaggaggcaucucuuuccuugcccaucacgcugggcaccaccacccucccugaacccuggaacaugaucaucaguuccaagcuagcugggggcugggcagggaguccaguaccuggauccuuauccccacugugcuacuguuuacugauggacccucugugucuggucucagccgagcacuagggacccccagggggcucagcuuggucccugacauuaggaagcucucaauucugugggguaaugagagguugauuuagacccugaagacuaggaagacuucauggaggaggcguccuuuguaccaggccuugacagauggcagcacauugauagggggacuaggauggacaaagucugagaaguggggaaggucgcaguauaucagggagcuaccacauguggagaggggaacacgccucccuuggcggcgaggggucacugcuguaggggccgcccuuucugaugagaguguguuucaugccuuuaacacacagucaccagguaccuggugggugucuggcccugugccucaguucuuguucugaacaguugaaccccacagguccuccacauggaagagcucacuggcucacaaggugggcuuugaguccaaaccaaggcauuuggguacuguccugcagguagagggugcugcccuuuugucgugaggagauagcaugagaugccggagcuuggaggugacauauugaguucugcccauugagugccugccacucgcaaaacacucggccaaauguuucaucuauaaacaauccuuagccuuaugagggagaugccauuguaaucuucauuuuacaaaagaggaaaucaagguacagagagguuaaauaauuugugcaaggucacagagcuagugaguggcccagcugggauuugaauccaagcagccugccccuggagucccaucuaguacauaagcacugcuucaugcugccguguacauuucuaacuguaaagcaugguaucccuacaggaugaauguagggccaaucaggccuugcuggguaccugaacuuguguggcuguugucgggcaggcccuuucuugggacuuugggcuccuggcuuccacauggaucuguucucugcagcauauuuucugucuguauggggcuaugggcagaggcuaacccaggcuggggaaagaucagauggcuggagaggauuucagcuggaagggcccuugaaaauacucuuguccaaauuguucacuguuccaaaggggacacugaggccaaagcauugaucucgagucaucaugaguaucuucugagagucuauaauucaacuuucuuacaugacauuuggggaaguugaggaucagagaagugcaaugauuuguccaaaguacacaacaaguugauggcugagcugggacuaagagcucugucuccugacuccugggcagggcacuauccccuguacuauguuccuuuucuguacuugucucugcucuguccagaaugcaggcucagcuccucccacacccuucuuccaggaagccuuccuugaccaccccagcugcccauauaugcccaauauuuccuaugccaaauuaauucccgucagugccuucaaugcacuucuccagccucaucccuuugccuucccacgcuccuguuuuuuuguuuuuggcauggacuuuuacucuguugcccagauuggagugcaguggugugaucuugguucacugcaaccuccgcuucccggguucaagcaauucuccuggcucagccuccugaguagcuggaacuacaggcccaugccaccaugccuggcuaauauuuuggauuuuugguauaaacgggguuuuacuauguuggccaggcugguuucgaacuacuggccucaaaugauccaccuaccucagccucccaaaaugcugagcccaaaaugcucccaaauguaagcccagucuguacaucccacgcuucuaccagcccuccugagcacagagcauaccauugucucuuuuuccuucaugccuacccagaugcuguucccucuucauggacuguuccuuuauucuucagugaacuccuacacauccucuaaaacccagcacagaugucuccuccucugggaauccaauaaugaccccuccuaccagcccccaagcacaguaagccacuccucagcccccucacuccugccucccucuucuagguuccuaggugccucuucuaccuguuaggauucuuugccaagcccaauuauguuauuucacuucguagugucugguuccccucaggguuacauuguuaccaccuuggagcucucacuuggauacauuguugcagcugcuaauuccccauuacaucaucuccccuccaacccucacacaugguacuuuguuacauuuccccaaauucugacauugcuacuuuguuucuuuucccugcuuucacacguccucaaucuguuucacuccuaguucuccccuguugucacauuugguccuuucuccccagcccccagcucaugugacccccaagacugggagaagaggaaaguggagccuggcagcagggagcagugggcacccagugagcuauggaggugcaggcggggagaggugcacuggagccuguuuggcuccgucuuucuggaggguggacagacugugggcucggaggcucaggcucgguuuugaggagaccuucuccucuccaaccucccuccucuccaucuccuccuccgucucugcucagccccccucccucccucccuccucccacccuccuccucuuacucgcuuccucccccugcucugcuucccuagaggcccuuaucuugcucccuggcugguuggaaccucccaugucccuggcugugacccaccagggccagaaccugagggcuccccuuggggacaggggucuugagggcugaggggguaguuaggaccaaggcuagagggauucuugauucuucuuuaguuccuugcccucccggccccagaacucacaguucccugcauccgucccuccugaaauggaguuuuggggcaaagagccaggaaucagcccuggccuugcuguucagaugaggagacugaacccagagaugaaguguggcuguugagggucacucagcagugagaaguggaacagcuuccccggggcugaagccccuacauggccucugggagcugagcccuggcuggcuggauccuauucucaugugagcugcggagcuggggggcuuguggggacaaucucagauccagagggagcucagcugugucuugagggauggucugcaaggcugcaagugaggccagguaauccuuuuuccacguggagcuaaggccauguuucuguuuaggacguuaguuuggguuagggguuugcguguaccugcaacaugugugauggcauguuguugugugucugugcugaugcauggggcccuggugucuuuguaggaaaaaguguuuguagccuaugccagggggaucaggagucccccaacugcugucccucccccugccucagcuccaggggcuuacccgcaacacuguggauuaaggaaguugggagaugcucucuaccuugggaggcucagaugcaugcuuacaaauggaggaacauggaccugugcaaauacccuuguccugugcacacguguagagacagagacagggacacacauacacugccaugugcacagguaccacucagagacacagcccuccacgcuaacauggacacacucagacccacacaggcaucuaagccacucgagacagcccuaggcauacacacauggaugcaccuagacagacacacacgcccagaaauaccccugaaugugcuuggaugugugcaugugcaugccuguguacgcccacacauucacacauacacacacacacuccccacacacacccacacacucucacccacacacucacagucauccacacacacucacccacacacaccccacacacacccacacacucucacccacacucacacucauccacacacacccacacacacguagcccacacauacacccacacacucucacccacacacacucauccacgcacacucucacccacucacacucucacccacucauacucaccccccacauucauccacacccccccacacacucauccacccccccacacucauccacacacucaaugcacacacucacccccacacacacauucucacucccccacacacucacacucucacccacacacacacucacacacacucauccacacaccccacacacacucauccacacacucaugcacacacacccccacacacucucucacucccccacacacacucacccacacacacacauacucauccacacacacgcugucguccccacacacucacacacacacucucaugcacacacacgcacucuuacccccacacccacucacacacacgcacacucacaaucacacacucucucucacacacacacacugcuggggcucugagcuacgaaaauaugucuguccuuaauccugacucuuaaucccagggucuaggagcccaggccagaggggcagcuggucaucuggccucguuagaggugauuaaggcaggagcagugugugugguguguguguggagggccucagagcuuuguuuucugccugaccuccagggacacuucucacucccccgcacccugcacuaaaaaaccaaccuuggauuccuucggagaugcaguuauauguuauuuaccacacucuggaugccggcaggcuaggggguagcaggagagggaguguggcugugccccugaggaaauugacagcuggggucagagaggccaggagacgcgggucccuuuauuucaccaccugccuggggaaacccugaucagagucuucggcacuagggccucguggggauucugauuucugggggggauucuguuucuuugaucagagcauuucugacuuaugggaaaaugaugcccaaccaagagauguugaaguuggggcccugagcagggaggaggggugguugccugagacuagggugggauggggacgccuccaugaggaggggacgcgugagcugggcauuaagggugcuggcuccuggggcauuuugaaauuuuugguugucauaguaguggaagugcagcuggcauuggccaggugggggucgggcugcuaaauggcuacaguguccagaacagucccgcugguggaaaaucguccugcccagguaccaauaguguugcuuuugacaaauguuuggucaugagacaugguggggggggggggggcuccuggugggugggguggguauggaccauggcacaguggugagacugucuuugucaugcugugggagggaggaacauuccacacugccuggggcaccguggaggugcacagagauugcaugggccgauuccccugacccugcaccuuccccacccucagcacuucccucccuuuugccuuuccauguuuacagggaugugugucccguguugugucuaaggggauggccgugauaaaugguggaaagagggcguuugggcaucagcccaacuuggcuguugggcuggccuuucccugguggagcucccuauaggggagggggccacgcugcugugacucggucccuaauggcagcagcuggccucugauccugccgggggaggcucaggggaggaugaaucagcugagacuugacauggacuuggacuuggacuuugaccucugcaugucagcugggugaacuugggcaggucacuauacuugugucguccucugagccuguguuguccucuaugaagcuggagggugaccauggugcuacaggguguugcaagagcuagggcuuacuuggcgcagaguccagcacacugcucugcucacaggcugcuacuagucaugguaaauguugggggaguggccaugagagcccaccaucaccacagagguggcagucacuacccauccucguccuggguuuggggaacaagacuguguucuagcaacagccacuugccugaaguccaacuuugaguccaucuuuucuagcccaguuccucucccacaagcacugucuacugcagagcuuugguuucuguuugguagacuguuuuaggaucauucauucauucauucauucauucccugggggccugggggccuggggcuaaggcuggugggcaaccuugcccugguggagcuuccuacaggggagggggccaagcuggugugacuaggucccuacuggcagaagcugggcuucugauccugccuggggaugcucagggagcuauuccugguggagugggugggucagcugagaccugaagcaguuugauucagggaagccacguucaggugacacaugaggaguggaggccaggccuuaucccugggcugcagggauaggggccagggcacucaggguccuugagcccuggcagguguuuggacucugagcucagugggggagaggaagagccuguagcuguguggagaaggggcuggcaggauaccuggggaacgcaggaccugcaggaggcuggaggaggauguuggguugggggggugagcacuggguuuucuuuggcucccugcaccccauugcugaggggcaggggguccuuguagaguucuuggccuccccacucaggauccucuguggucccugccuggcagucuaaggcacugugaggccuccucccuucuucuucuuccucuuuuuuuuuuuuuuuugacggcgucucacugugucgcccaggcuggagugcaguggcgugaucuuggcucacugcaaucuccaccucccggguucaagccauccuccugccucagccuucugaguagcugggauuacaggugugcgccaccaugcccagcuaauuuuuguauuuuuaguagagacggggucucgaacuccugaucucgugauccacccgccucagccucccaaaauucugggauuacaggugugagccacugcuccuggccuccuccucccuucuuaauggcugagagaucagagucugggaggcaaagccaagguguugaggcucaagacagggccuaagggguuuuaggcuucauaccugaguucagccaggcaggagagacggggcuaccgagcaccuuccagacaaaggccugguagcuccagcccaggccuagcccaggacagacaggccucugccagagaguagaguggaaaccacccgaggggcuuggcggcugccagcugugcugggcggagcuggugcuugggagccaggugaagauggggccagggugaaggguggggccugaagaggcaccuguccucaggguugcccuagacagccauggggacagagggcagauggacuugaguuaaaauucaggcguguuuuaccacugggacccugauaggcucugccccuucccuggcagggacauauccucaugccuuuuccugagggcagccaggggugaggcacauggucaaagggugggguggggcauccggaaccacugagggcugcagcuggaaugcuggggucgaggguuggggacggcagauagccugggucuggagucccuggagucucugaagacucugggcugagccugucccccuccacuggccccaccugacaaaguggccuuugaacagccuagaagaggcaguugcugagcugggccucccacuuguggucugcggacuaaacguuugccugucugggggcgggggcuguggaggcuucaccugaggcuugguaagaagauguucaaaugggagaggaggugagcagggccaagacaagcguguugucaggauaaggaaugcugggcuucucugaacuugaguccaggcucugcugugugacccugggcaaguuucuuguccucucugagccucagucucauauucauuguuauuuuugaaacaacagcuuuauugauauauaacucauauacaucuugcccaucuaaaguauuuaauucagugguuuuuaguauauuuacauaguuguaaagccaucacuaaauuuagaacguuuuuaucaccccagaaagaaacgcuguacccauuaacaguugcuccuuguuucuccacaaucccugcaggcauaggcugucacuaaucuauuuucugucuguauggauuugccuaucccagacauuucauauaaauggaauaauauaauauguggucuuuuguggccaauuucuuucacuuaacauaaugguuucaagguucauccacacuguaguaucaguauuaguucauuuguuuauuuuugagacugaguuuugcucuuguugcccaggcuggggugcaauggcaugaucucggcucccugcaaccucugccucccagguucaagcaauucugccucagccucccaaauagcugggacuacaggcacgugccaccacaccuugcuaauuuuguauuuuuaguagagaugggguuuuaccauguugcccaggcuggucucgaacuccugaccucaggugacccucccaccucggccucccaaaguguugggauuacaggugugagccaccaugcccagccucaguauuaguuuuuuuuucuuuugccaaauaauauuccauuguaugaacauaccacauuuuauuuauucauucaucagcugauggauauuugggugguuucaaucuuuuggcuauuaugaauaaugcuaccuuuuuugguguguggacauauauauuuucauuuuucuugaauauauacccuaggaguagaauuacugagucauauggaaacuccauuuaacauuuugagagacugccagccucuuuccuaaagcggcugugcuguuuuacauucccaccaguggugugugaggguuccgauuuccccacguccucgccaacgcuugugauuaucugacuuuuugaucacauucauucuugcauccauucaucccucaaguauuuauagaacaucuauauucaacaaggcagaaggcccacugcagagcugggaagggaauuuaucccuugaagaguuguuuagaagauuccauggcauaauaucuagaacaacccccaccaagcucagcacauaguagaugcucagagacgggagacagggagcaucaaggagaggaucuggggguggucagcaaccauggggcccccgggaauggaggaaaagaggauggaauuuguacgugcugaccacguacugugugugggaaccagugcuucaguccuuaugacccucugggccauaucauuguuccauuugcagaugguggaacugaggcucaagccaagcagcuuguucugggucacuaggcugagaaguagucagacugugggcugagagccuuguuuggaucaucuuauuuaauccucccaaccccugaggucaguccuauuacuauacccauuuaguaggugaagaaacugaggcucagagagguagacugacuugcccagagucgcguagcuggugaaguucuguccugggauuuggagccacauagucgagcaucagagucccugcugugucucccaggccucuggaggggagggugagggcuuggacaugucugcucccuccuucccucccuuucucaccccacugugucccacagagccucaucuuggguuggagacaguccuggggcaaguguggcccuaggcuggcuuuugagggcccugccaacccuucuuccagccuuuuugucugaugccuugcucugugccucaguuucccaucugggugauggugguggugacuuccaaggcugcuguggcucagaucaucugagucuggcuuguucugucccuagaagaggagcagccgagaagccagugggacugcuccaggcugggggcggggaguggcaucuccacugugugugaguuugggcugguuauaaauaacccagcaaacaggagggugcggggaaccacagcccgccuccucaggaggagaggccuggacacacacacacauucuuacagacagggccguuucaguuaugugugugugugugcugugugugcccaggguguaugcucagcauguguguggggagggcuuuggggagccgucagagcugugcaggcucccgggacagcuggaaggucugggccugcucaggcugacuccagcagguucucuucaguucccuggaggaggcuggggucagcccagcagagcucuagggcuggcgaggucccuggagcccccucaccuggcuucaagugauuccaaggucaggcugaggauccuucugcucuuaggggccuccaugugcuccuccagccccuucccacugccacgucccacccugccugcucucccugucccugcuccaguccugaaucccauccugacucuccggcugagcucacugaccucuagcaagucgccugggcuuucugccucuguggaguaaggaggcccauuucacuggcuccugagaagguagaguccagugcuuagugugugcucagugaaggcugcuuucuuccaguccugguugagaaauggccagaauguaugcuccacugggagcccacugaucugcauauuugcauauaauuuacauaaacauuuugugacaaaauaugcugggaucagugucuguuucucuucccuccucccagcucacuuggaguccuccuggcuggauuuuggagggaucagagagaacucuuguucauuccucgguuuuacacacagggagacugaggccagagaagagcagggccugccuugggaucccauagcgauugggagcaggaggcaggugaugcagaucucugggggaugaugcaacccacaguauucacugaacaaagacugauggaggcugacuguguuccagaagcagucugagcccugggguuagagaaaugaccacacagacccagucacugccaccaggagcaauuggagggggagacagacacauuccucugaagcccggaaauaaaccagccaauuuucaggcagugguaagcgauugaggacuagcccugguuuugcagacuagcugggcacguggggacgucguuuggguggauuuggugguucagggaggugagcuuugaguggggacacagugucaugucccagugccuacuaacugccuaucaccacuaggcacgugacagcugguaucucuguguguuggggaucauuauucccguuucauaggaggacagagcgaggcccagugaggcgaagggaugugaccagguaaccaguuugggagugggaagccagggcgggaacaccuaacuccacaccagguuguuccucggagacuccugggccccaggagcgggcaacccuugccguguuugcuggcagugaccgucauggagccuggagacagacuccuagaggcaccugcuggugagucauggugggggcagggggugccuaccugagcugggccaccugucgugugagugcgccuuguccuccauuucuacucacucccaggcuuucaggcugucucugugcagggagcugagugugagguggugcuggucucugacauuugcccugcuuuugagagccuucugguaggggaaacugauuagggcuaggagcaggugugcucugcaauccaaagggcauggucuuugggguucagcuaaucuuggguucaaauccuggcccauugcugugugacuuugagccaguugcuucaccucucugaauuuuaguuugcccaucugugaaaugggaauggcaaucccuuucuggucaagugagaagagaaaugaggcaaugugcauauaaggaaccuggcacuuagugagggcucccuccgucggggcugugaucauuuucauaagggauggaauggcccagccuuuuccagaaaagugcucaguggaaggagucuugaaucacaaacuggcauucccugcaggcauucucagggguucaggaguucacugaacacaggauuuagacucaacaaggccagaauucaacuccugugugaccccacugguggcuuaacaggcucagucuccucaucuauaaauggagaccauauuaucugcuucccagggcagcugagugguuucacugagauccaguggaagggccuguuagagugaugggagcaugguuggugggccuucucccuuaguaaaugacaacacaguggagguacugaguccccaagaaaggacuuccuaauuuggaccagggaggugguuggcgugcguaugugacauucaagcaggcugacaaaggaggcauugugugagcugagccagcuuuguggggacauaucuagugccuaggauggugcuuggcacacaguaggagcuuaauaaccauugguuuuacugauuaaccagcugaguaggugcuggccaggcagagaugguggggaaagguauuccaggaagcaggaacaggccugaaggagcccguguucccagaacuguaaauaguuuugugugggaggaguaugggggugggcagcugggagugggguguggggggugcugcugggucuggaaacggggccucagugggugguccugcucucaggcacgagcuuggggacaggcaucaaugagcagugugagucaggguggccaagagugacgugagagggcagguggcugggauugauggggcggugacggaggcgucccagcccuggguugaggagggggccuggcuuucccaggguugcauugucagcuucugucuaggcacaggggacagagugggcugcuguagggcagccagucugcaccucaacagagacuggccagcccggcugagccaggaacagggcugaugggagaaggcgggcgggugggugucugggcaccacaggccaagguggccgccagacaggcugaugccaggggagggagccagguccugccaagccagccugucuguggugagacucgguugggccgugggcccugccagcucccucagaggcuuuuguguucauuuccuuuccaccccccuuuucaguuuccucguaaggucccucacgaacagucucaauggggucucagcagaaccaggggacccggaaguuucacagaccagagaacaccagggauggagacucagggaggaugugcgcucucuaauaacaaaagugcuauggguuuaucggagaaauuguggaaaauacagaaagguccugagaagaaauuaaagcugccuguaaucccaccacccagagagagccucugggaaccuuuaguuauaaugcagcauuuggaaauucacuuugauagugaguucauuaaaacaggaucaaguucuacauauuuuuuguaaccuauuuuuuaaacauaaugaugauacucauauuaauagccagcauuuacugagcaauuuguuaaugggugaacaugcccagccuccuucuguaaaccccacgaggugggcauucuuaucuuuguuuuaccaguuaaagcagccugagagaguuaaauaucugcccaaagucacaucggaauugagagagccaucugcauauuccuaucaacagcuauacugucuugucuucugaugaucaauaugugcauuuuccuacauccuucaauauuccuuguagcaaguaaaaaaaagccuucuaugacacauuuaugucuuuuaauaaccucauuagacaguguagauuugugagaacucaauuguugauagcugcguaauauuccauguuaugguuguacccucauuuauuuaacucguccccugucguucaguauguggguuauuuccauuuuuucccucucguaaauuacauuguccuggaucuccuugaccuaaggaucaaauucuugggaguccagagugucagaaucagaaaggcccuuagaccaccaugcuugguuuuccauuuugcaaauggggcaaaggaaaggcagagaagggggaagaggauuuguccacggucuuggaggcugugggcgccugagccagggcugcuaccugcucuccuguuggggcugggguggggauguggguggaggcaggugccacagugggaaaaagggcauccuggggggauggugggaacacagggcuggguagagggcagacuggaggugacaggagagauacaggcuugggguagggagggcucugcugccaugauaucuuugcagaggaguugacugggaugggacaggcccaaagggaacauuuccugcccucugagcugccuuuguagaugggaguaggggguggggauagguuugguuugugagaggcuugagugugugaguuggggcgagugggagggugugugucugggcuugguggauuuuucuuggggggggucugugguguuucagcuuggccuucucugcccuccccauuccacuccuccccgggcuucugcucucugggacuugggcuccauagccccuuccccagcaggugcaguccucgugccccucaucuccagccacaagugggugugggacugccggcuuccuggccagggcagcuguggcuggguggggguggggacugagacaucccccuccuggucccggcucccaauugugcagcccccuuggcugucuugcugcccggagcuuggccccagcccacauuccugcggugaugcucugggucuccgggguggaucuggugagcgugaggggcacugaguucucacaggacugagggcuuuuuggggacggagccugcagggauccagagggccaugcugagacacccucccucccugccucgaggagcuaguaguuacgucgcugugugucuuugggcaaaucacuuuaccucucugaaugcuucguggcagacuaaccccgcccccuccuuucgugauaagcaaggcuuuccccucucugugccucaguuuccacaucgguaaaaggggagaguugaacucagugaucccucaggcccaguguagccuugaaguugcagccugaggugggaagugcaggcuguaggaauauagacaaagccuuauacggcuccgacugugugcaggcaugaucucacuugauucucacaacugcccuaugaaguaucauuguuggccucauuuaaccaaacaggcucagagagguuaaguaacacauccaaagucacccagcaaguaagcagagcugaauuugaauccaagacugucagaaccuaaagcugggcccccaccccuugcucaugucgccucuggucaccaggaaagugaggccugagucuggcuaauuaggggaaggaagcucgggcagaacuaauuacacucgauuuuauucuuggcuuuuugcaacaugauuagcgcugcacaggggugccgggcuccuggcccccagccugcugaccuaauuugugugcuugugucuguuucuguaacuugcccuuucucccccuucauccaaccucucucuuuuugucucucucugcacucuccccugcuguguggccuuggcaaugccacuuaaccucuccgggcauuaaucgucucaucugccuggguguagucaucccaauuuggcuucccucaugaggagguugaggcuuacaugagauaaaggcuucgaaauaauaauagaaauuuuaacauaaacuaacagcaaucguggcuacacugauuuauucauuuuucacuuggugucggguccugugcuuagccccuucccacagcaaugcuaugagcugcguagucuucucaucaucuccauuuuacagaugagaaaacugaggugcugagauuaaauggcuugccugacagccaaccggguaguaaagaggagcugguucauuaugcuuugccucugugcugaccgguuucucuaggaaggcucauggugguguggggcugggcacgagagaccccaaauucuggagugggcucugagagaggauggggugggagggaugcacuggccuuccugaacguguccccugcacucagagugagugaugaguggguggguagagguagccgugaaagugaggagacuuagcugacauccagcucauuuggacccucacccaucacagcccugauggggugcuccugggagggagggggcugggcaaccugggagguggcaccuccuugccccuggcccaggggagccuccccagcugcugcucuaaaacucuaggagaggaucggugggaguggauguggagugagggggccugugggucacugcugggccuggucccuucugggcugggagccugaggugccucuguggagugaggcuguggguuacuucaggaagguguggugacuaggggacugugaggaaaaauggaagcagggggcaucaguccacuaggaagggugccacauuucaucccgaugugugugugcacuuguguguacccggaaggaaagugcguguuugcgcgcauguguguguggagggaacugagaugcagguauuguggaccuguuaauggcaugugaggcgggauguaugucugcuggggcagguucagggagggacaaguaggcugcgcacauguggaggcaggguguugggagugccugguguguugggucccgugcucagccccuucuccugcaaugcuaugagcugcauagucuuaucaccaucgugugcuggcgcguggguguggauguugggugggcauggacagcugugggcauugccgaguugaugucaugcagggggugagggcagcugcggggcacagauguaugaauuuagcccuggacaagcaaugggucuggggguggcucaggaauguccaggacaaggguuucagagacagaggccucaugccuggauucuaaccccugccucaguuccugcaucuguggaauggggaugauaaaacccugggcaguugugaugcuuaaaggaggcugcauaaauaacaugcucccagcaccuggccuggggcaggcccucagcagcagcaggcagaggucucuagagugcccugggaacgcucagcggcuccccugggaccugaugcucaggccuucaugggccgcuugcggagccucugcuggguguccccucccgagaucagugguggccggaagcagaagguucagugcuuccaccgggcacgcucgcuguguguggggggugcagccgagaggaaagguuguauccgaguugugagguucaugucugagucagaggaugcaccugccgagggugaugucuaggagcgauguguguuuagggaacauacguggccauggcgguggguccguguugugggccuuggugaggugaguguggugcguggggucaggagaaugugcugagguuucucgggggcauccgugggguguguggugaggagaggagugugugugugugucugugaguacccuagggcauguguacaggcagcuaggggugaaguagaugggugagugugugcuggugugggcugggcuguauugccuauaggcuguggugaguauacagauuggugugggcaaacauugcacuuaauaguguguguguguauccauuggggugcauaguacaugcagaagaauauauaugcaugaggauguugggcugucgugugugugugugugugugugugugugcaugcgugcgcgcgugucuuggggguauggaagccuccuaucaggcauggggggguuguguuuaccuggagggggcacagugagggucaaggagaagcuggcagcguccuggggcuuuuggauucaguucuccuuuaagggaauggcauggauaauuaugcuuauuaugauggauuaugcaaaugcggaggucguuugggggucaaagccugcuugucacccuccuccucaggcauucugugacuucuaaggcuuucccugcugccucccaggcuccguuccccaaccccuauuucucuguccccucugggaguugcagcuaccagcacccccucuguaguguuccugagagggccucaugagucccagcgcccaugccugcaggucccagguguccucgcauuaaguucccgcugagcaucccaggugggcucaggggugacugggccguuccucccccugcacacccugccauuggggaugcuugcuguucggaaagaauguacucuuggaagcagguuuggaaaauuacugagguggccccuuccccagccuugccucaucagcaugaggcuaaauuaggaugugugaguucuccccucugccucccacccuugccuucucuccuucucucguacccccagcccacccuccccgucucugccccucugcccccuggccucccucaguccucgacucucugucaccgucucugucucugccucccccuucccugucauccucucaguucccccgugaucucucccucuccuguaccaccccaucucuguggggagcugcagcuccuggucguuagcauggagaagauggucgucaugguaacgguugucaugucgauggcuacugagcuggggaugaauaguauguaggugagcgcuaccugaguggaggcugauggguuuccaggaggcucgaugcuugucucugagcucagagcugcacagcaggcccagcuccuccugccccaugugaguggcuguuuuuacccccaggcaugcugacacgcugagcccucuguggcugcuuuuaggugagcauguuucagugugugucugugcaugugcugugucucuggggugugucauuucaagggucuauguggcauggggguaggucuuuggguuuguacaggcuuuucuuggagcaggaaguuaggggcuaaguggcacuggucacugaggaaucuuggggacucccuuguuuuggcacccacauuuacuucaguugggggcuuccagggaccacagaccucuuaguaucccuccucccagcuaaaggccucccagccacugcccagccuacugggaaggauagaaagacagugaagacagcccugggcaggggcaggagccggagccugggucccugcucaguccccauucuucugugugacuucaggcugcuugccagagagcuggagggagcagggacuccagguuggcugguucagguuguggaggggagugccauggggaguucuagcuccuccaccguggguauuuuucuuucugggcagaggggagcuggggaaaaguugggcccuacugcucugagcuccuagaauguuuaaaaaaggaggaagacccagcaauucgucacgggagaaauuacacuaauuguuccacuccaugacucacugguagaaaguaaauacugauuaauucauuacuuugagacuaugugugugugugcauuuugugagggggcaccuccuggcucccugcccuggcugggcugggcagggcucuggagcaggugguugaggcuggggauaugaagacaggauugagauccucacucuggcucuguaucaacuccagaagggggcccaucaguggcagggggugagaggcugggccccaaaugcagggccauuccagcccucgccugcucacacaugccccagggcuccccacagccagcccaacauugcggcugcucagagaccaccccagaccuacugaaccacugaauuuaguuuucacaauauucagaugugcagucaagaugaaaaaugaccaguuucuaagagaaagucaucagccagacacugaaagccuucugggaugggaccccaggugacuugccacaccccaccccugcccugugaauuauucacacacgcacuuuccuucaggguacacacaagaucucugucacccacguggaugucacucagcccacaagggcaccugucgcccuucugggcucacccaggcugccagucucgggugccgagcccuguguccaccucuaccuucccuaggcccagcgcuggcgcagugagaacuucgagagacccguggaccuggagggcucuggggaugaugacuccuuucccgaugaugaacuggaugaccucuacucggggucgggcucgggcuguaaguaccccccucccuaccucugccugggggcagugaccagucuguauccagccucaacucugagaagcccacggggggcuugcuucagugaggcagggggcauucacugccugggucaggcaaguucuucuugcucuggauccccagaacaagaagggcagaacauccuucuggggauagaacaagaccugggaggaccucagggcccagaauguccaggucuccagggucccacgucugcaucuuugugugugcuauguggcuuucucugcagaccuugcuugguuccgguggucccgucaggugcaauaagcuguggccaauggugggguuagggcagugaugacacagggcaggugcuucaaguggugccugggauggccccgcccuggggaaggggagccaggucagcugggucuagcagaaucucgggagagaagggcaccgcgaaccccacucugccauguagcaacugugugccccucggugcucccccucccugaaucccuguauuuucaccuguggauggugagaaauacgacuucuucucagugccucuaggaggguuugggauaggaagcuggggucuggcacagaggaggagcucucaaaaugguagcaaaaagaaggcagcugagacugggcccagugagggcacgggcuggcaucugaggagaugguacggggucugcacgccacagagcuggcuccccacagcccucgccucuggucuccccuccuuagccaaguccuuugagccucuuucaaauuaaucuuuguaaaacccguuuauauugggucacaucucuauucgcaaaguucccuggcuccccucccuccugccugguuccgagcccaggagcuggcuguggcuucucccucccccauccccuacuccccaucucauuuccucccaaguuccuucacugucccggcuuugcgucagccagauugcucaagcaguuccccugccucaagggcuucuuuucccuuuuacccuccgccucugccucugggggaagcccuuaguguaccaccccugccuugagcuugugguaggggugccuuuggggucugacucuucccagaaugccacuccuguguuccccugcaagccccagcaaguuuugcagccaguagcgccucaguugcugcugccuggauucaaccucauagaaacuguaggcugggugggcaggaauagucaaggaaggcuucccgggagaggcggcccccagaauuuuugacuuggcagagagaaguuggggaacaucagcaacugaccaccuuuagcugggcugugccuuccuccuuucucucaucuuuucugggaaaauuggguaaagagaggggguugggagaccuaaucuugauggccauugcuuaccugggauccucaugccccucacaaccacccagcucccuagcucucucccucucccccacccccucagacuucgagcaggagucgggcauugagacagccaugcgcuucagcccagauguagcccuggcgguguccaccacaccugcggugcugcccaccacgaacauccagccugugggcacaccauuugaagagcuccccucugagcgccccacccuggagccagccaccagcccccugguggugacagaagucccggaagagcccagccagagagccaccaccgucuccacuaccauggcuaccacugcugccacaagcacaggggacccgacuguggccacagugccugccacaguggccaccgccacccccagcaccccugcagcacccccuuuuacggccaccacugcuguuauaaggaccacuggcguacggaggcuucugccucucccacugaccacaguggcuacggcacgggccacuacccccgaggcgcccuccccgcccaccacggcggcugucuuggacaccgaggccccaacacccaggcuggucagcacagcuaccucccggccaagagcccuucccaggccggccaccacccaggagccugacaucccugagaggagcacccugccccuggggaccacugccccuggacccacagagguggcucaggugaggguguugagaagggacagggaggagggcggaggagggugggucaggggagggaugaggaggauggggcuggacaggacugaggaccaggaggcuauagagaugagccagacaaagugggggcgaggggcaggaccaagggacagagaucggauagggagggaagagggacagaaaacgagggcuggggugguuggauccuaaugggaugggacauugguggggaaggaauugggugaacgugugcauuggugacaaggggggccgggcugaguguuucgguugagagaauuaauucaguggucuggcagcuggauuagaaucuuuccacugccacuuccuagucacgggaccucaggccagucccugaucauuucuauaccuccgcuuccucaucuacggaaaggagaaaacaauagaauguguaucauuucauugugagcgugaagucuccugacauccacagugcuuagaacagcgccuggugaugguacagccaguggguucucagcugcugucgucaucacgguuguuauuaucaugggucugagggugguuaagagcugguguaugagaaggcaucacucgccuuguggagggcugccugggugugggucagugcucagcacuuuaccuguguuagccccagcccucaugcccaccccacgggcagcacuguggucaucucauuuuacagacgagcaacugugggugcacagggaggugaagccacuucccaaggcuccgcagccagcgaugacagucaggauuugaacccaggcaguuggugccagagccgggcagucucgcagggccagggcugcaugugugugcauuugggauauucuggauggggcaggggaauugaugggaagaggaugaagaugucaggagugccagggauggaugaaucccaaggacaugagagagguggucuggucccagcugggugcacuaaguaagauggagaggugggaacauggacugggugccagagcccucugcagcuggccucacuguggaaggcccuugggccguggcgcugccuuggggucagugucagucccucugacuccccagccagcucuagcaggaugcaggcccuucccuugccuccucaagcagcuggggcagccugguguuuucacacagacuuggccaagcaggaaggggaaacagugauggggcacggagcccaggagaaggugcacagggcccagguugcuggaggagccauugugcacgcuguguacgcuggggcacugcugcagccucuuuucagccuggacaucaggccugccuuuccaugcccaccuuugaaguagcgacaucccugcucugauggcucccacagcccccacuuuggucucaucauucccagcucugauccugccuccgaguggugggagcccuagagauugucagucacugagcugguuuccgggacaccugccccugaggccaucauagucugcagguugugcucuuggacuggccuccaggcuacagaaugcuccccugccuuaggcauggacugggaccaggcccacauccauagcaucugcacccagcaguucccaaacagcuucucggcaggaaucccccaaggauuguuacuaaggcagcuggaggggacaugagggggacaggauguccagagcaagaacagaggcaguguguuagugguuagaaacacagacuguggagacagauagaucugaauuuuaguucugucccccacuuacuagcuguguguccuugggcaggucauuuaugcucugagcugacuuccugcucuguaaacugggggcauuguuacacuccuucauggggauaguguguagcacagugccuggcauguagggagugcuaaguguuagccccccagggcaguaggaugguggugggggguuaugcaugcaugugugguuguccugggcucaugccacccucucugcagaccccaacuccagagaccuuccugaccacaauccgggaugagccagagguuccggugaguggggggcccaguggagacuucgagcugccagaagaagagaccacacaaccagacacagccaaugaggugguagcugugggaggggcugcggccaaggcaucaucuccaccugggacacugcccaagggugcccgcccgggcccuggccuccuggacaaugccaucgacucgggcagcucagcugcucagcugccucagaagaguauccuggagcggaaggaggugcucguaggugaggcuuggggucugggccaaggggagccugggaggauaccagagugagacagcuggcugggccucaguuugccucuaggaacccagaaaggagaucagggcgugguuuccuaggagccagauaggaaggaaacuugagaacucaaccccccaggaccugccuucuggcuccucccaacuuuccuccuucccaauauccaacccugacuucauguccaucucuaggucuucccucaguguccucugaccccucuguggacucugacuuugaucccugcuuuccugggccacacuggcugacccccugggaccuuacuuccuagaugcuaaucucugacccauccuucagcuugaccuuccccaguuuuugaccccagucccuguggaccugcccuggccgcaucuagggagucuguggacuccugguucaaauccuggcuuugcacucaaggcaagguacuucaccucuccagucuuccuucucuucaucgguagaauggggauagucauuuugcccuuaaucaauucuaagaggcacaucuguucacauguuaagucuucuguaguugggguaugucauauuuaguuagcagagcuuuuucuuuccuagcaguuauaaaauacuggggcaucuuaugagugguggcauuuuaaauuugaugaagcccucagaugaccccucccucauagggcuggugugaggguucagugaguuaguguguugggcgauuagaaugcagccagugaaggccuaugaugguacccagugcugguaguaguaguauugacuccaucaucacuccaacucagaucugggacucccagcccucuccucacccuggcccccaccccugaggacccuuugcccugguucuacccugccucugggccuugaccugugcccucuucuuccacagcugugauugugggcgggguggugggcgcccucuuugcugccuucuuggucacacugcucaucuaucguaugaagaaaaaggaugagggcagcuacacgcuggaggaacccaagcaggcgagcgucacauaccagaagccugacaagcaggaggaguucuaugccuaguggagccacagugccucccugcagccucaacaccacccugcuguccaguccccagccuggccccaccagcccaagccugggacugggccuggaaccuggccccaguucuucucugcccucucucccaaggucugcccaggcugccagccucacacagaucuuccccgaggaagaggggcugcugccaucugccccagacugugcccuuacgagcucaucucuuguuccccucaucccugccaccagucuggggcuucaggaccucaugucagauggaugggaggaagaaagcuccugauuggcuggugguggaagaaaggguggggcuugagaugagccugagcccugacuuggcacccacagugcucacugagaucuccuuuuuggggcagagaggcacucaggcugguuuccaggacaaacauuugguaaacacagcccuugaaaucaucuagacacugcaaccucuugcucguaucccagggccucucucuagcugggugagagggugucccuugucaccagccuguuuuguccuggucucucugggguuguugaaucucuccucuugccugccaaguacacauguacccagacuucauuucuuucugcaucuucccccaagaaacagcuuccugagggugcuggggcagccacuggugaggaggggcugcucugaugucccuccuaugaggggacucugcacagacaccauugcccacacuaucaccauauuuucacucagucacacacaagacaaaagcaugcaaugacaaaaccauacgcaauccugaccgcccagccaaucaagacauaucacagaacacacgcguccuuccaagaauguuuauccucaugcaucacuuacacacccccagacacguacugcaaugcaagucacuagucauggucacaugacagugacaguguggccuccuccuaccccaaauacacccacacucuggcaccacacacauugucuccagcuuucaggcuuacuggggaggguggaaucgagccagaacaaucagcccauauugggucccccuaaguugccccgucauacucagucccaugccauggugcccacaccaaccaugcagccgccaaccccagccagugucagacacaaucccauguggaugcacagucucacuccacaugaccugcucucaaugcuggagggaaacaggcaggcccuugccuuucucggaaaaaguguggggccacagcccuuuuagggcauugcaugcaggugggccuggcuucaccccuaccugcuuccuccccaccgcagcuggcagagggggagguuuggggccagacccccacuagcugggagccugggggcuccucuaaggcugaggaaggaaauuuggccccagguuguuggggggucuugggucucccaggacggaaggcccagggcagggagggggcaugugguugggcuccuuuaucucccuguguccccuuccugcuuugagcuagggggcugacucugccucccaggacacaagucuccaaagugccugugagggcgggcccuccgcacccucugcccucugccuggcaggccaaccucagcccaccugcccagaggcccucccuguggacacccccucaccuauuuggccaaacaauucuggcugcagcuucaggggccauggcuggaagcagccccugcagaucccucaggccccgaggucaggguuugagggaugagaccaggugauagugggggagggguuacuuccuuuguuaccuagcaaguagggcuauuuccaucgguauuuuaaauguggggucacagaucuuuuggggagggugugcuuggcagggggccucuuggagccaaagggauguggugugaguugcgauuggcuggcacucacacccccaccccucacccacaucccagauucaagucaggaaggcagguuuuauuucagggcccuuuucaagaugcccuggcagcagauuucugcaggaugagggguagcgguguguaggcagugagggggagguuccaggggcugucccacagccugucuuuuccaggcugggcuccaucuuccagucccaaaacccuccuucacagggcccagaggcuugugaggaagccagguggacccagccuuagaagagugggcauggggggccccugauaucuggagggggcggguuggccucagucaucuuuggagcagaagggcuggguccuggggccacagaccacaaggcucagccucccuacccugcucccuggggugcugcugucuuggagagcacagcucuggugagacggccugggcaggccgaggcugagaaaccagggaggauagaggagaaaagggcuugggcccccagccccagaagaugcuggaccccaggugggagacccaacagugggugcaguuucucaguagggcuggagccaaugguggggguggccccggcaggccuggcuccucacaucccagggguuggcuucugauuuggggcuugggcuccaggcacuggcuucucuucucuguguccuuagcauuugagagaagaggccaggggccuuguucauggaucccuggacccaaggcagauguccaggcuuuauccuccugaggaugaggagucugaccagcccaaaucugcccuggccggccugaccggggcaaggcaguccaagagaguucagugaggaccagcuaggcucucccaggugcaaugugggugcagggcccucaugucccccuaccccugccugugauggaguguucugaggggcuuuggcauuugcuggaagcacagggaguuccaaaugagagggagcuucuguggcuugagagccucuggggccuuggcugccagagcacgaggcaggccaggaccuggagagcccagacccugucuccaggaggccaggaggccagaugggggccuugccugaaagacugguccccuugaucgcuggaggcauguggguggcaaccagggcugggcagggcuuagggugugugggccaaaccccccugggguuggcaaagccgccugucaggccuccuggugggggccccuggacacagggagcagacccucugccucaugggguaggaguggcugccuccuguguucucuggauuucuucucccaacaacuacaacccuggacuugccuccccaggccucuugccuguaaauagaagcccgcaaacuguacagauuuacagaggcaucgagacugggcccugggaguugccaucugagagccgauggccccagcaucccccaggugccugccuggcaccacagugacccuggccucagcguggcaaaugcauguaaauauuuuucguaggcagcguggcuccagagagcccccugaagacagugucccucccuccugugaguccuuucuccuguacagaaccugccuggggugggugggggucugccauucccucccccaggccuucccugccccuucucuccccuguaaccuguuuauuaaccauaccuguccugaguucauggccaaaaccuuaaauaagaaaaacaaaagaaaaagacaguggaaaaaagagaccaaggcgccugccccacugcggguacucuccuguuccagccuugugaaggaacugguuuuguuuuuguuuuuuuuuuuuuuuuuuuuuuuuuguuuguuuguuuuuuuaacacuuccugugcugugcccauuuauaagaggaaauaaaauuaagcugaaaugaugu

SEQ ID NO: 14146 - RNA, 39327 nt, Homo sapiens
acaucauuucagcuuaauuuuauuuccucuuauaaaugggcacagcacaggaaguguuaaaaaaacaaacaaacaaaaaaaaaaaaaaaaaaaaaaaaacaaaaacaaaaccaguuccuucacaaggcuggaacaggagaguacccgcaguggggcaggcgccuuggucucuuuuuuccacugucuuuuucuuuuguuuuucuuauuuaagguuuuggccaugaacucaggacagguaugguuaauaaacagguuacaggggagagaaggggcagggaaggccugggggagggaauggcagacccccacccaccccaggcagguucuguacaggagaaaggacucacaggagggagggacacugucuucagggggcucucuggagccacgcugccuacgaaaaauauuuacaugcauuugccacgcugaggccagggucacuguggugccaggcaggcaccugggggaugcuggggccaucggcucucagauggcaacucccagggcccagucucgaugccucuguaaaucuguacaguuugcgggcuucuauuuacaggcaagaggccuggggaggcaaguccaggguuguaguuguugggagaagaaauccagagaacacaggaggcagccacuccuaccccaugaggcagagggucugcucccuguguccaggggcccccaccaggaggccugacaggcggcuuugccaaccccagggggguuuggcccacacacccuaagcccugcccagcccugguugccacccacaugccuccagcgaucaaggggaccagucuuucaggcaaggcccccaucuggccuccuggccuccuggagacagggucugggcucuccagguccuggccugccucgugcucuggcagccaaggccccagaggcucucaagccacagaagcucccucucauuuggaacucccugugcuuccagcaaaugccaaagccccucagaacacuccaucacaggcagggguagggggacaugagggcccugcacccacauugcaccugggagagccuagcugguccucacugaacucucuuggacugccuugccccggucaggccggccagggcagauuugggcuggucagacuccucauccucaggaggauaaagccuggacaucugccuuggguccagggauccaugaacaaggccccuggccucuucucucaaaugcuaaggacacagagaagagaagccagugccuggagcccaagccccaaaucagaagccaaccccugggaugugaggagccaggccugccggggccacccccaccauuggcuccagcccuacugagaaacugcacccacuguugggucucccaccugggguccagcaucuucuggggcugggggcccaagcccuuuucuccucuauccucccugguuucucagccucggccugcccaggccgucucaccagagcugugcucuccaagacagcagcaccccagggagcaggguagggaggcugagccuuguggucuguggccccaggacccagcccuucugcuccaaagaugacugaggccaacccgcccccuccagauaucaggggccccccaugcccacucuucuaaggcuggguccaccuggcuuccucacaagccucugggcccugugaaggaggguuuugggacuggaagauggagcccagccuggaaaagacaggcugugggacagccccuggaaccucccccucacugccuacacaccgcuaccccucauccugcagaaaucugcugccagggcaucuugaaaagggcccugaaauaaaaccugccuuccugacuugaaucugggaugugggugaggggugggggugugagugccagccaaucgcaacucacaccacaucccuuuggcuccaagaggcccccugccaagcacacccuccccaaaagaucugugaccccacauuuaaaauaccgauggaaauagcccuacuugcuagguaacaaaggaaguaaccccucccccacuaucaccuggucucaucccucaaacccugaccucggggccugagggaucugcaggggcugcuuccagccauggccccugaagcugcagccagaauuguuuggccaaauaggugaggggguguccacagggagggccucugggcaggugggcugagguuggccugccaggcagagggcagagggugcggagggcccgcccucacaggcacuuuggagacuuguguccugggaggcagagucagcccccuagcucaaagcaggaaggggacacagggagauaaaggagcccaaccacaugcccccucccugcccugggccuuccguccugggagacccaagaccccccaacaaccuggggccaaauuuccuuccucagccuuagaggagcccccaggcucccagcuagugggggucuggccccaaaccucccccucugccagcugcgguggggaggaagcagguaggggugaagccaggcccaccugcaugcaaugcccuaaaagggcuguggccccacacuuuuuccgagaaaggcaagggccugccuguuucccuccagcauugagagcaggucauguggagugagacugugcauccacaugggauugugucugacacuggcugggguuggcggcugcaugguuggugugggcaccauggcaugggacugaguaugacggggcaacuuagggggacccaauaugggcugauuguucuggcucgauuccacccuccccaguaagccugaaagcuggagacaauguguguggugccagaguguggguguauuugggguaggaggaggccacacugucacugucaugugaccaugacuagugacuugcauugcaguacgugucuggggguguguaagugaugcaugaggauaaacauucuuggaaggacgcguguguucugugauaugucuugauuggcugggcggucaggauugcguaugguuuugucauugcaugcuuuugucuugugugugacugagugaaaauauggugauagugugggcaauggugucugugcagaguccccucauaggagggacaucagagcagccccuccucaccaguggcugccccagcacccucaggaagcuguuucuugggggaagaugcagaaagaaaugaagucuggguacauguguacuuggcaggcaagaggagagauucaacaaccccagagagaccaggacaaaacaggcuggugacaagggacacccucucacccagcuagagagaggcccugggauacgagcaagagguugcagugucuagaugauuucaagggcuguguuuaccaaauguuuguccuggaaaccagccugagugccucucugccccaaaaaggagaucucagugagcacugugggugccaagucagggcucaggcucaucucaagccccacccuuucuuccaccaccagccaaucaggagcuuucuuccucccauccaucugacaugagguccugaagccccagacugguggcagggaugaggggaacaagagaugagcucguaagggcacagucuggggcagauggcagcagccccucuuccucggggaagaucugugugaggcuggcagccugggcagaccuugggagagagggcagagaagaacuggggccagguuccaggcccagucccaggcuugggcugguggggccaggcuggggacuggacagcagggugguguugaggcugcagggaggcacuguggcuccacuaggcauagaacuccuccugcuugucaggcuucugguaugugacgcucgccugcuuggguuccuccagcguguagcugcccucauccuuuuucuucauacgauagaugagcagugugaccaagaaggcagcaaagagggcgcccaccaccccgcccacaaucacagcuguggaagaagagggcacaggucaaggcccagaggcaggguagaaccagggcaaaggguccucaggggugggggccagggugaggagagggcugggagucccagaucugaguuggagugaugauggagucaauacuacuacuaccagcacuggguaccaucauaggccuucacuggcugcauucuaaucgcccaacacacuaacucacugaacccucacaccagcccuaugagggaggggucaucugagggcuucaucaaauuuaaaaugccaccacucauaagaugccccaguauuuuauaacugcuaggaaagaaaaagcucugcuaacuaaauaugacauaccccaacuacagaagacuuaacaugugaacagaugugccucuuagaauugauuaagggcaaaaugacuauccccauucuaccgaugaagagaaggaagacuggagaggugaaguaccuugccuugagugcaaagccaggauuugaaccaggaguccacagacucccuagaugcggccagggcagguccacagggacuggggucaaaaacuggggaaggucaagcugaaggaugggucagagauuagcaucuaggaaguaaggucccagggggucagccaguguggcccaggaaagcagggaucaaagucagaguccacagaggggucagaggacacugagggaagaccuagagauggacaugaagucaggguuggauauugggaaggaggaaaguugggaggagccagaaggcagguccugggggguugaguucucaaguuuccuuccuaucuggcuccuaggaaaccacgcccugaucuccuuucuggguuccuagaggcaaacugaggcccagccagcugucucacucugguauccucccaggcuccccuuggcccagaccccaagccucaccuacgagcaccuccuuccgcuccaggauacucuucugaggcagcugagcagcugagcugcccgagucgauggcauuguccaggaggccagggcccgggcgggcacccuugggcagugucccagguggagaugaugccuuggccgcagccccucccacagcuaccaccucauuggcugugucugguuguguggucucuucuucuggcagcucgaagucuccacugggccccccacucaccggaaccucuggcucaucccggauuguggucaggaaggucucuggaguuggggucugcagagaggguggcaugagcccaggacaaccacacaugcaugcauaaccccccaccaccauccuacugcccuggggggcuaacacuuagcacucccuacaugccaggcacugugcuacacacuauccccaugaaggaguguaacaaugcccccaguuuacagagcaggaagucagcucagagcauaaaugaccugcccaaggacacacagcuaguaagugggggacagaacuaaaauucagaucuaucugucuccacagucuguguuucuaaccacuaacacacugccucuguucuugcucuggacauccugucccccucauguccccuccagcugccuuaguaacaauccuugggggauuccugccgagaagcuguuugggaacugcugggugcagaugcuauggaugugggccuggucccaguccaugccuaaggcaggggagcauucuguagccuggaggccaguccaagagcacaaccugcagacuaugauggccucaggggcaggugucccggaaaccagcucagugacugacaaucucuagggcucccaccacucggaggcaggaucagagcugggaaugaugagaccaaagugggggcugugggagccaucagagcagggaugucgcuacuucaaaggugggcauggaaaggcaggccugauguccaggcugaaaagaggcugcagcagugccccagcguacacagcgugcacaauggcuccuccagcaaccugggcccugugcaccuucuccugggcuccgugccccaucacuguuuccccuuccugcuuggccaagucugugugaaaacaccaggcugccccagcugcuugaggaggcaagggaagggccugcauccugcuagagcuggcuggggagucagagggacugacacugaccccaaggcagcgccacggcccaagggccuuccacagugaggccagcugcagagggcucuggcacccaguccauguucccaccucuccaucuuacuuagugcacccagcugggaccagaccaccucucucauguccuugggauucauccaucccuggcacuccugacaucuucauccucuucccaucaauuccccugccccauccagaauaucccaaaugcacacacaugcagcccuggcccugcgagacugcccggcucuggcaccaacugccuggguucaaauccugacugucaucgcuggcugcggagccuugggaaguggcuucaccucccugugcacccacaguugcucgucuguaaaaugagaugaccacagugcugcccguggggugggcaugagggcuggggcuaacacagguaaagugcugagcacugacccacacccaggcagcccuccacaaggcgagugaugccuucucauacaccagcucuuaaccacccucagacccaugauaauaacaaccgugaugacgacagcagcugagaacccacuggcuguaccaucaccaggcgcuguucuaagcacuguggaugucaggagacuucacgcucacaaugaaaugauacacauucuauuguuuucuccuuuccguagaugaggaagcggagguauagaaaugaucagggacuggccugaggucccgugacuaggaaguggcaguggaaagauucuaauccagcugccagaccacugaauuaauucucucaaccgaaacacucagcccggccccccuugucaccaaugcacacguucacccaauuccuuccccaccaaugucccaucccauuaggauccaaccaccccagcccucguuuucugucccucuucccucccuauccgaucucugucccuugguccugccccucgcccccacuuugucuggcucaucucuauagccuccugguccucaguccuguccagccccauccuccucaucccuccccugacccacccuccuccgcccuccucccugucccuucucaacacccucaccugagccaccucuguggguccaggggcagugguccccaggggcagggugcuccucucagggaugucaggcuccugggugguggccggccugggaagggcucuuggccgggagguagcugugcugaccagccuggguguuggggccucgguguccaagacagccgccguggugggcggggagggcgccucggggguaguggcccgugccguagccacuguggucagugggagaggcagaagccuccguacgccagugguccuuauaacagcagugguggccguaaaagggggugcugcaggggugcuggggguggcgguggccacuguggcaggcacuguggccacagucggguccccugugcuuguggcagcagugguagccaugguaguggagacggugguggcucucuggcugggcucuuccgggacuucugucaccaccagggggcugguggcuggcuccaggguggggcgcucagaggggagcucuucaaauggugugcccacaggcuggauguucguggugggcagcaccgcaggugugguggacaccgccagggcuacaucugggcugaagcgcauggcugucucaaugcccgacuccugcucgaagucugagggggugggggagagggagagagcuagggagcugggugguugugaggggcaugaggaucccagguaagcaauggccaucaagauuaggucucccaacccccucucuuuacccaauuuucccagaaaagaugagagaaaggaggaaggcacagcccagcuaaagguggucaguugcugauguuccccaacuucucucugccaagucaaaaauucugggggccgccucucccgggaagccuuccuugacuauuccugcccacccagccuacaguuucuaugagguugaauccaggcagcagcaacugaggcgcuacuggcugcaaaacuugcuggggcuugcaggggaacacaggaguggcauucugggaagagucagaccccaaaggcaccccuaccacaagcucaaggcaggggugguacacuaagggcuucccccagaggcagaggcggaggguaaaagggaaaagaagcccuugaggcaggggaacugcuugagcaaucuggcugacgcaaagccgggacagugaaggaacuugggaggaaaugagauggggaguaggggaugggggagggagaagccacagccagcuccugggcucggaaccaggcaggagggaggggagccagggaacuuugcgaauagagaugugacccaauauaaacggguuuuacaaagauuaauuugaaagaggcucaaaggacuuggcuaaggaggggagaccagaggcgagggcuguggggagccagcucuguggcgugcagaccccguaccaucuccucagaugccagcccgugcccucacugggcccagucucagcugccuucuuuuugcuaccauuuugagagcuccuccucugugccagaccccagcuuccuaucccaaacccuccuagaggcacugagaagaagucguauuucucaccauccacaggugaaaauacagggauucagggagggggagcaccgaggggcacacaguugcuacauggcagagugggguucgcggugcccuucucucccgagauucugcuagacccagcugaccuggcuccccuuccccagggcggggccaucccaggcaccacuugaagcaccugcccugugucaucacugcccuaaccccaccauuggccacagcuuauugcaccugacgggaccaccggaaccaagcaaggucugcagagaaagccacauagcacacacaaagaugcagacgugggacccuggagaccuggacauucugggcccugagguccucccaggucuuguucuauccccagaaggauguucugcccuucuuguucuggggauccagagcaagaagaacuugccugacccaggcagugaaugcccccugccucacugaagcaagccccccgugggcuucucagaguugaggcuggauacagacuggucacugcccccaggcagagguagggagggggguacuuacagcccgagcccgaccccgaguagaggucauccaguucaucaucgggaaaggagucaucauccccagagcccuccagguccacgggucucucgaaguucucacugcgccagcgcugggccuagggaagguagagguggacacagggcucggcacccgagacuggcagccugggugagcccagaagggcgacaggugcccuugugggcugagugacauccacgugggugacagagaucuuguguguacccugaaggaaagugcgugugugaauaauucacagggcaggggugggguguggcaagucaccuggggucccaucccagaaggcuuucagugucuggcugaugacuuucucuuagaaacuggucauuuuucaucuugacugcacaucugaauauugugaaaacuaaauucagugguucaguaggucugggguggucucugagcagccgcaauguugggcuggcuguggggagcccuggggcaugugugagcaggcgagggcuggaauggcccugcauuuggggcccagccucucacccccugccacugaugggcccccuucuggaguugauacagagccagagugaggaucucaauccugucuucauauccccagccucaaccaccugcuccagagcccugcccagcccagccagggcagggagccaggaggugcccccucacaaaaugcacacacacacauagucucaaaguaaugaauuaaucaguauuuacuuucuaccagugagucauggaguggaacaauuaguguaauuucucccgugacgaauugcugggucuuccuccuuuuuuaaacauucuaggagcucagagcaguagggcccaacuuuuccccagcuccccucugcccagaaagaaaaauacccacgguggaggagcuagaacuccccauggcacuccccuccacaaccugaaccagccaaccuggagucccugcucccuccagcucucuggcaagcagccugaagucacacagaagaauggggacugagcagggacccaggcuccggcuccugccccugcccagggcugucuucacugucuuucuauccuucccaguaggcugggcaguggcugggaggccuuuagcugggaggagggauacuaagaggucuguggucccuggaagcccccaacugaaguaaaugugggugccaaaacaagggaguccccaagauuccucagugaccagugccacuuagccccuaacuuccugcuccaagaaaagccuguacaaacccaaagaccuacccccaugccacauagacccuugaaaugacacaccccagagacacagcacaugcacagacacacacugaaacaugcucaccuaaaagcagccacagagggcucagcgugucagcaugccuggggguaaaaacagccacucacauggggcaggaggagcugggccugcugugcagcucugagcucagagacaagcaucgagccuccuggaaacccaucagccuccacucagguagcgcucaccuacauacuauucauccccagcucaguagccaucgacaugacaaccguuaccaugacgaccaucuucuccaugcuaacgaccaggagcugcagcuccccacagagauggggugguacaggagagggagagaucacgggggaacugagaggaugacagggaagggggaggcagagacagagacggugacagagagucgaggacugagggaggccagggggcagaggggcagagacggggagggugggcuggggguacgagagaaggagagaaggcaagggugggaggcagaggggagaacucacacauccuaauuuagccucaugcugaugaggcaaggcuggggaaggggccaccucaguaauuuuccaaaccugcuuccaagaguacauucuuuccgaacagcaagcauccccaauggcagggugugcagggggaggaacggcccagucaccccugagcccaccugggaugcucagcgggaacuuaaugcgaggacaccugggaccugcaggcaugggcgcugggacucaugaggcccucucaggaacacuacagagggggugcugguagcugcaacucccagaggggacagagaaauagggguuggggaacggagccugggaggcagcagggaaagccuuagaagucacagaaugccugaggaggagggugacaagcaggcuuugacccccaaacgaccuccgcauuugcauaauccaucauaauaagcauaauuauccaugccauucccuuaaaggagaacugaauccaaaagccccaggacgcugccagcuucuccuugacccucacugugcccccuccagguaaacacaacccccccaugccugauaggaggcuuccauacccccaagacacgcgcgcacgcaugcacacacacacacacacacacacacacgacagcccaacauccucaugcauauauauucuucugcauguacuaugcaccccaauggauacacacacacacuauuaagugcaauguuugcccacaccaaucuguauacucaccacagccuauaggcaauacagcccagcccacaccagcacacacucacccaucuacuucaccccuagcugccuguacacaugcccuaggguacucacagacacacacacacacuccucuccucaccacacaccccacggaugcccccgagaaaccucagcacauucuccugaccccacgcaccacacucaccucaccaaggcccacaacacggacccaccgccauggccacguauguucccuaaacacacaucgcuccuagacaucacccucggcaggugcauccucugacucagacaugaaccucacaacucggauacaaccuuuccucucggcugcaccccccacacacagcgagcgugcccgguggaagcacugaaccuucugcuuccggccaccacugaucucgggaggggacacccagcagaggcuccgcaagcggcccaugaaggccugagcaucaggucccaggggagccgcugagcguucccagggcacucuagagaccucugccugcugcugcugagggccugccccaggccaggugcugggagcauguuauuuaugcagccuccuuuaagcaucacaacugcccaggguuuuaucauccccauuccacagaugcaggaacugaggcagggguuagaauccaggcaugaggccucugucucugaaacccuuguccuggacauuccugagccacccccagacccauugcuuguccagggcuaaauucauacaucugugccccgcagcugcccucacccccugcaugacaucaacucggcaaugcccacagcuguccaugcccacccaacauccacacccacgcgccagcacacgauggugauaagacuaugcagcucauagcauugcaggagaaggggcugagcacgggacccaacacaccaggcacucccaacacccugccuccacaugugcgcagccuacuugucccucccugaaccugccccagcagacauacaucccgccucacaugccauuaacagguccacaauaccugcaucucaguucccuccacacacacaugcgcgcaaacacgcacuuuccuuccggguacacacaagugcacacacacaucgggaugaaauguggcacccuuccuaguggacugaugcccccugcuuccauuuuuccucacaguccccuagucaccacaccuuccugaaguaacccacagccucacuccacagaggcaccucaggcucccagcccagaagggaccaggcccagcagugacccacaggcccccucacuccacauccacucccaccgauccucuccuagaguuuuagagcagcagcuggggaggcuccccugggccaggggcaaggaggugccaccucccagguugcccagcccccucccucccaggagcaccccaucagggcugugaugggugaggguccaaaugagcuggaugucagcuaagucuccucacuuucacggcuaccucuacccacccacucaucacucacucugagugcaggggacacguucaggaaggccagugcaucccucccaccccauccucucucagagcccacuccagaauuuggggucucucgugcccagccccacaccaccaugagccuuccuagagaaaccggucagcacagaggcaaagcauaaugaaccagcuccucuuuacuacccgguuggcugucaggcaagccauuuaaucucagcaccucaguuuucucaucuguaaaauggagaugaugagaagacuacgcagcucauagcauugcugugggaaggggcuaagcacaggacccgacaccaagugaaaaaugaauaaaucaguguagccacgauugcuguuaguuuauguuaaaauuucuauuauuauuucgaagccuuuaucucauguaagccucaaccuccucaugagggaagccaaauugggaugacuacacccaggcagaugagacgauuaaugcccggagagguuaaguggcauugccaaggccacacagcaggggagagugcagagagagacaaaaagagagagguuggaugaagggggagaaagggcaaguuacagaaacagacacaagcacacaaauuaggucagcaggcugggggccaggagcccggcaccccugugcagcgcuaaucauguugcaaaaagccaagaauaaaaucgaguguaauuaguucugcccgagcuuccuuccccuaauuagccagacucaggccucacuuuccuggugaccagaggcgacaugagcaaggggugggggcccagcuuuagguucugacagucuuggauucaaauucagcucugcuuacuugcugggugacuuuggauguguuacuuaaccucucugagccuguuugguuaaaugaggccaacaaugauacuucauagggcaguugugagaaucaagugagaucaugccugcacacagucggagccguauaaggcuuugucuauauuccuacagccugcacuucccaccucaggcugcaacuucaaggcuacacugggccugagggaucacugaguucaacucuccccuuuuaccgauguggaaacugaggcacagagaggggaaagccuugcuuaucacgaaaggagggggcgggguuagucugccacgaagcauucagagagguaaagugauuugcccaaagacacacagcgacguaacuacuagcuccucgaggcagggagggagggugucucagcauggcccucuggaucccugcaggcuccguccccaaaaagcccucaguccugugagaacucagugccccucacgcucaccagauccaccccggagacccagagcaucaccgcaggaaugugggcuggggccaagcuccgggcagcaagacagccaagggggcugcacaauugggagccgggaccaggagggggaugucucaguccccacccccacccagccacagcugcccuggccaggaagccggcagucccacacccacuuguggcuggagaugaggggcacgaggacugcaccugcuggggaaggggcuauggagcccaagucccagagagcagaagcccggggaggaguggaauggggagggcagagaaggccaagcugaaacaccacagaccccccccaagaaaaauccaccaagcccagacacacacccucccacucgccccaacucacacacucaagccucucacaaaccaaaccuauccccacccccuacucccaucuacaaaggcagcucagagggcaggaaauguucccuuugggccugucccaucccagucaacuccucugcaaagauaucauggcagcagagcccucccuaccccaagccuguaucucuccugucaccuccagucugcccucuacccagcccuguguucccaccauccccccaggaugcccuuuuucccacuguggcaccugccuccacccacauccccaccccagccccaacaggagagcagguagcagcccuggcucaggcgcccacagccuccaagaccguggacaaauccucuucccccuucucugccuuuccuuugccccauuugcaaaauggaaaaccaagcaugguggucuaagggccuuucugauucugacacucuggacucccaagaauuugauccuuaggucaaggagauccaggacaauguaauuuacgagagggaaaaaauggaaauaacccacauacugaacgacaggggacgaguuaaauaaaugaggguacaaccauaacauggaauauuacgcagcuaucaacaauugaguucucacaaaucuacacugucuaaugagguuauuaaaagacauaaaugugucauagaaggcuuuuuuuuacuugcuacaaggaauauugaaggauguaggaaaaugcacauauugaucaucagaagacaagacaguauagcuguugauaggaauaugcagauggcucucucaauuccgaugugacuuugggcagauauuuaacucucucaggcugcuuuaacugguaaaacaaagauaagaaugcccaccucgugggguuuacagaaggaggcugggcauguucacccauuaacaaauugcucaguaaaugcuggcuauuaauaugaguaucaucauuauguuuaaaaaauagguuacaaaaaauauguagaacuugauccuguuuuaaugaacucacuaucaaagugaauuuccaaaugcugcauuauaacuaaagguucccagaggcucucucuggguggugggauuacaggcagcuuuaauuucuucucaggaccuuucuguauuuuccacaauuucuccgauaaacccauagcacuuuuguuauuagagagcgcacauccucccugagucuccaucccugguguucucuggucugugaaacuuccggguccccugguucugcugagaccccauugagacuguucgugagggaccuuacgaggaaacugaaaagggggguggaaaggaaaugaacacaaaagccucugagggagcuggcagggcccacggcccaaccgagucucaccacagacaggcuggcuuggcaggaccuggcucccuccccuggcaucagccugucuggcggccaccuuggccuguggugcccagacacccacccgcccgccuucucccaucagcccuguuccuggcucagccgggcuggccagucucuguugaggugcagacuggcugcccuacagcagcccacucuguccccugugccuagacagaagcugacaaugcaacccugggaaagccaggcccccuccucaacccagggcugggacgccuccgucaccgccccaucaaucccagccaccugcccucucacgucacucuuggccacccugacucacacugcucauugaugccuguccccaagcucgugccugagagcaggaccacccacugaggccccguuuccagacccagcagcaccccccacaccccacucccagcugcccacccccauacuccucccacacaaaacuauuuacaguucugggaacacgggcuccuucaggccuguuccugcuuccuggaauaccuuuccccaccaucucugccuggccagcaccuacucagcugguuaaucaguaaaaccaaugguuauuaagcuccuacugugugccaagcaccauccuaggcacuagauauguccccacaaagcuggcucagcucacacaaugccuccuuugucagccugcuugaaugucacauacgcacgccaaccaccucccugguccaaauuaggaaguccuuucuuggggacucaguaccuccacuguguugucauuuacuaagggagaaggcccaccaaccaugcucccaucacucuaacaggcccuuccacuggaucucagugaaaccacucagcugcccugggaagcagauaauauggucuccauuuauagaugaggagacugagccuguuaagccaccaguggggucacacaggaguugaauucuggccuuguugagucuaaauccuguguucagugaacuccugaaccccugagaaugccugcagggaaugccaguuugugauucaagacuccuuccacugagcacuuuucuggaaaaggcugggccauuccaucccuuaugaaaaugaucacagccccgacggagggagcccucacuaagugccagguuccuuauaugcacauugccucauuucucuucucacuugaccagaaagggauugccauucccauuucacagaugggcaaacuaaaauucagagaggugaagcaacuggcucaaagucacacagcaaugggccaggauuugaacccaagauuagcugaaccccaaagaccaugcccuuuggauugcagagcacaccugcuccuagcccuaaucaguuuccccuaccagaaggcucucaaaagcagggcaaaugucagagaccagcaccaccucacacucagcucccugcacagagacagccugaaagccugggagugaguagaaauggaggacaaggcgcacucacacgacagguggcccagcucagguaggcacccccugcccccaccaugacucaccagcaggugccucuaggagucugucuccaggcuccaugacggucacugccagcaaacacggcaaggguugcccgcuccuggggcccaggagucuccgaggaacaaccugguguggaguuagguguucccgcccuggcuucccacucccaaacugguuaccuggucacaucccuucgccucacugggccucgcucuguccuccuaugaaacgggaauaaugauccccaacacacagagauaccagcugucacgugccuaguggugauaggcaguuaguaggcacugggacaugacacuguguccccacucaaagcucaccucccugaaccaccaaauccacccaaacgacguccccacgugcccagcuagucugcaaaaccagggcuaguccucaaucgcuuaccacugccugaaaauuggcugguuuauuuccgggcuucagaggaaugugucugucucccccuccaauugcuccugguggcagugacugggucuguguggucauuucucuaaccccagggcucagacugcuucuggaacacagucagccuccaucagucuuuguucagugaauacuguggguugcaucaucccccagagaucugcaucaccugccuccugcucccaaucgcuaugggaucccaaggcaggcccugcucuucucuggccucagucucccuguguguaaaaccgaggaaugaacaagaguucucucugaucccuccaaaauccagccaggaggacuccaagugagcugggaggagggaagagaaacagacacugaucccagcauauuuugucacaaaauguuuauguaaauuauaugcaaauaugcagaucagugggcucccaguggagcauacauucuggccauuucucaaccaggacuggaagaaagcagccuucacugagcacacacuaagcacuggacucuaccuucucaggagccagugaaaugggccuccuuacuccacagaggcagaaagcccaggcgacuugcuagaggucagugagcucagccggagagucaggaugggauucaggacuggagcagggacagggagagcaggcagggugggacguggcagugggaaggggcuggaggagcacauggaggccccuaagagcagaaggauccucagccugaccuuggaaucacuugaagccaggugagggggcuccagggaccucgccagcccuagagcucugcugggcugaccccagccuccuccagggaacugaagagaaccugcuggagucagccugagcaggcccagaccuuccagcugucccgggagccugcacagcucugacggcuccccaaagcccuccccacacacaugcugagcauacacccugggcacacacagcacacacacacacauaacugaaacggcccugucuguaagaauguguguguguguccaggccucuccuccugaggaggcgggcugugguuccccgcacccuccuguuugcuggguuauuuauaaccagcccaaacucacacacaguggagaugccacuccccgcccccagccuggagcagucccacuggcuucucggcugcuccucuucuagggacagaacaagccagacucagaugaucugagccacagcagccuuggaagucaccaccaccaucacccagaugggaaacugaggcacagagcaaggcaucagacaaaaaggcuggaagaaggguuggcagggcccucaaaagccagccuagggccacacuugccccaggacugucuccaacccaagaugaggcucugugggacacaguggggugagaaagggagggaaggagggagcagacauguccaagcccucacccuccccuccagaggccugggagacacagcagggacucugaugcucgacuauguggcuccaaaucccaggacagaacuucaccagcuacgcgacucugggcaagucagucuaccucucugagccucaguuucuucaccuacuaaauggguauaguaauaggacugaccucagggguugggaggauuaaauaagaugauccaaacaaggcucucagcccacagucugacuacuucucagccuagugacccagaacaagcugcuuggcuugagccucaguuccaccaucugcaaauggaacaaugauauggcccagagggucauaaggacugaagcacugguucccacacacaguacguggucagcacguacaaauuccauccucuuuuccuccauucccgggggccccaugguugcugaccacccccagauccucuccuugaugcucccugucucccgucucugagcaucuacuaugugcugagcuugguggggguuguucuagauauuaugccauggaaucuucuaaacaacucuucaagggauaaauucccuucccagcucugcagugggccuucugccuuguugaauauagauguucuauaaauacuugagggaugaauggaugcaagaaugaaugugaucaaaaagucagauaaucacaagcguuggcgaggacguggggaaaucggaacccucacacaccacuggugggaauguaaaacagcacagccgcuuuaggaaagaggcuggcagucucucaaaauguuaaauggaguuuccauaugacucaguaauucuacuccuaggguauauauucaagaaaaaugaaaauauauauguccacacaccaaaaaagguagcauuauucauaauagccaaaagauugaaaccacccaaauauccaucagcugaugaaugaauaaauaaaaugugguauguucauacaauggaauauuauuuggcaaaagaaaaaaaaacuaauacugaggcugggcaugguggcucacaccuguaaucccaacacuuugggaggccgaggugggagggucaccugaggucaggaguucgagaccagccugggcaacaugguaaaaccccaucucuacuaaaaauacaaaauuagcaaggugugguggcacgugccuguagucccagcuauuugggaggcugaggcagaauugcuugaaccugggaggcagagguugcagggagccgagaucaugccauugcaccccagccugggcaacaagagcaaaacucagucucaaaaauaaacaaaugaacuaauacugauacuacaguguggaugaaccuugaaaccauuauguuaagugaaagaaauuggccacaaaagaccacauauuauauuauuccauuuauaugaaaugucugggauaggcaaauccauacagacagaaaauagauuagugacagccuaugccugcagggauuguggagaaacaaggagcaacuguuaauggguacagcguuucuuucuggggugauaaaaacguucuaaauuuagugauggcuuuacaacuauguaaauauacuaaaaaccacugaauuaaauacuuuagaugggcaagauguauaugaguuauauaucaauaaagcuguuguuucaaaaauaacaaugaauaugagacugaggcucagagaggacaagaaacuugcccagggucacacagcagagccuggacucaaguucagagaagcccagcauuccuuauccugacaacacgcuugucuuggcccugcucaccuccucucccauuugaacaucuucuuaccaagccucaggugaagccuccacagcccccgcccccagacaggcaaacguuuaguccgcagaccacaagugggaggcccagcucagcaacugccucuucuaggcuguucaaaggccacuuugucagguggggccaguggagggggacaggcucagcccagagucuucagagacuccagggacuccagacccaggcuaucugccguccccaacccucgaccccagcauuccagcugcagcccucagugguuccggaugccccaccccacccuuugaccaugugccucaccccuggcugcccucaggaaaaggcaugaggauaugucccugccagggaaggggcagagccuaucagggucccagugguaaaacacgccugaauuuuaacucaaguccaucugcccucuguccccauggcugucuagggcaacccugaggacaggugccucuucaggccccacccuucacccuggccccaucuucaccuggcucccaagcaccagcuccgcccagcacagcuggcagccgccaagccccucgggugguuuccacucuacucucuggcagaggccugucuguccugggcuaggccugggcuggagcuaccaggccuuugucuggaaggugcucgguagccccgucucuccugccuggcugaacucagguaugaagccuaaaaccccuuaggcccugucuugagccucaacaccuuggcuuugccucccagacucugaucucucagccauuaagaagggaggaggaggccaggagcaguggcucacaccuguaaucccagaauuuugggaggcugaggcggguggaucacgagaucaggaguucgagaccccgucucuacuaaaaauacaaaaauuagcugggcaugguggcgcacaccuguaaucccagcuacucagaaggcugaggcaggaggauggcuugaacccgggagguggagauugcagugagccaagaucacgccacugcacuccagccugggcgacacagugagacgccgucaaaaaaaaaaaaaaaagaggaagaagaagaagggaggaggccucacagugccuuagacugccaggcagggaccacagaggauccugaguggggaggccaagaacucuacaaggacccccugccccucagcaauggggugcagggagccaaagaaaacccagugcucacccccccaacccaacauccuccuccagccuccugcagguccugcguuccccagguauccugccagccccuucuccacacagcuacaggcucuuccucucccccacugagcucagaguccaaacaccugccagggcucaaggacccugagugcccuggccccuaucccugcagcccagggauaaggccuggccuccacuccucaugugucaccugaacguggcuucccugaaucaaacugcuucaggucucagcugacccacccacuccaccaggaauagcucccugagcauccccaggcaggaucagaagcccagcuucugccaguagggaccuagucacaccagcuuggcccccuccccuguaggaagcuccaccagggcaagguugcccaccagccuuagccccaggcccccaggcccccagggaaugaaugaaugaaugaaugaaugauccuaaaacagucuaccaaacagaaaccaaagcucugcaguagacagugcuugugggagaggaacugggcuagaaaagauggacucaaaguuggacuucaggcaaguggcuguugcuagaacacagucuuguuccccaaacccaggacgaggauggguagugacugccaccucuguggugauggugggcucucauggccacucccccaacauuuaccaugacuaguagcagccugugagcagagcagugugcuggacucugcgccaaguaagcccuagcucuugcaacacccuguagcaccauggucacccuccagcuucauagaggacaacacaggcucagaggacgacacaaguauagugaccugcccaaguucacccagcugacaugcagaggucaaaguccaaguccaaguccaugucaagucucagcugauucauccuccccugagccucccccggcaggaucagaggccagcugcugccauuagggaccgagucacagcagcguggcccccuccccuauagggagcuccaccagggaaaggccagcccaacagccaaguugggcugaugcccaaacgcccucuuuccaccauuuaucacggccauccccuuagacacaacacgggacacacaucccuguaaacauggaaaggcaaaagggagggaagugcugaggguggggaaggugcagggucaggggaaucggcccaugcaaucucugugcaccuccacggugccccaggcaguguggaauguuccucccucccacagcaugacaaagacagucucaccacugugccaugguccauacccaccccacccaccaggagccccccccccccccaccaugucucaugaccaaacauuugucaaaagcaacacuauugguaccugggcaggacgauuuuccaccagcgggacuguucuggacacuguagccauuuagcagcccgacccccaccuggccaaugccagcugcacuuccacuacuaugacaaccaaaaauuucaaaaugccccaggagccagcacccuuaaugcccagcucacgcguccccuccucauggaggcguccccaucccacccuagucucaggcaaccaccccuccucccugcucagggccccaacuucaacaucucuugguugggcaucauuuucccauaagucagaaaugcucugaucaaagaaacagaaucccccccagaaaucagaauccccacgaggcccuagugccgaagacucugaucaggguuuccccaggcagguggugaaauaaagggacccgcgucuccuggccucucugaccccagcugucaauuuccucaggggcacagccacacucccucuccugcuacccccuagccugccggcauccagagugugguaaauaacauauaacugcaucuccgaaggaauccaagguugguuuuuuagugcagggugcgggggagugagaagugucccuggaggucaggcagaaaacaaagcucugaggcccuccacacacacaccacacacacugcuccugccuuaaucaccucuaacgaggccagaugaccagcugccccucuggccugggcuccuagacccugggauuaagagucaggauuaaggacagacauauuuucguagcucagagccccagcagugugugugugugagagagagugugugauugugagugugcgugugugugaguggguguggggguaagagugcgugugugugcaugagagugugugugugaguguguggggacgacagcguguguguggaugaguaugugugugugugggugagugugugugggggagugagagagugugugggggugugugugcaugaguguguggaugagugugugugggguguguggaugagugugugugagugugugugugggugagagugugagugugugggggagugagaaugugugugugggggugagugugugcauugaguguguggaugaguguggggggguggaugaguguguggggggguguggaugaauguggggggugaguaugagugggugagagugugagugggugagagugugcguggaugagugugugugggugagaguguguggguguaugugugggcuacguguguguggguguguguggaugagugugagugugggugagaguguguggguguguguggggugugugugggugaguguguguggaugacugugagugugugggugagaguguguggguguguguggggaguguguguguguaugugugaaugugugggcguacacaggcaugcacaugcacacauccaagcacauucagggguauuucugggcgugugugucugucuaggugcauccauguguguaugccuagggcugucucgaguggcuuagaugccugugugggucugaguguguccauguuagcguggagggcugugucucugagugguaccugugcacauggcaguguaugugugucccugucucugucucuacacgugugcacaggacaaggguauuugcacagguccauguuccuccauuuguaagcaugcaucugagccucccaagguagagagcaucucccaacuuccuuaauccacaguguugcggguaagccccuggagcugaggcagggggagggacagcaguugggggacuccugaucccccuggcauaggcuacaaacacuuuuuccuacaaagacaccagggccccaugcaucagcacagacacacaacaacaugccaucacacauguugcagguacacgcaaaccccuaacccaaacuaacguccuaaacagaaacauggccuuagcuccacguggaaaaaggauuaccuggccucacuugcagccuugcagaccaucccucaagacacagcugagcucccucuggaucugagauuguccccacaagccccccagcuccgcagcucacaugagaauaggauccagccagccagggcucagcucccagaggccauguaggggcuucagccccggggaagcuguuccacuucucacugcugagugacccucaacagccacacuucaucucuggguucagucuccucaucugaacagcaaggccagggcugauuccuggcucuuugccccaaaacuccauuucaggagggacggaugcagggaacugugaguucuggggccgggagggcaaggaacuaaagaagaaucaagaaucccucuagccuugguccuaacuacccccucagcccucaagaccccuguccccaaggggagcccucagguucuggcccuggugggucacagccagggacaugggagguuccaaccagccagggagcaagauaagggccucuagggaagcagagcagggggaggaagcgaguaagaggaggagggugggaggagggagggagggaggggggcugagcagagacggaggaggagauggagaggagggagguuggagaggagaaggucuccucaaaaccgagccugagccuccgagcccacagucuguccacccuccagaaagacggagccaaacaggcuccagugcaccucuccccgccugcaccuccauagcucacugggugcccacugcucccugcugccaggcuccacuuuccucuucucccagucuugggggucacaugagcugggggcuggggagaaaggaccaaaugugacaacaggggagaacuaggagugaaacagauugaggacgugugaaagcagggaaaagaaacaaaguagcaaugucagaauuuggggaaauguaacaaaguaccaugugugaggguuggaggggagaugauguaauggggaauuagcagcugcaacaauguauccaagugagagcuccaaggugguaacaauguaacccugaggggaaccagacacuacgaagugaaauaacauaauugggcuuggcaaagaauccuaacagguagaagaggcaccuaggaaccuagaagagggaggcaggagugagggggcugaggaguggcuuacugugcuugggggcugguaggaggggucauuauuggauucccagaggaggagacaucugugcuggguuuuagaggauguguaggaguucacugaagaauaaaggaacaguccaugaagagggaacagcaucuggguaggcaugaaggaaaaagagacaaugguaugcucugugcucaggagggcugguagaagcgugggauguacagacugggcuuacauuugggagcauuuugggcucagcauuuugggaggcugagguagguggaucauuugaggccaguaguucgaaaccagccuggccaacauaguaaaaccccguuuauaccaaaaauccaaaauauuagccaggcaugguggcaugggccuguaguuccagcuacucaggaggcugagccaggagaauugcuugaacccgggaagcggagguugcagugaaccaagaucacaccacugcacuccaaucugggcaacagaguaaaaguccaugccaaaaacaaaaaaacaggagcgugggaaggcaaagggaugaggcuggagaagugcauugaaggcacugacgggaauuaauuuggcauaggaaauauugggcauauaugggcagcugggguggucaaggaaggcuuccuggaagaagggugugggaggagcugagccugcauucuggacagagcagagacaaguacagaaaaggaacauaguacaggggauagugcccugcccaggagucaggagacagagcucuuagucccagcucagccaucaacuuguuguguacuuuggacaaaucauugcacuucucugauccucaacuuccccaaaugucauguaagaaaguugaauuauagacucucagaagauacucaugaugacucgagaucaaugcuuuggccucaguguccccuuuggaacagugaacaauuuggacaagaguauuuucaagggcccuuccagcugaaauccucuccagccaucugaucuuuccccagccuggguuagccucugcccauagccccauacagacagaaaauaugcugcagagaacagauccauguggaagccaggagcccaaagucccaagaaagggccugcccgacaacagccacacaaguucagguacccagcaaggccugauuggcccuacauucauccuguagggauaccaugcuuuacaguuagaaauguacacggcagcaugaagcagugcuuauguacuagaugggacuccaggggcaggcugcuuggauucaaaucccagcugggccacucacuagcucugugaccuugcacaaauuauuuaaccucucuguaccuugauuuccucuuuuguaaaaugaagauuacaauggcaucucccucauaaggcuaaggauuguuuauagaugaaacauuuggccgaguguuuugcgaguggcaggcacucaaugggcagaacucaauaugucaccuccaagcuccggcaucucaugcuaucuccucacgacaaaagggcagcacccucuaccugcaggacaguacccaaaugccuugguuuggacucaaagcccaccuugugagccagugagcucuuccauguggaggaccugugggguucaacuguucagaacaagaacugaggcacagggccagacacccaccagguaccuggugacuguguguuaaaggcaugaaacacacucucaucagaaagggcggccccuacagcagugaccccucgccgccaagggaggcguguuccccucuccacaugugguagcucccugauauacugcgaccuuccccacuucucagacuuuguccauccuagucccccuaucaaugugcugccaucugucaaggccugguacaaaggacgccuccuccaugaagucuuccuagucuucagggucuaaaucaaccucucauuaccccacagaauugagagcuuccuaaugucagggaccaagcugagcccccugggggucccuagugcucggcugagaccagacacagaggguccaucaguaaacaguagcacaguggggauaaggauccagguacuggacucccugcccagcccccagcuagcuuggaacugaugaucauguuccaggguucagggagggugguggugcccagcgugaugggcaaggaaagagaugccuccuacccuggcccaagaggaaccagagacaagccacgugaagggagcaggccuccccuccccacccaggccagccguccugccugcccuuccccacuaagccaacucuaggucaggcccugucucuggccucaggucuuucugauaguuccucaaaucugaagacuacaagggccccugggucaccauucacucuucccauuuaacagacguggaaguggaggcccagagagggaacaggcugccugcuaccacuugacaagcuaguggcaaauucaccucugagacacaaccaccuuggggaauguauaauaauuaaaagucaucacccagcagcagguuccuuuuaaccaucugcaccucccaccacuccucaccaccaccuaacgggucagggaucacuggaucugucugacagaagaggagacuaaggcugagucaagagucacuuagccaaauccacccacuucuucguuucguuguuguuguuugagauggagucucgcucuguugcccaggcuggagugcaguggcacaaucucaguucacugcaaccuccaccucccaggaucaagcaauucuccugccucagccucuggaguagcugggauuacaggugugcaccaccaugcccagcuaauuuuuguauuuuuaguagagaugggguuucaccauguuggucaggcuggucucgaacuccugaccuugugaucugcucgccucggccucccaaaguguugggauuacaggcaugagucaccaagccugccuuguuguuuuugagacagucgcgcucugucacccaggcgagagugcagugaugcgaucucggcucacugcaaccuccgccucccggguucaagcaauucucugccucagccacccaagaagcugggauuacaggcaccugccaccgccuggcuaauuuuugugucuuuaguagagauggaguuucaccaucuuggccaggugggucuugaacuccugaccucaugauccacccgccuuggccucccaaagugcugggauuacaggcgugagcuaccucgcccagccaaaauccacccacuucuaauggcagagcuggggcucagccugucagggaggagggguagggcuuccucccugcuucucuucaauuccccccucgagaccucacaaaagcacaugcaccugccaccaguaaaccugccugaagcaagacauggccagacaagacauaggacacacacgacacaacugaacacugacagcccccuugcacagggcuucauauacagcaggugcuuaguaaaugucugcugagugagcaacgcagucaaucaagacaggcgcccaugcaggagcccacacgucugccugaugcccuuguguggggaaaagaaagagaucaaaauggaguuucuuaugucuuccuuuucuacauagacacaguaacagucugaucgcccuuucuuuuccccacgcucuugaacgagcaucuccauaagcacccaggcuccaggcucagaguccugcuaacugccccacugugggcacauugcucaaccucucagggccucugugcccccaucuguaaaaugggguaaccaugccugccucacagggccauagugaggacccacugagauaaagcauguuaagcacuuagaaccacaccuagcacaugacaugcagcaguaaguauuggccguuaucuuucucaucaucuuccucgucaucaucugugcuugugucugucucccugacacagggagcaucuugaaggcaggaaccagguaagaugcagcugcagacaccccccaacaauggcauccaggccuugaggagggggcauuaagcaagggguggaugacagaggguaaagacugacacaggcaccuauaccccaacugugggccuggacagggaauaguguauggcuucugucagguaaaaaugcccuuccccugcucccaaaacaacaguccaccuccccccagcucuccaggagccuugccuacucaggcccugcaucccccacggagcacccccaagccccagcccagggagggggacaggucuaaugagccgcccacagcccccuggugcccgcaaucgaauuggcaaucaguuugcugcaauuagauuucccagaucccgcuggugauugauucuaaauuacccucauuaaagucugggcuggcaggcagggaugggggagggcaggauggauggggggguccuagcuggcagugcaggggguacaggaaucucuagggucgccugggccaaggcuaaccccagggugaagcagcaccagacagcacccuggaagcccauggcccauccaaaagcaggaugaaggcccaagucaguguuauccccagucccagcugcacccccagaaaacccuggcuaaguaggggaugugacgacaagaucagauggggcuccaggguaggagaaggggcaaaugaacaccaggcuccaccagcuccuggcugugugugcuuuggcagguggccuaacaucucugagccuuccucuaaauaaggggaaucccaccagccccucaagaguggugggaggcucagugggaccaucuaaggcuggagagccagccccaauccauuggcaaggccccaggcuguggcugggccaucagcugugggaugucaggcuguagggcuggccaucucucuaggacucuccaccccugagauccugcguaaacaucaauagucaccuacucugggccagggcccaugugacagacagaacacagccgagaugcucccuggcugggaggaaaauggaaagcacccagucucaccaaguccugggcucaagcugcaaauaacaaggccucucuggaguuccaggaguggaagggccugaagagucaucaugcaggauggacugcaggcugcucaacagcucuggagaaccagcccccagaaacucagcaccacggacccuagaaugugcuuccucucaucuggcuuaaguccugcuggcuccaacugggaguccggcccuuggucuccuucuaaggguacccccacccccagaguucuccuucaggccauccaugauuauucaaacuuaguucccccucucuccaaaagaaaacccugcuccucacccccaagcaguaguucuucaguaagacccagagagggacagaaaaagaacaaaaaccaaggcaggugaauggaaaaaaaacaagauuugcaggagcagcccgcuccuuauuuacuuuaguacuuuauuuacuuuauuacuuuauauuacuaauucucaagcaacccugaggucccauuuuaaagaagaggagacugcggguucagagagguuaggugaacucaccaaggucacacagcaggaaugugacaaagccaggauuucaacccugaaucagcuggcuccaggaucccuacuccuucgaugacuucaagcugcccccucaggcuugggacaccccaaaacagacauagcaccaaggccagggguggggagaaggcaggccucagccagcuggggcaacagggguuguagaacccucuccaccugguauaaaaggccagcauaggcguuuccugcccuccacccacagcagccagguaaaaaaagggccagaucauuuguuggggccaccgccacccccacugcugggcccucagccauggccgcucaggcucccccuguaaucacggcuuccuguuuggcgcugagacugggcuuggccagugggggaggggaguggcugccccucuggccauggcgggaggggggccggaagugaaggccaccaggccuccuggaaucuggggaggcugggagccaaggggagugaggguguggggggugccaucaacaaauauuuaccaagagccagcccgauguucccaggaugugauguuauggaggacagaggccuggaggggccagugagacaggucaggaaguccaggacccugcucccugcugggacagggguuuggggggaugaugggagcaagggccuggggccugggcagcuccuggcucuggccacccugucccuugagacacaaaaucaaagggcuccaagcagcugggcuguaguccagagccacagucccucgguccugcccagauguggugguggcagugccuuggcacucagacugaaggcccgcccgaugcagcccccuggcgccucccagcccacgggcacaugccuugcaugcagcaggacucugccagccucacuguccccaacccaccuacacaggaaaggacacaagccccugccugggcuccauagcucacagucccggcuuccuucauuccuuuauucccucauucauucauucauuccuuugaaucauucacucgagccugcaccaagcacagaguggucccuggggguucagugagaaaacauggcagccacgagccugcccaggaagcucaaagucuaucaagaaagcacugacaucacuccugacagcugggggacccccaccaagucacaccccaucucuaagccucaaucacuaugaggccagagagaaucuuggcugcaauggggccagugcucagagauggagcaggaggaacacggauuuggccuccacacacuuucuaagggccagaggggguuaaaggcaggccuggucaccucugcagacucaguccccaacacugggggcaucuggcacauaucagggcuuaugguggcuuuuuagaccccucucauccugagauuccaaacauuuccccucuccugugcccugaccacaugacccagacauaaacucccuuccgcauacacaugugugggcacacacacaaauguacacaugcacgcacacacaaucuugcugacagcccuucgcaguuuauaaagcucucucuccccaccccauacacccccaguggcccucagaguagcugcuuuuaugggcuacagagccuugggaggcgguagaugaggaagagcccuggccaaucccucccacagggugagacagcaucacugaccuccagggcugugggagaauuaagugagaaaagauaugggaccaacccccuucccagccccaccccgccagaagagcaggcauuuacuaaacaguagcuaaugcagacauaauccaggggguagggaggccccagagagguaaagcagcuugccuaagaucacacagcaagaggggguaaauuuaggacugcagcccagucccauuagccugucaggcccuggcucauacuagcucugccacuucuggcugugugacuuugaguaagucacugagccucucugugccucaguuuucuccucuguaaaauggggguucuggcuggggguuguggcucacaacuguaaucccagcacuuugcgggggccgaggugggaagaucacuugaggucagguguucgagaacagccugggcaacauggugaaaccccaucucuacuaaaaauacaaaaauuaggcagguguggugucaggugccuguaaucccagcuacuugggaggcugaggugggagaaucgcuuguacucaggaggcagagguugcagugagccaggaucauaccaccacacuccagccuuggcgauagagacucugucucuaaauaaaauaaaauacuaaaaugaggauucuaauaauuccuacaucaaaaaauuauuguaaggaugaaauaagccgauacauguaaagugcuuggugggcggggcucucgguaaacaugaccucucucucccacuugggaugagcccccccucgcucuccccaccacugccaccacuccugcugccccggaccccccagggacccuaugcccgcuuguaugaggugggaggagccacuggguuucaaaaggccauuuuuuuuguuuuuuguuuguuguuuucuuucacuuuuuuuuccagcacagcucaccucgcaccaacccccaacacacugaacucacagcuggaggcauugugcucacuccuccccagagagcaggaggcuucagguucaaaucccagcccugccuugaggauagagucacagcccccaguagugauucuaaaagccaaguauuuguugcccccaguugacagguaagaaagcugagggucagggcagguuacagccugcuacugucaugugaugaccacuuucauugcuuagcucaaaacccuccuccuccaggaagccuucccugaccccauccaugcucccucccagaaaggucccaucuccugagagcucacuacguggcaggugugcucggucuacucaagcagcucauuuccaagucacaacaucccugugaggcugacaccauuacuguccgcauuuuauagacaaggacuuugagacagaaagaaaucccucacuggaaaucacacagcaggugucuguccccagagccccugguaccuugggagcuaacaggcagcauacagcuguggugucccugugccugucccccaaaugcuggaaggggagaugguucacccaagagccuggcccagaacagcccaggggcccccaacuuuccauuuuuuuggugaggacuaucucauccuggaaacccaaggcucacagucacccaggggagccuggaggggagaagagcagggaugcuugaaacagggugaggaaggaacggaaaccaccaggccuggggcugagcuucaaaagaauucccuacuaauucccccaccccaccccacccccacccccacccccauccguacucucucucucucacaaacacacacacacacacacacacacacacacacgucucccacccuuccacuccccaccccuccugccuucccaaccacaguacagcaacuuuguaaaagaacaagaaauccauauuuguugagcccuuaguaggugccagccacugggcuaaaagcuuuccaaauuaagcccuuccauucucgcauugucuccauuuuaaagagguggaaacuaaggcacagagagguuagguaacuuucacaaggucacacagccacaagguaguggucucccaucacugggaguauucaaacaagacuaacaccuaagaucccuuccagcccuggacuuuugaaagaacauguuucaaaagcuaaaauguucaggauccucacacuccaaaacuuugaguggugacuuaaguacaguagcugagguggccuuaaaggcagaugucccucagaguccugguaacuuggucugucagaagagggacuccucaaaggagaugccaggagacagacacagacacacaaacacacacacacacacacacugcaauucaccaucugcagugugaaugaggccugcucucccugcuauccccaugcugaaagacacgaagacacacacacacacacacacacacacacaaaggcuggcaggugacccaagggucaucaugucccugcccuucccugcccugugccagccaccgcucaucuaccaaggccaccccuggagcuucccuggcuggggcucuucugaucuaaccucagucccuccugcugcaggcacugcccucucccucuggugcggaaccccggcaaccagguaccacccauuaacccuuuuccucccaagucagaugaggacaagagggaugaugccccuccuugacagcuugacccaugggaagaugugaggccuggaggacacuccacuucccaccaccucaccaggcgccccaguaccugcccucccccaggccccacccaccauuucagccucugggcucagacucccagggucugcuugaucugccacccaacacugggucugagccacaccucucagauucaggucacccguguugcgaggcccuacugugcaugaggcuauuaaaugcucucacuaaguccuuccaccaccucguggaguaugaauuauuagccuuauucagcaaggaaaguggccugcccagcgcuccaccuggccuccaagucuaaagcuuucuguccugagccccuuucauucaugugcacaccacaugacuccugagcuccuucucaggacacucgucagucaucccauugaauuuuugcccucugaggaaggggucauuagccccauuucacagagggacaaccaagggucagagaaguaagaggaccugcccaaaccaugccacgaaucggcggggguagcaggauuggaacccaggguugugugauucccaagccuuugauuuuaaggauggucuuucagaaauuuggcugagaaggcgaccccagcugcuagggugugcugggucucuaucccucccagggaccucuuccucucaccccacuuaggggagagcugggaaugagacauccuggccagcaggcacuucacacaggucagcccucaacacuuccccucccuccagcugacagcccccuagauggggaaggcugaggaggggccuguccauccaagaagcaagcuuggagccccugccuguccuccuccugucuuacugacuggcccacugaggcugggaaagggaaggaacuugcagagggcggcugggcacccaguguugcuugagaggccuggguccuuuucagccugggggaugcaggacagcauagcuccuggaaccaaccugggaggcuggaccuagaaauccccagcccgccugagccagaaccuggacacuuguccaacaagaacucaucuggggccuggaucccucaaagggggaugagguccuuccuuucucugccaucccugacggagcugggaccaagcauggcugcuacggucacucaaagggacacucaagggucaccucauacauaccaucaccuccaccugcacaugcuugguuccccucagggguccucguccuauguccagggucccccaugcaccugcaugcacacgcugcuaugugcacucacacacauucauggguccaagcacacgcccaccagaggucuuucacacacacacccucacccacugcagccacacacggccauagccaacaguggcccagccaggcacaggcacacaucaugcacaaugggucacccucccacgaccacggacgggagggcacgcuggcauccacccauguggcagacacauccuucaccugcacacgccccacagguccccgcaccccucacugaguuggccacacacgcccacacacgcccacacacaggguuacccucacuccccccucaggucaccuucaccaagucacccuccaccuccaccuccccuucccgggcccacugcccuggccggcugccgcgacccugggaagaaccaaaugcacacccuccccucggaaggggaaccgauccgauucccaaaaaguggccauggucugggcacacccacgaggcaaaagccaggcucacucccaccccaagacacacccagccgggacggcgacccccagcccgccgccggguccuucucgcgccucccaggccagcgcaggggucccgcuucguccccggggagacaguucccggagccacugggaggugggggaacagggcugaggacccgcgaucggguucccucccgggauucccucuggggaggggucccaaaaggaaggagagaugcgccccccgaagaugaccagcggcgggggcggccucuccccgcggaugccagcuagggggagauuccggaggggggggagcagggugcagaaaggggcgcucgggggagggucgagggguggcagggaccgcggccccgggggaagcagccgggggggagggagcggggucccggagggggggucgcgggcggggaccggcaccccgcgcggggggcggccccggggagccguggcggggauccgggcgcgugucacucacccccgcggcgcgccccgccagcagcagcagcagcagcgguggcaggagcagcccgcgggccccgggcccggccgcggccccggccccggcgccggccccgugggcggccccggcacggugcggcggccccggcuucauggcggcggcgcgggcgcgggcggcgggcggcgggcgggcgccuuuguucccgaggcgcggcgcgcggggcggcugcuuggcggcggcgcggcccggcggcuggaccgacgcgcucuaggcucgcgggcucccggcucggccgcccggcuccgccucgcagcuccgcgcccacagcggccgcgcccgcaggaagcgugcgccgc

SEQ ID NO: 14147 - RNA, 37437 nt, Homo sapiens
augaccucagccuggcauucacucuuccaugcagcugauccuccccaagcccuggacugggccgcaggcuaccugagaagcacaucaaagcguuuguucuacaggacccucgucugugggcuugugcagcuuggggccagggaugguggccuacuggccuuugcacugccaguacccacccaggcuuugcuuucaggguggucagaaaaugauuacugggggaacacaugacagaaaagcaggaagggggccucuuggugcugugagcugaccagugcacaguguugguccuucucgacagggaugacuucuacuuuuuggaagggagaguucagacuuuauuagauaccuuaaggcuggcccuggggaaaaccguggcuggcuucaccauccuccuaauaggaagaggcagugaggagaacaguagucuggggaaggugggagccccaacugaggggccugcacccagccccucagauccgccuccccucccaugucacuccagcucuuuugggaugaucacauggugagaaucugcuuugaagauaugaagggcuucauggaggcuuccaaggcagacugguaguccugcagcgggaccugggagcaggcaggggcugugagcuggccucggcggaugagaucgcacagugugaggaucagcuccuugaacuggucugcgggagguuggaggaaaucagacaagagaacagcagcuggggcuuggugagauguggcacggggcugcccuaugggcaggagcuggcaccaagcuccaauaaagccuugagaguccuggcugugccaaggauaggguggcuguggaggcagccuggucccugccugucuuuaggacagugaggucaagguggggagaggggaacauaggagcggcucuaggggcugaggggcagacaggcagagaccacccuucagagugguggcuaagauggcacagacucacagaaccuggccacaguggagacaggagcacugaauggugggaggaaaaggauggcggaggcagggaggccagaggaggcccagagagggaguggguaugccuggcacgccaagugauguggaacaguugagcucugcucaggaaauggagcucucccugagagcccaggacucccuuagaaccccacgaccggacgccaccaacauccccuuccugggccugccuccugcgaaggacccuauaugguacaggaaguugagaagugaaggccucggcugagaaguguuuuuccauagacauaaauucauucagccuucaaaucuagucaucuauacuggcuccucaguugccuuuaagcgugagucuugucuggguguggugccucacgccuguaaucccagcacucuuggaggcugagguggguggaucacuugagcccaggaguuugagaccagccugggcaacaugaugaaaccccauuucuacuaaaaauacaaaaacuagcuggaugugguggcgugugccugugguccuagcuacuugggaggcugaggugggaggaucaccugaaccgaggagguugagucuguagugaucugugaccacaccacugcacuccagccagggcaacagagcgauaccuuguuucaaaaaaaauaaccccccaaaacagcaaaaaaacccaugagucugaaugccuuaaucagguuuauaaggccucuguaaccuggucacaacccacucacccaauuuuccagccccagcucagaucuagugcuccaggucgcucggaaccgcuucagugccuaguugcacgugugauuuucgauauuuucugccugaaacacugccuucaugccaccaccuuccuccccuucacuuggauaacuccauguuauucuuuguccugaguuuggagaucccgcucuggggagccaguccuccaggagaugaacagggagaugaucuguuuacaucgugccucauaccucccugcagggaggugacuuugggcacgcuacuuaaccacucugaaccucaauuuccuccucugucaaacacggcuaacaagaguuuaaacuuaggacauuuaaacugaggcagagauuaaguaacuugcucaaggucccacugcuggcuaggcagaaccucuauccaguaguguggaagcagaauuugaacccaggcaggcuggcuccagagucuauucucucuguuuggcuauccaucuuuccccacugucagcucuucaggacgggggcagugucugucuuguucugcgccccuaagacuaacccaguuuaguccaauaacuguuugcugacuguagcuggacuaaggcuauucucuuugauccuucuguggggcuggggacccaaucaccccuccagggcucagaauagcuggucauuucugcugccauuuuuaggcacugcccucaucugugacucuuggcacugggccaugcacucaccuggacugugauccuucuuccacugggacaaccaaaagccucgaaguuugagauccuuaaaaaugagcaggcucugcagacacaggaaggacaugcugggcucugagggcaagaacuucagguaccgcuuaaggguacagacuccccuccaggaacggggcauugccuaagcuuagacagcugucgugccaggggauguggccuggcugaggugucuggcccggcuccaggcaugccucccucugcacccagcuuaccacagaggcuacgacgggcugcuuggccauccccccauagguuaccaugguuccuccacgccugaaaaguccaaagagaacaaagaguggaugcaaggcagagacagagcccuuccugaaccugccauggcgcuucuacuccaacccugguuccuuuauaaacccugcucucagaaucucugggaaagguugaaaaauacagauuccagcugggagcaguggcucaugccuauaaucccagcacuuugggaggcugaggcagguggaucacuugagcccaggaguucaagaccagcuugggcaacaaaaggagaccccaucucuacaaaaaaaguacagaaaauuagcugggcaaggcggcaugccuguagucccagcuucucaggaggcugaggugggagaaucaccugaggccaugaaauugagguugcagugagcccugaucgcacuacugcacuccagucugggcaacagagugagacccugucucagaaaauaaaugaaugaaugaauaaauaaaugcaugcuggggauggcagcucacaccuguaauaccagcacuuugggaggccaaggugagaggauugccugagcccaggaguuugagaccagccugggcaacauagugagacccugugucuauaaauaauaauaaaaaaaaauuagcugggcacggugauacaugccuguggccccacucaggaggcugaggugggaagaucacuugagccugggagguugaggcugcagugagcugagauugcacugcugcauuccagccuaggcaacacagugagaccaucucaacacaaaacaaaacaaccaagaaaccagauuccuagguccaaucccagacucaaugaaucaggagacgagaauguauauuaaacacacacacacacccgcucuggaugacuuguauguuuagccaggauugggaauccacugaucuaacccauccagucaggcuuugauuaagugcugaaaagaaacaugcucuccccagaugagcucgaggccugaguucagccuuggcucugcucucacuuacagguguccgaccuagggugaugcagugaaaauggcccagaccucaucucuucaucugccagugcucauucuaagaaucaacgugaggaaacagcucuacagauaaggaaugauguggacggugcagggaacaaugacaagcaucuucucacugcaggaggugccuucucaguaccugcugucugacacccacacccccaugucagcugacauacaggauugaggcuaacauaauuuuuaagugaauaagccuggaguucacuugacuuaaccuauguucaccuccccacucccuggcucuucuaggagucuguugauuaaggaugaccucaggcacauuuggggacaacacaagguagacuuucaaaacuaccaaauggaaggagcugcuguccuagggcagguacuucugucccugaggcugcuggguaguuuggucuuaagugccccuugacugccaccugcuguagaaaguagcuccugggagccaagcccucucucuucuguaucccugcugcacuucaucuaaucagacuagcugacacuuaccaggcuucuacuaugugccaggcacaguucuaagcauuuugcaugcacugccucagggaauccucguaacaaccuuguuuuagagaugagaaagcugaaguccauccgucauuuguacagcaauuuguauaucgcccaguguccuuuagaccagcggucccuaaccuuguuggcaccaggaccgguuucauggaagacaauuuuuccauggacuggagugggggagaugguuuugggaugaaacuguuccgccucagauucucaggcauuagauucucauaaggagcaugggaccuagaucccuucccugcgugcuucacaauaggguucacaugcccaugagaaucgaaugcugccacugaucugucaggaggcggagcucagguggccaugcucgcucacccaccgcucaccuccugcugcgugaccugguuccuaacaggccacgaacugguacuggucugcggccugggggcuggggacccguguuagaccacccuucagaggcagaggguuuauauaacccccauuuuacagaugaagagacggaggccuggauuguuuuucacguauugccuaacuuuccacaggcccacagcuaguaagucacagagcaggggcuugaacccagccauucuggcuccagugccuacacccguaacaacgcuucccccugcaaugacauugggauugaggucugccgcagggguugucugucagguauagggcugaagcggugugcucaaauguggggucaagccuggcucuccugcugccuagacuuugggacagguacuugaccucuuugggccuuguuuuuuuuuguuuguuuguuuuugagacacacuguuucucugaagcccaggcuggagugcaauggcacgaucuuggcucacugcaaccucuaccuccuggguucaagcaauucuccugccuuagccucccaaguagcugggauuacaggcacccacgaccaugccuggcuaauuuuuguauuuuuaguagagacgagguuucaccauguuggccaggauggucucgaauuuuugaccucaggugauccacuugccucggccucccaaagugcuagguuuacaggcaugagccacugcgcccggccugggccucauuguuuaaaaguauaaaacagagguuagaacugcacccccugucuaggugguugugggaaggguaagucaagcgcugcacacagucuggugcauggugaauacucaccacagugcucuggccacgugacucaccugcucaucaagccugugaauucucagagggcacaucagugucgcagcccucucuguaccugguagcuaguaagugcucagcaaguaugcgcuagcugaauccguacuauugaggggguuccugcuuuaauuaggaagugucuuuuuacacacacucuagcucaagaagcuuuuauuuuuauuuuuugagacggagucucccucugucgcccaggcuggagugcaguggcgcaaucucggcccaccgcaagcucugccuccgggguucacgccauucuccugccucagacuccugagcagcugggacuacaggugcccgccaccacaccuggcuaauuuuuuguauuuuuaguagacacgggguuucaccguguuagccaggauggucucgaucuccugaucucgugaucugcccgccucagccucccaaagugcugggauuauaggcuugagccacugcgcccggccuagaagcuuauauuaagggaaagaagaauggaaggacaugcauuaauauugucaacagggcuuaucccccuugguaguggggugauagguaacuuuuuuuuuucuuuuuugagauggaaucucccuuugucacccaggcuggaguagaguggugugaucucggcucacugcaaccuccaccuccuggauucaaaugauucucgugacucagccucccaaguagcugggauuacaggugccugccaccacaccuggcuagucuuuuuguauuuuuaguagagauggaguuuugccauguuggccaggcuggucuuaaacuccuggccucaagugaucugccugucuuguugggauuacaagcaugaaccacuaugccuggccagguaacuuaaaaaaaaaauuaauuuuuuuuuuuguagugauggggucucacuauguuacccaggcuggucucgaacuccuggccucaagugaugcuuccuccuuggccucccaaauuacugggauuauaggcaugagccacagugcccagccaacaggaaacuuuuaugcuuaaguuuuccuuugcacuuuuacauguuuucaaaauguuuuguaauaagcauaauguuaccuuuaaaauuagaaucuauuuuaaaagcuaauacaaauuuugaaagguuaaauaaguuaggacuaagugacuuuuucagacaucccuagguuauaaauccuugacuauuccucuauggcaggcagcuuagcagucuacuucuggggucccuuggaaaaauaaagcuggauaggccaaaauuuuggucaucugcaaaggggaaggcugagaaaccagugcccaaauagcuggaugacuuugguccuaguuuccacucaacauugugcugaccuggacuuggcucgaacuggcgaugggacucagucacuugaugguccucccagcuaaagaccuggagagcucuggcgagcuggaccugcaggcccaagggacuuacgcuaacugccgcagcagcucuguggagcuuuucccaccaacacaguugagagcaagccguggcuggggcauguccuggaaaacaacaaaagugcagugagggagcauccccgcucuacauauggggucugaagcuugcccaagugcuguguuaaaaggagggaguaaaugagauguuuaugccuuuguuugcgugcacguacuuauguauauguguguguguuuaugccuuugaacucaccuuuuucucugcuuaggaagugucuuuucuuucuuuuuucuuuuucuuucuaagacagggucucgcucuguuacccaggcuggagugcaguggugcaaucauggcucacugcuaccuuacccuccugggcucaagcaauccucccaccucagccucccaaguagcugggacugcagaugaguaucaugaugaccagauaauuaaaaaaaaauguuuuuuuguagagacagaggucucacuauguugcucaggcuagucucaaacucucagacucaagcaauccgccugccuuggccucccgaagugcugggauuacaggcaugagucaccucauccagccaagaagggccuuuucuguagcaacuuaauccuguuguccauuuuaggaccuggcagaacucaucuucucugggaaagaauaggcaaagggcaucugcaugcaguuugguggguuucagcucccugugugccccccuuuucaguucuuugacucagcugauauuauauaugcugaucuacugcuucagaaauguucgcaagaagcgcaugcucuugagugugugucuuugguuccuccagaugguucagugaaaaggggcugagggucuggucacuuacuaggcauguugugggguggagguucuggaagguuaagaggcuuugaguucggagagacugaggccagcucugacucucuggagcccuuauaaacuauaugauuuugguuaagcauuuccucuuuucugagucuuaguuuccuaaucuguaaaacagauaacaguuccuuugaaaagcuuuuguggaaaucaucagauaaaauguaaggcaggugguugggaaagguuacuucuuuucuuucucuuucugugucucuguuuccucagguccucuccugccaguucuaagagucacacaugugggcugaugcggcccaccacaaacguuuaaacugcaagucauacuggguuuccuaaacucuguuucucaugccucccucccagcaucugggcacuuaaugcgugcugccugccgccuggcuagggggaaugggcuuuaaccaaccaagaggcaaagggagguuuccagagaggaacaauggggccaguccccaguuucucuaaugcaugucaacuuucuucagggagaugugcguggacuggaggggcaaugucccucuuccuagguaccuuaaagaaguuuuucauuucgggccuucuuagcuccucuucugugaugacaugcucagcccccagacucuucagucugucacucagcuucuggauaucaggucuggaaaccaaacauaggucccuggucacaucugccagcuuuuuccaccaaagccccccaggaccucucugccacagcugggagaacccgugcuucuuuuugcaggaagcugggauuagguuuaagccaggcuugagcagggaccagccaccuaauuucaugcagcuucaauagcucuuggcugucuccucacuggcaacagagugagacugggugguuuucacaggcccugacagcucaauaguguuagaagccaucugugcccagggagaagucacuuaacuuccugauuucuucuacugaaaggacaaacuccacuuccccccucuuuucaagugguucuucagaguguuggacauacacagucuagaccaggaguggcucugggucucuuugguuaaggcaaauggaauuauuuuugcgaguacaacugaggaacugaagcuggugucgauuauacuaagagugggcuuccaugacagccacagccacauucauggacagugaggccuagagaaacuggacgauaugauggaaagagaguaagugaggaaaccgagucuauuacugacuugcugugucuuccagggcaagcugcucccugaaacuucaguuuccucaucuguaaaagacagaugacaaaccugccccugucuccuucacgucuguauuuagcgcacuuccaaguaccacacaaaagcaaggguaaaggggccuuggguuagacaguucacagaaagaauaauacagcucaaaucauucccaaauaucaacugggguuuugaaaacaugagguuaucacaagccaagagucucagaaagucuuagcuauucaguaagggcagucuccaccuccuuccugcccucucuuuacaugucagauucacucauccuaucgccaaaagccagcuggacuucauuucuuaggacugacucaucuguuucagccgccaacuguuagcgaugccuaaagccaguuuaugcuuaugcaagggcgcccucugguggacaacugggcaccgcagggaugggaggugggaaagacccaagacauggucugggaugaagccuccuuccccacgcaccugucucggaccacauugaugguucuuaggcccagggcugcggcgaucuggaugacugcuugccccacuccgcuguuggaugcauucuggaugacagaauccccuguggagccaggaagagaaccaaaucaagcccuguauagaucugcaauaggucaaaggcucccagccggggauccuucuguaggcaagggaguccucaggcucaacagggacccaggaccuggcugcugagucuucucagaccuuccacuguuucucacuguucuccuaaugccuccuaaacuuccacaacacucacgaugccucccaggacuuggcaacucagcaucuacacuggauauaauuuagacccugcccugcuauguaaaauauuuuauagccuucgucauccucccaacuuuuauguccucaagucuuuacuuagguuauuuccuugguuugcaauguuucccuccuucucucuuccuuccuauugaaauccuguagauccuuugaagcgcagcucaagugcagccuucaugaagccuuccuggauuguucccucuaugugcucccacagugcucugugggcaucuguauuaaugcacauaccacggucugccccaucuuacacuucauuguauauagguccauuucuaucaacagcuugcagcuucuugagagggaagggucaugcccuauuccucucugcaguguuuaauaaaggugcacugccuugaaaugggauuacagcugcgcuggagaaacuggcagccccugaaacaggguccuacaguucuguggcaaagcccagguuuagcuuuggaccuggccauuggggaaggcggugugacaugcugggaaaaaugugggcucuggaaugagacagaucugggcaugagucucaguuucaccaaugauuguaacuaaacagacagggcaagucaugaccucugugaacuucaguuuccuucccuuaaaauauaaucccagcuacuagggaggcugaggcaggagaaucgcuugaacccgggagguggagguugcagugagcugagaucgcgccacuguacuccagccugggugacagagcgagacucccucuauuaaaaaaaaaaagugcccccgauuagagucaaaugcaucguguccgggaaagugcuuuguugaauuugaaaugcuaucugguuuuugagaggcagcagggaucugucacacaacgggcugaaacuagagauagaggacuuccuggaagaagaaugcccacucgucuucaccaggggucaacguacagguugucacccaccaguggauuaugaaucaaucuaguugguugcaagcaccuuuuuuuuuuaaaguuaaaauugagaagagaauaaaaaauaacagaguaugucacacauaguaaggguauuucacgaaacuuugguuuccauuauauauauauuccuauuuguauaaacugaucacaauauaaaauguaauucuuaccaugugucaagauccuaaguuuauucaacagugaucuaguucaggccauaucagccuugaggcaggaaaguggagaggugugcaguggguacuuagggugggcagcgucgaaaugccuagaucuguuacuacagcugcagccuaaaugggagguggcuuuagggcaugggaugcaagcaaacaaagugucugcugcacuaggacuccagcaaaggucccuggucacagccacuggcuuucuccaccaaaggcucccaggaaccaucugccauaguugcaagaaaccuauauuucucuugugggaacuggcaucggcuuucagccaggccuuggacaguggcugggcaccauguuucaucacacuccaacaacugugggccucaguuucuucgcugguaugagagguggcuugggugaguucuacagccacugcggcucacggaugugcauggaugugcauggugugcagaggcagcccaggagguuaaugcccuuagggcgacccuuaaacaauggggugugagaauuaguggaaaacuggcccagccucucaucauucaaggguuaguuuuuguuuuguuuuguuuuguuuuguuuuugagauggugucuugcucuguugcccaggcuggagugcgguggugcaaucuuggcucacugcaacuuccgccucccggguucaagcgauucuccugccucagccuccugaguagcuggggucacaggcgcugccaccacgccgggcuaauuuuuguauuuuuaguagagacggguuuucaccauguuggccaggcuggucucaaaccccugaccucaagugaucugccagcuucagccucccaaagugcugggauuacaggcaugagacaccaugccuggccuuaaggguuaauucugcaguggguucugagagucuucagagggccccagcaagacugagcaggccggcuggggguggguggcucgcgccuguaaucccagcacuuugggaggcugaggugggcggaucacaaggucaggaguuagagaccagccuggccaauauggugaaaccccauuucuacuaaaaauacaaaaauuagccaggcaugguggcaggcaccuguagucucagcuaccugggaggcugaggcaggagaaucccuugaacccgagagguggagguugcagugagcccacgccacugcacucaagccggggcgacagagcacgacugucucaaaaaaacagccggagcaguaguugcccgcagcaguaaccgggcuucaugggcuuugccuccaucucugucucacucuccccacuccccuucauuucuucuucccaaacaaacucucugcacccagugcuggucuuaggcucugcuuucagagaaacccaaauaaaaacacuuggcucugucauuuacucccuggcugaucucaugcaaauaguuuaccuuucuggaccucaguuuucccauuuaugaaagggaagaagaauauaagcagcggacagucucugcacuguaugcccagcacugugugaaguauuaugcuguaguguuucacccuccacguucuuuauucuccauuuuacagaagaaaaaucugaugauuugagaggcaaauucacagucagggaaaggugaagccuggggucagacccagguuaucugcccagagcuugagcucuuaaccaaugaugguaccaaccuuacugcaaugcugugaagauuucaugcacucaacggggauaaugccugucaacgcacuucugugaacuggaaagugcuauguaaacgcugaguggaauuauuaacacuaaguucagcauuuuauugaaaacauagggacugugucuaucuugucugccuuuguaucccagagcuuagccccagcucaacacauuuuugcugaaugacagaauucaaucccaagcucuagagaaugugacccugcagcaguuuucgagaguguacuccucaugagguuucagcauguuuccuaggaaccaagcuaacaucuuucuaagugaaagcaacaacauucacccaggugagagguccaucacccccucaaaaccuccaccuugcaaguucuccuggccuuggggucaggaugugaguggcacccuaguugcgagacccuggccugcucccccaaccuguggguuccuaccuggcugcaguugcucgaaguccaucaacauccuguaggcugugcagggauugacacccaggguggcagcgcucugaagagggaugucacucggaacuuggaucagugcuuccucgcugaacacagccucgguccgccagguuccugagucagaagaugaagccaggaucauaaggaaggagcccugugcacauucaaccccagcucacccuccuuggccaagaagcauccaggauaguggguagcauccacuggaagcauccaggauagcauccaggauguuuagaaaaagaagaaaaucuggacguuccucugaaugucugaguccucaugauaauuaugcacaauagauuguuauucuuuuuaauuuuuuuuuuggagacagagucuugcucuguagcccaggcuggagugcaauggcgcgaucuuggcucacugcaacuuccgccuccuggguucgugauucuuaugcugcagcccccugaguagcugggauuacaggcaugcacuaccauacauggcuaauuuauuuauuuuuaguagagacaggguuuugccuuguuggucaggcuggucuugaacucccggucucaggugauucgccugcaucggcuucccaaagugcugggauuacacacaugagccacugugccuggcccaaaauagacagucauucuuaucuuaaacauguaguaaaaauggggugugguggcucaugccuauaaucucagcacuuugggaggcaaggugggaggacugcuugaggccaggagcucaagaccagccugggcaacauagugagaccuugucucuacagaaaaaaaaaaaaaaaaaauuagcugggcauaaugcccugcagucccggcuucucaugaggcugaagugggaagauugcuugagcccaguaauuuaaggacacagugagcuaugauugugugacugcacuccagccucggugacacagcaagaaccugucucaaaaaaacccaaaaaacaaaaaacaaaccaaaacaaaauaugccaaauaccauuguaagggcgauucagagaggcugcuucucugaguuaccauuagauuuaguuaaugucaccgugcagguaguuaaugaccucaaacugcugcaaucuaaggguaagacaguaguaacauuaccaccagggcaggagaagcugagaaagcccccuuuuuccuacacaguccucauucuucucauccagagcagguugacucacauguuuuuuuuuuuuaagaugaagucuugcucuugucucccaggcuggagugcaauggcaugaucucggcucacugcaaccucugccuccuggguucaagcgauucaccugccucagccucccgaauagcugggauuacaggcaccugccaccacgcccggcuaauuuuuguauuuuuaguagagauggguuucaccauguuggccaggcuggucucgaacuccugaccacagcugauccgcccgccucggccucccagagugcugggauuacaggcgugagccacugcgcccggccugacucagguaguuuuaggcaacaaagcauaaaaguagaagucaagagcacagaugccaaaccugguuuugcuauucugcuaguuugagaaaauuccugucacugaguuuuaguuacucuaauguguaaauagcacaggcaagaacagccugacucgccuccuccaggagcuacuguagaaaucaaaugagauaaggaaaugaaaaauucuauaagcuugaaagaaaugagcaucaacucccagcccacauuccaguuccagacaaaagaauucuagaaugucaguacugagaaggcccuuaucgaacaucgacuuugaaccccucaugcaacaggggaggaaaugaggaagugacuugcccagagcccccuggcuuaucuaggcagaguuggagcuggaaccuggguaucugggcugccuuccuuccaucuacagauauuuaucuugcacccaggcacuugaacaauacagacaguuuccuuaguuucauucuaguggagucgaacaggugaaaaaaagcagauaugauaaugauaaauuauaaagagacaggaacaucaagagaauuacuuuagaugggagucaaggauacuucucugaggaggugacaggcuaagagugaaaggauagaggugcuaccgucucagagcacacaaagaacaucuuagguagggcaugcagcagaugcagagaugcuguagcaggacaaaggacugggaugggaugaugcugcaccgcaggguggagagugaugggaagaguggcuugagacauggcuggccuggcugaugcagcaggggccgggcaggugauauuagacuuucagaauucugacccacaguaaccaugaguuccacugugaauucguacauauacauacaugaauguacguguaacacaagccuguguuucacagaauacuuacccuuacuaugugugauacucugcuauuuuucauucuuuucugcucaacuuuaauuuuaaaaagugcuauuugcaacucacuagauugauuucucgaaugggucacaaccugugguaugagaacaugaccucagcacugugguauggagaacugaucuuguuuuagugaaugagugagugggaagccuguaacaagcuuuaagaggagacugagaugauccgauguaugcuuuaagaucacuuuauugcugggugaagacuguggaguggggaggggcagcguggaagccagaggucuuugugggggucgagguaugagaugauggcugccuagucugggacuuuggcaguggggaugaggaacagaagauggauuugaguucuauuuuaaagacagaaucaauaggauuuggugaggacugcgugaggggucugcacucacacaggcaggaucuuguaugaagaaggggugaagaggguaggcuuuggagucagagagacuccagccuugguuccacaguguccucacugugucaccuuagggaaauugcuuggagccuuguuggcucagcaucuggucacaguggcagcucggggcccuuggccuaugcuuccaaagcucuugggcaugccugcucacuauccaguugcugggauucuaaugguguccugguccuaugugggucagcugugggaagcagggggcagccuggguaaucacuaacugugcuauaggaaacggggaugucaaugugggcuuuagggaccaagaacuggggacaggaggcaggaacacuuuuuuuuuuuuuuuugagauggagucuugcuuugucgcucaggcuggagugcaguggcacgaucucagcucacugcaagcucugccuccaaggcucccgccauucuccugccucagccucccaaguagcugggacuacacgugcccgccaccacacccggcuaauuuuuuuguauuuuuuaguagagaugggguuucacuguguuagccaggauggucucgaucuccugaccucgugauccgcccaucuuggccucccaaagugcugggauuauaggcaugagucacuguacccggcccaggaacacuuuuuauagaaggcugugucaauccuagaguaggucuauggcugagaaaauaagagacugaaaaggcgaggauuccucuguaauccaggaagugccccagcauccugugggcuucccccggacuggccuucaaaucaucguucccauucaucucagcuaacacuuacuguacucuaccgugcaccaaaugcuuagugcagggcuuucuauguaugaaauccagggcauuuucuaauuccccuuauggcacgacaauggaaauccaacccuugauauggauuucuggggcuuagcagucccuaauccucuucucaagagacucugggugggagggaggcagcacccguggucagagacaagggcuuucaggguuucaaguagaacucuuaggcuugaaguuggagagaccugcuuaaaaacccuggcucuaccacucacuagugugugacuuugaaugaucacuucaccuuuuuugaguuuccauuucccuaaucugugaaaugcagagaguaacacuuaugucauagugugaagauuaaacuaaagacauuuguacagagacuaucacuaugccuaguacacaguggguguauaacacacauuguuuuccuuuaaugaugcuaauucccagacuuuagcucugaggauucccaauuccucagucauaugcaacugacccuuaaccaucuccauuguugaacuugggggucagcaaacuguggccugugggcuaaaucugccucaccacuuguuuuuguaaauaaaggguuuuuuuuuuuuuuguuuugagacaagagucuuacucuguugcccagguuggaguguggcuuacugcaacuucugcuuccuggucucgagcuauccuuccaugucagccuccccaguggcugggacuacagguguacgcugccacacuucgcuaauuuuuuguagagauggacuuucaccaaguugcccaggccauucuugaacucuuggacucaagcgaucugcccgccuuggccucccaugcugggauuacaggcaugagccaccaugccugguccuguaaauaaaguuuuauuggaacacagccauguucacucaauuguuuauauauugccuguggcuguuuacgauaguagaguuggguagucacaaagaugauauagccuacgaagccuaaaauauuuacuauuuggcccuuuaagauaaaaauuugccaacuccugaucuaaugcauacagaaauuuggcauuugcaaagaucauugcauauauucucaguugaguacugcugagacaugcuaggcagugacaauuagucccauuuucgagaugaaaaaacugaggcucaaaguagcugugacuuaaauuaggucauacagcggagcuggaaagagaacuugcccccugauuccaaagccagugcacuuucuacggcucugugcuuccucaggaagguuuugcauauuucccaaggagaaagucaguuggcaaagaucuauccacaccaucuggucuggucuccccugggauuggcugcacgugggaaaaggcuggcuaugggcuuagcaacagcuaggcagcucagaaccaugaaaaaugaccaagcuguggccaacuaagaacuuaccuguuuaauaguugccacucuuacuaaauggcagucuucacgagaagaaagaccaugucuguucacugcuguguccucaagcccagcaugcugcagaugcucacaaaauguuuacugaauacacugaguuaauugcaguccucacaauuauaaaauccucauccucucuggcuggcaccuugcuuaaaagacucaccugcuggccaggcgcaguggcucaaugccuguaaucccaacauuuugggaggccgaggcgggcagaucaccugaggucaggaguucaagaccagccuggccaacaagacgaaaccccaucucuacuaaaaguacaaaaauuagccagguguaguggugggcgccuguagucccagcuacucgggaggcugaggcaggagaauugcuugaacccaugagguggagguugcagguugcagugagccaagauugcaccagccugggcaacagagcgagacucugucucaaaagauaaacaaaacaaaacaaaagaaucaccuuuucuccagggaagaaucccuguucuggguacccccaccaccacauguacaauuacccauacaccuggcagacauccuuuauuguucucuucuccaaacugaaaguauugccaaguccuguuacuuuagcccuugacuccaugcccucuucuccagcccuacgacacugucuuauucagacccucacacuucaucaucugaagccugacuuguuugcccaccuccucacuggcuuucugccuccacccucugccuuuccagaccaaugguuuccagaccauucucugcauugcacaaauccuaucaaaucauuccucuacuuaacucucuguugguaccccucgcaccguggaugcaggaccgcugggacccagccccaccccaccuuuccagcuccaucucacuucucucccacucgcacccaugagccagccacccugagcuaccugcaguuccccaccagugcugugccuucucucaucacuuacguucacacacgcugcacucugugccugggaagccccuccucaccuagcccacuggcugcacuuccagcagcucuuccagacugaguucaagcaucacuucucugggaagccuuucuuaacgcuuuccaagauagaggacucuugucuuggugucaauccugugauuauggcacuuguaauacuguauuguauuaaguguuguuuuuccauuucugggccucccacugccagccaagagcacucugagggcaggaacugucugcucaccuugauaggaccuucacuuagcacgggggcuggcccgaagcacuggcaucaggauccagugaauccuugcagcucucaauuugcucaaauggcugagcuccuucaccgccagguggguguaggagacgguggagccauucuuggcagccuuccugaucucagagaagcaaagagcuuguaguagacuccuauuacuguuuuuuuuuuuccugccuaguaucuuuuucucucuacaagugcuccuuccuaaucucuggggcugucaaccacaaggccccaccuguaucacagaggagggugagagacucaaucagagcaaccggaguggcccuaccccgccccaggggacugguucagggaugggcaaggcccauucagggcccuucugggggauggauaugguugugcuggacaugauuguggaggauaugcucauuuguuuguuuuuagggugauaugaaccucaggcugcugguggccaucuaugagagguauguaucagaguggaucugaauucuaacuccaucacuuuuggcugggugaccuuggacaaacugcuuaacaguuuacaguuuucugcugcauuuacuguuauaucaccugcaaagugggaaugaugagguauccaucucauguugugggaacaauugaguuaauauacaugaagugcuuagagcagugccuggcacaaagagaguggccaauaaauauuuguugguuugauuauaucaauauguggggagaucucaucuaagaacaagugagagacacaacucugauaguacugggguuccuggaucuagcugaacccgaagcuuucacucuguuacacuucccaguuccacaaaucaacuuucuuuuuuuuuuuuuuuuuugagauggagucuuacucugucgcccagguuggagugcaguggcacaaucucggcucacuguaaccuccgccuccugggaucaagugauucuccugccucaacuucccgaguagcugggacuacaggugcacgccaccaugccuggcuaauuuuuuauuuuuagaagagacgggguuuuaccauguuggccaggcuggucucaaacuccugaccucaggugaucugccugccauggccucccgaaguucugggauuacaggcaugagccacugcgccuggccuuauuuuuuuuuuuuuuuggagauggagucucacucuguugcccaggcuggagugcaguggcaugaucucggcucacuguagccuccaccuacugaguucaagagauucuccugccuuagucucccggguagcugugacuacagacgcaugccaccacacccggcuaauuuuuuuauuuuuauuagagacaggguuucaccauguuggccaggcuagucuugaacuccugaucucaggugauccaccaccucggccucccaaagugcugggauuacaggcgugagccaccacgccuggccccaacuucuuuuuuuaaagcaaguuugagcugggucgcuguaaguuacaacccagaagaucauaacacugguguguaaugggaacccaggagaaagaauccagugggcacucucauuuugcuguuugacuuugggccagggcuuuacuucucaagcuucaauuuauguccaauggauggauaauaccugcccugcuucccucuuguagcugcugugaggaucaauaacagacgugccuugaaaacuguuaagugcuaaaaacaaaacucaccuaugacuccuuauaauauaucaaacaaaauccuacucauuagcuuggcuugggcagggccuuaccccauguggacacaagcuaccuuuuuaaaaaaaaauagacagggucucacucuguugcccaggcuggagugcaauggugcgaucauagcucacuguagccuagaacuccugggcucacgugauugaaccugccuuucuggccuucuuucucacucgugcaauccucucccauaugcaaacccucugcugaggcuacaauggauuuuccaccauuucccaaucucaccuuugugucuuuccucauuuuacauccuccacaugaagugaauuuuggcucaucuccauguauaaacaaaauucagacucggcacaguggcucaugccuguaaucccagcacuuugggaggcugaguggugggucaccugagguuaggaguuugagaccagccuggucaacaugauaaaacccccucuuuacuaaaaauacaaaaauuugucgggcgugaugguguacaccuguaaucccagcuacucgggaggcugaggcaggagaaucgcuugaaccugggaggcugcaguaagccgagaucgcgucacugcacuccagcacaggugacaaagugagacccugucucaaaaaaaaacaaaacaaggccaagcgugguggcucaggccugcagucccagcauuuugggaggccgaggcaggcggaucccugaggucaggaguuugagacccagccuggccaacauggugaaaccccaucucuacuaacaauacaaaaauuagccgggcguggugguaggcgccuguaaucccagcuacuugggaggcugaggcaggagaaucacuugaacuggggaggcggagguuuuggugagcugagaucgcgccauugcacuccagccugggcaauaagagcaaaacuccgucucaaaauaaauaaauaaauaaaaaaaauaaacccugcauuacccagguacacucggccaaucaguggaugccgacagagugggugaaauaggaucuggaagaacgaauaggcagcugacaccuggagaaacucaccuaaaccagcauuugcuggaaucacccagucuccuggcuucagcccggucacauugcugcccaccgcuaccaccugugcaacaccuucguucccuccaacagcaggcaguucaggaaggaauccguaguuuccugagggagaagagcauuaaagggucaaccagugauguuugggcagugaaagagcauggacuugaguccacgccauccuaggccugaucugggcucugcuuuggacugucugccuaaccaaccucugagccuuagcuugcuugucuguauagggggacaauauucuuuaguguucaugguuaucaugaaaaucagguaacauaugaaaugaaaccagcaugucgcaggcacuucacaaugcuuaguuuacuccccacugcaaucuucucaaaaagccacacauuccagaaaagggaggccagacagggcugacacagccugcagacggcucaucuggagaacagcugcugcuaaucacaggcauuucacacccacaccugaggaggaaugaaaaugagguggcagcugaacaaaaaagccaauuaacauaagccacagaaaccaagguuaccuuggaucauauuuaugucagauggauugauaggggccgccagcaucuucacacggacaucugauccucucacagcagcuagcuccagguucuugagucuaagcacaaagccaaacggagauguucaugucauccaggcuagaauggguguuucgcucaaaucaucuccucaaaguaggucaggcaacauuucugagcugccaugugugcccaggaauuacgguucuguuauaaaagagagguaccauaagaaaucaacacaggaggcugggcgugguggcucacgccuguaaucccagcacuuuggaaggccgagacaggcggauaaccugaggucaggaguucaagaccagccuggccaacauggugaaaaccugucucuacuaaaauacaaaaauuagcugggcgugguggucggcgccuguaaucccagcuacucggguggcugaggcagaagaauugcuucaacgugggaggcagagguuguagugagcugagauugugccauccagccugggugacaaagcaagacuuugucucaaaaaaaaaaaaaaaaaaaaaaaaaagaaaucaacauaggauagagguugacucucauuaacugcaaguggaaaacccacaguguuuuuuuuuuuuuuuuuagacagagucucacugugucacccaggcuggagugcagugacacaaucucggcucacuaaaagcuccgccucccagguucaagcgauucuccugccucagccucccaaguagcugggacuagaggugccugccaccacgcccggcuaauuuuauuuauuuauuuuuuuaguagagaugggguuucacuauguuggccaggcuggucuugaacuccugaccucgugaucugccugccucggccuccuaaagugcugggauuacaggugugagccacugugcccggucuuucaaccccacugcccacucugggacaggaaaccucugcuggccuagaugagcccuguguuuuccaaaacucgcuuaguuauaagaauuaccugguaugcucauggauauaaauuaucaggcccaccucugaucuacuaagccagaaucuccagaugagggcaccccaaguaguucuuaccaaccgggguaucuuggaaaucccaggcuagcugacauguccuccacauguuugauuuuauucuugguccuaacauauacaggggagaggagauauuucuguuaguugcagagugugggcguaauggggagauggccuauguaguucacaaagaacucccuggauggcugugauucacucugagugaugucccuucuggaggaggauucuugucuggcagaaaagacccuggguggagggcugaagguccuggguauaaagcuccacugcaggaugccugggucaccaugggcaaguuucuucucugcucuaggcuucuguuucuccauuuguaaaacagaguugcaguggugguuuggaccugauccccucuggaagccucuuccauguuaagugguaagucccucugcucauggugggucuuggacaccaugguggcaacaucuuuaucccagugaaacuuugcuuaaugggcaaaaccugcaagaaggcuuuugagggaggccaaguggcaaugugcauguguuacuuuuguuauuucaaaaaagcuuuuuaaaaaaggagcucugccaaccagauacuacuggucaguguacuggacccauggggccugugacuuuuuaaucaccagugacugcuuucuuucuuucuccacaccccuuagauuucauguuugcaaugcuucccucugcccaaaugcauuuauuaaguaguaauucauuuuuacuuacccaagacacauauaacugccaacaagguuuuuagcauuaggcaacaguaucacccaacuaagcugauguaauuccaccuacuuccugcagaaaucugaccuuuuaauuauacuggaggcuugaucuugugguaaaagugugauuuugaagaaauguuuuauaauagcugggcacgguggcucacgccuguaaucccagcacuuugggaggcugagguggauggaucacgaggucaggaggucgagaccagccuggucaaccuagugaaaccccaucucuucuaaaaauacaaaaauuagccaggugugguggugugugccuguagucccagcuacuuaauuaaggaauguauguauuuacacauagcuggaggacggggagcccuuguaauaguaauaacuacuguuuauucagugcuuaccagucaggcacacugcuaagugcuuuaccugccagccuuccuauuacaauagcucucauacuauuguucugcuuuuacagcugaggaacaaaggcucuaagagguaaacaacuugcuuauggccacuacaaaguagcaaguggcugaccugauuugaaccuggcagugugaucuagagaagccagcagguaaggggcugaccccacaccaagcagagggcagugaaaugagcacaggcuggaccggcugccguugccuuauggggagauggagggagcgcuaacaggugggcacuaagcaaggaggcaucagcccagauagugauguuucacucucaauguguguauuaagucugcauucaaaagaaaaauccugcccagagcaaauggauuucggacuagcugccccuuuguauuauccacagugcuucucuccuguauuuucacagaucaucagaguuuuucuguaagcugacaaaauucaugugcucaagcuguuuaaagacauuuuuucugcacauuuucuauacguucuuccuauagcccagaauguuuucuuccacagcuucucuaugaagugaggaauucaacucacccuucaaggcccaguucaaaguuuacuucccuuaagauaucuuuugacccucuuccuaguccagaaaaaaaaaaaaucacuugcucaguauucccauuguacagaauuauacaucaugcuauuuaagacuaucucauaugaguuuacuaauguuuaguuugugaagccauuucauacauuuuuugucaauugaucaggacaagacauagguucacaaucccuuuuccaaaacucuuggggccauguauuaucuacauacccaaugggggcuguuguagcacccugugaucagauacaugaauguuucugcagcaaaauguaggaauacucaggcuaagugggaugaauaaagaccacauaaaaaccucguuagaucguuuccuucaaaugaguuauagaaaaaaccugucaguuuccagcgcuuucaggauuuuggaacugcagauacaaauuuaaacuuggauucaggucuuucagacucugaguucagagcucuuuuuacuuaucaccuaguuuugcagucagaauauguguauaugugcuaucuccuuguuagacugugagcucccagagggcagagaaguuuuagucuuaacucacuguugagcaaaugucugggaucgaacuuuucucacuagugagaaaauguggcauaacugccagucauggccaggcaugguggcucacgccuguaauccuggcacuuugggaggccgaggaggguggaucaauugaggucaggaguuggagaccagccugaucaacauggcgaaaccccgucucuacuaaaaaaaaaaaaaaauacaaaaauuagccaggcaugguggugugcuccuguaguuccagcuaucugggaggcugaggcaggagaacugcuugaaccugggagguggagguugcaacaaguggagaucacgccacuguacuccaaccugggcgacaaagugggacuccgucucaaaagaaaaaaaagugccagucauuuaggaaaucaggcgcagggcccaaaccaaagggacuuagcuauuugaacuugcucuuccucguuuuaggcuguuuaggaaaauacuccugcaagaugggcucaaauaaagauggagauuauccuuaagagcauucagucuaggcauacacaucucacgugcagugacacugcacuucuuaaaaaucuagaugaccguggucaagaugagaauacagguagaucucaguucauagaugauggguagagcacagaucuugagugaagcagacagcccuggguuugaauccuaccuuggucauuuaucagcuagauaaaccucagaauauuccuccguaaaaugggauaacacgagaacucaguucacgggauuaaaugaguuaauguauguaaagcauuuaugguaguaccuacacaguagaugcugaagaaaugacagcuguuaucaguuguaggaauauccaaggaaaccucuggaacaauucccugguuauaccucugaaaagaaucacugagucacugaaaggaagacagcaacguuuuggaaaauucaaguaaacguaauucaacaaauauuuauggacagucgaaguaucagauacugugccaagggguuucaugaugaauaaaggugggcaugguagcacgcaccuguagucccagcuacuugggaggcugaggaaggagaguugcuugugcucaggaguucaaggcuauuguguaccaucaucacaccugugaaugaccacugcacucuagccugggcaacaggagacccugucucaggggaaaaaaaaaaaauccccuucucagggccuugauggacugggaacccauccguggaaacacugggagaagggcuauaauagagggaggcuuguggugcugagguuggcugacagugucuagccuggugggaggaaggaaacagaagauuagaaaagggucuuuggaagaaaggauaccauaguuugaaggauaaauaggcauuuacagggcggauggagaaaagacaaaagguuuuccugccagagggaaugacaaagaaucugacccaggaguagaccaggcaacagguguaaucugcauaagagccaggagaauggagaggauucaauaauguaaaaucucuuaaauaagcgacacuaaugucacuuggugaucaguuccauguggcgggagggaagagaagucuuugauggcucccaggccuuuggcuuggacaacugaaugcugagcuagggaggaaggaagaguagauuuggagaggggacacaggugaccugcaguauggauacagagcagagagugcucagggcuagacauacagaacugugaguuggcuggguggguggagucuaggagagucgaaaaacuuauucugggugauuucacugaacaaugaaaugacaacuuaugucgauggcuuacugagcuccaaguaugcuuaacauuuuauauacaugaggacugacugccguucaguccucaaaaugccuauguggagggugguaucacccaaauuuaauggaaaggaaacugaggcucagagaaauaauuuacucaagagucuugaucuuaagcuagacuccaaaaugcaggcuguugaacccuacaccagcauucacuacgcugugugugcugaauuuuucuuggagauacuguuagguauuucuuuucuuuuuuuugagacagagucucgcuuugucgcccaggcuggagugcuguggcacaaucuuggcucacugcaagcuccgccucccggguucaaggaauucuccugccucagccuccugaguagcugggauuacaggugcgugccaccacgccuggcuaauuuuuuuuuuguauuuuuaguagagacaggguuuuaucauguuggucaggcuggucucaaacuccugaccucaugauccacccgccugggccucccaaaaugcugggauuacaggugugagccacugcaccuggcuguuagguauuuccugcgauccaauuuguuugggaaaugcugccuacuaagccccuuuucuaagauucugacuacacguuagucauaaaggcucugagaagucccggaauaaagaaacccauguggccugugucauccagagcuuuccagauuuaaugugggcugggaacauuacaguauuuucacagcacagccugccccaaacagcaguuugagaaacgaugcucugggccccucguucucuucuuugucuucugggaagcccagcagcucugccauuugagauucacugaagugggagagaaggagagugaagagggccaagcaggggugaggguuuaggagaugggaaguuaaguugaagcugcaaacacagguggauggugucgggggcuggccccacauuugcugcaagccuggggguggggggguccagcugccucucaccagggaggccagccuuggccugccccagggaaugccaucaauaccacagacacugcuguuccugcagacagugcuaaccauguugucaaggauaccauucugcugagacaggagggaaaacagggaccaagucugaauuccaagaguuaaaccucuaguguaaugauagcaauuucuucccuguucuuuaaaaaaacaaacaaacaaaacucaccaaaggaaacaguggcuauguuuuggaguacaaaugaggcacccaacccagccuggcuagaucucaaauugcuucccccauaccguucacguccuccgugaauguaauggcgccaugcaacucgaggggaugccacuguccucaaucaacagaucccagccuggauaaggucacaauggcuccuuugaggccaaggcuguacaccugugaugccauaugaaguacaagggagacaaaagcaggcagaagaaagagccuuuugagaggggggaaaagaggccaguacccuggggacuggcacaguuauacuugcuguguaaggugggcauuagcuagcucugcugagauaucuuuccugcguuccacauuuaauuagcaaucauuuguacuuaucuuucaucuuuuacucaaucacaucaaacggucaauaucauuuugagcaggaagaagagguagggagaaauugucacuggccagagacuuucucgucuacuuaguacagaaccaagaauguuugugucaucacagggcaccgacuuaguacagaaucaagaacguuugugucaucacagggcaccgggugaauguaacugacccuccugugguccuccccagucugucugugguccccuggucaccaaacugccuucugugauucagugaaaugccuggugugcuagguacauuguucugggauuugacuaauaauuaauaagcagggcacaacuaggcaauugugaaggaaugaaguuccucagcucgcagcuuguaagggccuggcucccagggaacuaagggaguccugggcucucggggagagcuccuuugccugagcaaagcuccuuuguuccaggugguuuggugugcuggacacagccacacccucccugcaccucuuacggcuuccaggacucccaccauucaggacucauuuuuuggcucuuuagcacaauuguuuugaacugaaggaaucagagacuuagggcaacuucuggaaguuucuacccaguuggcaaagaaaccuucucaauccccuacuuacccuaaacuaagaggaccagaaagucugcaggccccaugauaugcuacaucugcugacaccagggaaacuccacuacaagggaguugcagucugucacucaacuugcugaggaccaacucuugggggcacagucccuaccugcaagcugcuuggaucucuuugacagguaaaaacacaaccaugcagcuccugucuggcuggaggcugggagggcuauugauuguguaaugaaccaagggccaagaggggguccuugguaacaucuugugcccaggaucccagauuucaaacaaaaucauugcucccuggaggcugcuggaacaaccauuggugagcaggcagucaaugccuguguuacuuuccuagaauugucacagccggacaauuguuggagcaaagaggauucacgucucaugauaauuuccauggcugcaguguuaugcugagaaggauguugagggcccgucuugucuuggcaggaagagcguugucuggggagaaugugauaaagagguguguagguuuugaggucuacagaaagggacugugaaggucugcauggggacagcacacauacccauauuuaccacugcugaccuuggucacucucuucauuuuaucaaggaguaacugaagauaauuggagacuaacgugauuuccucacugccauaauuaguggcagaggugggacuggaacacaggcaagaaacaucccaagucacagguucaccuugugucaucuuugcuuuuccuucucuaaaaugaggaccccucccaccucacccagggugggaaaggccaguucaucccagagagcugcuaggagagggcaagagacaacuuggaguggcuccgaggggcagcuuuccucccggacucucuggacggagggaaaaccccagucuuuugugugauuccuagggggugugccugcagcuuucaccuucagaggcaacagugagaaaaccaggguagcagggcuuggcccuaaacuccacagccuagucuaaaggccagauggaagguaauguaugaguuauaggauguggaauccgcuuaagcuugagcccugugaucuaaggguaguccccucugagcugguuucagcagacaccuuucucacaggauuacaugagugcacaguaggcagucaacaaauacggacugaucacacacaccauguuuucucuucccucggggucucugcacaugcagguuccucugcuugggacauuuccccacuuucucuccucauacacugcucaccggaucucuggagcacucaguuuacacccugucucuucagagaacacucugacuaacccgaggggguuagguaacccccuucuggguguccacaggacucugaacauaucccaucacagcauuuaccccacuggacuauggcggccuuucuccuggauuaggcugugaggcucugagggcaacgaccacaacagauucaacucuguacccucagugccuugcacucaguaaacucucaaagaauacaugcuggccaacuuacuauaucaaugccuucuguucccacuccauucaugaccacaauaaagagcucuaaacagagcaccaaacccaaaaugcuauuuuuuccccaaaguacuaaaauguggguuuaaaaaucaagucaccugcaguuuugcuuuauauuaacuguaaaaagaagaaauuccugagaguaaacagugcccuauagugagaauggacagacuggggccccacuaccugcuccuccaaaguccaucuggcuuaagacagaauggguaggccgggugccguggcucaugccuguaaucccagcaauuugggaggcugaggcagguggaucaccugaggucaagaguucaagaccagccuggccaacauggcgaaacccugucuucacuaaaaauacaaaaauuagcugggugugguggcacgcgccuguaaucccagcuacucaggaggcugaggcaggagaaucacuugaaccugggagguggagguugcagugagccgagauugcaccacugcacuccagccugggggacagagccaggcucuaucuaaaaaaaaaaaaaaaaaaaaaaaaaaaagacagaacggguauauguccacggguuuccagcuccagcuuaguuucauuguuguacuagcagcaggcaggugagaaagccaagaugaucaggaugcuguuuuacaaaagccucgggauccugaaaaggggaggagacagagaaugguauuucuaaacuuucccaggauuggggcugcccuuucuacagcguagaaauuugggguuaccugaaugaccuacaauuucaccuucucuucugaccuuuuucccaauuuuauaguccaucucauucucaaaaaucauuugagacuuugggagguugaggcagaaggaucgcuugagcugagguguuugagaucaucuugggcaacauggugaaaccccaucuauauuuuuuauuuaaaauauuuaaaaaaguuuauuugaagaaaucauuugaggugacugcuguuguuuccucaggccuaugucuauaucaaggacuuuuaauaaagaaggggcauccuagcuguaagaucucggauaagugccuuucaaucuacuugagcuucaauuuccuuaucuguaaaguggaaguaauaauaaccaaacuggaguguuuugauuuuaaaaccccguaauauacagggagcauuuaguccaaugcuugcuauacagcagguauacaauaaaugaaagcuguuuucaccagaagauccagagaauggcaaaguucugagcggacuuucaggaaaaaaagaaggcaagagaagaacuaagcguuucugggaacuaucuuuuuuuuuuuuuuuuuuuuuuuugagacacagccucacucugucgcugaggcuggagugcagugguguggugcaaucucagcucacugcaaccucugccuccuggguucaagcgauucuccugccucggucucccgaguagcuaggauuacaggcaugcaccacugugcccgacuaauuuuuguauuuuuaguagagacaggguuucgacauguggccaggcuggucucgagcaccugaccucuggugauccgcccgccucggccucccaaagugcugggauuacaggcaugagccaccaugccuggccccuggguuucugggaacuaucugauagggaaucuagaacucugcacaagggacaguggcuauggagaacucugaaauuucucaaauguuugucauucuucugcacagucuuacuuuacuuagaucuacaguuuaaucuuuuaaauaaaaaaggcccaaauacuuauuuagggaaucccauuuuggaagaaagggaaagaaacuaagcaacaggggaaaauggcuuaggagagaacagcugcaauguuuggaggccaacaggaaugaaaacagggacgugagaacaggagaaaccuggaggccuccuuuugaggauucagaccugagaaggcuguuccucauuccuucccuccugcuugcagagguguggcccacagcgcaagcaucacaaaccacacuaguucugacaaugcucuguucagacucuagguagucccaugaccccuaccugguguaaccugacccagacagccaguuaccaggauguguaaaggacaccugauucuuucugugacagugugguuacccuaaaccuuguaagacaugacuacaaagagaaucccagucucuggcuucaguccauacgagaacaaguaaagccgccugaaucugggucagaaaguaaaguugcccuucuggagcacggagagaauuacugcuugucugacaaucuguauccacaaggcagugguucucaagccuggccugggcagcagagucaccuggagagcuuugaaaaaaacagaagcuccaagccauccuagaccuacuaaguaccucaggaguggggccuaggaauacauacgguaguuucuaaaagcacuacaggucaagcuggguguggugguacacaccugcaaucccugcuacucaggaggcugaggugggaggaucccuugagcccaggaguucaagaccagccugggcaacauggcaugaucucaucucaaaauaaauaaauaaauaaauaaauauauauauaaaauaaaagcugucugauauuuuaugugggcaaauacaaaaaauaaaagcacuacaaauggugacugugcugugaagccaaaguugaauauaaugcuuuguggaaguaucuuuuuuuuuuuuuuuuugagaggaagucuugcucuguuacccaggcuaaaguucaauggcgcgaucucggcucacugcaaccucugccucccaguucaggcaauucuccugccucagccucccgaguagcuggaacuacaggcuugcacccccaugcccagcuaauuuuuguauuuuuaguagagacaggguuucgccaugaucugcccauguuagccucccaaagugcagggauuacaggcaugagccaucgcgcccgguuggaaguaucauguuuugaacuagagggaaauuacugaaguuccacagaaggacauaauagaagcuuuuuuuuuuccuaaguggcaucugcaaacagaccggucuguuccagcuucucuggcucuccaagaggagggaaucaauuaggaggcaacugcauucagcugaacuuucccaggccuuccucaucaccacagcagaacuuaauaaaagguucacuuuuuuuggaaauuuagauuuagauugaacuaacauuuuaggagcaccuguuuuguggcagguccugcugcagacacaaacuacaaguccgugggagagacacuacaugguucucauuugggguacauuccuggaaauggaggaguguucaucagagcuguaccaguuccuuacaacgcaguccuuagugagaugucuucccugacacaaugcuuuauuaccuacgaucaacauacaauuuggaguuuacugacugaugugucuucuugacauucuuuucguuucuauaaugcgggauguggcuaggcugauuggaugaccuugaauuuaucugaggcuuauccucaccaccugucaaaacaucuagcuugauuuuuuuuuuuuuuugagacagagucucgcucuguugcccaggcuggagugcaguggcgcaaucucgacucacugcaaccuccgccuccuggguucaagcgguucuccugccucagccuccugaguagcagggauuacaggugcccaccaccaagcccggcuaauuuuuuuguauuuuuaguagagaugggguuucgccacguuggccaggcuggucuagaacucgugaccucaggugauccacccgccucagucucccuaaugcugggauuacaggcgugagccaccgugcccagcucuagccugaauuuuaaccauuaaaguaauaccacauuugcccauccuuuggaaaauaaucaaacuauuugcugggaaucaaagaguuaaaaagaagguacugcacaagaguaugcagguguuuuuugguggagagcacuacauagaucuuaggugauuaccacuaugaacuuugucuguacugucuccauuuuuuaagaugaugaaaccgaggcucagagaaccucaguaacuugccaaaugcaaagcuaggacaaggauuugaccccaaguauuuugauucccagaccugugcuuuugcuuuagcuccacuucaguggccccaauagcccuucugaauggcuauuuaugugcagauuuacaaugguuggcaacugacauacuauuuuuaucaaccacgugcaaaaagcaugaauuaagauccaacagaauuuuaggaggaggacaaagucauaaaaguaacgagaaguugaaugacuucucuaagaccaaacagcuacuaagacguugagccuguauuugaccaaauauagauacuugggucuguauggcaccaaagcagcucuuuuuaaccaagccaagaugcauauacggugcaguggagagaaacaugaguuuggaaucagaagccauggauuccagucuccuguuccaaucacuuauuagcgguaucacucugggcaagucccuugcccucuggaaacaaugaucuaugaccuacucuuuacugacacaugaagauccaaauggauguaaaaguauucugaaaacuucuuccaaauaauaauaauaauaguaagaacucacgcaggucagucagacauagguuggaauucugacccugucacuuacuggcugugugaccuuggacgagugauuuuaccucuucugccucaguuuucaucugcaaaauggggauaaaucaauaacuaccccaaaacauuguugugacaauuaaaugagagcauccauuuaaacaagggauugccugacacaauauucgaucaauaaacaucagccauuaauacccugauaauugccucucgggucuucagcuaccuucaaguacggucuuucugaccuaccaaaaacgcccugggcuucggcuucgguuugcuauucucugcccccuuccucggacccugucccucucuucccaguccgcagcucguguuaaagccuuccagaaaccccaguccccuuccccggcuucggcgccgucucuuacucgacgaccuuggcuggauccccguggugcccauagacaagcgcccggacccgggcaggcucggcggaugcggaguaggaggaggcggcagguccgugacagccagaagcugggagcagcccccgccacugccgggcggggguucgcacccgccacaggguacugcagacccacaugcucgcuccaaccaacacagagccugacgcccc

SEQ ID NO: 14148 - RNA, 5458 nt, Homo sapiens
auaaaguaaaccaacugcugaaaaaaaaucucuaaugaugaacuaaccaaacucaagcccaugguauugaguccacauugcagauaacagcccaucucuaacagaauauauauucacauaguagggugagaaaaacagaacaaucauuauccuaaacaccaaacaguaaaacuaaauccucccagaaugggagguagagaggaaucugcaucaaauaugaauuuagucuuacucuguaacuacucuaugagccuauuugccaacuuuguuuuagcuauucaaaacuuucaaaaaugaacuaagucagcuaagguauuucacuuuuacacugcaaauaguuuguggaucaaacuaucauuacccccugcaaucauaacugaacuuucuuuuuugauauuuuaaagucaacauggcuuuccugaaagggagggcagauacaaucaucuguguccauuucaauuuucugacacuuuucaacacuaaggauaaaugaaauugaaagcuuucaaaaaaggggaaucaacuauugccugaugacaagaaguucgugaagacucaaccacaaauuaaaaacgauuugaaaaaacucgagagaugaaagucacauuaccaauuuagaauaaaacucuugggauuuaauauagaauuacuuuaucuguuauuccuacuuaaagaaauaaagguuuacacucugcagacagcacuaccugauuccacacaaaagcuacaaacaaaaccaguucauacuuaccucuuaaacaacacaaugagcaggcugccagguguuaaagcuucauuaaagaugaugccucuuggaucaucuuggcuguaugaggcaccaugucccucauaaucgccccuggucccugggcuggagucuguuucuucauuuucauuuuugguuaaagaugccacucccuaugcuuuuauuaauuaguggaugccacuaauuaaguauuuuaaugaauuuuucaaauucuuuuaaaauggauggaucaauagcuucauuucaauuacaugaaaaccuuuccaaguccauguuucuggucugugguuccugacucccuugccugagccuccugcucugucugcccucuucauuccugaaggcugaauucaaaccucccucuuucagacuuccucuucucucuaggucuugggggucuuuguucaugaagguccccuuucuggcauaaaaaccuaaacccaugguuggggaccugggagaaauaaagugccuuucaagcgcuucuucagacauugcgugcaguucagaaaucuuuagccugggagacuuucaucucaacacacagaaaacucaaguaaaacauuuccucaaacuaugggcauacaaauucagagcauaaucuaaucccucaccuucaggguacuauaagaccagacggcccuaggaaugacaauaaggcagagaacauuuacuuguacaaauccuuccucagccaaccacgauaaagcugauaccaccuuacagcuuuucaaagaguagccugaggaggagaaucacuagcagucuccaacuaaggacaacaucauaaaaaauaccaucugucucacuuuuggcaguaacuugucagcuugcuggaagccucuacagagacuaaaggcugaacaagcccggaaaccugaacuacccucucacccucagaggcaauccccaaaggacaggacuaaaggaaauagcaugagggaagcuuugaaugucaaugcccacauguaucuaguaugggaauuuaaaaaaucuucuauuuccggaguugucaauaacucauuuuguaaccuugggccagucaccuuaucaccccaugccucaguuuccccaucaguacaaacuagggacaacacuuguucauaaaguacuuugacauacucaguugaaaaauaagucauacaaaugcauuaauauuuucggaaguuuuaagauuucaguguuagcuuacaaauuuguaaguaucaccccaacgguauucucucagaugccuggagcaccuuucuucugaggagcucaaaguaaaauuugcgguucuggguaccuggaagcauaaaaaaauacuagaaacccaaaccacauuuuauuaccgagucuauauccugugccuaucuuuuaagaagggacaaauacuucguauggcccuuaaauucauacaguaccucaaugagaaaggaggagcaaaacaguauauuaaacugaagaacagggauuuuaaaugacuuagucaaauaauuacaaaugauguuuauucauaccacaaacugaagggaccaagaaccaaggaguggaggucuugaaccagggcaauuuacgcuguuaacauuuggucaaaaaucucaauaugguauuaucucuuggcauugauuuuucaaaaugacagaaaaaaauuaaauuccccauauauugggggaaaaaaauaauacacuuuuuugggggguaaguugacuuuaaaaagugacuuuuaauaaaaaaaaauuugaucacauuuguaauaguuauauuacuaauaaaacaaugacagaaugcuacuuaauucauaguccuaucucuauuuauuauucauucaagaaaaacuuccugauuauuuuucacuugguaaauuagcaucuuuuauuuuuauuuuuuauuuuugagacagagucucacucugucacccaagcuggaguggaauggugugaucucacacugcaacuuccgccucccggguucaagcgguucuccugccucagccucccgaguagcuaggauugcaggagccuaccaccaugcccagcuaauuuuuguaauuucaguagagacagggucucaucauguuggucaggcuggucucgaacuucugaccucaggugauccgcccgccuuggccuccuaaagugcuggaauuacagacgugagccaccacgccuggccagcaaacacaacagggguacuccaugcuguugaagugcccaucacacgggcaugcucauacacugcggguguuaaguguaacugguguagcuuuucuggaaaguuauuugguuauaugcacugagauacuugaauauguucacuccugcugugacacaugaauuuuauuucauggaauccauauguacucagggauaauaaaaaugcaaacaaaguuuuaugcacauaauacccaucacaggguuacuuauaacagcaagaauuaggagaccaaaaaaaagguagacaauauaagaggaaugguuggguaagucauaauauugccauacaauggauuuuaugaagccauuaauaaggaagauuuuaauguaauagaaaauacaugagauaaauuaaguaaaaaaagcgugacacaaaauugcacguaaaaccucacccaucuuaaaaggaugcuuaaugauacuuuucacuuuaugcuuucauaauaucuaaaugaucuacaauuaaccuacauuuauucucuaaugagucaaaaaggcuuuuuuuuuuuuuuuuuuuuuuuuugagacagagucuugcucugucauccaggcuggagugcaguggugcgaucucggcucacugcaagcucagccucccggguucacgccauucuccuacuucaaccucccaaguagcugggacuacaggcgcaggccaacaggcccggcuaauuuuuuuuguauuuuuuuuuuaguagagauaggguuucaccauguuagccaggauggucucgaucuccugaccucgugauccgcccgccucggccucccaaagugcugggauuacaggugugagccaccacgccuggccuaaaaaguuguuuuuuuuuuuucuuuuuuuuuuuuuuuuuugagauggagucucacucuguugcccaggcuggagugcaauggugcaaucucggcucccggguucuagcgauucuccugccucagccuccuaaguagcugggauuacagcaagugccaccauacccagcuaauuuuugucuuuuuaguacagacgggguuucaccaugcuggccaggcuggucucaaacuccugaccucaagugauccgcccaccucagcuucccaaaagugcugggauuacaggugugagccaccgcaccugguccaaaaaguucuugaauuuguuaugcuugauaggcuaaauagacaagccuuaaaggcugccaaaugauuuccucauauauaauucuaaacauuuuaauuagaaaaaauuaguuuaaaaaauuauaauaaagggcacuguucagaaaaguaggaacucuuggugggugcgguggcucacgccuguaaucccagcacuuugggaggaugaggugggcggaucaccugaggucaggaguuugagaacagccuggccaacaaggugaaacugugucucuacuaaaaauacaaaaauuagcggggugugguggcaggcgccuguaaucccagcuacuugggaggcugaggcaggagaacugcuugaacccgggaggcagagguugcagugagcugagaucaugccacugcacugcacugcagccugggagacagauugagaccccaucucaaaaaaaaaaagaaaaaagaaaaaaaaaaauaggagcucuuaaacaccgcagguggaaacguaaauauuaauuuaccgaguaauggaauagcuagcaaaagcauuaaaauguguauaugcuuugacucccaaagucuacuugcaggaaucugcccuaaggcaaaaagaaauguauacaaaaauucauauaaaggauauucaacaguauuauacaugcauaaaauaguacaaaaauaaagauaaccuaaaugccuugcaacaugguucugauuauguccauuaaauaacauauguauguuggaguacuauguagccauuagaaaccagguuguaggagaauacuuaaugacaaaggaaaaggaucaggcuguuagggugaaacaagcaaauuauaaaauaacuuauaguaugauuccaaguuuggaaaaaaaaaaggagucaggagaggcauaagaaaagggagagacugugcaggagauagguuuuuuuuuuuuuuuuuuugauggagucuugcuccaucaccaggcuggagugcaguggcccgaucuaggcucauugcaaccuccacuuccuggguucaagcaauucuccugccucagccuccugaguagcugggacuacaggcgugcgccaucaugcccagcuaauuuuuguauuuuuaguagagacaggguuucaccauguuggccaggauggucucaaucucuugaccuugugaucugccagccuuggccucccaaaguguugggauuauaggcgugagccaccacaacuggccgguggguuuuuuaauuaaaaaaaaaaaaaagaaaagaagagagacagagugcgugcgugcacaugcccauaccuguaugugaaaaaaaguaaaacuaaaaaacccaaaaugcaaagaguuacaucuuuggauuauuuugguccuucuccauauaaaaa

SEQ ID NO: 14149 - RNA, 1159 nt, Homo sapiens
cugcgggcuccagcgcggugguucuuuaggaagcggacgcgagcagugaggacgacccuggacagcuaggcccugagccuccucuccugcggccuggggcgccugggcgggggccgcgucuucucccucgcccucccuuucgugggggccacaccgcacgcagcucggcuacuccugcugggcccgggauccaggccacaggccgcaggcagggcgcggccagcaaucgggagggcuuaagcugugcggcccggaucccgaggcgcaggggcggugcugcucugaccgggccacgggccacggaggccucgggcggaggaggcgggaaaggaggccaggcggcgggaaagggggaugauucauccggaggagcccgaauuggaaacgucgcaaccugggaacagccuugcccgggccgacgggggagccgggagggcauccguccggcggggcccagcgcccggcaccggcacccccgccugcugccguggccccagcacgaccgcugggggagggagaggccucucaugcguggacuugauggaaaucuugggcgaagucggcgccgccucuccuccucugccuggcuggucuugauccgagcggucuucccggugucuagcucaagucgcuccugcugcagcuucgcugcgggcggaggaggucuggaaggagggggcgggcagggagaggcuggagccggugacgcccccuccucccgcgcugcgguauguaaagcacaguaggggggagguggggcccggcgagcgaccccugcggaccugggaggcccgagcgcccccgccccauuugcuacggugcagccacgugcggggguggggucgagcccgggagguacuuacccuggagacgcggcagcugggggccgcacguuucccgaggcccaagacccgcgggcuugcggaccggacgcaggcggcagauuugcagcccgggaugcgccagggaacagccugcgccccccucccuccucuccgcccgcuggccgggccaacuccggcuucugccgcgcgugccuggcucggagcuccgcugcggaaaacccgagcgcgggcggcuccccgccucgccgcccgggaaaauccggggguggccgccagggaucuccaagcggccugggcugggcggccggagcuuc

SEQ ID NO: 14150 - RNA, 3823 nt, Homo sapiens
acagauaccucaaggggaaggggaacacaaaguccacuaggggaggcugccuggaagagaccuaguguucugacagcgguauuuauaggaaguaggaagcccgcgggaguggucuuagcucuuacaugaugugguuuuccugguaagcuaacuaguuccugguacccagagaaguuaagaagcuugaccaaggucacacagccauaaacggcacuggcacagcuuggggguugcaccucuuuguuccuggcguugucuccuuggugcuggaggcgguaggaugagaagcagguaaucauaauguggugggguuggggacacaaggggguccuuccagauucaaacagccucuuugucacaggggaaguccaguagugggcaaaacagcaagguaaaaugucaaggccucagggucaagcagagcaggggggaauccuggcucccccaccgauuagccauguggccucaacaacgucaguucacccgucucaauucuccuacaggauugcugcaaauucagaggaauggucuccaaguacccagcccauggccaggcuuagaaaaacaccauggucauuauuacuccacagugccagggcagccgcagaagggugacaggacuggauguccaagggacaaguagacuuucagugccaacagucccaaccuacaaucacugggcacaaguucucggcagggcaggggcuaucaggucaggcccaugaugcaaucacagcucucugccuaugcuacaaggugaaccaugaccuucaggaaauugaaagaacagcccauaaaaagggaguaugaaacaaaaccucagcgaacguuuauuucucaucauauggaacugguagcaaagccaaagauuucugcacuugaacacuggauaccacucccuacccacccagugaacauuuacagucaucacaugcccucuagaacccagauccccaugccggggccucuucucuccugcacaccuucuugcagggagggcuuucaggccggaagggggugccgguugcuucuccgcgccugcacggguauuuaauguggcacacuggccaggcuccucuccugccccgcccagcagcagcacggcccuugccuuucuucagugcccuccaaacuggucagagaggaggcacagacugcuagaagaagggcaagagaagucguaauucacagucauuugcuacagaaagugccuggaaucgguccuuggcugcuucugccuggaagcaacccacuuaagccccaggagaggggacagaugagauacugggaugggggugggaguccucagaaggcacccaggagacacuggcugcagaaauggggucccugaucuugcaagaaaauccgcuugcuguuggcagguuggccugagaaucccaggggcagcuucagacauuguggggacucagacccacccucucagucugcagcuguggcagucagagguuuggcaauguagccauggucaccuggccauggcccaggggcaggguccaaacaagaacccuggugccucccgccccuccugcugagccauggugccaccuaagccaucuagaaaggcucaacuuuuugggagacaucugcggcagggccacuggaggcaggagaguggggugcuggccucugcgaggcaggugcagcucugggagaacagaauucucccucuccuccuccucucacacacuguggcuccagguuggaaccucaagcauaaaggaccaaaauaaagaggauuuauaaucuaauacucccuccucuucagaaggcaaugugaccagcaaaggcucaaacucucuagagauaaucugcuuuuuuuuuuuuuauguacuuggccucucuccugacgccucacaccauuaagcauggagaaaagggaaaaagggcaaaggaagucaaaaaacugaacuaggauucgggcaacagccucaggcugcccaacagaacaggcuuuuagggaacuggacacacagaccagcugugacccugacuuucacauugaugggugaauggcaaguaggagguaaugaaaucuggaaaugacaggggagagaaggcaaagcugccuggagugucagucccggaggcauuugccccucucccccgggggccagccagggacuucccaguucaggaaggccacaacacuuguggcacauuaauuccgagcuuggcccggcuucuuuccugugcccucugccucugugggcaggggaaggaggaaggguguggucccuuaggaucuccaagugcucuuccagcucccaggagcagggcugagaucccagagucagugcaaugaacuguccauuccagugaggaaaagggaggguguggcuucgggacugcacaucacacacaagcccacugcagcguggggagggugggcaugggacacaaaagggucuggggcugucuccagacagagaaguccuuguggggagcugaaccgggcccagguccugcucaggagucaggucauguagcgggugauggcacggagggcguacagcagagcggcuugcaugcgcgccuccaggagcagcaaguucacguggaccuggggcacagaggaaggcauguuggcaacugaugucacuccucacccccacaccccucccagacugccuugaucccugacccacuuaccucaccauuuccuuuccuacagagcugccccagcaucugcuaaggcucugagcaguuuaguacaaggacaagcacauucauuccuaucaugacuaagcucuguauucccuaaagguaaaauggccaggugcgguggcucacgccuguaaucccaacacuuugggaggccaaggcgaguggaucaggaggucaggaguucgagaccagccuggccaacauagugaaaccccaucucuacuaaaaauacaaaaaguuagcugggcauggugguggaugccuguaaucccagcuacuuggaaagcugaggcaggagaauuacuugaacccgggagacagagguugcagagguuuauguacauuuuuuuauuuuaucuucccagcaaccuugaaauacagcaguauuuauucccauuauaaaaaugaaaucccagcuacuugggaggcugaggugagaggaucacuugaguccagaaguucaaauacagccuggacaauauagugugaccccaucacaaaaacaaaaaacuuugagaggcugaggcaggaggaucauuugaacucaggagguugagaccaggauggacaacacagugagaccuuaucucuacuaggaauuuaaaaaaucaggugguguguaccucaggcccucugggggcugaguugggaggacacuugagccuaggaaguggaggcugcagcgagccgaaaucacaccgcugcgcuccagccugggcaacagagcaagacucugucucaaaaaaaaaacaggauaaaaagcucagagaggccaggcacgaugacucacaccuguaaucucagcacuuuggaaguccgagacagguggaucacaaggucagaucaagaccauccuggcuaacacagugaaaccccgucucuacuaaaaauacaaaaaauuagcuggggaugguggcacacgccuguagucccagcuacucaggaggcugaggcaggagaaucgcuugaacuugggagguggaaguugcagugagccaagaucgugccacugcacuccagccugggcaacaaagggagacucaucucaaaaaaaaaaacaaaaaaacucagcgagauaaugugacuugccgaaagucacacugcuaucaagagauaguguuaugauuugaacccaggu

SEQ ID NO: 14151 - RNA, 3823 nt, Homo sapiens
accuggguucaaaucauaacacuaucucuugauagcagugugacuuucggcaagucacauuaucucgcugaguuuuuuuguuuuuuuuuuugagaugagucucccuuuguugcccaggcuggagugcaguggcacgaucuuggcucacugcaacuuccaccucccaaguucaagcgauucuccugccucagccuccugaguagcugggacuacaggcgugugccaccauccccagcuaauuuuuuguauuuuuaguagagacgggguuucacuguguuagccaggauggucuugaucugaccuugugauccaccugucucggacuuccaaagugcugagauuacaggugugagucaucgugccuggccucucugagcuuuuuauccuguuuuuuuuuugagacagagucuugcucuguugcccaggcuggagcgcagcggugugauuucggcucgcugcagccuccacuuccuaggcucaaguguccucccaacucagcccccagagggccugagguacacaccaccugauuuuuuaaauuccuaguagagauaaggucucacuguguuguccauccuggucucaaccuccugaguucaaaugauccuccugccucagccucucaaaguuuuuuguuuuugugauggggucacacuauauuguccaggcuguauuugaacuucuggacucaagugauccucucaccucagccucccaaguagcugggauuucauuuuuauaaugggaauaaauacugcuguauuucaagguugcugggaagauaaaauaaaaaaauguacauaaaccucugcaaccucugucucccggguucaaguaauucuccugccucagcuuuccaaguagcugggauuacaggcauccaccaccaugcccagcuaacuuuuuguauuuuuaguagagaugggguuucacuauguuggccaggcuggucucgaacuccugaccuccugauccacucgccuuggccucccaaaguguugggauuacaggcgugagccaccgcaccuggccauuuuaccuuuagggaauacagagcuuagucaugauaggaaugaaugugcuuguccuuguacuaaacugcucagagccuuagcagaugcuggggcagcucuguaggaaaggaaauggugagguaagugggucagggaucaaggcagucugggaggggugugggggugaggagugacaucaguugccaacaugccuuccucugugccccagguccacgugaacuugcugcuccuggaggcgcgcaugcaagccgcucugcuguacgcccuccgugccaucacccgcuacaugaccugacuccugagcaggaccugggcccgguucagcuccccacaaggacuucucugucuggagacagccccagacccuuuugugucccaugcccacccuccccacgcugcagugggcuugugugugaugugcagucccgaagccacacccucccuuuuccucacuggaauggacaguucauugcacugacucugggaucucagcccugcuccugggagcuggaagagcacuuggagauccuaagggaccacacccuuccuccuuccccugcccacagaggcagagggcacaggaaagaagccgggccaagcucggaauuaaugugccacaaguguuguggccuuccugaacugggaagucccuggcuggcccccgggggagaggggcaaaugccuccgggacugacacuccaggcagcuuugccuucucuccccugucauuuccagauuucauuaccuccuacuugccauucacccaucaaugugaaagucagggucacagcuggucuguguguccaguucccuaaaagccuguucuguugggcagccugaggcuguugcccgaauccuaguucaguuuuuugacuuccuuugcccuuuuucccuuuucuccaugcuuaauggugugaggcgucaggagagaggccaaguacauaaaaaaaaaaaaagcagauuaucucuagagaguuugagccuuugcuggucacauugccuucugaagaggagggaguauuagauuauaaauccucuuuauuuugguccuuuaugcuugagguuccaaccuggagccacagugugugagaggaggaggagagggagaauucuguucucccagagcugcaccugccucgcagaggccagcaccccacucuccugccuccaguggcccugccgcagaugucucccaaaaaguugagccuuucuagauggcuuagguggcaccauggcucagcaggaggggcgggaggcaccaggguucuuguuuggacccugccccugggccauggccaggugaccauggcuacauugccaaaccucugacugccacagcugcagacugagagggugggucugaguccccacaaugucugaagcugccccugggauucucaggccaaccugccaacagcaagcggauuuucuugcaagaucagggaccccauuucugcagccagugucuccugggugccuucugaggacucccacccccaucccaguaucucaucuguccccucuccuggggcuuaaguggguugcuuccaggcagaagcagccaaggaccgauuccaggcacuuucuguagcaaaugacugugaauuacgacuucucuugcccuucuucuagcagucugugccuccucucugaccaguuuggagggcacugaagaaaggcaagggccgugcugcugcugggcggggcaggagaggagccuggccagugugccacauuaaauacccgugcaggcgcggagaagcaaccggcacccccuuccggccugaaagcccucccugcaagaaggugugcaggagagaagaggccccggcauggggaucuggguucuagagggcaugugaugacuguaaauguucacuggguggguagggagugguauccaguguucaagugcagaaaucuuuggcuuugcuaccaguuccauaugaugagaaauaaacguucgcugagguuuuguuucauacucccuuuuuaugggcuguucuuucaauuuccugaaggucaugguucaccuuguagcauaggcagagagcugugauugcaucaugggccugaccugauagccccugcccugccgagaacuugugcccagugauuguagguugggacuguuggcacugaaagucuacuugucccuuggacauccaguccugucacccuucugcggcugcccuggcacuguggaguaauaaugaccaugguguuuuucuaagccuggccaugggcuggguacuuggagaccauuccucugaauuugcagcaauccuguaggagaauugagacgggugaacugacguuguugaggccacauggcuaaucggugggggagccaggauuccccccugcucugcuugacccugaggccuugacauuuuaccuugcuguuuugcccacuacuggacuuccccugugacaaagaggcuguuugaaucuggaaggacccccuuguguccccaaccccaccacauuaugauuaccugcuucucauccuaccgccuccagcaccaaggagacaacgccaggaacaaagaggugcaacccccaagcugugccagugccguuuauggcugugugaccuuggucaagcuucuuaacuucucuggguaccaggaacuaguuagcuuaccaggaaaaccacaucauguaagagcuaagaccacucccgcgggcuuccuacuuccuauaaauaccgcugucagaacacuaggucucuuccaggcagccuccccuaguggacuuuguguuccccuuccccuugagguaucugu

SEQ ID NO: 14152 - RNA, 919 nt, Homo sapiens
uaagcaggagagggaaaucuacaggucuagguugggcugaguagggcaaaagccuuuagaagaugguguccaaccauaaguagcucccaugaccagcucccaucauccucacucuugcggagucgggggucuagaaacaccugagaagccugaaugcaugcaggcuugcaaagcuaaggcgugcuggcgaggaaggagagcguagagggggugacagguggguaagggccgagggagucaggcugggaggcaaacguugggcggucggaucuagacacugugcgaagaaucuggggguguuucgcacgaccugaggagaacuccacgcgggagaugguaaugauaaaggaggaguugagccguggguuguuuuggagacccgccgguggaaacgguuugggggccugaaacuguugugcagguaacugggagugcccuauacguggcaacggucgggacaucaaggguuaggguauacuggauuggggcccgggaguucuguugggggauggggcgcccaaggcaccagguaggaacggguggggcgauuggcaguuuaaggauuggaaggccauugggagauccagggcuggacuugggacccggugagccucaccggaaauaucguuccucuucagccugcucucucuuuccgaaggccccaccggcuucccggauggagcccgcgccccggucgacauucucggacugcagagagacagggacacugguaaagguacggaagcaaagaugggauccgcccgcggggcuggagcagcggacacugccgcagcguaccugauccgagccgaagccucgggcuugcaugguccucacgccccacacgccaagccacguccgcgccgccaacgccgucacugccauugcugcuggagcugcaccucuggcgucucugccg

SEQ ID NO: 14153 - RNA, 10231 nt, Homo sapiens
aagucccgcccaccaggcccaggccccgggccgccccgagggcugcgcccaccuccuuccugccucggcaaccccgggcccugagggcaggccccaaccgcggaggagcaggagagggcggaggccggcgggccaugcccuggucgucccgcggcgcccuccuucgggaccugguccugggcgugcugggcaccgccgccuuccugcucgaccugggcaccgaccugugggccgccguccaguaugcgcucggcggccgcuaccugugggcggcgcuggugcuggcgcugcugggccuggccuccguggcgcugcagcucuucagcuggcucuggcugcgcgcugacccugccggccugcacgggucgcagcccccgcgccgcugccuggcgcugcugcaucuccugcagcuggguuaccuguacaggugagugcuucgccccgggaggggaggagugucggagcccagcaccuccgucagcugggucaccuguacaggugacacgccauaugccgggaaggggacugggagagggaaccaaguccugugggcgccuggccuacaggugagcgugcagcccuuuacggaaagggaaucccgguagacugccuucauucuagcccuagcuuuccuggcacaggcgaagaaacugaggcccagggaagaaagggaggcgcaugggcuuugaagucggaccucucagggauccacuucuggcuuugcccccucucgccucacuucugcauuucucugagccucaguuuccuccugcguagaaaggagguagucacccugagacaggugugacgggcaggccuguugugaagagugagcgaaagaaugagaaagugccucgcacagugccuggccuguaauggcaggggcugcggacucaguucagcaucccauguuucagcaugggcagggccuugggaagucacugaccucucaguggggcuguuugguugcuguucccauugggauggggauagcgccugcccguuuggugaagaugcagugaaaugacaucuguccacugcccuggcucagagugagcacucagcaaccucagcuggcuucuugaccugggccucccugggaguuucagcagcccugaccccaccacagcgcuugccccucacaaaggccgccucucacccugucugccugguuguauucuucccccugaaacuuggcuucccaccccagacccagcaagagggcagagauggccucugacucauccaugcccauggagccagccagggcugggcauaggcuggguccuggaaaauguguguggauucugcuccuuuuuggaccugguggagccucguagagaugggaaaacaaacccaaggcucagaggcaugcgacaaagucagggcagagggugguguggguugggaugggguggccagggccaggaucugcucuugaauccguuuuuacaaacucuugagaucuggccuugacaaagccacacggagucuccaggaguggaagagaggagcuuugaauguggcaguuuugccugagggauuauagagacaucagaaaaccccgggugggcaugaaggggugcaguuguuaaguccugggcaggccuccaugagccgugaaucuguaacuaccuuaugcaucuuuguggccaauauuucugcugagcuugagucagacagacuguacuagcuuuggcuuuggaaaugggucucuguuccugccugugaauuggccgaggcaggggucccugcuaggucacuggggaccauaggcaaaggcuccugcugagggagaaccccagccuguccugccugccugcuccucaguguguucuuguguccuuccaggggaagugacaguacaugucuggugaaugagcuugugaugagugaacgggguucucucccaauaggcaacugagagcaaaguucuggguggaggguccuuggugcauccuccacuuacucuucaugccaguggguaccccagaccugucuguccaaacucuggacucucuuaacuccgccccaaucuccauccuuaaccacucagggccagccucuuaaaugggaucccuccuuccaaucuaacccuccuccagccccuccccuguguggccggggcaaggcagagucugauuccaucuggccugugcccagaagugcccaagaggcaaauguccucuugcccacaggaccccaggagaucuugggcacacuaaaguuugagaacuacugccucaggcaacuuuauagcaugccuuuccaauucagguuuggauccaaauccucauuccaguacuuauuagcugcuuauaauuuuuuguuuguuuuuuaaaaagagguagggucuggucaggcuugguggcucaugccuguaauccuagcagucugggaggcugacguggguggaucacuugaggucaggaguuugagaccagccugcugaacauggcaaaagcucaucucuacaaaaauuagccaggugugguggcgcaugccuguaaucccagcaucccagcuacucuggaggccgaggcaggagaaucgcuugaaccugggagguggagguugcagugagccgaguuugugccacugcacucuagccugggcgacaagcgacagauguagacucugucuccaaaaaaaaagaaaaaaaaaaagagagagagaggcagggucucuguugccugggcuggagugcaguggcacaaucaaucauggcucacaguggccuugaacuccugggcucaagcuguccuccugcgucagccuccugaguagcuuggacuacaggcuuguaccaccacguccaacuaauuaaaaaaaauucuuuguagagauggggcuugcuguguugcccaggguggucucaaacuccuggccuccagugauccucuugccuuggccugucaaaauguugggauuacaggcgcgagccacugcacccagaccuuauuagcuucuugauccuguuuccccaucuguaaaaugggcuuuugugagaaguaaacaggacaagguuugugaugagcuugggacagugcuuagccagcgggaguagaagguguauugauccccauuuuugcuuuuuuguuuuuuuugagacggagucuuguucugucgccaggcuggagugcaguggcacgaucucggcucacuguaaccuccgccuugcagauucaagagauucuccugccucagccuccugaguagcugggacuacaggcgcgcaccaccacacccagcuaauuuuuuguauuaguagagacgaggcuucaccauguuagccaggauggucucaaucuccugaacucgugaucagcccgccucagacucccaaagugcugggauuacaggcaugagccaccacacccggccucgauccucauuuuacagaugaaacaaguucagugagguuaggacauugccgaaggccccauagcauggaugugaggagacagguuggagccuguguccacucauuagaugggugggaggcugaggaauucacaggacacuaaccuggcccucugggcauuuguguguggugccuaggugcgugcaggagcugcggcaggggcugcugguguggcagcaggaggagcccucugaguuugacuuggccuacgccgacuuccucgcccuggacaucagcaugcugcggcucuucgagaccuucuuggagacggcaccacagcucacgcuggugcuggccaucaugcugcagaguggccgggcugaguacuaccagugugagugaaggccuguggcuggccccccugucguggcuugguggggggucucucaaauguuggaacuguuuuuagucuuuuauaaaggcugcuuagaaaacaggagaacaggcuuuagucaggcagaucuggcuugaaaccuaaagucacucuacagcuguuugaguuuggacaaaugccuugaccucucugaguauguuuguucucaucugaaauaugggcuuaaauccuccugccucauaagguugaugaaaggauuaaaugaggugaugcaaagaaagcccauuuccugguacauaaguuccugguacagagucucacucugucaucgcccguaguggaguacagcagccugaucauggcucacuguagccuccaccucccaggcucaagugauccuccugucucagccuccugaguagcugggacuacaaguguguaucaccaugcuggcuaauuuuucuuucuuuuuuuuuuuuuuuuuuuuguagagacgaggucccacuuuguuacccaggcuggucuugaacuccugagcucaaguaaccuccuaccucagccuccuaaggugcugggauuacaggugucgcccacugugccuggcccacaagucuuaauuguaauuuuuauaauuuugaagauaaugaaguguguaaggugccugauacagcauagguaacuuuuuaguuaagaaacaauuucauacguugggaggccaaggugcacaggucgcuugaggccagaguuggagaccauccuggguaacauagugagaccucaucucuucaaaauuuuaaaagagaaacaagaaacaauauauugaaugccuucauccagucagguuuucauugugcaucucuucugugccuguuacugugcuggggacacagcagugaacaagaugaacccagccccugcccugccaggaugauagacuaaaacaaguagcuacgguugagugacuggaaaagggagaggcagggagcagaggaucacagggcccccuaagcaugggugaaguuuacagugaggagcuuugggaggguuuuugcaugaaaggaaagugacuugcccauuuccacagaccuggacaguggccaagcuaaagagggcccccacucacauccgacucaggguccaagccuuccccuuugccuuccuccaccgcugccauaaaugccacagccucucaagaaaccaguccucacucuaccgucacucgcugugugaccuggagagccuuccuguggaagauggagguuggacucgaucuccaagggcccuuucgucuugcuagucugagucuauauauugauugaaaaaacaauaauagcggcugucacaaucgagugccagcuauuagccaggcccugugggaagcacuuacagucaucauugcucauguucacagcagcccuguagguuugugcuauauugaucuucauuuuuaaagaggugcagaaaggugagugacuugcccuggguuacugggcacucacugggcacacgucuuugucuguugaggguugggggugucuagaaccagggccaagugcagacagucugcacugugaguguggcaggggguaagggggcgagacagauuuucccuacuuuuuauuuagcaaacaucucuuucgcugcuguuaugugccagguacugggcugcugggggaucccaagugagcagagucuguuuucuacccucgaggagcccagagauaaggaaauagauaauuacugugugaugagacuccagacagagguggguggcauguuacagggauaccugacacagcugaguggguggcauggggucagggugggugacucccggggcucuucaagcuggggccugcgggguaauggaggaguaggccggggaaguggggccugugcuucuggcgaccuaacauccugggcagagcuugucaaggucacggaagguggcaugcugggcaaacuggaagaacaucagcccugcugagaccugggcaaggcuaaugagcacagaucuguuuccaggcuaggaguggguucugggcgccuaauagguucccaguaaacaucugucgaaugacugcgguggacggggacaggggaggaagcagucgggagacgugccggugccacuuccaucccucccuggaggcccuugugcuucugcuccaggauuggcaaccaggaggugggauaggaccccuguuguaaacuucuggaucuuggaaaaucaagguuaggggucaguccgauggccucuggucuuggaggggaggggaggggaguggggagaccuucuguccacacagcagggacaucucuccuggcccugagggcagcuuuagccagagccuguugccaccccaugggauuuucuacucccuuuuugagacuaagaaagacggaacugagacuguugauuuuuagacacaaggaaggcuuguguucuucccagaaagaaaggguuauggggcccuggaagaugcccaggaugcagccaaggcccaggggugcugagugcugggugggccacaggucacauccucucaucuuugacaaauaccacccggauagcaccuacgcagcaaagcgcuguggugaggggcaggcucuauauuaggagucauagcuuuguuuuugguugugggaacucacugggucuucucuagcugcagauuugccuucaacaaacgagggauucuaauaccuaccccaggguugcugggagggcccccacgguaccugugaccgcuggggagugccaagcaggcuggccccaggacucacuguucccuccuacucuuugcagggguuggcaucugcacauccuuccugggcaucucgugggcacugcucgacuaccaccgggccuugcgcaccugccuccccuccaagccgcuccugggccugggcuccuccgugaucuacuuccuguggaaccugcugcugcuguggccccgaguccuggcuguggcccuguucucagcccucuuccccagcuauguggcccugcacuuccugggccuguggcugguacugcugcucugggucuggcuucagggcacagacuucaugccggaccccagcuccgaguggcuguaccgggugacgguggccaccauccucuauuucuccugguucaacguggcugagggccgcacccgaggccgggccaucauccacuucgccuuccuccugagugacagcauucuccugguggccaccugggugacucauagcuccuggcugcccagcgggauuccacugcagcuguggcugccugugggaugcggcugcuucuuucugggccuggcucugcggcuuguguacuaccacuggcugcacccuagcugcugcuggaagcccgacccugaccagguagacggggcccggagucugcuuucuccagagggguaucagcugccucagaacaggcgcaugacccauuuagcacagaaguuuuuccccaaggcuaaggaugaggcugcuucgccagugaagggauaggugaacggcguccuuugaagcaggaucagacccagccagcagagauggagagugacucuguuggcagaaggcaggcgaggauaagcuaacgaugcugcuguggccucuaugcacucagcaagagcgggacgccugugcugggccgggcaccagggauggugcugagucgggcagaggccuccuuucaaggaguucacagugaacaagaugagaagggcugggcccuggagggucaagagccccaauuauguacaagacacuuugggaggaaagaagacuaccuuuucccccugccauugguauagcuggugccccaaaacuuccaccucccucccuggcuaccucuaaaaugacugguauaggugcugccccaccccuuagcuccccuauccugggcuaggaggccacaggggcuguccucuagaauucuuccuucccucccccacaccauucauucaauucaugaaacaaaucuuugccaagagcaguuuaugugccaggaacaucauucuguccuugcaaccuggaacaagaccagcuaccagccuagcuucauccgcuacuugcaccaaccagucccggguuagaucccaaaugcuagaagccagggaugcccaacucuggguggccccagucagaaccucugggaucucagugaagcuggccuggccucugcuccugcucucaaggggcugcuuuucaaccaagagccuugugagccuggucugagccuugcacagccacugaguauuuuuuuugccuuagccaguguaccuccuaccucagucuaugugagaggaagagaaugugugugccugugggucucuacaagugacagauguguuguuuucaacaguauuauuagguuaugaauaaagccucaugaaauccuccaaccuagucugugucaucaaacgaaauccccuauggaguucagagccugaacuggaagagaucagggacauaaaaucuaccucucaaaaucagucaagguccacgaacagagagagggcuggcuuaggugggguuucucaaccucguguuugaaguuucaggagcuggugagccagcgugggguagacagcucagcuggagaucagaauccagaucugggcugacuuagugcauccucuucaacaccagcucugcugcugggcccagcaggaguggccacagacacauuuagggccaagaagugaauauaguugccuggugaagaaaggucuuuuugcugggagcucugagagguuaagugaugaggugccucaggggauguggauguggugggugauggugcuggggaaguggaaccuuuugcuguucuaggagguccaugguuuggagaaacgggacagaaaagucaauugagauagagaagaaaauguucuagucacugcugugaugggauccaggauagucucagcucuguuacuauucugguggagacacaaaaaccaggauaaguaaaacauuuaguauaucagauaguguuaagaagugcuaaaagaaaaagggaaagggauagggagagagaguaaguauuuguguguugggggugggaauuacaacuuuguauagaauggcuggggaaggccuuccugcaaaaccgguaagcugguuagcagugacuuggguguggccuauaaaugucacgagaaggagcagaaccuggagucacugguagcuugaaccacugugguggaaggaaugaugcaaacagaauuccaccggaugaauaagcacuuguaaccacucuguuggccuggaacuaaagaugacccagagaugaagggugggggcagggagaggaucugagaugaugcuggugacuuuuacauacaagcaaugguuagaggcagaaaggauccugcagaucauccugucuagugauuuucaggcuuuugaauaucauguaccuauaaaauggccaacaugguugcaacuuaauuuuaacaaaaaagggcauuaaaaacuaccaccauuuggcugggcaugguggcccacgccuguaaucccaguacuuugggaggccaaggcggguggaucaccugaggucgggagaucgcgaccagccugaccaacauggagaaaccccaucucuacuaaaaauacaaaauuagccaggcgugguggcgcaugccuguaaucccagcuacuugggcggcugaggcaggagaauugcuugaacccgggaggcggagguugcggugagccaagaucgugccauugcacuccagccugggcaacaaaagcaaaaccccgccucaaacaaaacaaaacaaaacaaaacaaaaaacuaccaccauuuauuuucaucaucucauaaaaggauguaccaaucuuagaacaaagaccauucuucuaauugaauacauguaaacauacacacacaccugaaauugcaggaagagauggagauguuuaucuacucugugcuugaaaucaaugccucuaauauuuguauuuauaacugaguagggauauagcagcuaacgcguuugcuucaacuaaugugcaccuaaugaggaaaacauuuaauaacuagaauaggcaacuuccucuuuucuggggaauuuuuggaaaaauacaucuuauagucugacauguaugguacuuggaagcuagaacccaauucugauuuccuucauuggacuaaaaggcagaaaggcuuugugacuguuuuccagaccagagggauacagccagacccaaaucagagaaaugaaaugagaaaaaguaguugaugugacaggaaaucagggcaaaucaaaugagguuugguaucaguuugucaguuuuaucgcuuuugugguuuaagugcagugcagcaagguacugauuucucuccuuaauaaauuucagcauauuuggaagugaaugaaaucuuuucucacuccaguucuaaacuuuaaaagcaauauauuuuagaaacaauacauucucccauacaaauuauuuuaaaauau

SEQ ID NO: 14154 - RNA, 51291 nt, Homo sapiens
cgugagggcggggcuagugcgcacgcagccuuagcuccuuccccgcccuugcucuucccaguuucuccgucagccugcgggucccggcuggcggcugcuuccgguaggagagcgguguagagcgagcaggucucagcuccucgucaugucauacggucccuuagacauguaccggaacccggggcccucggggccccagcuccgggacuucagcagcaucauccagacgugcagcggcaacauccagcggaucagccaagccagugagccgggguaccgagcuggggggcgggagcugucccggggacaggccugggugaggcugccgggacgcagggcccggcuggggcuacggccgaggccacaccuggggcugucucgggcuguccacccugggggcggugggcugccaucccccaaucugucaggcccggguugcccgaggguccccggccccagcugaagcuugagcugcuucucuggaguucugcccccacggugcugggaccaaaacagccgacuugacagcccgagggugggaaggggagugugugucaccucgagagcugugagugcguugacuuggcgcaguggucagccgaguuucuccugucacccaccuuccuccccacccaccucgcuuuccucuuagaccaguuuggaugggguuguuuacugauuuagccuuuagguuuacauucugcucagccccuggcuccucggaaaucagcaacuuucaauuaagggaaguggagagugcauguguuugggugacuucauacacaguucuuccuguaaugaauucggaaaucagacacaaugacugguauuugaaaggugggaugacuucauuuuaauaaagagaauucaccaacagcauuucaauuuacauuauuuugucuuuuguaacaaauaauugggguguauuuuuggauuucaggcagaugaggcuuuuguuuuccuucccuacuuagcugcucuugaacaaaucugguacacagggaagcuaagacacuuagccacaaccacauagcaaguaaggcaugguagaguuguugguggaauucagaaugcuauugcuugucuuaaaacucccuccuccccauuagggucugagugaaacuguagcugaaugagucaaauacaggguguuucuugugcuugaaaaucaucuuggagccuuauaaacaggagaucagcagcagcuuuacuuggaaagaaugguggucaucauccuuguuguuuauuauuguuuugugagcuuggcguacucuguuaauagguagaacuaguuaguccugaauuacaauuauauucuauauuuuaaagagugucacuuugcuuucguuuuuaaacuuuuaaaaauuuuucuuuuuuguagagaugaagucuugcuauguuggccaggcuggucucaaaccccugggcacaagcacuucucccacuuuagccucccaaagugcugggauuacaggcgugagccacugugccuagccuaauuuuuuugauuuaaaauauuuuuaauuuauuuuuucgagacagagucuacuucugucacccaggcagaaugcagugaucugagugaagugguacaauccuagcucacuauaaccuugaauuccugaucagcuugcugaguagcaaggacuacaaggaugcaucuaccgugccaggcuaauuuuuaaauuuuuuguagggauggggucucacuauguugcccaggcucacuuugcuuuuaaaucuaaauguauauuguagaauuugagaaguagaaaguuucugaucaaaagggauugagacucuggaagugaaaggaagaauauguggccuguuaaaauccagaaguaaaaaaaauuaauaugaccacugguuagaaaguauaguacuguuuguuccaguuuccuuuugugaaggagcuguaauacagguuagaucagaaaauucuaguucaaggcugaaauuuucuuguugaagcuaaaucuaauuuuaauaucuauuugcgaaauauucauucaacauguauccaucuauccaucuucguguguauuuuauauauauauaaaaccagaauacucccaaagguagauccgacauacaguuuuaaauuuaaauuuaaauuuuuauuuugagacagggucucacucugucacccaggcugguaugcaguggcaugaucucagcucacugcagccucaaccucccuggcucaagcaguccuccugccucagcccuacaaguagcugggacuacaggugugcaccaccacgcccggcuaauuuuuauauuuuuuguagagauggaguuucaccauguuguccagucuggucuugaacuccugugcucaagugauccacccaccuuggccuccgaauaggccaggauuacaggcaugaaucaucaugccuggccuucaacauauauuuauuugaguauguaguaaguauaagaacuggcauggaucuuucaacagggaaccugcagaguucauaaccaaaauauaaaguugaaagggauuggugcuauagaagacauauaaauaacaugcagguauucugggaagagagagauuguuuuuaauugagaaggcauuauggcauuugaguuaugucuggaaagaggauggaaagauuuggaccuucgaagguaaagaggagaagagcauuccaggagggaauaaaaugaacaggcaucauaguggggaagcauagaguauaucuagaagaguaauuuaauuuggcuagagugguggauuccagaaaguagugggaaaaaaggauugaaagguaaauuguggcccaaacaugaaggauguuaaaugcuaagcuaaggggcuuggauuuaguuauuuaggaaagugcgaauugaauucaaagggagagacuggaaucagagauaccaguuagggcugugaaaaugaaaagaaaggaaaggauaggagagguuuccuuggugauagaauugguaagauuuagcuauugauugggcauugggccucaggggaucauuuaagucaacuguuaguaauauuaauagcuaacauuugaguacauacuguguuccaggcaguaugaaaagugcuuuacauacauuaucuuauuuuauaacaacucugaagcaccaguaucauuuccauguuauguauuaggaaacaaacuaagaaagguuaaauaguugcccugcuaacaaaugacaauaucugaauuugaaacuaggucucuuaugaccagcaauuugucuuuuuauuacuuuuuauuaauauuacaguucugggcugugcucaguggcucacaccuguaaucccagcacuuuaggaggccaaagagggaggauuacuugaggccaggaguuugacacuagccuggacaacauagugagaccccaucucuacaaaaaaaaaguuaaaaauuagccagacaugguagcaugugccuguaguccuagcuacucaggaggcugaggcuggagaaucucuugagcccaggaguuggaggcugcagugagcugugauuaugccacuguacugcagccuggguggcagaucaauacuuugucucuaaauaaauaaauuaaaaauaaauaaaucaauaacagugcuauagcaguuaacacuucagguuuacaaguaugcaaauaacuuguuuuuucacucuccagaggacacucugugggggaaauaccugaagccguggugcuuucucuucucgugguguguucaucuccucugccagauuguuagcuccuuugagucaagggacaugacuuauucaucuuuauauuuccaguacuuaucucagucccaaacauaugaaagauucauugauccacuaugcaacaaauauuccuggagcaccugcugugugcuggggugaagcagaacaagagauaaaaucccuccccugauuguguguauauguguguuucugugugcggggggaguauguauacacacauacguacauacacauauaaauaaugucaaguaauaauaaaugcuaugaagaaaaagcaggguaaguggguagagagucagggaagagggagggugggugcauuauuuuaguugaucaaggaaggcaucucugaggagcugacauuugagugaguagacaugugaaugaaaugagcaagagcugugugaguagcugggaaaggcauucuagguagagggcaagagcaaggacuuugauguguucaaagaagagcaaggaggcuaguuuggcuggaguaccguuagaaaagggaggcagaauaggaaaagaggccagagagguaaccagggaucacauuauauaggaucuugaugcauaauaaauuguaucaaauugauuugaaugaaugaggcauuucuaccauuuuggaacucuuccugccucuuuccccuuguacuguguaguacauaccauauccuaugacccuaggcagugugaguugagauucuuccaggccggacacggugacucacgccuguaaucccagcacuuugggaggcugaggcaggcggaucacaaggucaggaguuugagaccagccuggccaauauggugaaacccugucuuuacuaaaaauacaaaaaaauuagccaggcgugauggugcacgccuguaaucccagcuacuugggaggcugaggcaggagaauugcuugaauccgggaggcggagguugcggugagccgagauugcgccacugcacucuggccuggaugacagagcgagacucagucucaaaaaaaaaagaaaaaagaaagaaauucuuccuuuggaauuguuuggugagaaaugggaaaucugaaauugaugggaugacguugcaucuacucaguuaucaagcuagugccuauccccaaaccucuccaagaggccagcacacccaaauauacccuuagaauaugagcucucagacauauauauuacccacacacccauacagcccugcaaggacuuguacccauuaaaagucugagagcauaguuauucuuuuuucuaaacuguucagccacagaugugggguuggaauugcugagcacaucagccugagauaaggcagcucacugcguggguuguuacagguacagcuaagguugacugccugguacaaguggugauuaucaguauguguuggguacagaagaaaaauauuugacuuacuguggaacaaagugucugggcaaguauugcugaggcagauauagcugaaaaccuauuagccucaaaguuaacucugaagggauuaaagaacagcauuucugacugggcgaggugucucacgccuguaaucccagcacuuugggaggccgaggcgaucggaucaccugaggucaggcauucgagaccagccuggccaacauggcgaaacccugccucuacuaaaaaucaaaaaguaagccgggugugauggcaggcgacuguaguccuagcugcucgggaggcugagguaggagaaucgccugaacuggggaggugcagguugcaguaaaccaagaccaagaucgcuccacugcacuccagccugggcaacagagcgagauuccaucucaggaaaaaaaaaaaaaaaagaacagcauuucuguucuuuauguugcuaauugaugugaucuuguuuacuaacaaaauaagaagaguggaggucucacucugucacccaggcuggaaugcagugugcaaucguaguccacuguaaccucaaacucuugggcuuuagcgauccucuuacuugagucucccaaauagcuaggacuacaggcauaugccacugcgccuggcaaguuguaaaaguuuuuuagagacgggggucucgcuguguugcccaggcuggucuugaauuccugaccucaaaccauccucccaccucagucucccaaagcaagaagaguugaacauuuaaaauugauuauuaugaaauccuugggguuccacuuucaaaguuauuuucauguuugccccuuauuuuuuauguuucuuugcuauccucuuaaguauucaucagcucaacaucuguauuucaacagcauauucauagugucucugauuauggucuugccccauucuaguuuauacugauggugcuaucagcacuaugucuaaaguccuguuuuuauuauacugcucacuuccucaagagccuaaaguggcucucuguugucuauugaaucagaugguuuuuuuuguuuuuguuuuuuuuuguuuuuuuuugagccaagucucacucugucgcccaggcuggagugccauggcgcaaucuuggcucacuguaacauccaccuccuggguucaagcaguucuccugccucagccucccgaguugcugggauuacaggaccugccaccacgcccagcuaauuuuuguauuuuuauagagacaggguuucaccauguuagccaggcuggucucgaacuccugaccucagaugauccaccugccucggccuccgaaagugcugggauuacaggcaugagccaccgugccuggccugaaucagaucuuaauauuucaccuugcuuucacucccugcgaucuuaacccaaauuagccauauuuucuacucuuccuuacucuuugcuaggaaggcuauuuucuuuauguuucucaacucuaucuuucaguuuauauuuugcucauuugguuccuccuuuuuuuuuuuagagaaagagaguuucgcuguuguuaacagcccaggcugcaaugcaguggugcgaucucggcucaccacaaccucugccucccagguucaagcgauccuccagccucagccucccgaguagcugggauuacaggcguguaccaccacgcccggcuaauuuuguauuuuuaguagacacaggguuucuccauguuggucaggcuagucuugaacuccugaccucaggugauccgcccgccuuggccucccaaagugcugggauuacaagcaugagucacugcguccgcccuuugguuccuccuuuuuuuaguaucuuuucucucccuaccucauuggcuaucuaaauuauacaaauccucucaguugugcauaaguccugcugauagcaauuaaguuuuucuuugcuuguuuuuuuuuuuuuuuuuugagacggagucuugcucuguuucccaggcuggagugcaguggggcgaucaggcucauugcaacuuccgccucccagauucaagcaauucuccugccucagccuccccaguagcugggauuacaggcgugcaccacaugcccgacuaauuuuuguauuuuuaguagagacaggguuucaccauguuggccaggcuggucuugaacuccugaccucaggugaucugccugccuugcccucccagagugcugggauuacaggcgcccagccuuccuuugcuuuugaaagacaaagugaagucagaaagaucauggacucuccggggucagcagaucugugacugaaucccuccccuuccauguauuaaccucgagcagguuauuuucccugccguguguaaccccauuuauaaaaugagugaaauuauuaaaaggggauguuugaggcugggcacaguggcucacaccuguaaucccagcacuuggggaggcugaggcgaguggaucucuugagcucagaaauuugagaccagccugggcaacuuggcgaaacccuggcucuaccaaaaauacaaaaauuagcugggugugguggcacacaccuguagucccagcuacuugggaggcugagaugggcaaaucgcugaucgcuugagccugggaagcagagguagcagugagccgagaucacgucacugcacuccagucugggugacagagugagacccugucucaaaaaaaaaaaggggggauguuugaaagugucugguauacugccugccuggcacauagcaggcguucaauaaauggugacauuauuauuauuuuuauuauuuugagauggagucuugcucugucacucaggcuggaguacaguggcgcaaucucagcucacugcaaccucugccucccgggguuaagcaauucucaugccucagccuccugaguagcugggauuacaggcucaugccaccacgcccagcuaauuuuuguauuuuuaguagagacaggguuucaccauguugaccaagcuggucucgaacuccugacgucaggcgauuugcccacugcagccucccaaagugcugggauuauaggugugagccaccacgaccagccccaguggugacauuauuaauacuuguugaaucccuugcccugcaauaguuuaauaguuagguaggcaggcucaggagucauauugccaggauuugaauccuagaucugcuucuuacuagcuguguaaacacauugcuuuaccuauuucucaguuuccuuauuguuaaaauggaguuaauaauaccuauuucauaggguugugaugauuaaaugagauaauucaucuacagucccugcuacauaguaagugcuuaagaaauguuagcucucauuuugguguauuuccuuugaauuuauaauacaagcaauuuucccucacaguuuagcacgcacuuauauuauauauucuuuaauuaauucaagcuuuuugauauugucaccccaagcagagagaucacuguuaguuuuguggagaccaugcauuauacauuugucuuuagucacagugccuggaacaacaaugcauauauaguuggcauucaauauguacuuaauugauuuuauuacugcuaaguacauuuuucuuggucuugaguuugauaauaauagcuaucuuuaauugagugcuuuuaugugccauuguucuaaauuuagcuucguaucaucucauuucauccucacaacaaccauaugaagauucucuuauucucauuuuuaaggcaaagaaacuaaggcauagaggaguggagccuuuuacucaagaucacuuugcuuggaaguagcgggaccacgacaagcauaggcauaagcagugguuuuuuguuuuuuguuguuuugagaaagggucuugcucugucacccaggaugugccaguaguacagugguaccgucauaggucacugcaaccuugaacucaagggauccccccaccuccaccuuccgaguagcuaggacuacaggcacgcaccaccacguccaaguaauuuuuuaauuuuuuguagagacgggcucacuuuguugcccaggcuggugucaaacuccuggguucaagugauccucccaccuuggccucccaaagugcugggguuacaaacuugaaccaccaugccuggccauauaggcggucuuaauucagagcuaugcucuuaaccauugcauauucugaaacugguaugguuaaaggaaaauuauaccuuugauauuuaguauccauuuucacuuuagucuagaacuuuacuguuaugguacaguggcuauuuuuuaaagucagguugauggacacggugacucacaccuguaauuccagcacuuugggagggcagggugggcagaucgccucaggucaggaguucgagaccagccucgcuaacauggugaaacccuguuuacuaaaaauauacaaauuagcccggcaugguggugggcaccuguaaucccagcuacuugggaagcugagacaggagaaucacuugaacccaggagguggagguugcagugagcugagaccgugccauugcacuccaaccugggcaaagagagcaaagcucugucucaaaaaaaugaaacauuuuuuaaaaaagguaauuuucauuguagugauauaaaaacagaauguaaaccuaauuuucagaguaaaacacugagaugacuucauuuucauaaucaccacauaggcuaucauuuucucauuugguguaaauaauguuuuuuuguuguugaauuuguuuaaaauacugacuuagagcauucgauccugucaaaugaagagaaaucuuuuucccaccucugaugauaguuacuuucaauauaauuugacuuugauuugacuuugcuuuggaugaagguucauuuggagauucagauucugccgauaucagcuuaaaguacaaaaagaauuuucaguuuagaguaguuccuaguguggauguuagcuguaauguauaacaaauugauuugcuucauacucuuuuaaaaguuuuagccaggauaugcuuuuuuaaaaugagaggucagcgauaggagaaauugaguccuaguuguuuguuuuuuguuuuuguuuuuguuuuuuugagauggagucgcgcucuguugccgaggcuggagugcaguggcacgaucucagcuuacugcaaccuccgcucccggguucaagcaauucuucugccucagccuucugaguagcugagacuauaggcaugugccaucaugccuggcuaauuuuuguauuuuuaguagagaugggguuucuccauguuggccagccuugucucaaaacuccugaccucaggugauccacccaccuuggccuaccauagugcugggauuacaggugugagccaccacgcccagcugaguccuaguuuuaaaaagaacaaaauugcuuacacagaacugaaggacuugucuuuaccuuuggccuagucaucugguuucuaggauuauguaacauuucauaggaaauacccaauuauuuuccuucaaaaaguuguagcacaucagucuaacauaaaaccuucauuuaguagaaugcuuggaaaaggaguuuucucauuaaccaaguuagccagaagauucaacucauccugguaaaaauauuuccaaaaagcaucacuuggccaagcgugguggcucaugccuauaaucccagcacuuugggaggcugaggcaggcagaucaucugaggucgggaguuugagaccaggcugaccaacauggagaaaccccaucucuacuaaaaauagaaaaaauuagccgggcaugguggcacaugccuauaaucucagcuacucgggaggcugaggcaggagaaucgcuugaaccugggaggcagagguugcggugagcugagaucacaccauugcacuccagccugggcaacaagagcgaaacucugucucaaaaaaaaaaaagugucacuuuacuuuuuaaauuuuuauucauuugucuauuuauuuugagacagagucuugcucuguugcuuaggcuggagugcaguggcaugaucauagcucacugcagccucaaacuucugggcuugagcgauccucuucucucagccucuugaguagccaggacuacaagcaugcgccaccaugcuuggcuaauuuuuaaauuuuuuguagaggcaguuuucacuauguugcccaggcuggucuugaaccccugaccucaagugaucugcccaccuuggccucccaaauuguugggauuguaggugugagccacugugccuggccucacuuuucuuuuugauauuuuaaguaugcucaagggcaaauaaauguaucuguaaacacguuauuccuuugugugcuuuagguuuacugaaagauacaucucuuagauguaaaauacaugagucauugaguuacuaguuuugaacaaaucccugauguuggugauuauagagggcaauauacaaaaaguccugcuucucuggguuccaguaaacuacgacacuguuguccuuaugauuugaguuuuaggguaucugauaccugagucuugcuggaaacuuuaaagaaaauaucuuaauauuuaggaauuuagaaaguguuaaggcuuagauuaauucuggugcuuagcuagcaaaugacccuauaauauucccaacacccccacuuccucaaccccucccuaucuuuccaccccccaaauuuaggucaucccaacaaaggaaaucagaaaagucuagaugaagaagaguucuccacugagaauaugcagagaacagcugauuauuaauugauuuuuucauauucuauaaaauucccauagcucuguagcuuauuuaauaaauuuugauagaugauuaauaacuugauacuuuggcauacuucuaaaguuucuaaggaaugcucuacuuuuuaaagacacucaauaagaaaagaccuauuuccuugacuuuuuuugucagaucuacguuuacauguuaucauauauucaaccauuuucuggauggguguguguguguugggaggaguuauacauacacaaaaaugaguagaaugcagucccugccuucuagagggauauagucaguccaguccuguuuguaccuugcauuuaugaaguuaagaaagucacagguggaaccuuucuaagccaaacuuucggguugcaaaaguacuccuugguuacacagcauaauucuuugacuggagcuauuucacuguuauugaauuuuggaauugagcaguggugggaguacuuagagaucauuuaguucuuacauaguuguaaggauuuaaugagauaaaauaaaaaccuuacacaaauaguuuaaguauucaguaaaugucagugaaaucugaauaucaucuauaauuggugaaaaagagacccagucaaaugaaaugacuugcuuagugcccugcaucuaguuagucgucaagucuggcuuagauuucaggccucauuauuccuagcuuauauucuucauucauaucuucugccucaaagagcuugccagaauggaaaagggaggcuaacucaauuaaucaguaauugauuauguaucaccugggugccuggcacucugcugaacucuagugaguacagaggaguguucccauaggugccagggagcuggagaagggagcagguuagaggaaggacaucagccuaucuggagcagagaccuauuaacuuagguaucagauaaguaggguggggcuaaguggaacacugggaaaucuaggccugcccugugugacuacauucuuuuuccuguaagagucagccuuuugagagacuguaauguggcacauuccacugcaguuagcccuggguuuaaauucugguuguaaugacacucuguucaaaaccuaccagugauuucccacuucauuaaaauucaaaguccucauaauuguuugcaaggcccuauacaaucugggucccuacuaccuccuuggccaccucucugcugucucuugcucacucugcucuagccacccuggccuccaucacaucaaguacccuugcuuuggggacuuuguacugauuacucucuucuccuagaaugcuucuccccaagauagcuguguggcuugaucuuucacuuuggaucucagcucagugucaccuuaucagagaggucucucugaccacucuauauaacuaguauccucugcccaccacugucacuucagcucuuaacugaauuuauuucuuuuuauacucugaccacucuguauaacuaguauccucugcccaccgcugucaccucagcuuuuaccugaauuuauuucucuuuauaccauuuuucacuaccugauauguuuauugucuaucucuuuuccuuagaagacucucgaaggcaagugucuucuaggacauggaauaguguagaguagauacucuacucugaaugaaugaaugaaugaaugaguucuguaacucucaggagccucauugugcucauaugcaacaauggaauaauaauacuuacuuaaaggauuguuggagucaaauaaguuaaugcuugucaagcccagugucuaguaccucauaguagaugcucaguaaaugaaaauucaugcccucuuucauaaauuauuuuuauggcuguccaguuaauagcuuuaguuguauccugauucccauuugacuuagauaagaaggacauaccacauguuagugaugaagaaaagugguugucacacauaaugcuaucuuagcagaaugcaguaauuauagugcuuauaauuggaaccauggaaccacugagcuauagugguuccucacuuaguagaauagauaucuuuuagagaagucuugucaaaaggcaaaauuugaauuaagugaauccuauauuucuguuauaaaacuggaaucacauuuuuguuaggaaaauauggucucaaaauaagaugaaaucauaaucugaagugcuaccagccuauauauacuugacucgggaaauguuugcuuuguauccccaacaaugcaguaauuuuggcuagggagaaauaacguguacuuacuacuaaggacugaguuguuccauuucuguuuaggaauagaagcacccagcaauaaguuagaagauuuuugccuaaucguugcuucuuaucagauuuagggacuacuggccgggugcaguggcucaacccugcaaucccagcacuuugggaggccgaggcggguggauuaccugaggucaggaguuugagaccagccugaccaacauggugaaaccccaucucuacuaaaaauacaaaaauuagccaggcgugguggcacacgccuguaaucccagcuacucgggaggcugaggcaggagaauugguugagccugggagucggagguugcagugagccgagaucaugccacugcacuccagccuggccgacagagugagacucuguaucaaaaaaaaaaaagauuuagggacuauuagcaugucauugguauuguaagguaacugguacucaauacauuuuagcuuacuuuuuuacugaucuuggugaccaaauuagggacaagauuaugacugugucccccaaauauuguuauuuuaaagaguaccauuaccaaaaaguaaauuuggaacaauuaauuuuuaaauuucaaaauucuaauaagugaagguucuuucuuguuggacaugggagcauuauauguauacuguuucuauaauauucacaaauuauacaauauacauuggucuccucauuuucuuccacugaacuagucauuuagcaggcugguguuucacaagugaaacuggcauuaauccagagaggauagaaagggcucucacaaagaaagcugaauggcuggaagagccuuauacuuauuguguuaugugauuucuugaaguucuguugaaacuugaugguaaguguguuacuucugggcaaugaguacucuauucauauguucuguacuccagcuacuuguaauagaagacagugaaugcucuuggaaaacaagcaagcaaacaagaaaucauauaacuaacuuccaaccucuaugaaugaauaaaucucccccacccuccccaguaaccagaaaaagaaaauagaaagcaaggcauaaaauaaaugaagggcucuauuguugcagaaaucaguaagggacaggaguguucagagucccaggcaggcuggcguuagaguguuccuccuuauugauagaugaucaguuccucuggaccucugcuuucuuggucuaggauaggaguuaaacauccaggauucaaacaugaccauuccuagucuuagcaaauaucuaggaaaagguagagaaggcugaacaaaaccauauguuugacuguauuaugguauagacagcacaguugaaagaacauagccauuggaaucugauguacugggcauugaauuuuugcucugcuacuuauuaauuguguaugcuuguauaagauacuuaaucucucuaaauacacuuccuuaccugcaaaauggaaguauaucuacuaaggccaggcgugguggcucacgacuguaaucccaggacuuugggaggccgaggcgaguggaucacaaggucaggaaauccagaccauccuggcuaacauggugaaaacccgucucuacuaauaauacaaaaaaauuaaucgggcgugguggcaggcgccuguagucccagcuacucaggaggcugaggcaggagaauggcaugaacccaggaggcggagcuugcgugagcugagaucgugccacugcacuccagccugggugacagagugagacuccaucucaaaaaaaaaaaauaaauaaauaaaaaaguacaucuacuggagauugcuguugugaaaauuaauaacagaguguauacaaagcucuuaguauauagugccuggcacuuagaggugcucaauuggugguaacccauuauuaguaauaaguauacauugucuuuccaaaaauguuugcuauagaaaaauuauuguauuugacuugauuuuuuuuuuauuguugcaaauugauaucuggccuagaggcccuucuaaagguguugaaauuuuuaaccauugcaauaggagaucuaggaaaacuagcaaauuuuagggggaugauaaaacuaccaccuucuacuuugugacacaguuacucuauaggagaaaggugaaccuuguaauuaguuuuuggaggaaugugugugucaagguuuugaucauagcauggucucuauuaguugcauguauuaauacuuauucugaaugggaagagaccaggaaucuuagaaguaggguacucaugaugaauguauuuuucuuuuaaauaaaucuuuuucuuccuaucuccccagcugcucagauaaagaauuugaugagccagcuaggaacuaagcaggacucaagcaagcuacaggaaaaucugugaguaacuuccugacaagguuggguuuugugagggccauuugaggacacaguguccuugccagacagcagcuuagguuucaggucugggaagucagaaugagaggcagugggucaugagauaagagcuggaucuaaaagaggggcggggcaacaaaguauauuaauggauuguaauuuccguugccuuucaaagucuuugaacucugguucuuucuccucuugggcaguuuagcagaacaauuuagggaaguagaaaagggaauucguaccacuauuaaacuauauucugcucacaacucugccuaaaugagcuuccuuguuggcguaggacuccucaugaucuagucuaacuggauuuccagcuacagucagccuuccauauccauagguucugcaccuguggguucaaccaaccacagauagaaaauauucagaaaaaaaaaggaaggucucuacugaagauguacagacuuuuuuccuugucauuacugaaacaauauaguagaacaauuauuuacauaguauuuacauuguauugugucuggaguuaguuccuucugguggguucuuggucuugcugacuucaacaaugaagccguggaccuucguggugaguguuacagcucuuuaagguggugcggacccaaagagugagcagcagcaagauuuacugugaagagcaaaacaacaaagcuuccacagcguggaagaggaucugagcagguugcugcugcuggcuggcguggccagcuuuuauucccuuauuuguccccacccauguccugcugauugguccauuuuacagagcacugauugguccauuuuacaaaccucuagcuagccacagauugcugauuggugcauuuuacaauccuagcuacagagugcugauuggugcauuuuacaauccuccugugagacagaaaauuucucagaguccucacccaacccagaaguccagcuggcuucaccucuaaguauuaaguaauguaaucuagagaugauuuaaaguauauggaagggggugcugggugcagugacucaugccuguaaucccagcacuuugggaggcugaggcgggcagaucaccugaggucaggaguucaagaccagccuggccaacaugaugaaacccugucucuacuaauaauacaaaaaucagcuggauguguggcaggcaccuguaaucccagcuacucaggaggcugaggcaggaaaauagcuugaacccaggaggcggagguugcggugagccaagaucgcaccauugcacuccagccuaggcaacaagagugaaacucugucucaaaaaaauaaaaauaaaaauaaaaaauaaaguauaugggccgggugugguggcucacaccuguaaucccagcgcuuugggaggcugaggugggcagaucacccgaggucgggaguucaagaccagccugaccaacauggugaaacuccaucucuacuaaaaauacaaaaauuagcugggcaugguggcgcgugccuguaaucccggcuacuugggaggcugagguaggagaaucacuugaaccugggaggcggagguugcagugagcugagauugugccauugcacuccagccugggugacaagagcgaaacuccgucucaaaauaaauaaauaaauaaaguauauggaaggauaugcauagguucuaggcaaauguuacacaauuuuauauuaaggacuuggcaggaggccuggaaccaaucccccguggauacugagggacuacugcauauguaaucagaauggcccaaggggagccugagggagagaauaguagacugauaguagggacuccugauucuuuuuaucacauccuuuucugcuccauuucugcuuuuagugcuauucuucaucuuuaaaauguucugagcaagccgggagcaguggcucacgccuguaaucccagcacucugggaggccgaggugggugggucacgaggucaggagaucgagaccauccuggcuaacacggugaaacccugucucuacuaaaaauacaaaaaauuagccaggcgugguggcacgugccuguagucccagcuacuugggaggcugaggcaggggaaucgcuugaaccugggaggcggagguugcagugagcugagaucacaucacugcacuccagccuaggugacagagcaagacucugucucaaaaaaauaaaauacaaaaauuagcugugcgugguggcuugcgccuguagucacagcugcuugggaggcugaggcaggagaaucacuugaacccgggaggcgaagguuggagugagccaagaucgcgccacagcacuccggccuggcgacagagcaagacuccaucucaaaaaauauauauauauaauauaaauauaguauauaaauauauauaaaauauaaauauaguauauaaauauaucuauaauauauauaaaauauaaauauaguauauaaauauaaaauauauaguauauaaauauauaauauauaucuauauauguauauaucuauauauguguaucuauauauguauauacauauauauguaucuauauauguauauacauauauauguaucuauauauauguauauacauauauauguaucuauauauauguagauacauauauauguaucuauauauauguagauacauauauauguaucuauauauauguagauacauauauauguaucuauauauauguagauacauauauauguauauauauaucaagcaauauuuuuuguuuccuacccuagacagugugagguaagagaaugacuauuauugugagcuuuuuccagggaaaugugaaauaucucuggauauuuucuacugccugggauguucaagccacugauuggguaccucuugcuuuugacuccuuuuuuuuaaauccuggaggcccauuugcaguacagaaaaaccauuaauaauuagugugguguguuagcccauuugggcuacuauaacaaaauaccauaaacugaguaguuuauaaacaacaacuuuauuuccaugaucuaaucacccuccaaaggaccccaucuccuaauauuaucaccucgggaauuaggauuucaacauaugaauuuugcagggacacuaacauucagaucauagcaugugguuucacugucgucucagaaagccuuuguagaaauggcuggauaguagaggaaaccacaaaugaaaagaguacuuuuuguauuucuacuacuuuaaguuccacuuaauauacuacauauucuuuccucuucaauuccccuuccucccuacuccuuuuguauuuuuaacagguaaggcuucuuuguuuuggagggaagagccagaaacucagguauaaagagcagguaggaagccaaggauaaggcuagaaaagagccagcuuuuuaaagcaagagcaugggauuagauguuuggagguuguucccuaggguagguaggaagcuacgcuuuuaaugcacauuucaucuaacugucugugccuagauucuagucaguggacuguggcagucaacuccuggacaauaagagaguucaguauguuuaaacuacuugauuuaggugugggcggcaauuguucuuuuuauauuuuuaucagaacugcugauaugcuuuucuucucuucccaaagaguuaaaauucccgaucugugcuuucuucagcaggcuauugaagcagauucuuucugcucagugaagauaccuugaaguggguuugccuggguaauauuucuggaauuuuguugugaaccugggcaucuagggacucauuucuucaaauggcccuucauucccuacguuaugagacacucugagaacaaagugguucuguguauaacccucucaagaagugacaacauccugaaacauaucuuuucucucuuaggcaacaguuacaacacuccacaaaucagcucgccaaggaaacaaaugaauugcugaaagaauuaggguccuugccccuucccuuaucuacuucagaacagguugguauuuucuguuuuguuuauuaauaggaaaggacuuuguguuaguagaaaggcaguguguagaacaaaaaaaaaauaaguuggccuuuggugcuagauagauagaccuccucugcaccucaguuucuuauccaucaagugggggauaugugacuguuggggcaauagaaagaauguacacaccagauguggcaaagugucugcgucugguagguaaucaauaugugguggcugcugcuauuauuaacauuauuaauauauuaauaaaauggaguuaacugaagagaaaucucaacauuugcaucucuuugggguuuggcuagcaguuuuauguuuguaggcuuccuccuuucuccuaguuuuuuuuuuuuuuaauuauuauuauuuuuauuguuguugucguuuuggagacagggucucccucugucaccuacgguagagcgcaguguugaaaucauagcucacugcagccucccacuucugggcucaagcaguccccuccccucagccuccugaguagcugcaacuacaggcaugugccaccacacccagcuaauuuuaacaauuuuuuuguacagacauggucuugcuuuguuucccaugcugguauugaacuugugacuucaagcaauccucccaccucagccucccaaaguguugggauuacaggcgugagccccaugcccaggguuccuaguuuguuuuguauccauuaucuuuacauuuuaaugaaacaucuuucuuucauguuuugcaguuaccuucauguucugucaugaguuauucacaggucucacucagguuaaggaacugcucagggaaaaaggguucucuuuucaagucauuuucuucaguggccauuuaaauccuuuagaaacacacaauuuuuacugagauucauuguucccuuaauaugccacauuccugaagucagaugugccccuccuucauuguggcuugacuugucauucaugaucuaccucaggucuccaguaaaaaaaacuuucuccgucuaccuuccuauuaugauccuguuuugcuuuuagcuucuauaccauucgugggggcacuuaacuuguauugcuuuuuaaauuuuauuuuauuuuugagauaggguauuacucugucacccaggcugagugcaguggcaaucauagcucacugcaaccuugaacuccugggcucaagggauccucccaacucagccuccugaguagcuggaaccacaagugcgcaccaccacacgcagcuaaauuuuuaaauuuuuuguagagaugaggucuugcuauguuuuccaggcuagucucaaacuccugggcucaagugauccuccuuucuuggccuugcaaaguacugggauuauagacaugagccacugugccugaccuuuauaucguuuuuuaugauugaacguuuuaaaugauaauguccuauaucugauggcucugaagacaaagccuuucaacuucccugucguggguuguuuuucaaaguauggguuguggcuaguggaacaugaagucauuuuaguguauugagaucagcauuuuaaaaaacuuagaguagaaguaucagagucuauauuauguaauaaugguaaauauuguuauauggaacuguuguuucauacauacauauguguauguauggauggaucaugaugucaaauucuuuuuuuuuuuuaauuugagacagagucuugcucugucgcccaggcuggagugcagugggauaaucuuggcuuacugcaaccuccgccucccagguucaagcgauucuccugccucagcuucccaaguugcugggauugcaggcacccacuaccacgcucggcuaauuuuuguauuuuuaguagagaugggguuuugccauguuggccaggcugguuucaaacuccugaccucaggugaucugcccagcuagaccucccaaagugcugggauuacaggccugagccaccacaccuggcccauguugucaaauucuuauuguaaaucucugucaaaaaaaaauugaaaaucacuaguuuaaccugauaaacuguuccauguagcauaucuggaguuuuggcccccacuugcagaagagagaggaggacaagaugcuuugucauccugcuacaaaguaguuacccuuugguugucuauauacgggcuguuuauucuaauuauuacucaugcugauguuucaguuaugggccauuucccccuugccauccaauaucuccaaacugcugccaaguuacccauuucuuccuccuaaccaugcacuuagggaauacacacuuguagacaguuuucauaguaacaaaaaaggaguugaagggucuaaugcagaguagugaaaguauuuaagaguuaaguaguagccuaagcaaaauauaaauagaaaaucaaaucugcuaccaaaacaaaauucaucaaacaucuucuaaaaccaaauagaaguuauuuuuggauuaugcaugcuguuguuccuuuccauuaucuuggaucauuaagaacacgaacuagaucuacaaacauacucucucuggugaaauauaauuccuugauuccccuccucuuguuaugcucuguauccuuuugucuuucuacucuuuucucaucuaauuaaucuuagccccaucacccgucuuuucauuacuaucuuauacaucaaaccauacuccuacuuucaguuuuuuuccauacuuauauacuaucaucaaugaucuaguuacccaguccaguggcuuuugagguuuuuuguucguuuguuugagacagggucucacucaguuauccgggcugaggcgcaguggaguggcgcagucguggcucgcuguaucacuguagccucaaccucccaggcucaagugauccucccaccuuagcuucucgaguagcuaggaccacaggcaugugccaccacaccaagcuacuuuuuaaauguuuuauagagacagagucuugcuauguugcccaggcuggucucaaacuccugggcucaagcaauccucucuccucagccucccaaagugcuggaauuacaggcaugaacugccauaccaggcccuuuguaaagaguuuuuuuuuuuuuuuugggacagaguuucgcucuuguugcccaggcuggacugcgcaaauggugcaaucucggcucaccacaacuuccaccucccagguucaagcaauucuccugccucagccucccgaguagcugggauuauaggcaugugccaccaugcccagcuaauuuuguauuuuuaguagagaugggguuucuccauguuggucaggcuggucuugaacucccgaccucaggugaucugccagccuuggccucccaaagugcugggauuacaggcaugagccaccgcaccuggccauaaagaguuuuuauucacuuuuuuuuuuugagacacaguuucacugugucacccaggcuggagugcaguggcgugaucugcacuccaaccagaucaguggcaugaucugcacuccagugagcaaaggcucacugcaaccuuugucucccagguucgagcaauucuccugccucagacucccaaguagcagggacuacagacgcacaccaccacgcuaauuuuuguauuauuagcagagacaggguuuugccacguuggccagguuggucuugaauuccugaccucaagugauccgccugccucggccuuccaaaguucugggauugcaggugugagcuaccaugccuggccuauucacuuuuuuucuguuuccuuugauccucuugccuaucccgucugcccugaaacuuucuucuugccaugauucucuuucauugugucccccaacucuggagauccccagguugagucagccuccuucccggacuucauauccuccuaagagugggcaugccccaagguugugccauugauccucgaauuauuucacuguaugcuuucuccuuaggagucaccugcuuuuaugaccucccuuucaccuuuaugaucaugaccucagaucuuuuuccaaucuaaccccuucaccucuaagugcguggcccauaucuucaauucauguucugacaucuccuccugaaauaaacuaccuucauauaaaacuugucuuauacugaguuucucauguuucucccaaaccccuuaacuaaguucauugacaauacuuaacaucacagaaaaguuugugccuuuugaccuaauauucucacucaugcuaauuagcccuaaggggaaaaaaaauucugaagguaaacacacacacacacacacacacacacacacacagagucuauauacucuggagccaaauuuccuggauuuaaauccaucuuugucacuuacugugugauccugggcaaauuacauagccucuguggugcuuugguuuucugauguguaaaguugggacuauaauaaugccuaauuuauaggucauuguauagauaaaugaauuauuauguaaagcacuuacaguaguacugguacaauuuaagcacuauauaaauauuagccauuacauuggggcuuacuuuauaauauuuaauaacugugaaaaaucuagaaggauuauuuacauaaaauuuaggucaacuugauggaauauauguaagcgauuaaagaucauggccgggcacagugguucacaccuguaaucccagaacuuugggaggcugaggcggguggauugcuugaguacaggaguuugagacccagcccgggcaacaucucuacaaaaauuagccaggcacgguggcucaugccuauaaucccagcacuuugggaggccgaggugggcggaucaccugaggucaggaguuugagaccagccugaccaacauggcaaaaccccaucucuacuaaaaauacaaaaauuagccaggcgugaugguggccaccuauaaucccaacuacucgggagacugaggcaggagaauugcuugaacccaggaggcggagguugcagugagcugagauugugccauugcacuccagccggggugacagagcgagacucccucucaaaaaaaaaaaaaaaaaaaaucgcgccacugcacugcagccugggugacagagcgagacuccaucucaaaaaaagaaaaaaaaaaaaacucgugccacugcacuccagacuggacgacagagcgagacuccgucucaaaaaaaaaaaaaaaaaaaaaaaauuagccaggcaucgugguacacaucuguagucccagcuacucagguggcugaggugagaggaucauuugagucugggagguuggggcugcagugagcugagaucacaccacugcaccccagcuugggugacagagcaagacccugucucaaaaaaaaaaaaaacaaaaacauaauugugaagaguaugguaacauggaaaauguuuaugauguauuuaaaaguuaugauaauauuuuugcacgguaagguuagggaaugauguccuccccguuauuguuauaauuuuguuuaugcaaaaauaaaaaucucagaagaaaaggguugcucaucuaaauuugcuuuuaguauuaccaucacucuuccagguuugaaauuucagucauucuugacuuuaucucucuuuccccaccaccagucaaaauguuucuuaaauucauuucuuuaugauuuuauuacugauacuguguccuccuaaccuuaaaccuagacuauugaauuaguguucuguuugacuuguuucuuuuuuccauuccaccuuuguguaaacggugacccaggucucaucacagacuaauuuuucuaaguuacuauuuuguacccaugauguuucuugcucaaaaaucuucauugcucuuuguucuuuagagguugaaccccaaacucauuagcuuguuuuuuuuuuuguuuuuuuuuuugagacagaaccuggcucuuuugcucagucuggagugcaguggcgcgaucucagcucacugcaaccuccaccuuccagguuuaagcaguucuccugccucagccucccaaguggcaaaggacuacaggcgcacgccaccacgccuggcuaauuuuuuguauuuuuaguagagacaugguuucaccauguuagccagauggucuccaucuccuggccucgugaucugccugccucauccucccaauagcuuggcguuuuguuuuguuuuuugagacggaguuucacauguguugcccaggcuggagugcaauggcacgaucucagcucacugcaaccuccaccuccugguucaagcaauucuccugccucagccucucaaguagcugggauuacaggugccugccaccaugucuagguaauuuuuucuauuuuuaguagugaugggguuucaccauguuggccaggacggucuugaauaauuccugcccucaagugauccacccaccuugccuuccaaagugcugggauuacaggcaugcgcuacugcgcccggccuagcuuggcauuuaaaaccugcugugguuggccccuuucuuaacuuuccaauuuuguauuuuagcuacucucauuacuaaacguguaguuccaaccaaacagucugucuagagauccucuucaaguucugccaccaugccuuugcucacacuauucucuugcuuggauuugccuuaccccuucuuucugcuuauucaugccuuccucuuacuucacuguccaccuucucuugaggccuuucuuggccgcuugaguucuuacugauuauuccugcccucugaacuccuguaguaccaauuggauauagcaguuauuuauaauaacuuuguuacuugucugucuauauccuuuauuuacaaauagacagcuguuugaggucaggggugaguuuuuacuucuguguucauagaacaggacaaugcugucaguaugugguguguguguguguguguguguguguguguguguguguguguguuuuguuuuguuuuuucagacagaguuucacucuauugcugaggcuggaguacauggcaugauuucaacucacugcagccucaaccuuccagggucaaaugauccuccugccccagccucugaguagcugauguguaccaccacgcccggcuaauuuuuuuauuuuuuguagagauaggauuuugucauguugcucaggcuggucuugaacuccuaggcucaagugauccuccugccucagccucccaaaauacuaggacuauaggcauaagccacugugcucaaccucagcauauguuuuuugagacauagaaguaacaagcuuaguagagguagucuguagauaaaugaaguacuuaccaagucucaaagauuuuaaaccacuaaaagccugugaaaugcuucuauaguuuacagggaagcugugaauucaauauagaugaauaggguuuuaacauuuuagcuaaaacccaucucuguuuggauucaacuggaguccagagguauuuauucucuuuuauauucuccagggcaccaaaauucugaauugcaguucuuuggagauuacuuuagaaguuaaauacaggcugggcacagugacucacgccuguaaucccagcacuuugggaggccgaggcgggcagaucaccugaggugaggaguucuacaauagcccggccaacauggcgaaaccccaucuguacuaaaaauacaauaaaaaauuagccagguaugguggugggugccuguaaucccagcuccucaggaggcugaggcacaagaaucgcuugaacacgggcggcagagguuggcagugagcugagaucaugccacugcgcuccagccugggcgacagagcaagacuccgucucaauaaaaagaaaaaaaaaaaaagaagaagaaguuaaaugcaacccaguuccagguuugucagaaugaaagaagaaaaauucugacuuggucuauaguauuaaccagggacuugagcuagcaaagagcaaauuuauuaauuuaaagaagagacuauuucauaauaauuuuccuaguuggaaaucuuuaagggguauaauuuuacuuuuaagggaaauuaaaaccaaaugauucuggguuaauaugaaaucucaaguucuugcuugauuuccuuagcgccagcagagacuucagaaggaacgccucaugaaugacuucucugcagccuuaaacaauuuccaggcugugcagagaaggguaucugaaaaggaaaaggagaguauugccagagcaagagcuggaucucgucuuucuguaaguugauucccaaaagaagaccuuugcaauaucagaauguucuuuuccaaguuuguggguuuuuuucuuuuucucuuugaccaauaaacauguaaguuagcugcugugaaaauggcagguugguguaaccuauguaaaaaacauauaugcaugugaucaaagccuagaaaggaaucugaaugaagguuaagagauauaggaggaagaacuaugucuaauuuucuuuuucauuuugauauauugguuuuaacguuaaaaacuugaaaauaaaaauaaugaaucuguuuccuggaauauaacaggcuaguuuauuuggacuagcccucuguuuuugaaaaggauuuucaaauacuggauuuuaaaaauccaacuucucaaaaguaucaaagauuaugaaaauauuaagguaaagccugagaggucagcagaauacugaaacugcuuuugcauugaaugucuuuacugaaggcaaacuugaacuucaguuuugauauccucauggcauggggaggauaaaagucaaagccaaagguccaugcaagagagagaauauaaaagaagguacaacucaaauuaaacugggcccuaagagacuauauccuuagaacauuaagucaaaaguaagcucuucuaucccccggcagauuacagaaagauugcauuagcacugaacugagcagauggaggaggagggcaggagggaggagaaaucuagacaagguuaccacaaaguaaccuucuucaggcagauuuucugcucaaauucauccuaccugaaugguucagugguccuggacugggagagccaccuaugugugggauagaagcaaacacaaauuccuucuguagaaagacaccuuuauccuagcccugaaauaauacucucaaauaauuuuucuagggcaguaaguaccagucacuaaaaauaaccaugugugcaaagaaacaaauuacucugaacaagaauuaguagaaacaacaaugaagugaaauauaccuacaaagacuuuuuauauuagaauuauaagacaacuauacuuauuguguuuaaagacauaaaaggcugaaaaccucugcaggaaacuacacaaagauuugaaaaagugucaaaagaauuucuaaaauggaaagauauaauauagaaauuuaaaaacuuaguggaugggugguuuaacuaaaaaauugguuagaauauauuauccagcauguagcauaggggguuaagagguuaaauacggaagaaagauuaugaaaaauggagaauggagagaaaagaucuaacguaguuuuaacuggaguuauagagugagaauagggcaaacauagaacagaggugauauuugaagaaauaaugagugauaauauucuagaacugauuaaaaacacuagccugcaguuucaagaagccuaacaaaucccaagcaggauaaauaaaaucucuaaucuagauacaucaaagacaaacuucagaccagagacaaagagaaaaaucauaaagauagcuagagaaacauuagaauaccuucaaagauacaauaguuagauugacaguugacuucucaacaacaguggaagccaguagagugcuaucuugaauguugaugaaggacaauaacugccuaccuaggauucuaaacccagugaaaauauaugucagaaugagggcuaauuaaagacauuuucaaucaaaagagaguuuucugucagcacaucuuauugaaggaaauucuaaauaauguauuucagauggaaggaaagugaucucagauggaaagucugaaaagcagaaagaaaugaagaacaaaaaaagugguaaagaugugaaaagacuagucacagggagaagacauugcuauauauauuuaauagcaaaggacuagcauuuagaauauauaaagaauucggccaggcgugguggcucacaccuguaaucccagcacuuugggaggccaaggugggcagaucacgaggucaggaguucaagaccagccuggccaacauggugaaacccugucucuacuaaaaauacaaaauuagcugggcgugguagcgcgugccuguaaucccagcuacucuggaggcugaggcaggagaaucgcuugaaccagggagacagagguugcagugagcugagauugugccccugugcuccagccugggcgacacaacaagauuguaucucaaaaaacaaaaaacaaaacaaaaaaaaccccagaauucccaugaaucaauaugaaaaagaaagauacaacucaauagaacaaaaguugucaaacuuuuuaaucucaggaacccauuacacucuuaaaaaucauuaaauucuguggccgggcgcaguggcucaugccuguaaucccagcacuuugggaggccgaggcggguggaucaccugaggucaggaguucaagaccagccuggccaacauggagaaacccugucucuauuaaaaaauacaaaauuagccgcgcaugguggcgcaugccuguaaucccagcuacuugggaggcugaggcaggagaaucacuugaaccugggagguggagguugcagugagccgagauugcaccauugcacuccagccugggcaaaaagagugaaauuccgucucaaaaaaaaauaucauuaaguuaucuucuugaaucuuaaaaaaaaaaaaaauuacuaaggaccuguauuagucuguucucacucugcuauaaagaacugcccgaagcugggcgugguggcucacgccuguaaucccagcacuuugggaggcugaggcgggcagaucacagggucaggaguucaagaccagccuggccaacauggugaaaccccaucgcuacuaaaaauauaaaaaauuagccgggcaugguggcaggugccuauaaucccagcuacucaggacgcugaggcaggagacucgcuucaacccgggaggcggagauugccaugagcugagaccgcaccgcugcacuccagccugggcaacagagugagacuccaucucaaaaaaaaaaaaaggaagaaagaacugccagagacuggguaauuuacuuuaauuuauauugaaguauuuaauuuauauaggaaagggguuuuguugacucacauuuccacaugucugggaggccucaggaaacuuacagucaugguagaagacaccucuucacaggaccgcaggagagagaaugagugcggagagaaggggaaagccccuuauaaaaccaucagauguugugagaacucagucacuaucacgagaacaacaaggggaaaacuguccccaugcuucaguuuuguccaucuggucucgcccuugacacguggggauuauuacaauucaaggugagauuuggguggggacacagagccaaaccauaucagaccccaaagaaguuuuguuuauaugagucauaucuauugauguauacuguauuagaaauuaaaacugagaaaaauuuuagauguuuguuuauucauuuacaaauaauacacuuauuacauauuaacaugaauauaaauuagauuuuuuaugcacauggggaaagaaggaauuaaauuagauuuuucauuuuaaaaaauuguguuuccaagaaaaaaaauuagugggcagaguagcauuauuuucauuuuugcaaauuuuuuuuauuuuaaugucuggcuuaccagaaggcagcuagauuuucauagcugcuuuuguuuuuuaaccuccauacuaaagauguaaaugauuuauauaacaccauuacaguauuagaauauucugaauuugacuauuuacuuacuuuuaccagugaauguuauacuuucauauguuuucauguuacuaauuauuaugcuuuucauucagcuugaagaacucccuuuagcacuucuugugaggcagguguaguggugaugaacucucucagcuuuuuucgucuaggauuauaucugcuucuguauucagucuauuaugauagauuguucugguugaaguaucugaagaaaauccaagcuagcagaaauauacaauuggaaaaggaauauuuuuauaaccuuguugauacucuucuuugauacuacaucaaaacuugacaaaaguuaguugcauuguacaaucuaaaaccauuauaaugacuucauacucuguuacauuaacaucuguuggucuauauuauacuuugauuggaucuuuuauccaugcaugauuuuuauagcaucauguauuuaucauuuggauaguauugguucccugaguuaugcagcucuuccaaaugucgauacauuucauuuuacaauauaaaaaaauacauauuuccaucaguuucaccagaaaaguauuuaaauauugggaaacucuuacaaugguagauacaagucuuccgaaauuuuauuuuuauuuuuacuugaaagcuacauuuuugucauuggcaacaaacacccucuguuguuuuccuugaagugacaggcucauacuucuuuucaacaaguugucugccaaauacccaucugaaaaguuuauauguauacguuuaugaaaguuuuaaagcuuuuaaauaaguuuuuaguaaguucuuauaaaacuauauugaauaaguaaaaaugguauucccuaaaaaaaguggcuaguucagccugcaguuccauuacacaagugcuuuuccuagagacagacauuguauuucuuuaugcagcagaaguacuuuaugugcacuucccauuucacaauacagaauaguagaaagauauguauugaggggucaagguuuaauuaauaauuuguauggcuucaagaauacauuggcuuuuaaaauacggugaguguguggugaugaagaauacaauaauacuagugcaauucggugccacugccuucagccauuuuaucuaucuguauuaguccauuuucacacugcuauaaagauacuaccugagacuggauacuuuauaaauaaaagagguuuaauugacucacaguucugcguggcuggauaggccucaggaaacuuacaaccaugguagaaagcuaaggggaggcaaggcaugucuuacaugguggcaggagaaagagaaagagagugcaggggaaauaccagacacuuaccaaacaaccggaucucaugagaacucccucacuaacacgugaacacuaacacccccaugauccaaucacuucccaccaggucccucccuucgcacguugggauuacaauucgagacgagauuugaguggggacauagagccaaaccauaucacuaccauugccuuuuuuuaauuuuuaauuuuugugggcacaugguagguguauauauuuaugagguacaugagauacuuucauauagucauguaauguguaauaauuacaccaugguaaauggggugucuauccccucaagcauuuauccuuuauguuacagacaauucaauuauacucuuuuaguuauuuuugaauauauaauuaaauuauuauugacgauagucacccauuugugcuaucaaauacuagguccuauucauucuuccuauuuuuugugcccauuaaccauccccacuuccccgccaccagucccccaccauugcuuuugcuccguccuguugauauuuacacucauggagcaaauaaacacguuaguauuauuuugaguaauggucaaacaaaugaaaagguacucagcuucuuuaguaauggugaaauuacagauuaaaauaacaaugaaauacuauuucaugcccaccaggagggcagaaguuuaaaauucugugaacacugggaguugucauuauggauaugaugcaacaggaacuuuuuuaucuggccggugguauaaguuagaacaacuacuuuggaaaacauuuuggcuguaucuucagaacacaugcagaccuugugauccagcaauucuacccuagagaaaccuguauguguuauaccaggauguauguacaagaaugugcauagcagcauuguuuguaguagucaaaaauuggaaacauccagaugucugucaacuguagaauggauaaauuguguuauguucauauacuauaauaucauacagcaaagaaaaugauugaaccacaguuacauucaguaucagagauggaucuggcauaaucuggaaugauucaaaaaaagcacuaaagaauauaaacaguauaauuccauuuauguaaaguucaaaaacaggcaaaaugauauugaauaagaauauagcucacuauucuuaaaaugcaagaaaaugauuuucacaaagucaagauaauagauacuuuaaaagggagggauggaguugugauuggagaagggcacaugaguaggcuuuuaggacucuggcaauguuauuucuugaucuggggaaaaagauaaaguaaaaagaaaaaaacaaaccaaaaacccacaguguuccucugaguggauagaaauuugaaauucuuuucauuuugcuuguccuguauugcuauuauaaaaaggguaagcuuuuuaaaaaugaaaauacauugauuuuuaccauuuuugcuuuguuuuuuauuuauuuauuuauuuauuuauuuauuuauuuauuuauuuauucugagagggagucucacucugucacucaggcuguagugcaguggcacgaucuuggcucacugcaaccucugccuucuagguucaagcaauucuccugccuuagccucucgaguagcugggauuacaggcacccaccaccaugccuggcuaauuuuuguauuuuaguagagacgggguuucaccauguuggccaggcuggucacaaacuccugaccucaaagugaucugcccaccucggccucucaaagugcugggauugggauuacaggcaugagccaccgcacccagccuguuuuuaaauuauaaaaguaauacauccauuagacugauuuuuuaauaauaaugauauuuauucuuacagcuugauuauaaagcauacuuuuuccucaucaaacaguaacaccugaaagauucgauugcuagucuuucaccaaaugccaaaaauccuggugaauucucuuuuaaaguagcacuauaugcuugccuaacuuucuuaauucaauaguauuagauaaauuaccauuggaaagacuauuuuucaaaaacguuauuauaugccaaagaggagacuaugauaaaucagaguuauuguaagaauuaaacaaaauaauauacagaauaauaguucccaauaaguucuguuaaaucaaaaucugccacgauuugaagcagccuucuugaaaauaaagguuagugggcugggcgcuguggcucacgccuguaaucccaacacuuugggaggccgaggcaggcggaucacgaggucaggaguuugagagcagccuggccaauauggugaaaccccgucucuacuaaaaauacaaaaauuagcugggcgugguggcgugcaccuguagucccagcuacucaggaggcugaggcagaagaaucgcuugaaccugggaggcagaggugguagugcagccgagaucgugccacucgauccagccucgggaccagaguaagauuccaucucaaaaaaaaaaaaagaaaagaaaagaaagguuaguuuauguguguuuaugccaaaucccaucucuccagaguuuaauauauauugauaauagauugauuagcaacguucucaaagaucucauauacucuuuuuuuuuuuuuuuuuugagauggagucuugcucuguuguccaggcuggagugcaguggcgcaaucucagcuuacugcagccuccgccucccugauucaauucuccuaccuuagccuccugaguagcugggacuacaggugcccgccaccacguccagcuaauuuuuuuuguauuuuuaguagagacgggguuucaccauauuggccaggcuggucuugaacuccugaccuugugaucugcccaccucagccucccaaagugcugggauuacaggcgugagccacugcgcccggccagaucucauauacuuuugaccacacaucaguaaaaaucaaaaaaaccuuaggagaaaaaaagguaacaccauuuacauuagacugauuuuugaagugaaucugcuuuagugccuacugugcuauguccauuuaaaaaauuuuuacauguucugaaauuuuguauucuugcaaguuuaucuaccucccccuaaauuuuaaaauauuuuauuguuguuauuuuuauuuuuagcccuuucuccuacgcauauuauucuccacccuguucaguaugguuucuguucaggacucaaacuggaaugcagauuuucuucaaccacuuuacacccacuucuuaguugagacagauugccagaguccuauguaaucuuacagauucugugggugucaaaggauguugcuucuuuauacugugcuaaggaagcccuuguuuugugugucugugauguguuucuggaugacagcagcaauaauaccaucuacuuucuaggcagaagagaggcaaagagaggagcagcuggucucauuugacagguaauagaauuauucauacaaccugcuggauaguugagaugggaaucuaucucguuauauuuuaauuuuaaaaaucaaugaaaaaauagagggcaaaaauaagggggcaccuggaguggauaacauaauccacagaauaaaauuaaaaaggcaaaaccaugggcuuuuccaagcucuuugaguuauuggaaggaguaauuucaaggugaauaaaaacuuccaagaaaccauugaugucuauguguuaagcagagagcuugacucccuaggaauaaguaugaaccuacaugucuacagauuaggaagucuaagucaucuuaccucuaaugcagauuuaaacccaucagaguucuugggucucuacucauuuauaaaauggaagcaacucauccuucuaggaguauuaagagggaaaccagacaauuuguaucugaaugauguucuuaacuucuccaaacuaaucacauggaaguguauuugugguauuaguucagaacuugauauguuuuagcauagauacacauccaucccuccccacuacacuaugagcaccucaaaggcuuggggacucugucuuacuuaguuuuguaucucuagcacgaagaggacguuauuuaaacauuguaggggugaaguaugauuuaugauacugaugggaaaacacauaauaauggaaaauuucaaaguguuuuauaucuaguauaauaaguaauauguuuuccuuuuaaaugcuugaaaauaaagaggcguuggggcaugguggcucaagccuguaaucccagcacuuugggaggccgaggcggguggaucaccugaggucaggaguucgagaccagccuggccaacauggugaaaccccaucucuacuaaaauacaaaaaugagcugaguguagaggcaggugccuauaauccccacuacucucgaggcugaggcaggagaaucucuugaacccggggggcggagugaaguaagcgccacuucacuccggccuggaugaaagagcgaaacuccgucucaaaaaaaaaaaaaaaagccaggcaugguggcucaagccuguaaucacagcacuuuggcagguugaggcaggaggauagcuuaaagccaggaguuugagaccagccugggcaacaaagcaagacccccauuucuaaaaagaauuuuuuaaaaaguguuauaacauuucacuagcuuucuguuaagaggguuuuuuauggauuguuuuuuaauagagaugaggguuuugcuauguuagccagguuggucuugaacuccuggccucaagcaguccuccugccucggccucccaaagugcuaggauuacaggcaugagccaccgcgccuggccuguuaagagguauuuaacccaaagcauaaccccaaggaaauuuuggaaaacuaggagaugugauucuguugaacuaacuggcaaagcacugauaggucacuuagcuugcucuucuccacccacuuaguacugaagguacuaaugcagcuugcacuuugagagugcccuggaagaugauggugcaacauaauucaaugaguucaaaucucuggcuacuuuccuugucuggcaagccccagugagauuacagaguauaccccuaaauggaaacagccaggagucccauccgucauaauucugccacaugucagcuuugcccauggaagcugagucuuuguuuuccugauaucaucagcucuuugcuucuggauaugaagaauguggcccuccaagacuuuauugauagcagaggacuggagcccugguaaugucuuugcauagguucugcuggcaguagagauguuggagauaugucuuguuaugccuuugagaggagaaaucaccuagugugccuguuucccugcagccaugaggaguggaaccagaugcagagccaggaggaugagguggccaucacugagcaggauuuggaacuuauuaaagaaagagaaacggcaauucggcagcuggaggugagagccacgucauguuuuuuguuugacucagugugucugcagguaucugaacuccuuaguucacuuuaauucucuuagugauuaugaaaaggcauaaaaugugucauugugugauuuguauuuuuucugucucaguguaaucaugguggguuugaacuaccgguuuuuuuuguuuuuuuuuuuaucuuggauggaauuucgcucuuguugcccaggcuggagugcaguggugugaucuuggcucacugcaaccucugccuccuggguucgagcgauucuccugccucagacucucgaguagcugggauuacaggcaugugccaccacgcccagcuaauuuuguauuuuuaguagagacgggguuucuccauguuggucaggcuggucuugaacucacgaccucaggugauccacccucaucggccucccaaagugcugggauuacaggcgugagucaccgcuccuggcaugaacuacuguuauaauggcauuggccuuggugcccaggaguacucaaauccuuuccucaaucaccacaucuuauacggaucaccacaucuuauuucuccuggagaaauguacauggagaacagaacaaggcagacagauauuuuauugcucauuagaacuuugaccucaaaucucaaugccaaccuccggguuaggcaggacuccauggagagccccuuugcuuagucugaagagcccagaauaaaggcaggccaaaagucuugcuccauuuuuguauauccuaaagucuaaucccaaguuguacaucuuaucccuucagugagucagagaaauaggaacaguuuuugagguggagguugagggagaagucuguaggccuuucuuaccuaacugagcuuucaacuuuaauuuugcacagugacuaauaaaauauccuuuuuuuuuuuuuuccgagacuaagucuugcucugucgcccaggcaggagugcaaugacacuaucucagcuuacugcagccucccucuccuggguucaagugauucuccugccucagccuccugaauagccgagacuaccaguacgcaccaccacacucggcuaauuuuuguauuuuuaguagagacaggguuuugccauuuuggccaggcuggucuugaacuucugaccucaagugaucugccugcuucagccucccaaagugcugggauuacuggcaugaaccacugugcccagcuaaaauauccuuaaaccugaguuuucuccaguuuaguuuucuccgaagguagaaggcugccauugcugggaucaggggaggagaaaaggagagagggaaauuuugagcucuuccuuggccuccaucuguagcagugguucugaacugugagugcacaugaggaucaccuggagaagauuuuuuuuuaaugccccagcucucauccaccacuaauuaccugaugggauaaugugaaauuccuguuuauuauauguuaaaaaugggcaaauauccauuauuuuauaugguucaaacuaauaaaucauaauuucugggcgugaggcccugggcauggguauuuuuuuaaaaaguucccccaggugauuauaauaugcagccaggguugagacccacugcccuaaaggccaucaaugucuguuuuuaucuauuuauuauuuauuuuuugagucagagucuuacucugucacccaggcaggagugcaguggcgcguucuuggcucacugcaaccuccacuuccuggguucaagcgauucuccugccucagccuccugaguagcaaagauuauaggugcccgccaccacuccuggcuaauuuuuguauuuuuaguagagacgagguuuugccauuuuggccaggcuggucuugucuguuuuuagaugggauaguuuauccuuaaguuaugauuauuuuauugccuucaaaaaugucauaucuuuacucuuuuucaccuacugcuacuacuaauugaauuaauugucuaacauuagaaauauggcuaagugcaauggcucaugccuguaaucccggcaaguuggaggcugaggcaggaugauugcuugagcccaggaauucaagacagccugggcaguguagcaagaccuuaccucuacaaaaaauaaaaaauuaaccgggugcuguaacauguaccuguggucccagcuacucaggagccugaggcagaagaucacuugagcccaggagaucaaggcugcagugagccaugaucgugccacugcaauccagccugggcaacagagcaagacucugucucaaauaauaauaauaauccuuccuucaaagaaaaauuacuagccgggcgcgguggcucaugccuguaaucccagcacuuugggaggcugaggcgaguggcucaccugaggucuggaguucaagaccagccugaccaacaugguaaaaccccgugucuacuaaaaacacaaaaaauuagccgggugugguggugcaugccuguaauuccagcuacuggggaggcugaggcaggagaagugcuugaaccugggaggcggagguugcagugagcaauugcacuccagccuggcaacagagcgagacucugucucaaaaaaaaaaaaaaaaauacaguuggcccucgauauauuuagguuucacauccucagacucaagcaaccguggagugaaaauauuuaaaaaaaacuaaaaaauaauacaacaauaaaaaauaauacaaauguaaaaaccaauacaguguaacaguauuuuauauaacacauuguauuaguucaguacauuacuaauacaauguaagugcuauguaaaauaguaauguaguauaaaauaguaauguaacauuauauaaguaauauagagaugauuuagaauauaggagagaaugggcacaaguuauaugcaaauacuaugccauuuuauaucagugacuuagagggagggaguccuggaaccaaucccccacggauaccaagggacgaauguaccguuauagcaaaguggagugagacauauggagcuaaggaaagaaauguaauggaugccaggguauaauggaucauuucauauucaacagaggaaaguccaaauuccuuagccuagguucaauuuucguaucuaguaauuuccaaacucugacauacacauucuauguuauggcaaagcuagguuauuugcucuuuaacugaguugccuuucuguucauaugaccucuccuuugcuuuaaggcacaacucaugucuuaccucuucugcagagucuuccuuuucuccacaccuuucuauaccauuaauucagccauuuccuauauaguacucuuccuucuuauuuauuuuauugugcacuuauuccccacguccaccccaguuagcuguauucacagcaacuagcagacuaccccaacuaugguagacucuuagcaagugauugaaaugcugacaagacuugcuuuagcagauaguccacuauaguagacucuuagcaagugauugaaaugcuugccagguuaugauuccaauaacccuucaaaccuggaagggaauugcccucaaauuuccauagggucaugccccauaugagcaccccuuuaauaagacagguuuccauugucuuucuucugccugaucaugagucagaaaaacucaaauauaggccagacguggugguucacaccuguaaucccagcacuuugggaggccgaggcaggcggaucaguugaggucaggaauucgagaccagccuggccaauguggugaaacucugucucuacuaaaaauacaaaaauuagggccgggcacaguacaagcucacgccuguaaucccagcacuuugggaggccaaaguggguggaucaccugaggucaggaguucgagaccagccugaccaacauggugaaaccccaucucuacuaaauauaaagaauuagccaggcauggugguacauccuguaaucccagguaccugggaggcugaggcaggagaauugcuugaacccaggaggcggaaguugcagugagccgagauugcaccauugcacuccagccuagcaacaagagugaaacucuaccucagaaaaaaaaaauagccgggcgugguggugcacgacuguaaucccaucuacuggggaggaugaggcaggagaaucacucaaacccaggggauggagguugcagggaguugagauugugccacugcacuccagccuggaugacagagcaagacucugucucaaaaaaaacaaguaauaaauaaaaauaaauaaaaagaaagaagggacggaggcugggcgcgguggaucaugccuguaaucccagcauuuugggaggccgaggcaggcggaucaggaaggaagggagggagggagggauagagagagaagggagggagggagggaggccaggcacagugacucaugccuguaaucccagcacuuugggaggccaaggcaguggaucacgaugucaggaguucaagaccagccuggccaacauggugaaaccccgucucuacuaaaaauaaaaaauuauccgggcgugguggcaugggccuguaaucccagcuacucaggaggcugaggcaggugaauugcuugaauccgggagguggagguugcagugagacgagauugugccacugcacuccagccugggugacagagcaagacucugucucaaaaaaaaaagaaagagaaaggaaggaaagagagaggagaaagaaggaagggagggagggaaaaaaggaaggaaggggagggaggaaggaaaggaaagggaagggagagagagagaaggaaggaaagagagggagggaggaaggaaggaaggaaagaaggaaggaaagaaaaggaagaaaaaagaaagggagggagagaaggagggagggagggagaaagacccaaauauaggggauuuugccaauguuaaauucuuccacugcuguuaggaaaacaagcugcaguucagcccacugagcugauuuguguuuaccuucuuugaucagagcaguaaauagguuguaguccauucacuuuggaacugcuauccacagaccaucagcuuuuugucagucaguugggaguuaccauagggcauuguccagugaugacagaauccagcaacuccucacacaguuccagagucaaucccaggggaaaagaggcuccuuacuuguagcuccuccuugcauuccucagauagcaugaucuuguauaaacauuuaaauucuguaguccaaagucccagugguugucaucgggaggcacucaacaggcuuuugucacaaggccuagcagucuccacauagggcuaucacaccaagaauuugucuauaucagcacuccagccuucugcuguacuguuuggacuugggcgcucuuacugguucucauguagcaugucccauuaauguugcuugaagagugaguuuaugugccuucuguuuuacaauauuggguaggcagcaauagauuauuuucuguuuauggagaaagcaugcuuuguagagccuuaaaaacacacguguuaauagcuaaaacuuuagguacgugagggaaacaaaucuucuaacauguugcuuaauguuaguuaauuguuuuuugucuuccuuaggcugacauuuuggaugucaaucagauauuuaaagauuuggccaugaugauccaugaccagggugaucugauugguauguauuauugauaccuuuaaccucaaggugaguugauaguauuuggcaugcaucuguaaucccagcuacucagaaggcugaggcugaagcaccaucuaggaguuugaagccaaccugggcaacauaaugagaauuugucucuuaaaaaagaaagaaagaaagaaaaaggaguuaggcuaggcgugguggcucaggccuguaaucccagcacuuugggaagcccaagcgggcagaucaugaggucaggagauggagaccauccuggcucacacggugaaacccgucucuacuaaaaauacaaaaaauuagcuacgccugguggcaugcaccuguagucccagcuacucgggaggcugaggcaggagaaucccuugaacccaggagguggagguugcagugagccgagauugcgccacuguauuccagccugggugacagaaugagacuucgucucaauuaaaaaaaaaaaaaaaauggaguuagucauaucagcuauagaguuaaaguauguuuaggaaugccguuuuaaaaauuaccaaauuuauuuuucguagcaauuuuuuuauguuaucaaauguagaaguuaaaugaggccucaugaauacucagucccauugacuucuuuguacaucuuuguuuagagaaauagcucucagcuucccagcuuuuaucucaacaaacuugcaaaauuaugggguuaguaacccuuuuuuuuuuuuugagacggaguuuugcuguuguugcccaggcuggagugcgauggugcgaucuuggcucaccacaaccuccgccuccuggguucaaacaauucugcugccucagccucccgaguagcugggauuacaagcaugugccaccacgcccgcuaauuuuguaguuuuaguagagacgggguuucuccauguuggucaggcuggucuugaacucucgaccucaggugaucugcccgccuuggccucccagguggugggauuacaggcgugagccaccacgccuggccaguaacucuuuuuuuuaaagcuuucuauguggaaauaauuucgaguuuauuaaaaguugcaaaaauaggcugggcaugguugcucacgcuuguaaucccagcacuuugggaggcugaggugggaggaucacuugaagccaggaguucaagacuagccuaggcaacauaguaagacccugucuuuaccaaaaaauuagccaggcauaguaacaugcaccuguaguccuagcuacucaggaggcugaggugggaagaucacuugaacccaggaguuggaggcuacggugaacuauuauuguaccacugcacuccagucuaggugacagagugagaucccgucucuuaaaaaaaaaaaaaaaaaaaagguagcaaaaauaaaaauauuauaaggaccuucuuuauacccuuuacccagauuuaccucuuguuaacauucuaccccauuugcuuuauuauguauucuuucucucuuucucuauguguaucuacauaauuuuuuaugaaucauuuauggguaaguuaaauacuucauagcccccaaaaauucauuguuuuuucuccaaagaaaaggcuagucucuuaccaagguaguaacucgauuucauggcuggauaguuuggauagugguagugaaaccaggacauguaacaucagaaaucuguucaauuugcagucuuaaaacaucugaguguguuaaaacauccucuguccuuccuuuugcagauagcauagaagccaauguggaaagcucagaggugcacgucgaaagagccacugaacaguuacagcgagcugcuuacuaucagguaaaagcggguaccaaagaaagucacucuguguugcagacuuuuuaggccaucagaguacauugacauauugagaacagcuacagccuuugcuuagguuuaagcuaaaggaaaguagucauaauugcagucccaguuccauuuuuauuauuuuccuuugcagauagaucuacaaaaaauaaucacaccuugaauaaacuuaucagaaggcuaguaacugcaaagcuaacccuauacacuaauaugauaccuaaaucugcuaugaggcuguuuuauaucccgaacagcugaauguauuucaauuaggauaguaagaaguacaguuaaaguagaagacuucauagauucuuuauguugaguguugccauagaggauggacauagaaucaacuucgacugcuauuuauauaugaauaaauaaggauaaucauucuggaacuguuccuguaaagugaaauccuucuacauguuaguugaaacucugguuuuuuuacuuauccaagucuuuaucucaguguacaaauaaugugaaugaagucuuucucacuucccuucaauuugguguugcauggcuuuuuagaaauaaauagcauuucauguccuucgcccacuuuuugaugggguuguuuguuuuuuucuuguaaauuuguuugaguucauuguagauucuggauguuagcccuuugucagaugagcagguugcgaaaaucuucucccauuuuauagguugccuguucacucugaugguaguuucuuuugcugugcagaagcucuuuaguuuaauuagaucccauuugucaguuuuggcuuuuguugccauugcuuuugguguuuuagacaugaaguccuugcccauccuauguccugaaugguaaucaguguggcgauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacagugauagacuggauuaagaaaauguggcacauauacaccauggaauacuaugcagccauaaaaaacgaugaguucguguccuuuguagggacauggaugaaauuggaaaucaucauucucaguaaacuauugcaagaacaaaaaaccaaacacugcauauucucacucauaggugggaauugaacaaugagaacacauggacacaggaaggggaacaucacacucuggggacuguugugggguggggggagggauagcauugggagauauaccuaaugcuagaugacgaguuagugggugcagcacaccagcauggcacauguauacauauguaacuaaccugcacauugugcacauguacccuaaaacuuaacguauaauuaaaaaaaaaaaaaagaagaaauagcauuucaguuguuuuccguguuccugggauagcuguauuuuaccugggagugcucguaaagaaauucguauuuaauaauaguguuuccuuuaaaaacuaggugauuaauuuaguguccaacaguaaaggaauaauuaaguaaauuauauacauccacucauuguugcauaugggaauuaagagauguuucugaagaguuuaaacagaaaaauguuuauacuaaacauuaagugaggaaaaacaucaaacaucauacaaugugauccaguuaugucaaauaauauacauagauaacaaaucagaaagaaauacaaaaauguugacgguauuaucuaugggugauuuuuuuuucucccuccgcuugcuguauuuuuuuuuuuacaaugaacauaacaguuuuauacguauuauaaaauguuauuaaaauacacaugcacaaauaacuuauuuuauugcaaauaaugccuggcagcacagguauaguuccuuugcaaaauuguauguggggacuuggaauuaaaacuuugaaaccuauacuacucggcugggugcgguggcccacgccuguaaucccagcccuuugggaagccgaggcagguagaucacuugaggucaggaguucgagaucagccuggccaacacuggugaaaccccgucucuacuaaaaauacaaaaacuagcugggcauaguggcacacgccuguaauuccagcugcucaggaggcugagacauuagaaucacuugaaccuggaagguggagguuucaguuagccaagaucgcaccacggcacuccagccugggugacggagugagacucugucucaagaaaaaaaaaaacaccaaacaaacaaaaaacacuugcacuacuaccuagugcugcugacuuaagauuucugggaaagucugugcauaauuuugcauggauagaguuaaucuuuaauuacaaggaggcagauuuaugaagcauucuuagagucuuacacauacaaauuuuacuuguuucaugaguaucuuguuuacauauuucuuuccucagaaaaaaucucgcaagaagauguguauccuggugcuuguccugucagugauuauucuaaucuugggacuuauuaucuggcuaguuuauaaaacgaagugauugccuccgaucguucucccgcugagcuguuuucaagggcaagugcuuguugaagucuugccagaacaaacugaucacaagaagacagcauauaucagaacguccuguaaucauuuaguuagaaacuaacuacuaacuagucuuuggaauucgugaccuauggagacaguaauuaucaauuuauugauucuauugauuucucaaauuaggaauuaacuuauguggauuuugcuuccucuuguauucugauugcccuucaucccaaguguuuacugaaaauuccauucuagauauucuuguuuugacaaaugacacuacagucucguaauauugucuuuuauguauauacaaaauuuaccuuuuuacuagcaucugagauagaguuacuuucugguacccaguauauuggagucugucagaaacucuauaauaggccaccaguuuuuauuauuuaacauuuuuauuugaauuucuaagaagccuauucucuaucuauuuugaaagauuuuggcacuauauuuaauuggaagguaaaauauuguacaugugauccagaguaaaugagaagucucuaucugagcuggucaguuacuggaguacauguuacuaaucuggguuuaaaguuuacuucauuaucugcuagugucauccacagcaguucauccucauccacacuaagccauccuguuagcuuuuaaaggaaguuaauuuaauuaacauuaauauacucuaugggcucccucucccaccugucugcauagaaaggcagaauuagacauagcaugcuuuggaaaagcaaauaggaauuguugggaaugauuuaaucuuguuguuguuguuguuguuguucacuugugguucuacauuccuggugaaugaugaauguugcugucaaagggcugcccccuaccuuauaaggguugcugggcauuugaaggcaggaagauuuuuaaagauagauugagguugguuuaaaauuauuccuguaaaccaacaauaaagcaaagaagagguucauuuuuguaaauaacacugguuucaaauagugauguuagacuuaaccuaauuuauaaacaagagauuaauaucuccaugcauaguuuuagacaaaaaaagauguuucaauaaaauuacugucuuguaauauaaauguuguccacuucccuuuuccacaggccuagaacaguuaaagggaacauaauuuguuuaggcucccacauaaaugugaaucuggccaacaacuuugguucauccuuuagugaauuagaggauuuggcuacccugaguauauuuauauucauuucuucuguucuccuucuguuauuauacuuaaucuucuaaacuaaacuaaugugaacaguagggaagcaagggcccaaaugcauaaguuucuuugcacuguugcacuuacuuaauacaaauaaauguuuuuuaaagcuuuuguaguauguuuuuaugaguuaacauccuaaugugguagguauuagguaaugugcugucaugagaaaaauugagacuuccaagaaaacuggacaccaggugaggguugguuuggagacggaauagguguagcugccuuuccuugaaaaacaguguguagagauggcugagugcaauggcucacacuuguaaucccaacacuuuggaaggcugaggcgggaggaucaguauaucgguacgucugagcccaagaguucaagaucagccugggcaguauagcaagaccccaucuccauuuuuuuuuuaaugauuuuuuaauuaaaaaaaagaacaacaggauagagcuguugggguggcacaguggcccaaagagcagcuucagagauaauuccuugguucuaugaucccuguuuaacuccaaauuacagucggacuuggauacaucauuuguaacauuguaggaaagaaaaaagucuugguugugaaaaacgauuugcauuuggguaaaauaaagugaccaugcuuuuguucuguaauacugugugaccugugguuguuguaauggugaucauggagagcaaauaugaacuuggccuggauuuuaaauggccuagaauuugugguaguugccaaagagguucuccuagguggucuuaauaaaccuauucacagaauucuccuuau

SEQ ID NO: 14155 - RNA, 2669 nt, Homo sapiens
uccacagccagacgcccucagacagcaaagccuacccccgcgccgcgcccugcccgccgcugcgaugcucgcccgcgcccugcugcugugcgcgguccuggcgcucagccauacaggugaguaccuggcgccgcgcaccggggacuccgguuccacgcacccgggcagaguuuccgcucugaccuccugggucuaucccaguacuccgacuucucuccgaauagagaagcuacgugacuugggaaagagcuuggaccgcuagaguucgaaagaacuccguggauauuccagcuuucccacaagcacugaucauuaugagccaguuacuuaaccgaucugagacacucucaccuccuaaauagggauagaugauacuaauuugcagguugucauuaugauaagacaggaucugaucaauauaugugaauuguuuauauuuggaaccuuuuuauugaguggaagaaguuguuuuaaauauucuagucaguucuuuccugcucccaggaaagcccggauuauguuuuaagauaagcaaaaugucuuaaaaguaagcuguuuuacuuugaauuuuucccuaaauguugauuaguguacuagauccauuuuaauuuggaaagugaagugcuacuuauuugaacuucuuaaaaaugcuaauuuuaacaucuaaagaguuaacuaagaaaagcuuaguaacaugauguaccaaguugaauaugcuguuauccuuauuuagaauagaaaauugguauuucuacguuuuauccauucuaaggcagguuaaaaaauuguauuuccaugacuaccuauauauuucuugaauuuauuauuguaaaguugauucauagucaaacaauuaaauguuuaaauuaagauuaagacacuagagaaugauuuauuugcuguccuuuaauugcagcaaauccuugcuguucccacccaugucaaaaccgagguguauguaugagugugggauuugaccaguauaagugcgauuguacccggacaggauucuauggagaaaacugcucaacacguaaguuuguccuuugguugccucauuaggaguggggcuggauacaguuaucauuguauagauuugugucuuauaaugagucccauuaauuucucccucccuuucuucgucuucuugcagcggaauuuuugacaagaauaaaauuauuucugaaacccacuccaaacacagugcacuacauacuuacccacuucaagggauuuuggaacguugugaauaacauucccuuccuucgaaaugcaauuaugaguuauguguugacauguaaguacaagugucuuucuaagguuuuuagccuucucaaagaaaaauaugcuuuauaauacuguaagccuaaucuaaaaacauauuuccaagcuuaucaaaaagacuuuaagauagcuuuuaaguuugccuuccaucuuaaucgccaaaaauauugacauuuagucccauccaguuuauacagucugcucacaacucuguauaccucuucuaaccuuuacuguuuggucaguuuguggagguagcaugguccagcuguuuauugaaugcccaugggccacagaauuguucugaacauguagcacccauuaaaauaaauuuggauuuggaucagcaagaaaauaacuuuccaugauucuaaagugggugccauacucagccauuccuuucauaggccucuuggauagugagcagauggcuaccugaaaaaucaauauugccagauuauaaugugcagaguauauguauuuuauuaaagauguauuucaaguggccauuagacuauaaaguguaguuguuuaaaaauagauuuuuuuuauuuuggaguuacauucaaccucaggugccacuuuccacauuuuacaauaaaaauaaugguugauuuacuuaacaaaugagaauaaauaaaacauuuuuuucuuugaaaauuucagccagaucacauuugauugacaguccaccaacuuacaaugcugacuauggcuacaaaagcugggaagccuucucuaaccucuccuauuauacuagagcccuuccuccugugccugaugauugcccgacucccuugggugucaaaggugaguaagaagaauccauuagagauguauuaacuauaagacgggcugcauugcugccaaaaaaaaaaauugaccuuagacuaccauuuauuuauuaacaaaagcaguuuuuacuuuuagcaugguuaucuauggguauuuuuuaaaguaugagucuauauaaacuauuauguaaaagcaaaugagcgucuugguauaaugucuuaauauuuucaaauuauuucuuuagaaaugaaauaauucuaauuaaaauagauaaaaucauucaguaagaaguuguuccaccauaucuuagaacuguuguuuauauuaugauccuauucacaauuguaauucucauauaaaugaagaauucuugguagauugacagucaccaucuccuuucuugaauacauagauggauucuuaccuuagcuuucucauuuuucagguaaaaagcagcuuccugauucaaaugagauuguggaaaaauugcuucuaagaagaaaguucaucccugauccccagggcucaaacaugauguuugcauucuuugcccagcacuucacgcaucaguuuuucaagacagaucauaa

SEQ ID NO: 14156 - RNA, 2971 nt, Homo sapiens
uuuuuauuuuuuguuuauugucaaacuuccccugucagaauguaaacucuauuaggacugaaauuuuuaucuauuuugcuaacuauuuugcuaaucuauuccuaguguccagaauagggcccaacacuuaguaggcacuguauacauauuucuccaaugaaugaugaaugaaagugugcaugcuuggcagggugugggaaguguguuagguguaugaaucgugcgugugugucugggugugugaauggauaaauuuuuugugucuugagugugugagguuucuagcauaaguggccuaugaaccaaguacgugcacaggugcaugugugucuaggcgugugacuguguaccugaagcugggccacgucugugagcauugcacacaacugugugcaugcacaguugugugugcuuguacaugggggugggaaggcgcugucggcuucucccagccuucagcacucacucagcuucaccccaggucgccugcugcgaaaugucaguggcagagaagcuaaaaauaucugcucuccuccuucugcucacugcuugggcugaugggacuguggggccccagccggccccuugggcccugcggggaggaggaacugcuggaugagggggcggggcacaggggaaggaagggaggcccuccuucguacacacccuucccccuuuccucuugggcuccaaagccaggcuucaggcucaccucuuucaggaagcccucaagaaccccccaggagcugugugugucugugugucugucuaccuggcaaggagauauggcccccaucagacuggagcuccacagagcaggucugugccucuucugcccauccagggacuccaggggacagagcucugucuccuucaggccaggggcucccagggaaaaggcuggugcugucuccucccuaagccugaggguuacggaugcagcccaggccagacagggcuucacugggcucugguucuggggccacuagggcccucugaccccagggcagaucugcugugaugaugagcuuguggguagggaggagucucagcucugcccacaccacacccuaggcaggcacguguuugugcuauggguacuugugugggugcaggugggacaugucagggcccgugguccucuggggaccugugccucuccacaugucgggcuccugccugcaucaguggugucagcgacugccugccuugggcacuguggucaaucgguacaaguugaguguauuguauguuucucuguguucuuuuuuucuuuggagggggggacggagucucgcucugacaccucccgaguagcugggacuacaggcgugugccaccacacccggcuaauuuuuuguauuuuuaguagcaagaggguuucaucauguuagccaggauggucucgaucuccugaccucaggugaucugcccgccucggccucccaaagugcugggauuacaggcgugagccaccacacccgaccuucucuguguucuugugugugcacauggaugacuguguauguggguuucugccuuucauugugcaggccugcagauacuagcagggauggacucugcauucaugugggaguugcugaugucaccaugggggguuucuguuugugugucaaugugcucgggugugugucucugucagaaggucagugccuguuuguucuguguauggagguguauguaggugcaucugugugucaguguuucaauuaccauguuucugugugucugugugucugucuuccugguugucauuaugucugcgguaccuccgugccuguguugcgugccuaggucaguuugauuuugcaggucuguagggccacgugucccucuguauguugguguuuuccauguggguuggaaucugccucugcuuuuccuaaucucccaccauuucuguguggaaggccucaggcauuguguguguguguguguguguguguguguguguguauguguguguguguucagcaacuuuccccagccccacagccugcaacccugagaucugcucucccacucuuucuccguuggacuucaggugggagcugaagcaaagagggcaggcaggcagggagcccacgacagccgggggccggggccaggcugccacgagggcccuaccucagcuuuccuccaagcaagcgcuaagccagagccucgguuacauguaaacaccagcugugucaagacggcgcagcuucuucuaggucaacagacagcugugggguugcuaggcaaccgccuggcuccccccuccauuaggcccccucccacugccucuaccugcaaacccucugcuggcuccccccacgccaggauaggccucaccccuccgcgccaauuaacacagcgggacugaggggguagggggucagggcagcuccgggacuggaaucaagguaugaggacguauuaacccuucacgugccaccacccccuccaccuaguccuggggcacuucacacaccccuaacuucaccagucacuuuagggccuggagugaugaggagcacguccugagggauggggacccucagugcagccacaaccaggacuggagagacgcuggaggcagauggcgcagggcuuggucaaggccucuccccuccccagccaagccugggggaaggaaggguuaaauucccccuuuauuuccccugucccgcccccucccaggacaaccaccccauuuccagggcagcaccugcgcucccagcugccgugcccgcuuggugccugaguccgggccaggcagcccccgcagcgcccaggcccucgcccucgccgucgcccucgcccucgccggccccagcgccgcccuuugcccggccugggacuucucugccgggaaaggggaggcgagggccccuaggccuuaggcaaggggcucaggcccaccggguggggugcgugggccagggccgccagccccggggugacuugg

SEQ ID NO: 14157 - RNA, 3192 nt, Homo sapiens
uuuaugacaaaaucauuuuuuauugaguuggguuggagacgggaacagggaaugcacugggggccauaccccgguuggcagaggggugggguguuggcucgugcccccccuccuuuagggcaccgcagggugaggcuuggcccccaggccauggcuguggcccuggacgccaggcuggaguggagcugggguugcauucuggucccagcugccuggccgggcugcaguuuuccccaaauggccaccagagggcagucggaccccagcgcagaggaauuuuugguugcucaggugauggcuucuuaaaaaaauaaaaaaccagaggcugguguguuccccuuccaaacccgaggagggcaggccuggggagaaggcucugguuucuaugaucucuucgauaaaaaauaauccaaaauaauaacaaaauacgugguuucucuuucacccuuuccccccuccaggaacugaggucagaaaugggggugaagggacaagggauacccugguauggccuggauaucaaggugugggccucuuuuuugccccuuaccacccauaaguaaauuuauaaauaaauaaaucaaucauaaauagacacugucuuuguauaugugcauauauaaucuuucucucuccuauuuaggcaacuaugugacuaaucucucugacucuuuagcucagaaauucaaacguaaagugacauggucaaggucaaguuugggggaagagggacaucugggacuuggaauggcacuguaaaacucccagcauucuggaauugcaacccagcugggcugugagacauuucugaguagaacacugaccaccugaacauucuggaaccguggagccagcugggcccccauagggaucugaacagaaccuugaaacacccaauguccuagaacuccagaaccagcugggucugggggguguggagcuggggguuuggaaagaagcccuggagagccuaacauucuggaauucuguaguaaucaggguugaagggucaugaagacucagcuagacaucacugggggagcgggaucggaaggggaucuuggaagaggaacagcagcagcagacagcccacagcacuuucugcacauccugguugcggaaggcguagaugauaggguugaucauggaguuguagguggcagggagcaagguaagauagguguagagagguggagagugggcaucacccagcaggcaguagacagugaagggcaaccagcaggcggcaaaggcuccaagcaccacggccaguguggcaaugcccuugcggguggccacauagugggaggcaggcagcaggugccgcugaagggcaaucugcugggcauggcggcagacgaugcggcagauuugggcguagagcugcagcaugaugccaaacaccaugaagaaggcaauggccagaacuaccagaugguucuuggagaguggauaaaccacgccacauguggucaggccauccaggcaguuccaggccagcacaggcagcagccccaggcccagggcaccuccccacacuaaggccagcaucacauagguccgugucacuguugucucugaauaguaggugagggcauuguacagagaaagguagcggucgacagugauggccaguagacugccgaugcuggcgguaaaggccauugccagcacgccaaccagcaccaggcucaucuccgcugagccgaugcagaagacagcagcaaagugcaggaccaggcccaggccugccagcaggucugccacggccaggcugcccaccagcaggaacaugggggcacggaaggcaggagugcccacgaugauggccaccacuagcgcauucucgcaggacaccagggugccugagaugcagagcaccacaucccaggccuuaggcgagggcaguggugcggcuggaccugugggccccucugcugggcccacgcugcuuacauucacguugccugagccagcugagagccaggccagagggcugccugcaccccacaucaugguaccugcaggagaaaggccuugugagaagcugaccaagcugggugaugggaguuggggucuggagggggugaggugcuucucaggauacguggugggagucucuccucaggauaccugauagagucccaaugccuuauccccacauucaugcccuggggcucuucccaggauaccgcuguccccuccaaugcccccaggccucuaaacaggggucucuuccuggggaucccuguccuagguccugcaggucucuuuuucccacgugugugaccagaggagagacagaagaagggguacuauaaguggaagagggccauaggauccaggggaugcccccgaaggcucaagauugggguagggaaacaucuaccccaucagggagacugagcagcuccgcucccucccaucagagaugaugaugcuagcucgugccugaggcucccagaccccucacgauuuucaguacugccagccuuagacuccgcccccagggaaugcgcgugaagcucccgccagccaucaccccgcacucccgcgguaacaccugggaacucagccccccaccccccacccucccagacuucuguuccuggcuggacccuucuuuccgccugaaucucuaggucucugggcagaccccccugcuggaagacuggaucccugagucagaugccuccuucugcccggacaccuggauuuugggccugacucugccuccugccuggauaccuggauuccuaaauuggacaccuccugcuguucggaccccugggucccugccccagacgccuccugccggcuuaaccucagaugaccaucagucccuccagggccucgggucccugcaggaaugcuuacccuucgccgggucauccaacucaaccccagcacucgagcacuugggcccaagccugcuaacccagaaucgccuaaacccagaauucccaccucgaacucgaaccccggccggccacuaggagccuuccgccggcccagugccccagcauccugcgugcccuucaggaccccuggugcccgcggcggggcccgcuacucaccgcucaggaccaggcgcggccgggccgcggggaggcuccgcucggguccuggcggcgcagggcgugcguggaccccgagaagcccccgcggccgcgggagaagcggcgugaguca

SEQ ID NO: 14158 - RNA, 1533 nt, Homo sapiens
cacccgcguuguagaaggcauccagagccgcggugucgccuagcuccagcgucccgaagggcaggcugcgcagcugcgggggcggccgcggccgggggaccugcgcgcaagccucgcgcaggcagcgcaggggcagcggcuccgccucgguucccucccgaggcucgagcccgggcugcggcucccgggucagcacguagaccacgcugagcggccggcuccgcgcgcagccccggcccgggggcgccgcgagcugccggccccggcucagcgccacggccagcggguccugccagcagcugccggcgcgcuccgccccggaccggggacacggccccgccaugcgggggcgcucaggcgcggggcgccgcgcacugggaaccgggggcggggcaggagccugggccggcagaucaggaaucuugggaucuggaauccguucggaaucggagaaucucccacgggaucuagggauccggaauacggccugacgucccguuccaggaaucuaaaguccagggagaaauccuagcucggacuugcaagguccugagguucugaaauccgggauugggucccaggaaucuggggcauccggugaucggcagcucagagccacuugggggauccugggaaucggcucggaggugcccgccaccuggacuucucaagggagcgcccgccaacgcugcccugccuucacuuguaggcuaagcccagcccuuucccggccgacccagaaagcuccacccucggcccuggggcagagccgcucccuagcggcuugagacucagccucuccccucccuucucucccgccagaacuuuggagacuggcggcuuccggaacagccugugccccugugcacgccaaagacuguggacugcucacagcaagugcacauaaaaugugugaggaggccagggcuagggaaaagguucgauaugcaggcccugcucugcagguaucuguugaaugaauggcucucuagagacaucagggugcgcagagcaugaugaacaauggguguccucccgggcccagugagcgcaggcagggagggacugggaugggggaaaccuacacccuaggccgcuugcccgaaagccuucaguccuggagugggacuuggcaucugagccuuaacugucacuagggggcugcuuuccccaggacccaaccugcuguggacccccgcugaccuuugacuucuaggcagaacguggccaugggaccugagaagcacuuccuacucuaaacaacucuaaacauuucuuuagccaccccuugaaggagucaaccccagcccuuugcacuacagcagcuucucagcuucaaauccccaagaguccccaacuuucuugugugaauuaaugagugaggcagcaaccugguagaagccucaguggacccugaaaccaagaacuggggacuuaaguugaauaacuuguccaggaucacucagcacaugacagcagggugcaaacccaggaccgccugucagacucuuaacuauuuaauucugccacuua

SEQ ID NO: 14159 - RNA, 57828 nt, Homo sapiens
uggcuguaacauccauuuccugcuagggaaccgauggauacaggaauaauccuuugauaauaacccuguaauccucuuggcacuaaccgcuucagauuuugugaguuaaaccagcuccacacucaggucccagacugggcaaaggagaugcuuuccuggacagcccagguucgaagggugccaggggugcgcgccaaggccccacugcccucuggugguuggauccaggaaaugcaccucagggcuccaaccucugcugaaccgagcccauuagggauugagcaauccuuaccccaaaugcuugaaagcagaaguguuucagauuuuggaauauuugcacauacauaaugagauaucuuggggauagaauccaagucuaaacacgaaauucauuuauguuucauauacaguuucuacccauagccugaaauuaauguuacauauuuuauuuuuuuugagacagagucuugcucugucacccaggcuggagugcagugguuccaucucagcucacugcaaccuucaccuccuggguucaagugauucuccugccucaaccucccgaguagcugggauuacaugcauacaucaccaugcccagcuaauuuuuguauuuuuaguagagaugggguuuugccauguuggccaggcuggucuugaacuccugaccucaggugauccgcccagcuuggccucccaaagugcugggauuacaggcaugagccaccgcgcccggcccaauuuuauauauuuuaaauauugcacaugcagcaaaguuuugacugucucaugaggucaggugugcauucuccauucauggcguuguguuggguuuucugauuagggaggcucaguuuguacacaccugagcuuaucucaugcaggggucacuguccccacuuuacaggugagaacuugagggcuucagugacuucccacugcccuuuuggucuucccacgguuaagagcaaaaucuuaaccauggagcacgcggccccauccuugccuccccugucacucugacccagccacccggccuuuucucaggucccaguguucgugggcacagcucccaguuacaauguuugggaacuuucuggguccuuuuccacccggaagccuuggcuccuucuucaguccccuccugggaucucacucacucgggacucaggaggguccuccucgccgucccucccuccccucugccucuuuuucaccucuugcacaaacacugggcacugguuagugccgcucucccccgcggggcagggcacguccugcuuagcucauugugguaucucagugccuggcaugugggaacaaccaccccagcagcugacagccaugaaguguuucugugccagccuuugaacuaaguacuucacgcccucaggccacccucccuccuaaagacccucguccccagaaagcagcccuugacucuauuaaaaacucacauugauuuauuagaauaugaaaaagauucaguuucuucuguacaggcagcagaguggcagcagcugcgguggcuugguacgugguugucgaugucacccuugcauggugacuccugcccaaacagcacuugcauggagaggaggauggacagaugggccgaggacccauggcccaguccccugcaaaaagggacacucugacuauugcacaauccugggggagugccccagggacaaggggaaggagugugugugggcaaaggucucugggggcccaggauucugcccaauccaccagccccaggggacaggggauccucaggggaggccuucucccccccaccgccuccacaaugggcuccacagcaggcagggugugguacacacaagggaaagguuccaggggccaaacccagggugggggaaguaagagcaggccagcaggacuggaggucaggcccaagagcuaggcaggugccaagaggccagcaucugugaggcuggagagacucuugauuaggagugggaguuacuucugaugucacagucuucgagcaacaguuaagagcccagcaggcagagagacgugggggagggguuggacagacaggcacagaugaggaaggguaauucuggagugugaggagggaguuagaggcagagcacuguucagccagggguuuucaaaauguuuuaaaaacaggagcgcccucugugcaaacaaucauauauaggagugugaacaaacaaaacuuaaaaaggcagcacauucuggagccacggccaguccuuccccuagcagcuuccccugaggggcccagugguccccgugggagcacaguucgaaaagcucugagucacgucacugucaccguagaaaccaccccugcuccaggcagagacacucagagaugcccucagcccgcagcucugaguaaggacagguugggugguggccagggugacagagcuggcaggaggagugugagaccuuggugggucagcagucccucccccagccaugugccugguaccccugguuuguccccugauaaagcagggccuacucaagggaggccucagcucccucccuuccugggugggaccacagcugagccagagacucuuugguuagaaacuaagauuggucugaaugaggaggaggaugaggcagagggaggagccuccgaggcccuaguccagguccgggagaagccuggaucuagggaggggcagggccggccucaccagccccagcaguucugccaaauggauuggggaggcagcucugguggggaggaugcuucccgggaggcggcaggggaggagcugugcuggggugggggcugugggcccagcugccaugcgguagggggaggggcagggccaauccgggucaggaagggcaaggggagcccccagcagccccugcucugguggaagagucugugaggggacaggcgcugccugcuggcccugguguuacugccccuuggggaagaacgguucucccuccccaggcucagggugugggccugggucacugaggcagcgcuguauccucugggagcuggggcugucacugggcgcgggggugaagacaucgucgguuccuggggacgaagucuccuugcuccgcaucaugaugcccccaucgucguccucguccuccucagccaccuuugcaggaucccggcucaacccuaagacuuugcccuucagcucuucauucaccagguccacagacucgggugacugcggggaagccgggucgauggugaugacaggcagguccuccuucggcucauaggccagugggucuggggaccaagagcaaggcacaagcuggguuccgcucuggagcccggcccagcacgugccacucggccgcgucagugccuccuucaggccuucucaugagcacagccgucccggucccaacaggccucagaagcaggccucugcgaccuuccaccccacagcuucucuuccucagacuguggcccucuccuuugacaggggcucccagaggugucccuccacaggccaaggccuggggcuccucccugagucagucugcccuggggcccugcccucacguuccccacacguguugggggucucgauggggcagauacccugccuuccugccaggcaccguggcucucccagcuccccacacaguccucgcccggaacgucucucucccuagggauggccccugacguagaagcagcucauggcuugggaggggauccugaggucagcgagggccaggccuguccucccaguggcugaggacuguuccuguggagccccauccucaggagguggcagcucagagugcccaguccugaggccccucgccaggcccuuaccugagccgaugcgggcccgagacauggugggugaguccagcuugugggcuggcaccgucagguaguuguugaucugacagagaggacagacggggugagcacaggcagcugggcagagggagccccucaggacagaacccggccagugcacaccccaccuuucguauaugcagggcgcuugcucccccucccuugugccugugugggcacccguacuggccccucaggagcuccuaagggcucaucccaggcuccugucacagccucccugaauacaccuacacugcucagccuuaaauccacccauuccucuguccccugccacugcccuaacccaggccaugccccacaaccccacgccaaucccuugcuuagaacucauggcucuccaugcccuuacacugcuaaaagccccucgaaagccaaacccuguuccuagaauggguacauuuccuuagaggcuguggcggagcuugggcgaguggggugggauacagauucccagaggaaggcagaggcuaccuucugcuccagcugccgggccuucugccuccggagcagcaucugguuccaggcuuccucguaggggucugccaccagcgugugucuguuguaggaccgcagcugugggagggacagcgucagggcagugcgggccccggaaggcucugcucauggaggggugggggcagugcuggaggccgggccaguccuggggugggugccgaggggcacgggcagggcagggcugccguagagaggggcugaagggcuccuguacccugggggucgggcuggggagcaggcccucacccgcugccuggucuucugcaaguuguuccucaggauuuugcggaucuccuccuccuuguccuuggacagugcuggcaggaugcgcucggaaggcagggacuugggguggauguuccuggggcaauagggcaucgguuagguccccaagauucuugggauccuggugccucccagguuuggccagaaggaagucacccuagggaugacccaggugggcgccaaagccucagguccuuggugcgagcccacagcucucuuguccgccccaacaggacaacagaagaccccgccccccagguggccaccuccaaccgggcuugaggggccggugugugggagcagaagcugccugguugccccagcacucacugcauggagacgguggagacggcagaggggaucuugcccaugcccccgcucuccaccagcucgauggccugcuucaucuccaucuugugguagaaggcaaugagcuggggcuccuuggagcgcucgccagcuaucagacacuucuucacauauuucuuauuaaaccgguugagccuggugggaggaggagggagacggauggcgccagcuuccaggaguggggagaugcccaggcccaggagacccuugccugccccucccugccugcccaccaggccugccaccuacuuguccuuccagugguggugaccguaguggccacagaugucuucgaugccugucagaaggugguccaggaacugaaaggggcccagggccaagucaagccucgcuguggggcgccuucccuaccaagaccucugacuagccccacucccucccguagcugcagcccugcuggguccagcccugugguuccaugagcagccaggagguggcgcccacacuccacucaucgaacccagcggcccugacucuggguaucucgaagccuugccuguguccggcugagcccccuucucuaaucccaccugggaccuaugccugggauagguuucaaauggaggcagagauggcaugaugcccccuccucaggcucccagcugcucacaccacaccuuccuauggcuagacccuggcggccuccuggggcagagggagccccugggcacuggcacagggagaaggggcugauggggggcagagacuugaggcccagcugcucccuaucucccuguuccuccuucugcaaccaagggcccagcccgcacuccaguaccuguguguggaucucuucguugauggagcgcuucgucucuugcuuuuucuucacagccaacaggucuaccaggggccgaauggucaugcccuggggggcaggcaggugucaggcacuccaguucugcuacccaggcagggaggccacagagccucccucccucaccccaggcccccaaggcuaggaugcccucucugcucugcucucucccaggacccaagggugugagaacucucccaccucccagcacuuaucuaaagacagguccuuaaggccugcuucuuccuggagacacggucagagguuucacugccaaaugacccccacacuggucaucuggccugggccaggcagcagacagccuggguucagauguggacugcaccacagacuugcucugcaaccccauggaagucaggccccacacacagggaaaacuaccucugcacugccuccccaccaggacugugaggaggaccgaguaauaacagcagcagcagauggaacugcacaccugccaugugaccaacacacgugcuuggaaguguucuagcaucaaucagcucuccaauauccgcaacacuaagagggagguccuuccauugucucuauuuaacagaugcagaaacugaggcucagagaggauaagcagcuuucuaagaucccagagaagcaguaaagccaugauuuaaacccaggcaggcuggcucuggagggaggcccccuccccaauguugccuucaaugaaaaugggcuuggaaaaucauuagcacauacaacugcaaaaucaagguaaaaaaaauuuuuugaagauggaagcagggcaagaggacaaaaguggcagccuccuccucuuuuuuuuuuuuuuuuuuuuuuugagauggagucuugcucugucacccaggcuggagugcaguggugcgauuucagcucacugcaaccuccaccucccggguucaagugauucuccugccucagccucccaaguagcugggauuacaggcggcugccaccacgcccagcuaauuuuuguauuuuuaguagaaacaggguuucaccauguuggccaggcuggucuggaacuccugaccucaggcgauccgccugccucggccucccaaagugcugggauuacaggcaugagccaccgcgcccagccucucuccuuuuucuuaacucgagagagagucucacucugucacacaggcuggaggagucacacaggcucaaucacagcucacagcugccucaaucuccugggcucaagcuauccucccaccucagcuucucaaguaccugggacuuacagguguguaccaccauacccacuaauuuuuuuuuuauuuuuuguagagacaagguugccauguugccuaggcugcucuugaacuacugggcucaagggauccuccugccucggccucccaaaguccugggaucauaggcgugagccacugcaccaggguccccucucccuuuaaaggacagaaaauaagcccagccccagguuuccccuauuuuuuuuucucaagagaaugcaaagauguaucccaucuagggcuuuuugaguaucagugcccagaaaagacagaaaggaugguaaagaaauggaggcucagacagaguguuucuuauuugcccaaggucaggcaaagucagguaaggcagagcaauuugcaccaucacaggcugggcuuccuuggggaccuuaggcaggagaguggcugucagcuaagccugagccguuuaaauguacagaaaucacugagcagcaggcuggaaggauucuugggaaucaucucgccugguucccucacuuuacagaugggaacugagacccagagaagagugggggucuuucuuagggucagagggacaccaacacagagcuagggcugacuccaggccuccugcugccuggcucauagcccuuuccaguuccccaugcugugauauuauucccauuuuacagaugcagaaacugagacccuaagauaugaaaucucuugccuaaagcccuacaaugaguuaguagcaaagagagaucuugggccuguugacuguacccacuucucucucuuuuucuuuuuuuuugagauggaauuucacucuuguuacccaggcuggagugcaauggcgcaaucucagcucacugcaaccuccaccuccuggguucaagugauucuccugccucagccucccaaguagcuggaauuacagguaugcaucaccaugcccacuaauuuuguauuuuuaguagagacgggguuucaccauguuagucaggcuggucucaaacuccugaccucaggugauccacccccucagccucccaaagugcugggauuacaggcguugagucaccgugcccggccaguacccacuucucuuaaugcucuaugaguuccaaauuaaguugggcagcauucugguuccuuuacauucugaucagucacucugcaaugacucaucacaauucucacuuuacgauugaagaaacugaggcccagaaagggggaguggcucgcccaaggucacacagcaaguuagugguggagcugggacuagaaucgcauuucaaaucacacgcuuuccucucuuuccacgggaacagccugugaggguccccaaggcaagggccugcccugcccuggcccagcaccugcacaaagacggugaagaagaugacagugaugauggcagugaggaacaggucacacauggggaagugcuucuuguccaggagguagcccagagagaaggcgauggccccucgcaggcccccauaggcgaugaugaacugguccuugggggucagcuucacgauacggaacuuguugaugaaccaggucaggcccagcaccccugcaggggaaggcagggggugaugagggucaggucgggcuguccccagucccuccuggauucugcaucagugauuucucugugcauccaggaagucuccauuacgaagcccaccccgcucacucaauuccugggucccucagcccagagugcucugaacuccucaauccaagagcuggguggauccuuaaaggacuuccccaaccuggaugugcuuuagagacaucauggaggccuccaguggcuggagggcugggggcaggaagagggagaaaagaucaaacaagaugggucacaggucaauacuuguuaaaugugauggguguguggggggucaugauccuauucucucuacuuuucuaaguacuugaaauuuuccauaauaaagcauaaaaaaugcagagggcugggcccaaccuccacccacagaaccagaaucccuggaggaugaggcucaggaauaaaggggauuucaaaagugcaccaaauaaaugugagguccugccaggcuuggggacauggaccuaacccucagagaggaagugagagauccagggaggaggcgacugaggcacuggggugaggcauguggggcacaugugaguggaacccaugcaccuggggccugguccccacgugugccccggccugcugcauagguuuggaggacugcacguggcucugcaugcgauucggcacaugcucacgucaccugucuugagacagugcagagagcacucagcucagagucacagaccuggguucugugggccucaggccccucaucaggacagccacagccacaggcucagagucucagggcccccucacuuugacacagccugacucuguccccagagaccacagccuugcugugacacaggcuucucccugcugaagggcccaucauggaaaugggaagucccuccugucuagcugugcugggagcaggcaggagccaaccaggaaaccuccaccacaaacugcaucacacauauacccccagccccuccacacacacacacacacacccaggcccucuacacacacacacccacacccucacagccccuccacacacacccacacccucacagccccuccacacacacacacacacacccagccccucuacacacacccaaccccuacacacacacccagcccuuccacauauacacccagccccuccacacaacuauacacacacugcaccacagcccaaucccuccacacaacacacacauauauacaaagcccuccacacaacauacuacacacacacacccccaaccccuccacacacuacacacacaccauacacacauccagccccccuacaaugcacuacacacaccacacacgcaauacgcauacacacacacaccacagcccagccccuccacacaauacuuauacacugcaccacaugcacacaccacauagccuggcccuuccacauagugcacugcacacaccacacacacagcaccacagcccaccaccccccacacacaccccacaccacaacccccaccccgccccagcccuggcccucacccagcacgcgggcgaugaggcagaagagcagggugcugaugacgaagguccaguuccaguggugggagccggccaccguggagacgccgaggaagaugaagaugagggucucgcugacgcugcuccacaucuucaggaaguauuugaugguggugugggacuugugggagauguuggccuccacauaggggcgcaucaccacuccugaggcuaugagccuggagcaggaaagagcggggucagggcuccgugucgagcugcaccugcucgagccccuccacugccaggggcaauggggccacgaccaaggugcccaugucccaagcuccucuaugggccaggggcccgcugugugcuuuacacccucuugccacucauccucacaucaacccuauagacacgguguauuccuccauuuuuuuuuuuuuuuuuuuuuuugagacgagucucacucugucacccaggcuggagagcaguggcgcgaucuuggcucacugcaaccuccgccucccggguucaagcaauucucugccucagccucccgaguggcugggaauacaggugcccgccaccacgccuggcuaauuuuuuuguauuuuuaguagagacgggguuucaccaucuuggccaggcuggucuugaacuccugaccuuguaauccacccgccuuggccucccaaagugcugggauuacaggcgacgagcgcaugcccggcccuauuccuccauuuuuaaaaugagugaucuuggcugggcacgguggcucacgccuguaaucccagcacuuugggaggccgacaaaggcggaucacuugaggccagguauucgagaccagcuuggccaauguagugaaaugcagucucuucuaaaaauacaaaaauuagccaggugugguggugggcaccuguaaucccaccuaauugagagguugaagugggagaaucucgaacucagaggcugcaaugagcugagaucgugccacugcauuccagccugggugacaagagugggaccccgucucaaauaaaaaaaugagagaucugacucuaagagaaauagucaccucuccccugucacgcugccugcaggcagcaaagccaagacacacaaaccacaguguccaacuccaaagccugcaccuuugccccaaggccacacugccucuugacccaauaggagucaaugacacagacccauggucuccuggguucauuccccucaagcguggcaucugccauuacacaggggucuccacagggagcuuuguuccaagcagcugcuuggagcucggaguccucccagcccagugcucacacccgggcucugcuccugggagccaggggcucugaaccccaguucugccuugcucggcacuggaacaccuucaccccucacugccuccccacaucccauucuccccauuuccagacccgguggagaccucaggaccgccaggacucaggccuggugagccuccuacuggggcugcugaggggacucccuuugagacaaugaaguagcagggcuguggcuuuccucaaccugaagcuuaguggcuuccaaggcucugcucuccuauacccugggcuugccuucaugcaggucauucuugcuucaucugcucauagccugaaaugcccucucccgauuccuggaccccagggggcgcugcagaagugcuccucuucuaggaagccacugaugcccuuggccauuuaaauggcuaccaagcaggucuggagccuggaguucaugucucaucccuggagcucaaggcugggcccugggagcuccgugaaccuacgagccuggggaauccaagcuggcagcccccgcccccaccccgccaagcccacugccugcugcacgcagacucacgccaugaugccugacagguggaagagcucggcugacaaguaggccauguagcuguagaggaagacgaagagcggcucgaugacccggaugugggagguaaaucgggaggugaaggcugcgaugaccccguagaccacgcccacaagcaccccgcccagggccaccacgaagaagcucaggaagccgaggaagauguccacgaugcccacguguucguaguuggcaaacuccucaaagaggugauacaggaccuggggagggugugcaggcuggugggugggaggagagggcccuggccccacgguucccugggguccacccagggcaauccuguccccuccguuaaccauggccacaagaagaggccacacgguagcagagaaacccuagugccaagcaggugcucaaaaccucagccuggggcugaggggcuugcucugggccagccacgugccccacuggugaagggugggcccugggaagcucugugaagacccugaagccaaacugccuggacuggaauccuggcucugccacuccugaguuguguacaggaagcaaauucaucucccuguguuucaguuuuccugucuauaaaaugaggauaauaauaccaaaucuuaggacugcugugaggacuaaaucagcgaaucaagugcucggagccuuaccugaugcaguguuagccacaucuggugcuaucaagucugccucucacugccugaccuugggcacgucaugcccaucacuggguuucagucccuccuucagcacaaaaaagggacguucacacaaugaacuagaaugucauuucuuaaccucuggagcuuucugaaaauacacauguucaggccauacuggacuuggacucucugggauagggccaagaaaucucuauguaacaagcaccccagggguugcaaugaacagccaaguucagaugcuauggaauuagaggcuaaggcaucccugucuccuggacugggaaauagauggucauugcaacacuaccaucagauguuuaaguggcacuucauacacuguaaagcccuuugauagucuuuaucugagucgacacucaacaaccaugcgaggcaggugggucaaggaugcuccuuugcuaaaccgaggcucacagugguaaaacaacacgccagggggcccccagcccaggagcagaagaacugggcccagaacuuauucccugacagccauggcugaggccuccccagcaggcucagcuuugaggaucugccccuccuauugcuaggucccugagcugccuggccuacucaagucuguccuagacagcucugccaggaaggagcagggaguuuccaggccugggggaagggagggaaggacgugaggauccaugacagggaacccuccaaagcccccaggaccuggagcaggaggaauggaccgugaggagugaccugucuagggcacagaccugagaccaggcagcucagggucagccucuggcuuuacucucugggaaauggggcacucacaccuaugccaagagcuccagaaagaccugacuugggccaggcagcaaggggagaugcagagcacuggccaggccuggugcggccuggccccagcugucugggggauaggacagggcuccagcggcagacagccucuuagcaggugcguacucagccgugggcuaaacucauuccuggccugaggggauucauggguccucauggucuaccacaugggcccauggagucggcacagaggggaaaguccuccuuucuggccuggugcuauuaccccuggaacuauagagaaacagaguaacacagugguaagcacuugggcuuuggacucagacuacggauuugaaccucagcuauaucauauaucaggcuuauguaaccucuccguuccucaguuuccucaucgcaaaaaaacuggaauauaacugugucaaccucauggaguuacuguauagauuaaaugaggcaacauaggccagacacaguggcucacgccuguaaucucagcacuuugggaggccaaagagggagcaucgcuugugcccgggagcuugagaccagcccaggcaacauaaugagaccccauaucuacaaaauaaauaaauaaauaaauaaauaaauuagcugggugugauggccagcaccugcagucccagcuacuugggaggcuaagaggggaugaucauuugaggaguuugagggugcagugagcuaugauugugcuacugcacuccugagugacacugucugugugacaggagacucugucucuaaauaaauaaauaaaaaugaggcaauacacauucagacaggaagcacccaaugaacaccagcaaucacuaccaccgcugccacugccuuugggagacaugaccauggguccacaaauggcugggucuguuaccugcuugaugcaaccaugccccaagcuccacagcagugcucaccugaaccccaacacccagaucccacuggagagggcuuuaucuuuggcacucacuggcuucacagacauuagugaguaugacucacuaauguaaguaauccuguaagaagccugggaggaugacaggcugaguacugcaaucccugugucacagauggggaaacucaggcucaugugguaacccugggcaagagcuagugcuagaggaagccaggauggaggccugccugcucaggucaggcuauucuacccagccccaugaggaggcgugggaggaacaggaagcugaggcugccagcagcugaacaccacagucugucucuacucugaggugcugcuuccugaaggcuggggcugcagaggagggagucauggccugggaaugcacaugugcccuugagcuuuccugugugugcagcugcucugagcgggacagcucaggagggggugggaguguucucacaacacaacgugagcaugcacaugcacacaucuguuucccaaggaaaccagcugggaggaagggcaugugcagguguauauggugcuaccacgugcagacccuggaggaaagcacuaauccucugccacuuugcagcuaucaaaggugaggcuggcugggcgcaguggcucaugccuguaaucccagcacuuugggaggcugaggugggcggaucaccugaggucaggaguucgagauuagccuggccaacauggcgaaacccagucucuacuaaaaacacaaaaauuagcugggcauggugacacacgccuguaaucccagcuacuugggaggcugaggcaggagaauugcuugaaccugggaggcggagguugcagugagcugagcuugcgucacugcacuccugucugggagacagagcaagacuccaucucaaaaaaaaaaaaaaaaaaaaaaggugagggccacagagguauagcauuugcuuaaggucacacagcaagcaaguggccaacuucuuuuacuuaucaccuucuagauguuuuggagacaaggccccuuuccauaaucuccgcccaaaaacugugcacaaaccgaauucuaacuuaagauauagccaacaugagagcugaaaggccccucacagaugauauggucugugaagagggaacugaggcacagagaguguaaguaauuugcccaagcucacaucaaaaugcaagagaagggccaggcuuguuggcuuaggucuguaaucucagcacuuugggaggccgaggcaggaggaugguuugaggccaagaguucaagaccagccugggcaacauggucaaaccccaucuccacaaaaaauuuaaaaaauuagccgggugugguggugcaugccuguaguccuagccacucggaaggcugaggcaggaggaucucaggcccagguauuugaggcugcagugaguuaugaccguaccaguucaccagccuagaagacagggcaagacccugucucuuaaaaaacaaaaagcaagucaagucaaggagggagcauauaaccuagcaaaaccaagagcuuaggcccuggagucagucagaccugguucaaucacaaacugguucauacuccaacagguuauuuaacuucuuugggccugugucuccccuggaaaaugagaauaauaagcaccucuuaaggcagccaugaggacuuaaaugagauaauccaugccgaagggcucagcauggugccuggcauacgggaagcgggaaugugccucagcuguuuuuauuacuguuauuagcggguggaugagggauucacuggugggccuggauuuggguuuguaccguuuggacaugggcauggccccuggccuccucaccacagugacggcgucauugagcaaggacuccccaaaaacaaggaugugcagcagcucauugaugugaauuuccucaaagacagccagaaccgccacgggguccacggccgagaugaugcugccgaagagcagguuguccaggaggccgauguuguugaucugcucaccgcccaccaggcacacggcguacaugaggccgcccaggaagaaggcguuccacagcgugcccaccacggcaaagaucaggauggugcccagguuuucugugaacugccgcaguggcaggaaguagcccgcauccaggaugaugggcggcagcaggaagaggaagaagacgucggacugcaggaaggggggugucucgccuacacccuugaucaggccccccaccagcagccccaccacgaucagcaggcagcucuccgggacgaugcuugagauaguggggaucacauggaaaccugcggagggcgagagaacgggaggccaugggcuuucggaggagccaggagaauagaagguuggggaugggccggggaugaggagcgcaguuggugagaggugcacaggcugggucucagagggcugcucuguuaacucucugagccuccgcuuccucgccuguaaaauggaagggacaaugcuagcuucacagguuugccaucauaaaccaagugacaguguuuuuaaagcacuuuuuucaaaggauauauacaugcuaucucugucacugucauaaaauguuagaaagcagcaguucuauaugcuuccagaaggcagaaauuauaaauugauuacugacgugccaaguaccuacgggcaucaccuacgccugaacccaaggcauuauuccaggcacaaguucagggaggcagaucugagcucaaccugaggaauaacaaucuaacaauucugucugagggaagaugguaguucccuaucacggagcuguuuaagcagaaggcagacaaccagcugguggggaguggcauaggagacagaagaaagcacagaagaaucuaagaauaccagcgugggaaggaacuuggggauaauaaggccuggggucugcaaaccugcaaaacaguaggcuuuccuacugaguccaggcagcugcucaagacacggcucaaggaugucaguggcaaccagcuuuggcaggugagauaaaaucuauuugcuaucccgcuucuagcucaaugccacccacuuuaaagauggggcaacuaaggcucagaaaagggaagggacuugcccaaagucacacagcaaguggggagcagaacuagaauagaacacaggucugaugccccaguucccaucaaacugcacaguucuguaauucaagcucuccuauccuucccucccaucaaggccuccucacacaccccucugccugggacccaccagccaucuccccaggccguguccuggccagcaacaggccgcucugcuguaguccaccuuaaggcuucaaacccagagcugaggaguagcaaaaauccccguugagagggccucucucaauaucagguauggccagagaacccugagcuccugugagugguuuacuuguuuguuuuguuuuggggugggaaaguagguggaaaaaaaucugagcaucuaguuguauguuggguacuaugcucccaggguuggcauagccaagaggguuugucccuuugcucaagaggaaagcucucucuggccuggcaugguggcucaugccuguaucccagcauuuuaggaggcugaggugggaggaacacuugaggccaauaauuugacaccagcuuguacaacauaggagaccucaucuccacuuaaaaaaaauagcugggcaugguaugcaccuguagucucagcuaguuaggagggccgaggcaggaagaucacuugagcccagccucaaaaaaaaaaaagaaagaagaaagcaaagcucucucuccuccccuucccuaucuugcaagcucugugcaggcagaucccauaacugcuuaucauuauacacccagggcuaggacacaagaagugcucaacaaauaucagcugacuugaaaauacacagggcugggacaucacccaagauuuccgauaaccugcaugccuggccaggccucugcucucauuacuuacucuugagauccuugggacagaggaggaacuucccucuccaugcccaaagcccuuccuacucucagguaggaaucugggcagugcuaguacggugacaagucaaaguucacacugcuggcugggcacgguagcucacgccuguaaucccagcacuuugggaggccgagguggguggaucaccugaggucaggaauucaagaccagccugaccaauauggugaaacccugucucuacuaaaaauauaaaaauuggccaggcgugguggugggugcuuguauucccagcuacuugggaggcugagacaggagaauugcuugaacacaggagguagaaguugcagugagccgagaucacgccacugagcuccagccaagaucacuccacugcacuccagccugggcaacagagcaagacuccaucuugaaaaaaaaaaguucacacacugaacacuauccaggcccagaauccuggcacagugccaagcacccugaagacacucaaaacacauugggaaaaaaagaugucuccauccuaggccaagaggaccucgaaggcaccaugugcauucuccugauuucaaaauagacaugaccaaaagucacuuuuuguucaucuacuucccacaucaauaaaagggaaaauaauuccaaaaucaccccuuuugcugaaaagucccccagucuuuguacuguccaccagucaacauccaguguguagcuggcugguccacugggaagggcuagucauguuggacccaagucucucuugcuguagaggauaaagcccacauuuucagcacugccucugucaucugcucuugccucaugucccauucuccccacugucaacucuuagguuucagccuugccaaauuccuugcaauugccccauaugagccacauccucuuuugccugccaaucuucaccuagucuaguuccucucucuagaaaucauuccucuaccucuacccccaccauauguggcugacaccauauccucugccugccuccuccuucaggaagcauucccugaccaccaccugucugcucagguuagggcaggaaucuucuggugcuucccucucucauaaccuucaauccacagucaucucccagguuccucucucucuuccuggcacccaccgagaucagucagacaacccaggcagaagcagcugagacaagacaauggcaucagaccccaaagaccugcagugugcuggaggggagacaggcacagcgcagcggagauaagcaggaugaagauuuaggggagcagagcuccuacaggcaggggccagaaagcaccuucccaaggccggaaguccagcuccagccagcugcaugcugaccccccuccacagccucccugccccuguccuggcguuagcaccaagagcugccuuaagagaaggcagagucuaaagagauaguccaggguaggcagaugauggcuuccaccuccaccuaaggggucgggcucuaaaaaugccuccuacccucacucugugccaucaacccaauccacagagcuuuccuggccccauaaaucgccagacagugccugggagacccagagaagaguuggccacagcuccugccuggggagggggcaggcaugugaaacaagccaagaacagcaacaugaagacggcuccucaggucugagggcgucccaugagccagaacugugcugggagccuggcacgcaccaucucauucaguccucaccacagcccuugggauagguauugccuccauuuugcagaagacaaagcugaggcucagcaagguuaugccacuccccuagugucuaagggaggaccucuauucuagcuuaggugucucaaaccgguagcagagagcgcuaauuaauucuuuagucaaagcucgguauuuucucugagccaggccauaugggacacugggaacauugaggugacucagacucugaaccuccgugagcagcugauggggagggccaugcuauuccagcccuuggagcuucuaugaccaggugaacagagagcuggcauuccuauugaacacaagaaaaacgagcucugagaggaggcugcaugcacucagccaggccaaccaggacugggucccgggccuccugacuacagcacagcgaccuccuucuccuucagccagcuccagaguaccuggggcuggagccauguuccuggagcugguuucccuggcuuuccuguuuugucucuggcgcucagugagcugaaggagcucuaggcccugaugggcucucugggccugaggggagggccgggccgggccaggcugaggagaaaggucugagauccacuuuuggcucccugccuguggguagguggcacauuauuggaaagcacuucuagggcugggggaggaagggauucugucaucaagaggaggcuccuucaggagcaacggcucagggaagugggaagcagccccuggaccugcgcuggcuugucccucuccuaacgcccugacuccaccaacugcgcucacucugcaucccugcagaguccccacaaagagcaggaugcuugcugacacccgguguggugaaaggggcacagaaggauggcugcggccccugguacccugacaaaagcccugcauggaggcaagaucccaggaugccaagagaugaggcaaaacuuucagggcccaaacaugcagcagcagugaugucaccagggugaaaucagggaugggaagaggcaguuagaguaagaaccagagucguaagagcuggaauggaucuuggagagcaucuaaauucuccauuauauagucagggaaauggagacagagacagccagugaccugucaaugaucacauguccaguucuaccccagcagucugugacacuccaagccacacagccuucuucgaggacguccaguccucccagaacaaggaggcacgaaaguguggaauucaacaucuccaagcacagccacaggccaaacccucugacacaguucagaguuggcgcuccuuuuagaagaggcugggggaugggagaaguguuuuucauucuaucuaguguaggugguagcuggaacgaacacacacacacacacacacacacacacacacacacacacacacucuugcugagcagacaccucaccaaacuuccaauugauggaggcucccagcccccugcggcugcucugcaccacaagaauguuuuauuuauaucuccucggacgguccccaucuguugagacuggcucaguggagcaggcaaggcuguccgacaucacccuggguugccagggugaccagacaugccugaucccccuucccgcaacccuccucuggccugggaagucagaggggagugcugggaagaggggucucuuuggcccauagugccaggucaccagggacccaggggcacacugagggcucugucgcccuacuuccaggccugaggacugcucuggggcugcaacucggccaggucccaagggauuccuaguugcacaaugauuccauuucuuuaacucccucuucaacugccccagcaaccagucucaacugcagcaaugaaagguaauacuucccaaugaaagcccagcacucuacaguuuacagcggcacacucuuaacccauuugcucuccaccauaguucugggaagucacaauuaccauccccuuauuuuacagaugaggaaacugaagcacacaaagguuaagcaacuugaucaaagucacauggcugguaacugggauucaaacccagguagucuggcuccagagucuguguucuuggccacucacuguauuaucccuggcuuuauucuuacuuuguuucuaaggggcgugugagccuaggacuaaagaggcccaaagcaguucccaaagggccagcgguagguuuuucuuuccaugagcucuucuccaggaagucucccacugcuucuacucuaguggccuaguaaagacuucaugaaauccuuccuaucuucaaaggcugcccucuccaggaagcucuccuaaguuaacucagccaggaggggaagguugcagugagccaagauugcaccacugcacuccagccuggugacagagcaagacuccaccucaaaaaaaaaaaguauuauucauugaguuucugcuguggggaugggagguuuuuuuuguuuuguuuuguuuuguuuuguuuugggggggcggagucucacucuuguuguacaguggcgcgauuucggcucacuacagcgucugccucccggguucaagugauucuccugccuuaaccucuccaggggcugggauuacaggcacccaccauggcgccuggcuaauuuuuguauuuuuaauagaggagggguuucgccauguuggccaggcuggucucaaacuccugaccucaggugauccacccaccuuagccucccaaagugcugagauuacaggcgugagccaccgcaccuggccaaauaauacuuuuuuuaaaauguagcagccagcuggggguggcagcucacgucuguaaucccaucacuuugggaggccgaggcggguggaucaccugaggucaggaguucuagaccacagugaccaacauggcgaaaccucgucucuacgaaaaauacaaaaauuagccaggugugguggcaggcgccucuaaucacagcuacucaggaggcugaggcaggagaaucacuugaaccuguuaggcagagguugcagugagccgagaucacaccauggcacuccagccugggcaauagagcaaaauuccauuucaaaaaaaaaagauaaacucuccagcacccaggagacaaacacuggacacuuggagaaucugaugcaaggcucugugcagggggcuuauacacacccccucucauuucaucucacauccugacccccaauuugacagaugaagaaauccagguucagagagguaacuuguccaaggcuaccuagcugggaaguggcagggucauuauuagaacccaguucucugaacugcuaguucuuugggccaugcugcuucaaagaaaacagcuugucaggaucaccaggaagagaauucaagucugcaauaaauaugccucccccacaaaaacagccauaaauaaaucuguuccaaguaccugggcaagcauccuuccccauacccgggcaaucagucucucucuguguuuuuccccaucauucuuccaaacagcacuucuauuucuugcuuguuucaauccacauuucaggggguccuacuauguuggagagaaagggucucacccucugggaacaucaggucuggaugggaaagcagguaaaaagcugucagaaaacacaagcagcauacacuggacuaucugagucauggaaaagagaagaccgugcaaggaggccaaaaccccagguccagaccccacucugcccuuuaguaaccaugagcuuugcguaaaucacuauaccauggaauaaccuccauuuucuugucuguaaacaagugagaacagggacuagacacaggagcaccuugugcacugaaacgacugagaaaagagaggucaggcaggcuggggggccugggcggccccuggaguaauaagcagcgauugagccagcagcaacugccuuagagaccuggcaagagaggcuguuccggaggcaggcauguugugauagaggaucacagccucagcaacccuggcacuggguuacaaaucccucacaaugcauagccucucccucucuccuuccuuucuccucucaccugucccaucuacaucaacuccuugacuccagugaccagaaguccccaaaucccaccucuaagcaaacagcaggaaacucuuccucaccuggaacuucuacccaccuuucaaaacucaguggagggccgggcgcaguggcucacaccuauaaucccagcacuuugggaggccgagguggguggaucaccugaggucaggaguucgagauuagccuggccaacauggugaaaauccaucucuacuaaaaauacaaaaaauuagcugagugugcgccuauaguccuagcuacucaggagagugaggcauaagaauugcuugaaccugcaggcgcagguugcagugagccaagaucgcgccacugcacuccagccugggcgacagagugagacuccaucucaaaaauacaaaaacgaacaaacaaaaaaccccagugcaggugucaccuccucugggaagccuuccuggagccacacccccgcccuccccaggcugagucaggugccccuccaaacugaggagcuguguucggugccucagccagccuggcaucccagcacacagcucuggacccccaaaaagugaugcucagaaaacacggguuaagggaaugaugaacacuuccugaaggauguaggacuagaguuuggucucaaaggugggugacuaaagggggaagagugugaacaaaugaaaagagaggggaccucaaaagccuuuugaggauccugaagccugcagccagccuggaaaugagagugaacagugcaggagaugcuggcacacaggccugacccgggcagaucaaggaaggaacugagucaaggagccugagccaacagagcaggccucagaggguccccugaccuucagccuggcccugaaugccccauccuagccugcagccugguucuaccaccaccagccuucucccugggucucaaggacccauuucuguaaccccuauaccacuccaagcuggggcagcaccucuugguaaccagccugaccuucccaaucauccaagcucugcauaaacauuuguugaauaaauuucacuccagcagauugccccucccccugcaggaaaggcacuggaucaagaguccccaugcagugaagcagaggaugacucacaggggagagggagggacagggacugggaccggcaguaaagagcccguguuguguugacaagaggcagagcuccaacaggcccaacagugccuggcaagggagaggugccaggcaguggggugcuuaccuggggaggggguuaccuggggaagcgguggggggcagcucagggggucggcuuuacuuggggcagggguaggaccucaagcuccaaagacucucauggcuggauugggugucugguaggugaccauaugauacacacugguuucuuuugauuuucucaaaauggaaauauauuauauugcuuuggugauuuuaaauaaaacuuauggucauuaaaauuuuuuucuaacagucauauaaguguuuaaguauaaggaaaaucaucucacagugauucucccccuucccuuuuaccaacuauaccagucucccccacaaccgaauuucuguuaaguuugguauauauucuugaagacuuuucuguaucuauagguuauuuaaaauuaugugugaaugguaaaucacacaugcugugcuucaacugcuucuauggggcagagacugcacuaaguacugaggcaucucauuuaauucucucaacaacccuaaugcaguagguauaauuauuauccacuuuuuauuuuuauugggcuuuuuuuuuuuuagacagagucucgcucugucacccaggcuggaguguuggagugcaauggcacaaucuuggcucacugcaaccuccgccuccuggguucaagugauucuccugccucagccucccgaguagcugggauuacaggugcccaccaccacaccuggcuaauuuuuguguuuuuaguagagaugggguuucacuaugcuggccaggcuggucuuggacuccugaccucagcugauccaccugccuuggcgucccaaagugcugggauuacaggcgugagccaccgcgcccagcccuuuuauugggcuuuaaaaaaaaauuuuuuuuuugagacggagucccgcacagucacccaggcuggagggcaguggcacgaucuuggcucacugcaaccuccgccucccggguucaagcgauucuccugccucagcguccugaguagcugggauuacaggugugugccacgcccggcuaauuuuguauuucaagccaccaucucccuccuuuccuuucccagugucccggauguguggcuccccagcucaggugcuccguuccccacuccaucucuaucccuggccuguccuugccucuugccagacugcugucaggacuuacagaugguaucaggugcuccagguaccaguuugccccacaccugggguggggcagaggugggggaagaaacagaggcucaguaagagagcuuccauuucuagaaacuuuagagccaugggagagcuagauuuuucuuuccucuuugcuggggguacaguagagcuugcaaaaugcaaaucugagagaaaaaaaaaauugaguauaccaaauaucuguuguucuuaguauugcuuccaguugaaagucaguuagcuuagaagcuuaccaauguguuaaauucauuauauauaacuucaacuugcuugaaaucucauccuacuuggcuacagagguggaauauaaagagguaccaguaggaaagcaacacaaaaagaaauucuacaauuuccaggacaauugcccugcagaaagcaagucacaguguccuauuuucagcacuacaaggaaugcgggggaccgcaaaggaagaacaaaacacaggcggcacuggcuggguggggaagacagaccagcagccucugggaggcaacuggggccccuucuaucccuaguagcuuuaucagcuuuauggggucuauugugugcccucacagcaucugagggcagugaugaagaagggguguuagccauccuccacuuggacauuuuagugaccucucagaagggccagaaaaggaucagugagagaaaaugacucucaggggacagagccuggaguagggcagaaaagauggggggccuucccagaggugggggcaugagcauccuuaggcugguguguuacggugugcaugggguggacugcagaauggcaaaugcacaggagcugggugcuccugacaggaaauucuuauuuucucguccccaaaccugcuccucaggccccaaauuuuggaguuguccuaacuccuuucuuccucucacuccugacauccaauccaucaccaaacccugcugguucugccuucuagacaugaacagacccugacacuucucaccgccuccacugcuaacacccauccaagccagcacaaucacuugccuggaccacugcagcagcauccaaucagucucucuucucuuuuccuuccuuccuuuucuuucuuuuuuuuuuuuuuuuuuuuuuuuuugagaaacagucuugcucugucaucuaggcuggagugcaguggcgcaaucuuggcucacuucaaccuccgccuccuggguucaagugauucuugugccucagccaccugaguagcuggcauuacaggcacaugcuaccacaccuggccaauuuuuguauuuucaauagagacaggauuucaccauguuggugaggcuggugucgaaccccuggccucaagugaucugcccaccguggccucccaaaguguugagauuacaggccugagccacugcgcccagcccacauauccacucuugccccccaggcucuuccuacaccagccaagagugaagcuuuuuuuuucuuuuugagacggagucccacucugucuccaggccggagugcaguggcgcaaucuuggcucauugcaaccucugccuccuggguucaagcgauucuccugccucggccuccugcguagcugggacuauaggcguaugccaccacguccagcuaauuuuuguauuuuuaguagaugagguuucaccauguuggccaggguggucucgaucucuugaccucgugauccgcccaccucagccucccaaagugcugagauuacagucaugagccacugugcccagccaagagugaagcuuuuuaagagguaagacauacuacugaaaggcagggacuacaucccccuccgcgucuuuccaccacaccugaaucuccacucacuguccccuagcucuacuggccuccuugcuuuuccuugagcacaaacaugcccccaccucagggccuuugcauuugcuguucccugugccugagacacuauuccccauguaggugaaugacagauucccucccuuccuucaggucccugcucagaugccaccuccccagagagguccucccaacccucucuauccgcuuacccuugccacuuccugacgucuagaugugcuuucugaccguuccccacccagaacauaagccucgugagggcagccucugucccaaucacuguuguaucccuggcaccuuaggcuguaccuggcacacaggagguucacaaucaauguuugcuggauggaugacuuucucuuaccucagugaccucacaagguugugaggauuacaugagaccacaaacacaaaagcacugggcgaaccacaagauguugucgggggggucaccaucagcuugucccuuggagagccacucuuccaaggugcugcucagcaguuuuuccuaaauaccccagggagcagaacccagucacgcucaguucuguggccugcagagccugggaccacacagcccucuauuaagagucugaugacacggcacagcugguuggucugucucccccuccagaccacaagcaaguuucuaccugcaagcaaggcuagggacccuguccuauucaucuuugacucucuaggccucagcacggagccugacacauaguaaggauaaagacuuguugagcuagcagaacuguuugagggcagaagucaugucugguuuaacuuuuuuuccuucccuuuuguguauauauuuuuggguuuaacuuaaucuccaguguuuggcacuaagcacauggacacuaagcuccagcugaauuggccuuuuccuugaaggaagggugagaguuaggcaccaagaaggccuggcaggcaaaucagcagcaucuggaaagacaggacagggaaacgagugugguacagguagaagauuuauuuuuugcggggggagggggcagggaaaacagagucuggcuguguugcccaggcuggagugcagugguacgaacauggcucacugcagccuugacuuccugggcucaagugauucucucaccucagccccccauguaacugggacuacaggcgcgugccaccaugccuagcuaguuuuuguauuuuuuguagagauagggguuuugccauguugcccaggcuggucucaaacuccugagcucaagagaucugccugcuuugccucccaaagugcugagauuacaggcgugagccacugagcccagcccagguagaggcuuucuauuggagcaaauggcaguggacuggaguggaaaucauuacuuagaugcuguaaagcagacuuuucucucgcccucacaacaugcccuggcagugggcaacagaugagagaacagacauugagagagguccagacacaggcccaagaucacauggguagcagcggaggcaggucccaaacccagaacuacugacucccaauccagcgcucagccaaggccaguuaugaaaggccacaaauacccugcagggagagaauucccaaucacccugcugagccaggcagagccacuggagggcucuggccuggggaacaacaugaaauucugccacuucagggagguggucaagggagacagcgcuggccacccaggcucagcaccuggcauagggcaaaguuguccaaaugcacagccauuuagucucagcuccagggacagcuggcacugccuccugcacaauaccagcaggaugggugagcacccccuccauccuaccuccaaaugccucaaaagaccagaaaacuacaauucugagaaaagaaaggccugagucaagcccaggcuggggaucaggggaacugggcuucagucuagacucagccacuaacauucugugggcuuugaacaagccguugcuucucuuuggucucagucucuccauccuugggggcuuguugagagccucucuaccucugacaucugacugaugaacucugcagcuggacaaagucgggcucugugauacucaccaucucuguccaugccagcaacuguggcaucuggguacagaauagcauucgugccauagcaagcuugcacgaggcagcagcgggcagcguaaagagcucugguccaucaaugagggagguaguuucugucccaauucuaaaucuuaacuucucugugaccuaauaaggcaaaucacgguacugcccugaaccucaguuucuuccuuucuaacauugggauaaagaaugucuauggcacagcguugcuguaagaggagagaacagagacagaaacacucagaaaaaagcaaaaacaaaaauauaugcccaggccaggggagguggcucacaccugaaucccagcagcgggggaggccgaggcgagaggaucacuugagcccaggaguuugagagcagccuggguaacguggcaaaacccaucucuacaaaaaauuuaaaaauuaguugggcauggcuggugcauaccuguagucccagcuacuagggaggcugaggugggaggaucaccugagcccgggagguugagguuucagugagccgagaucaugccaacugcacucuauccugggcaacagggugagacccugucuuuaaaaaaaaaaaaaaaaaaggccaggcgugguggcucaugccuauaaucccagcacuuugagacgccaaggcgggcggaucaccugaggucaggaguuugagaccagccuggccaacauggugaaaccccaucucuauuaaaaauacaaaauuagccgggcguaguggugcaugccuguaaucccagcuacuugggaggcugaggcaggagaaucacuugaacccaggagguggagguugcagugagccgagauccucacgccauugcacuccagccugggcaaaaagagggaaacuccauaaacaaacaaacaaacaaacaaacaaaugcaugcacgcacgcacgcaugccagacacucccgugcagaucuagauucccagaaaccagcagcggcagggucccagaggcaagcuggcagcacuagggaggcaagagcuucuccuaaacaggcaccugagggggaagcuguccaacugcacagcauuaaggcuccaugggcagcaggcacugccuccugcacaauaccagcaagaugggugagcuuuccugauacuggauccucuaucucaaggggguccccuaagggucucccauacacuucugauaacgauccagcuggcugggcucuguguggugggagagacagggcaugcuuggagggccucucccugccuccucucccaccacacuggggauaguuugucacuucaggccucuaggagccacgagauguagaguggauaggagaacugagcaugcucagaggaggcugcccuuuagaggacacugcagagaaaagaugaggacacggccagcugcagggcuugguccuggugccaggaaggcccagggcucuagaaacagcaaugggaggucagcucucuccugugggagaagaggggcagcaagaagucagagauuagaagagggagggcccucugagaccauccagugcaaccccucuauuuuacagaugcaaaggaugaagcccagagaggggacggaacuugguugacguuacacagcaaagugguagcagagcuggcacacacacccaggaugguccacuccaaaacugguccuugcuuggaacauggugccaacccccccauuccacucccacuucuuuuuuuuaaacuaccuucuauugagugccucacuuugaugcucuguauacuucaaucacgauucuccuagcagcccucugacacagggaucacccuccucauucuacagcugaggaaaccggggcagagagaaauggucugacuccagagccauggccccaaccaugcugccugcagcucugagccccaguuuucuggaccaaaugguggguguggggagcaggagcccugguuuauugccaggucugucacuccuuugcugugugaccuugggcaggucacucacccauucuaaacuguuggucuuucauuuuguuuguuuguuuguuuuuugagacagagucucauucugucgcucaggcuggagugcaguggcacaaucuuggcucacugcaaccuccgccuccuggguucacgcgauugucccgccucagccuccugaguagcugggauuacaggcgcccgccaccacacucgguuaauuuuuuguguauuuuuaguagagacaggguuucacuaugucggccagacuggucucgaacgcuugaccucgugauccgccugccucggccucccaaagugcugggauuacaggcgugagccaccgcacccggccuaaacugcuggucuuucuaagaucccuagcaguaccagugugcccugguucugugugugccuugcaaggagagaagcaggagcuauuuggcacccuaguaaugggaaauggagcuccacugacagcagcuccccagacugggucuagccugcaggccucugcucaaaacccaugugcaaugccucaggagacacagugcagcccuccagcacaugccacugugggaagggagaauuacuacgaagcccugugccuucucauuuagccucagcaaugccaugagguagacacuacuguuucaauuuuccaguagagaaauugaggcucagagcuuaaugaacuagcucaaaugacacacagccaggaaacaaccaaacugguauuugaucccagaagccaagcucugcccucaagccgggccugguuaacugcuuccugcuggcacucugguccucagggcacagguucuagagcccacuggugauaagcugagcacaaagggccaagggcuccaggcaggcugagagguugccugccugccuacuugucugccaaccaguucaccccauagaagugccccaugcccaggaaggagauaaggaagccuuugucagugcccacuuccgccuggccugugcuggcugcugagacugggcagggcccaucgugugaucccacacauggcacuggcacaagguguacaugccucccuccagcagggcaggggagaugccuggggcagccagaacuggggaagcagccaccacugggcaggacaaggagggucaagaauucaggcaagagccgugguucuuuuuucuuuuuugccacccacccccagaccaugguucuaacgagcccugucacgcagcguccaguugaaauggggauguuaauaauaaugauaguggcugggugugguggcucacgccuguacucucagcacuuugggaggcuuagggggaguggaucacuugaggucaagaguucaagaccagccuggccaacauggugaaaccccgucucuacuaaaaauacaaaaaaaaaaaaaaaaaaaaaaaaaagaggcagggcacgguggcugaugccuguaauccgaguacuuugggaggccaagguggguggaucacaaggucaagagaucaagaccauccuggucaacauggugaagcccugucucuucucaaaacacaaaaauuagcugggcgugguggcgcgcgccuguagucccagcuacucagaaggcuggggcaggagaauugcuugaacccaggagguggaguugcagugaucugagaucgcaccacugcacuccagccuggcaacagaaugagacucugucucaaaaaaaaaaaaaaaaaauuauccaggcaugguggcacaccccuauaaucccauaaucucagcuacaugggaggcugaggcaggagaacugcuugaacccaggaggcagagguugcagugagcauagacggcaccacugcauucuagccugggcaauagagggagaauccgucucaaaaagaagaagaagaagaaaaaaaaaauauauauauauauauauauauauauauauaaaauuauggcuacacuuauugaaggcuucuuaauccucacaacuauucaaagagguaggugcuaucacaccaauaucacagaugaggaaacugaggcucagagaggcuagguuacagggccaagcaggacucaagcccagaaacugacucuagagcagacagguacucaugcucaacuacuuccucauacgagccacagagaaaaugaucuggaugaguauuuucucaauucuccaaaaggaggacauaaccacaguucucccagaauguucaaaggagcaggcugggggccucaguauaauggugacuguugucaucaauggagaggaaagaacacugucccugagcaccaguccccauacuacccucuuucaggaagugacacucugggucucggguuugcucggccauauaaugaggggaauggacuaugugaccucaaauggcucuuuugcccugacucccuaggauucaaggucacccgguuccacugcuuucuugugugugugauccuggguaaguuaguuacucucucuggacaucagggucuuuauuuuuaaaaugaagaugccucuccccuccucacagggucaggugaggaccacucaaaaugaugaaggcagagagccuagcauaggaccagacaaagcaaguacugaaacaugaggugggggugccuccuacaauuagagcaggacuuuuucucaucacuguucacugccacuggaaugagugucacuccaugaccucauccugaaagcagauaccagggcuggcagucccuccccaacucccacccuaggccaacagggcacuuucggacagccccgccuggcucccugauuaucauugccacagugcuugcuuaaugagcuguggcuccagggaagggcggacgcuggagcaccaggagccauuuccacugccugguaccugguacugcacugugacgugguagcuaaacacccgggagagugggacccaccuggccccguaccauggaaaucuuaucaugccaaaugcuuccugggagggagcagggugggugaggcaaaggccuagcccaagcccgucaggguuuuguuuccugauucuuuuuuuuuuuuugagacggagucucacucucuugcccaggcuggagugcaguggugugaucucagcucacugcaaccuccgucuccuggguucaagcgauucuugugccccagccuccccagcagcugggauuacaggcaugcaccaccacgcccggcuaauuucuguauuuuuuaguagagaugugguuucaucauguuggccaggcuggucucaaacuccugaccucaagcgacccaccugugcuuggccucccaaagugcugugauuacaggcaugagccaucacaccuggcccauuuccugauucuugacgucaaccuagguuguaaucucauaaguaugggggcccccucuuuauuuuccugaagcugaggagacccaaacacugagcuagaagaaguguaagagacuacucaaagccaggacuucaucugacuaagaggugagggagugggguccuggcuugacuucuuggggaugggagugagccuggugggagcagggaacugaggcccagguuuagagguaguuaggacgggaagggugcuaugugcccuauugggucagcaucucccgccccauccaaauggccacuccacugccuucuuagaccagaggauguugggcauacuucacugccuggaagucccucagcuagggaaggggagagaagaacuggagcccugguaauuuuuuuuuuuuuuuuugggacagaaucucagucuguugccuaggcuggagugcaguggcgcgaucucggcucacugcaaccucugcugccccaguucaagcaauucuccugccgcagccucccgaguagcuggaauuacaggugccugccaccacacccugcuaauuuuuguauuuuuaguagagacggaguuucaccaucuuggccaggcuggucuugaacuccugaccucgugaccuacccaccucagccucccaaagugcuaggauuacaggcaugagcuaccgcgcccggccugagcccuggacauuuucuaaagugccuuuccacuguagcaggaagcccuacaguuaagaagugagucggucagagcugagcucuggcccagagagagugagaacccuccaggggaguucccacugcccaggaagaggaacagugcagacuccugggguucagaaacccuugguucaguuuuggcucuauuacuugcuggcucugugaccuucccugggcuacaguuuccucacagauaagaugauggggcuggguuaacuucuccaagcuuuccucuagcucugacagcccacgauuuuacauaauaaccagcacacaucacuuuucauuuugcuuugcucuuucauguacauuauuucauuuaaaccucaugguaucucuccgaggguccuccuacauuaaagaugagaaaaccaaagcucagggcauuuaagccugagaacauacccagacagggagcaacagagccaagauuuacacccuggguucuggccagauccuggguuccaccuagaaggaaaucugcccggccagggugaacggccgcaagugacugguuucaggguccaucccagacucuccccucuugaagcuguucucuugaugccgauaaggaaacucuuucaaaagauccgauuuaauuuaaaaaguuaagcugcaaaagaguacagacagcacgauuuuguuuguuucaagagcaaauugcucugucacccaggcuggagugcagugguacaaucucggcucacugcaaccucugccucccggguucaaaugauucucccaccuuggccucccaaguagcugggacuucaggcaugugccaccaugcccaguuaauuuuuguauuuuuaguagagaugggguuucaccauguuggccaggcuggucuccaacuccugaccucaggugaucugccugccucggcucccaaagugcugggauuacaggcaugagccaccaugccagaccagcaugguuguuuuuaugccaaauuuuuuuuuuuuaaaggcagggucuugcucugucaggcuggagugcaguggcacaaucauggcucacugcagccucgaccucuugagcucaagcaauccucccacuucagccucccaaguagcugggaccacaggccugugccaccaugcccuacuaauuuuuuauuuuauuuuuguagagacagggucucccuagguugcccaggcuggucugaaacucccagguucaaaugaugcucccaccuuggucucccaaagugcugggauuacaggggugagccacugugcacagauuaacauuuuuuaugaaaaagugguucacaccacuguagagaaaagcccaggaugaacuauucagagugcucggcccgagaagcaagggaguaaaagggguauaacuugcauuuuucuucuuuauauacuuaagcaguguuugauuuuuuuuuuuauuucuuccuuuuuucuggaaaaaaaaaaaaaaaaaaaaaucuggagggaaaauguucugagcaccugcucucugagucaaaauucaguacuaaacacuuuacugucacagauuauuucauuuaauucucacaaaacccuacggaguacaagaaugcucagagcagcuuuauucacaauugucaaaaaaagggaaccaauccaaaagcccaucaacaggagagugagccaacugugguguauucauacgaggcaacaccgaacagcaauaaaaugaacaaaccucugguacaugugacagugaagaggaaucucacagauaggcugagcaaaagcagccagacacacaagaguaccuaugauuccauucagaugaaguucaagaacagguaagaucaacugaugaugauccaagucagaacugugguuaccccagaauuaucugcagaaaaaugacacaggucagauaaucagccuacaggcauauagcaggcagguaguagagcugggauucagacaggucuguuggacucugcagucucuauuggccccugacugcccagaaggaugccuugaaucuccaccugcagagccuucugggccccucuagaggcagucucgcuccuggcuucagauguggggacccccuuauccucagcgcuaagcacacaucccugugguucagucacuaagggaagccuggcucuccagaagccucagcucauggagaacugcugcuuaacuagcaaggggacagcagccagguccacgacucaagcucugggucugcugggagcagggggcaggaggaggacugcucugugccaagggaggaugcccagugcacacucaccacuccuaacuagcccuggcccacaauaagggaauuuccaagcagagcugggccugggcuuggccccgcccacugggccacacugccucacacuuuccccagcucuuguugacccagaaaagucagacccugccagucacccuaaccccucuccucaaccgaggauaagaccaggaguuuugagggacucagcucccccagaagcaccugcaucuuccugcucuaaauucccagcccugcccaggcuucccucccuccccucugaagggagccaccaccugcugcuuggcacggauaccccucuccggcuacauccucuccacucuccccucaacuccuacacaauccccgucccaaacaauuuccugcaguuucccaucugaucaguuucuuaggaaggauaauuauccauggaaggaggaggcggaaaauucccagagccaagaacacugggggaaaagcuucaucuagucccuucuccaucagccaggagagcccucauccuaaacacaggccagucauggucauggcuccuccagaaccucugcaguucccccaucuucaggaaagagcccacacuucucugcauugaauccaaggcccucuugaucuguucuaacuuagguuugggccucguugccauuccauuguaagugguagugccagauggagccccaucugcccccagggcccaccugcaacgugcugugucccugcggcacuucagccugccuuguguuuuaguuguuuacaugucugucucccacacacaagugucagugccagcgcuuccagggugggaaccaccaaccacgcaacugugucugcugcaugguaggugcucagaggcaggcugaaaagaaagugggacaggcaggaggccgccucaccucugcggagggaacgaugugggaagaaggaccacuuauagcaucacaggagagccuggacuagaggucggggagcugagcucaaugcagcucuguggcccuuaagcaagucacuuccgcccuggccucugcuuccucugugagcugagggggaugggccgggcucugucaucaugucagacauuuagaagcccuuacugcuaggugcucgccucagcauucucauuuaaccuccacaccuuugcacauggggaccacaaaguugcaagugggggagggggguuucaguccuggucuuuugauucccuaaccccuuaucuucuccuccuggacuucugcagucucuaggaucccucccagugcuaaagucugguucugauucuaggucugcccuuuccugaccugacaacuccccaggccacgaccauaggguucagcagggaacacgcauguccaacccugguguucagcaaugccacgccucccacaugacaggucuggugacuguuugccugcaggcgcugaggcucagcaagggagggguggccagcaggaguccagcagagccuggugcccacucagccccucccuccccaaugugccccugacuccacgcccacucugcuccagcguccugcucgccccucccugcuagcagcucuccuaggcuggagcuuccaucccacugcuggcuuggccaguggugccugucgggaagcuuuacucuguugcccucauagacccagcuugagcugcuggcaggcaggacacugaguggggccagcccagggccugagccgacucuaucgcacucccaggcuguccgcacaucccuccccaggucagaccaugucaugcuacucaagagccuuugauggugccacacagcaccaugaauccuagccccaggcccacgggccuggcaugaucuggccccugcccucuucuccauucucacaccaugcuuccccucuucccccgcacuucagguuccucaagcacaccccccucaggggcccuggucuuuggaagaugagcucuucuuguccuuugggucucagcucagacaccagcuccuuagagaacccuugcuggccauccagcagccccaccucucccucaugucugccuucuucaggacacuuaccacuaccugacacugcuuuguccacauccaaugcuccaugcuggcaugggagcccccugacaucaggagccucuucugucuuguuccuggcuguguccucagauccagaauagugucugacauggggguagaggcagcugguggggcgugugcugcccguuagacuggacagucagggaggccucucugaagagaugacguuugaucuagggccugaaggagagcaccggcgcgaggcagucuaugggcagugcuccaggcuggggaucgagcaaaugccacagcuguauggaggaacaggccuggcaaggcagaugugcguuagggacacaggaaggccggugcgacuggaacagggaaaggguaguggggcaugaaguggagaaaggggugggccacacuuuccuugcauuuucucccaaguucaucaggaagcauuugaaagguuuucagcaggggaaacaccaugcucugguuuacaggucucaaagcucccugcggcugcucuggggagagcugccugcaggcagacagcaguggagccgcaagaccauucaggaggcccgggaaucacccggguuggagaagauggagugaagaggcaagccuuugacaggugugguuguguuugccaccagucugaggagcccuggccaagucuacaccccucuggaguuccagaugcuucauccagccccgcccaccuacugucuuauuucucacugacuccucacccagacuuuuccugcagcuggcugggcuccccaacaggugccugcccauaccuaguacucagagccugcaaagagccuuaaccggugucacggccauugccugauuggucaccuucccucccucuuagaagggucuggugaaggugucugcacaaagaucucugcuccauguucauuccagccacauuucuccccuuccuaaaggucuccuguucuuugaggcaacagcacagcaauccucgagcacuuaauuauucccuguuucacuuuccuaaaguagcuguaagcuaaauaaagcuagauaccaugacucgcacccuucggggccgucacauagugcagaaggcaaugaugcacuaugcgaagcccugagcacaaagccaggcacuggcagggucucaguaagugguagguagcucuguccucacugccuauaccagggcgacagccaucacaggugcucagugccccacaggugcaguuagcuucucugcccagcaaaacaggugagugaggcguguuugggggugagguggaaggguuggaaacaucccaaugaguuuuagaagcaaaggucaaugguucugcaugaucuguggcucugugucauucacaucucugugcccuucuccaguucuccccucuaugugagcuaagcacacucauuguuuuuuuuuuuuuuugaaacagaguuucgcugucgcccaggcuagagugcagugaggcgaucucggcucacagcaaccuccaccuccuggguucaagccauucuccugucucaaccucccaaguagcugggauuagagacuugcaccaucacaccuggcuaauuuuuguauuuuuaguagagaugagcuuucaccauguugaccaggcuggucuggaacuccugaccucaagugauccgcccaucucagccucccaaagugccgggauuacaggugugagccaccgcaccuggccaaaacacucauucuuaaccuucaggacccagcucaaagcucugggaagccuuuccugacccacccaccuccacuccucccucccgcacacccacagcucugcaggcuccugcugcagcacuucacagcacaucacaagugccuguuuacaugccagccucucccuugaggcugggauuauauuuauccaucuuuccaucuucaguacaguauuuaucagcacgaauccauuugcugaacaugugucuccccaccucccaacuaaagaacgagcucagacaauucagcuaauggucucauuugcaccccuaaccucaguacucagcucaccccaaugcccuccaguccauauaccuaaaaccauccuccagugcuugaccccacccucaccucuuccuuuaaggcuccaggaauaguagcaacucccauuagugagcacuuacaaugugcucagggcuuuacagacaucaccccccuuuagacuggggaaacugaggcucagacagggugauguagcuuaaaaagggcacaccuuuuccccuuaauacuggcaucacucaccuagcacuuaucauagcugggacuauuuuuaaaaccaucaucuguucugcaaaauugagugcuuuuauagcuacacaucaaguugucauacaaaaucacccuuugcucauuaaauguuucagacgaucagucuugcuacuccagcuaggugggguaacauaacauaaauguuauguaggagaaauggcacaggacuuggaaggggaaguccuggaguccagcuucagcucugccacagucaggcuauaugacaccaggcgggucaccuccacagcccaggcacggcagcucacgccuguaaucccagcaauuugggaggacaagcuggggggaucacuugaggucagggguucaaaaccagccuggccaacaugacaaaaccccaucucuacuaaaaauacaaaaauuagccaggcgugguggcacaagccuguaaucccagcuacucgggaggcaggagaaucgcuugaagcagggaggcagagguugcagugagccaagauugugccacuguacuccaguuugggugacagagagaaucuccaucucaaaauaaaaaauuaaaaaaaauuuuuuuaaaacaggauaagugacuugcccaaggucacggugcuacaaaguaguagagcugagauuugaacccaggucugucaagcugcaaagcuuguuuuucuaaccaccaugccugugggcauguuuccaaagggaacugcucugggacauucuucugcaauccagagguucugccccaaguagaagcuucuggcugugcccagugagauuucauucaaguaucucaucuaaauccuacauauacuucaaggccuagcucaguggucacuugcacagccuacugggaucuucccagguacgaaauucucucucccaccucuaaacucccguagaauuccaucugcacuucaaaucacacccccuuucuacugucugacuguuuugcaucuguaccgcauuucucaaacaagucguugagcuugguaaaagaagcaguucucaugcaucucugcaccuuccaccagccaggcaggcagugcucagucagggaagcgggugggguagggugccugcuccccucccccaucuugcuguaaccugagucuuaggcuuugcccaguuaggugaguuggccccgccucaugcuggcauaacgccuaccugguacagcauccagauuccuguggguccuggccaccggggagauaagaucuuauucccuggcuugauggcaaagaugcuauaaaaagcacagcacccaaguucaacauuggcuugugauggacuacacgaccugagggauucaaugggugaaggcagaagccucugggcugucucagaggucccaagaccuguacuuggcuccccuguaaggaccaguguaaggaccaaugguuucucugccaaggacagcucccuaauagauaccccaggaggaagcugcccuucuuuaggcuuaaagggcccacuggaagaacugagguuugccaaugcuaccaauauccaagccaaaaaccacagccccuccucucgguccacuguccaggucuuacugccuagggacuccugaguuaguuaacagagcagggaagaagacugacucugccauuaauucacgaguggccuggggccaauccucucugggccucaacuggaaaaacagagaacuugaucaaaacaucuccauuucccuuugggccuggggguuacaagcuaugauaaggauuuuuccaucucuaacauucuagaauuagaauauucuauacuuucauuccuagaagcagagugagaacagagaacagggaccuucaguccaggaaacagcagaggccagucagggcuuccuagcugcauccucaaagccuguccaccuucagaggcuuucucuugcgucugcugccucaaaggugguugcuuccccacuagcagagccucagaggugugccugggcccuagccgcuuuagggaaaugggcagguggccugagucaccuacugugugugagcugggcucaccauggcaacccagcagacccagagggcauaaagaagccaguaccuucccugcugcacaguguaggcggagcauguugcaucugcuuugauuuccaacuuagaaaaguuuuucucuacuuuaaggacucauuuccccuucccuucucucaggacacagcuuacucacucugggguccuucuccuugccuggaagguauucugcagucccacaggcaaaccccacucaucccagaauuaaguaccaccuccuccaaggauucaucccagaccaguuaguccucuacccuucuucaaguucccaccacacaaaaggcagaagcucuuaaccuucagaaucuguggcuuacacacugacaaucaacuguguaaaaaaaaaaaaaaaaaaaaaaaaucugagucuaucaugggccuucucccuugauaaaaucacauauauacaacugucugcagacuauuuugggagcuccacaaacuuuaucauggacucagaaacaaucuuagaaaccuagauccuagaacaacagaucauccaguccauccucucaccuacaccagaaucccuuagcaaccccuccugaaugauguuccucuucuaccccuggcccaccucucaaggccgccuccuucaagaagcuucccucaucucuccucuccucugauucccccaagcauccagccugaaccacacaauuucccaccugugcuuucucccuuguauguugucucacuuccccagcaagaaagcugacucccugugggcucauuucuucaaccuuguaacccucagcuggacuuagagaugaccgugaucuguacuuguacaaagcccugugcuuugaagccagggcucaaugacagcacuggcccacucccaaaggauagagcuguggaauuccccaucugagggccucacagucugcuuaggccucaacggaacagaggcuucccuggaaugaccgccuuucccacaggacagccccagagagcccuucaagaugaaaucgacagauagggaaacuaaggcccaggaaggcaaacauagcuuagcaaaggucaauaugcaggaaagaggcgagcuaggacuaagacccagguccccaguuaccagccuagagcucguuuccuuuaugcaauggcuuuaugaaaacuaaauuugccuugcaugcacacacacucacauacucaauauauacauggagaauuucuaaaaaagauggacaagacaguuaacagugguaaccucuggaauguaugacaguggggguggucagagaaguaaugagggggacuuuucccuuucaccucaauacccucuguacuguuggguuuuauuuuuguuguuuuguuuuuaccauugacauguuuuauuuauucauauuauaaaaauaaaucugccauagaaaggagauucuggcccagcccacccauucccaacacacauuaaagcaaagagaagccauaaguaaaucuguccagguacaacuauaaauuaacaagauugccuucuuguaugguuuaaagccacuggucucauuaauucacagucacagugcaguuuacggcuugaggaaucuucccaggaaaagcuuaauucaauuagggcucucggcagcuccccaaggaagcucugguaucuuacuuuuacuuacacaaauugagggcagaccaaacagauccagaucuucccagagagaccccacccggcccagagaagaugcccuugcagacccuccauuagagccaagccgagggagguggccaaggcagcaccacuuaaacacuggcuggcgccuaaggcaucauucugugagugucgcucccagcgagcucaguuaaacuccuuggcuuggcagucuggugccaaggagccucugcaaccuuugcucucccuccucucugagcagucaaacugguuucuugucugccccagggcuuugcagggauccuaucuuuacacugaagucaaucacauauucauucauguauuccuuccccaaauauuuauggagccuuuacucugugccaggcacagauaagaaagugaacaggccaggcgugguggcucacgccuuuaaucuccgcacuuugggaggccaagguggguggaucaccugaggucaggaguucuagaccagacuggccagcauagcaaaaccccgucucuacuaaaaacacaaaaaauuagcugggcguggugauguaagccuguaaucccagcuacucuggaggcugaggcaggagaauugcuugaaccugcagcuacucuggaggcugaggcagaauugcuugaaccugggaggcagaaguugcagugagcugagaucucgccacugcacucuggcacuccaacccaggcgaagagcaagacuccaucucaaaaaaaaaggaaaaaggaaaaaaaaaaaaaaaaagaaagugaacaaacaaagucccuguccucaagaggcuuacauucuuauggaaauugguacuaaguauagccugcuuaucuaauuccuuuccauccuucaagacucagacuaauguuccaccuccuuugagaggcuuucucuaaacaccccaguccucagggacugcuugcucccucuguacuuugccucugccaggaguccgcccagcccuggcaggcuggaagcuccuaaagagcagggccuggguuuacucuucuuuuguuccuugauggccauaugcuaaaugccugcuagcugauuucagcugaccugccucuuccacccaggaucuuagcgagcugcucuugguccuggcuggcugaugcaaagacacagccucuuccagcuucacuuggcauacagcaaaugcuaugcaaguguuagcuauuuauugguuuagugaacuugugggcucuaacacacagcugugauaucacuccuccgccuucuguggccuggucucaaacaggcucagcacuguggcaaggccagucugggcuuagggguaagugcuucccaagggacagggaagggggccugggaaggaacagagcuuuucauccugaaucucaguuagaacugcuuaaggacauaucuuuucaggaaagaauuugcugggguaauuuggggggaacucuggauucuuggcaaguaguauaaaaacucagggcucaggucuggccuaauagaccccaaaaucggcucuguauauuagaugagcuuuagggggaagaaaaugaagucagcaugaucccagggaaggcgggcagcccacugauccaggcccaacccaaaacuuaguucaguuaaaauuagauuagcccauaagauuaaaauaccaacauauaaucacgggcugcuuuaaaguaucaguugauguuuaucggcaucuaaagagacaguuuggcccagugcagugugugcagacaaccuuggggagacaugccugacucagacauuugcagggggagcgagugcugcaaaaugaggcccacacaggcgauggaugacucaggaauaacccagguccugggugugcugagcgagccuucucucccugccucaggaggaaagggggcaggugggagaggcggugaggaggaaaggaggcuguguaugggcuggcauucccagagacagccucaggcccccagcucuaguuccccgucacuccuguauuuuucugcaugcugccaccucugagaaagguuauuugcuucacagugggacuuggagugggucagcuuuuuccccaaacccaagaagugauccacagaaagcagccaaggcucaaaauacuaaagucuuuaaaucucccccaauucaaaaugauuaugggaaaaauugaauuucuaaacugaaaaggcccuuggaaucagggcaugaggaugaaaagaacacaggcucugaagucagacaaaucugggcuuaaaccccaauguuuucuagcugugcaaguaccuuucacaaccucuaaacuagauaugaauaaguggcagcuuagcuggauguggugaccuguaccuguggucccagcuacucaggaggcugagguggggggauugccuggagccagggagguugaagcugcagugagccgucuuugcgccacugcacuccagccugggagacagagcgaaauccugucucaaaaauaaacaaaauaaaaaauuaauaaguggcagcuaauuaacaaguauuuaacaaauauaucaccaauuaccggacgggugcaguggcucaugucuguaaucccagcacuuuggggggccgggacgggcagaucgccugaggucaggaguucaagaccagccuggccaacauggcgaaaacccaucucuacuaaaaauacaaaaauuaggccgggcgcgguggcucaugccuguaauaucaggacuuugggaggcugaggcgggcagaucaccugaggucaggaguucgagaccagccuggccaauauggugaaacccugucucuacuaaaaacaaacaaacaaacaaacaaacaaaaaaaccaaaaaauuagccaggcaugaugguuggugccuguaaucccagcuacucaggaggcugaggcagaagaaucacuugaacccgggaggcggagguugcagugagcugagaucaugccucugcacuccagccugugcaaaagagcgagacucugucucaaaaaaaaaaaaaaaaaaaaaagaaaagaaaaaaauacaaaaauuagcugggggugguggcgcaugccuguagucccagcuacuugggagguugaaguaggagaaucacuugaaccuggaggcggagguugcugugagccgagaucgccucacugcacuccagccugggcgacagagugagacuccaucucaaaaaaauaaauaaaaauaaaauaauagggagucaggugugauggcucaucccuauaaucccagcuacucaggagacugaggcgggaggaucauuugaggccagggauucaaaaccagccuggacaacaaaauuggaagauccccaucccccaucucuaaaaaaacaaaacaaaacaaaaugaaaaauuaaguaucuauauuaucaauuagaaaacgggcucaggccaggagcaguggcuuacgccuguaauccagcacuuugggaggccaaggugggaggaucagcuaaggucaggaguucaagacaagccugaccaacacggcaaaaccccaucccuacuaaaaauacaaaauuagccaggugugguggcacaugccuguaauccccacuacucaggaggcugaggcaggagaauugcuugaacccaagaggcagagguugcagugagcugagauugcacuauugcacuccagccugggcaaaaagagcgaaacucuuguaucaaaaaaaaaaagaaaaaagaaaacaggggcucagagagguuaugccuugccuaaagucacacagcugggcaacagagagcugagacuagaucucagguaucuuaaccuuucaccccauccuacauguuuuccauuguaaucauuucucugccucuccuuuucucucccagagggcaugcaacauucugggggaaaggacaaguccuccauuucaaagauuugcugcuccacagauaagggcuaugagaaugucaguccccagugcaacucuggcccucauccuccuucaugcaaauacagguauguucaaguuguagaaaagaacuuggagcugagccaaagcugucaaggcuccagaccacccagacccuuuagcccuuccugccuacaggaggaacaggugucccuccugacaacaauccagguuaccaauguggaugugucuggucauugacucuccucaaagccccuuuaaaucucucaucccccuugauccaacaagaacccagcauguuggccuggcaggagagaguuuggccuugagugauuagucccaggcaugcuaagugaccucaggcaggucacaaccgaaggcucaauuuccuuagauguaaaaugaugaacacaucaauaccacaugcuauucuaacccacaggaccacugagaagaucuaaauuaaauauuguacacacaagugcuuuggaaacaaauuucagugcuaaugagaaguacuauuaaacuccuccugccuuguagagcuaaacaaaguugugccaccugcucccaacagaggcugccucucaggggacucugcugggcccugaggguaaccaaaagcagccugucaccuuucugcucagaggcgggaggucauaaggucagccaccccuuguggcuaaaggagaccacccuuuaccuggcacuucccugcccaagcagggaagaagcaagcucuggucugauggcugagagggcaccggaagagagauagcaggcaggguugcuagcagagaacaagggauaggccuccugaaugcaggauucaggugcauccaagaagacucacaaaaacaaaggacaggugcacagcuggacacagaacaccuacagcuuucucaaggcagggacagggcucccaccaacgacaugugcccaacuccuagagggaguccuacaauuccugagugcaggugcagugagcugggcgcuucucagugcagggccaugugcaucugcugcgggaaugccagaggcaggagaugcagcugcaccccucuagcaggcuaugccaagacucgaacagacaauaaauagcaauuugacaucacugaagauaaccucucugagccauuuccucaucugcaaaacagagacagcuuuuaucucaugugauuugaguagggauuaaauaagauugcuuuuauaaagugccugacacuacucuguagauacuaaguggcaacuauuauuaaaacacacacacccguucaacacaggagaugucacagggcaggcaaggccuaaugccacuguuauggauaaacaauaagggaaaaggguuugggagagaaagagaaagugacugcugugggcugggaagaccucccaaaaggggaagaaucugcacggcccugaaaguuacuacagugagcugggcacucuaccaggcauucccacguucagccucuacguuggucuuaaggaugaggcaagucagguucagagaaugaggugcaugaaccucaagguucauggucacacagguacugagaggcagcaucaggagcagaacccagggcuucugacuacgucuuuccuuuguaccagggcuggacgccauggggcuggcuuggaaggagaggaaaggcaaacuucgagggugcucagcugaaugaagucugggcaaucugaccaacuaagcccucuaagugccuuggcacuccuagagacacauguccuaccugaagccuuccucccaguccccagcugaccucccucccacuguucugcagucagucugcuauuuucccaaagagaaaaaggucaucgcuuccuuuuuagaguccuaucugggcuucuugagacaguuucaaggugaccuuuaggcuauuuguucuucucuucuuuugagaagugagagaggcaccuucuagugucauuuuuauaggaaaccaguugcugggucugauauccaugcaugugaagugggcagugaccccaucuccccuauucacagacuuaaucuacagaggagauggcaggauucgccuugcaaagaccaaaaccaaaaaaagcuauaagauauaaagggacaaaagaagccuuuugugucccuggucaggagacaagaugaauaccugcuuuaugggcucccgggccucugccaggcauucugggucaggaacauggguaaacaauugcaggagaugccaguggugagcugaguuacagugaggcucuccucuggaauaaguacuagccugggagucaggugaacauggaacaaagcagaguucaugcgggguccacagcacaaugugggguggggaaugcaccuaacuccuaaggcuuggagucauucccacaguuuucccaauagccuaaauccucuucacaccacuggccccuccccaccaaggacaagcaagaauuccugacugcuggggagagaaaaaagguccagagagggaaggugacuuaccuaaugucacccacugagucagagguagacuagaacccagaagcaacuauucuagaacuucagcucccacccugcuccucccaccccagucucugcaagagucuacccgaggcucugcuccaugguuaggguaggaaggagaacugcaaagcacuuucuauucuuauaggagggguaaccugcaagggaagcagcugccauagaugacagaaugagggcuccaacggaacuccuacccacgcagggguguugagagaauaggcaagaccccaaaaucagcucccaggcucuuggguaucugagagugcagagggagcauggccucagccccccacccuuaucccuacaaggcagcuggugucaucuucccucccgccaugaccagcucaagugaacaguauaggacacauggaaacccugauacccuaaggaaggacauugguggcagccuagguuugagagauuuguaauccuucagcucagaggaagguuguaggaggcugagguagggaugcauuugcuguaggugguuaaaauauuaacaggggcagcugucacucauugaacacuuccuguguauacaaacuuuuaugugcauuuauuuauguaauaaucacauuaauagcacuauaacuggauacuauuaguucccauuuuauuuuuuuuuauuuauuuauuuagagacggaauuucacucuuguugcccaggcuggagugcaauggcgcaaucuuggcucacugcaaccuccgccuccuggguucaagcgauccuccugccuuggccuccagaguagcugggauuacaggcagccgccaccaugcccagcuaauuuuuuguauuuuuaguagagacgggguuucaccauguuggccaggcugguaucaaaacuccugacuucaggcgauccacccugccucagccucccaaagugcugggauuacaggcgugagccacugcgcccagcuuaguuccccuuuuauacaugaggaaacugaggcucagagaugcugcuaaguggcagagugguggcugaauuccacacugcaaaggugaagcugggaaaaaugggcuuucauuuuugaggccugaacagggacucuucagaucuuuagaccaccuuucucuccacucauggccagaugcuagaacuccuguuuucagaggcagaaaaaugccuuuccaaggcagaaacagacuuuuggaaaggagaccacauccagccucaucauuuuacaaugggaaaacugagguccaaggcugagugacuugccagaguuuccagagucaguggaaugacagaaauaucacaccuggaagggaccacaaagaucaacugauggguagggaggcgugacugguccaaggacagagggagguaggaagagaagccagguuuuccugacuucuagacugauauuguugccaugacaccaucucugcucuccagcugcccagggucccgggcacagcacuuggguggugacaaagcaggccaggccaagcugaccucauuagcacuagagauaccaggccugcagggacaaacuucugacugccuagaguggggucucugcagucaugcugucaucccaccagcagccacugacacucaaagugugucugccagcccugaaugcccuaauguaaugccagguguggugggcaggugaggggaucggggacaggaggcaauuuauagauugcacuugugaggucuccuccuggucucacacagucaaaugacaucacugucacuucagcuucuuacagcaaaucagacgacauuucaugacucaauugguguggucaaauugagagucuuaaccauuucacaggugagggagaccugcagaaaaaggccucagcuauucaaggucaugcauuuaugucagaaucaguacacaugguuccccuuguccaguccuugauuucucuccaggaagcuaacugccaucaagguauaggugcugauggcuuaguuccauguaaggcucugcuacugugaccagcuuggcacaagagcccugcaccaggaacccagcuccuggaucugucaaauuagaggcaccacuucccucccgcugcaugucccagagccugccucacaccagcccggcagcaccgcucagcuccugcauguccuugggagagcuggaagguuuccugccaaauucccaaacccaaaucucaggcagaggggacagcagagucccaggaccucaugccuuccacagccagcugggggcaagcugaaaaugcaaaggcaguugucaaagucccccugaacaccacuuucagggacuucugggcaauguaggcuccaguaagcucccccaaucacucagcagaacagagugcucaggccuagcagggagaccaauacucugagagcaaauaaguugucuguuuccuucuccccaaaagaagguuucaaagucucuucaggccugaacaucccuaggcucccccaucuaccucaucuacuugauugagcagcaggccagacagcacccugagacacagccaggcagcgaccugggggugagcuggggucagaccaagccucaaccuccucuacucucccuccacuuccaaaacagacuucagaaauuuccagggccccuugucccacagauucuauaaaguauggcauuccugggccggaaauugacucaggggcuccuaacuagccuggacaagcaaagcugacagauaacauucuggagaugaaggaaaggugggaauauggggauccccuguguuccaccacacuuguaaguuuccugugcccaggucuccacuaugcuuaaacuccucaagcaggccaaguagaaauauacuccauccuggaacacgcuccagugaagccugucauaaauugcacugguugcuguugacagagcagaaugugccacucgccagaagacacuccuuucugucucacacacagcggggugccuggcuccccugggggucuggcccagccagaggagacuugccagucguggaagccuuacugaagggaccuaggaucagaggcaucccauucucuaauccugcucucuucugugcacagugcuggcuccaaucuugggaagccucagaucacagaucagaagccacagaacuggagccugagaaggaccaagguggcaggauggagacugccuacuuuauggggguaguucagauccuuacuccuggacagccucaaauggugcgagaugaggcaagaagcucaccagucugguggcggccgcagcaucggagcaaacgggacuuaccuaucuucaugaggcaggccagaaggauccagagggagaucucgaagggggugcgcacguguguguagucgaugcccaggacuggaaaggccuugcgcggcuucaugccaugaucagugacggaaugauuaacagggcggcucucuggggugaccuccgguggagcgguggugacauccccaaucgagcguucucgugguggcucugagcuucgaauggugcuggcaguugggcugagcuggaggccauggcuccugagaacaggcagcagccccaccaaagcaaccaccacgaguaaggaagggaagauccgauguggagagaggccacagaugccagaccgcagaaccauggugcugcuuccagagccagccucgaccuuacccaaaugagaguaaaaccgggcacauagguagcaaagggucagcaagugggaagagagacuggcguagucucuaggaaaaguucauguuuuagagaggcauuuccauggaagcaauuuucuggggguggagggaggcuggguuugcaaucuggaacuccaaaguggggaaagggggcaaggacccaggaacgaccacgaaaggagaccaaaaggucuggaacuccgggccugggaagggggaggacggaugugggaaacugagcccuagggauagaggaaggggcaggauagggauagugcaaaggaaaggaagaaggaaggcugggaccuuuggcugaggaaagugacugaggagcugggacucugggcugugggcuaaaggaagggguagggagccugagcuaaaggaaggggaccgaagggggugagagccaguccaggaaaaggagagagggggcugggagcccaggcugagaaggagugaaaccgggaagcggccgggagcuucuccacccagagaggggcagggguccaggcgcgccgggcugagauuccggggaaauggaaagaggcggaaggcaggcggccuggcgggaaggcgccucggcgcgggcugggggcggcucgcggugggccagcagcaacacgccccuccucgcggcccuggcgcgacgcggcgcuccgccccggcccagcugcagcuccuccugguccagcuccagaacuaacccuagccccggccccggcggcagcagacugaagccuagcugagcccggcgcugucacuuauaggcaccagcgagcagccggugcggcgggcuagagaga

SEQ ID NO: 14160 - RNA, 11022 nt, Homo sapiens
cucgccguuuccgacgcuguccggaagucgaguuagucuaguuaguaucggccuguuaucuccuuuugcgcgacacggucucagcuguuccgccugaggcgagugacgcuggccgccaacgagguauacguacugggacccucgcccucagucucgucuccggcgcggcuaccugccccguuuucccugugaguugaccugcuccgggccgcgggccgccaauggcaggggccgcuccgaccacggccuucgggcaggcggugaucggcccgccgggcucagggaagaccacguacugccugggcaugagugaguuccugcgcgcgcugggccggcgcguggcgguggugaaccuggacccggccaacgaggggcugccguacgagugugccguggacgugggcgagcugguggggcugggcgacgugauggacgcgcugcgccuggggcccaacggcggccugcucuacugcauggaguaccuggaagccaaccuggacuggcugcgugccaagcucgacccccuccgcggccacuacuuccucuucgacugcccaggccagguggagcucugcacgcaucacggcgccuugcgcagcaucuucucccaaauggcgcagugggaccucagggugcgucucagggcggggaggcccauuuugcggauggaguaacugagacagggaggacagacgccacgcccccaugucacacagggagguaggggcugggucgcuuuggaguaaaacaggcaugaguucagaaucuggcucugcuacugacuggcugugugguguugauaagucaguucaucacucugaaccucaguuuccucacguguaaaauguguuaguagccaacuuggcgauuuuggaaguauggaagggguuaaugucgaaaguggcauggagauuguuguaaauuggugggcaaaaguaaaugaaagaguggagucagaugccaugggauuuaaaccccuugcccacugggaggcucagugcaagaccucuuguaagaaaaaaaagaugacuccuauuuccugggagaaggaaaccagggugguuauuagaaagaaacagaggcaggagacuaauggggaaagcuuccccucuguccucaagcccucauucucaugagggaaugcugaucccuguuucuccaggccacucucacccugucuauucccucccagcugacugccguccaccucguggauucucacuacugcacagacccugccaaguucauuucaguacuguguaccucccuggccaccaugcugcacguggaacugccccacaucaaccuccuuuccaagauggaccucauugagcauuaugggaagcuggguaagagcuucuguuccaggcgaagagcagggcagcagcugggcuagaaugaagcagacaucucagcugaagguagcugccucuggugccuugcguggucuggugauaguagccacaggcagguucuaacuccugcccauuuauuuugugccacucugugcuaguuaccguuguagauuuuggagacaagagagcuacagaugguguuagguguuacaaaggaauuaaagugauacgacagugaauauuugggagugaagugagugagcuuuggaguaaaacaggcaugaguuuaaauucuggaucugccacugaaucaucguguggucuggguaagucaguucaucucucuggaccucaguuucucacuucugcucugaagcaguggcaucugagcugagacaugaauggugagaaggagccagccaagggaggacuguucuaugcagaggcacuaguaggaauaaaggccuugucuuagucaguuugugcugccaucacaaaaauaccauagaccagauggcuuagccaauaaauauuuauuucucacaguucuggaggcugguaaguccaagaucaagacacaagccgaucuggugucuggugagagucugcuuccuggcuccuagacagccuccuucuguccucacagaaggaggcuauauucucaccuggcacagagacagagaaggggugggaggccagggacaaaauagggaagauugagguagaagcaggcugguaugaggcaggggaguuggcuagagucccaguggccagcuuuuuuuucuugauaaauuaguacucucggcugggcgugguggcucacgccuguaaucccagcacuuugggaggccgaggugggcagaucaccugaggucaggaguucgagaccagcuugaccaacauggagaaaccacaucucuacuaaaaauacaaaaaaguagccaggcaugguggugcaugccuguaaucccagcuacucgggaggcugaggcaggagaaucgcuugaaccuggaaggcggagguuguagugagccgagaucucgccauugcacuccagccugggcaauaagagugaaacuccgucucaaaaaaaaaaaauuaggccaggcgcaguggcucacgccuguaaucccagcacuuugggaggccgaggcagguggaucacgaggucaggagcuugagaacauccuggcuaacacugugaaacuccgucucuacuaaaaauacaaaaaauuagcugggcaugguggcgggcaccuguagucccagcuacucaggaggcugaggcaggagaauggcgugaacccaggagagggaguuugcagugagccgagaucaugccagugcacuccagccugggcgacagagcaagacucugucucaaaaaaaaaaaaaaauuaguacucuccugaacuggggacauuguucccuaaauagcaucucuagcaacaaaggaaccuagagaagacagauaaaaugaccagcacaugagcaauagggagguuguugggaaagggaggugucgggaccuuguccagggaggccaguuagcuucuagucuggacauggagugauguagaguccucagcuuacuuuaggauagagcugccagggagcccagauacuuaaguuuucugggcagaaacaggccacuagggggaaguccaacuuacuucuuuuagugagaaaugauuuauaaaacugaaucagggaccucagcaucaucuaguccuuauuuuacauuaagaaauaacuggcucagaaaaggaaagugauuuacccaggaggcuacccugcuagaauguagcauuuauucaguuuaaccauuuacagagucuuugcaguguaugugccagguccugaggguaugaccugacuaugagcucugugaggugaggacgaccaugcacaguucuugguacauacuuguuaucauuauuugcaacuuuuuuuuuuuuuuuuuuuuuugagacagaguuucgcucuuguugcccaagcuggagugcaaugguguaaucucggcucacugcauccuccgccuccuggauucaagcgauucuccugccucagccucccguguagcugggauuacaggcaugugccaccacguccggcuaauuuuguauuuuuuuuucuuuuuuuuugagacggagucuugcugugucgcccaggcuggagugcaguggcgcgaucucggcucacugcaagcucccccuccuggguucacgccauucuccugccucagccuccugaguagcugggacuacaggcacccgccaccacgcccagcuaauuuuuuguauuuuuaguagaaacaggguuucaucguguuagccaggauggucucgaucuccugaccuugugauccguccaucucccaaagugcugggauuacaggcuugagccaccgcaccuggccuaauuuuguauuuuuaggagaaauggaguuucaccauguuggcuggucuugaacuccugaccucagguaaucacccaccucggcuucccaaagugcugggauuacaggcaugagccaccgugcccagccuguuugcaguuauugaucaagcacuucucuguaccagacacugggguuuauagcauuuaaucuucauaacaguccuaugaaguagauaccugccuauauagcuaguaaauagcagagccagcagguaaaaccaaaugcuuuuuuucuuaguaacuucauuuuacugugucaagaaauauuugagugcaugagugcacaaaggaaaaaaggaaaaaggaaccucguccucaggucuuuagccugauacugguugcuccugaacacugguuucucucuuuagccuucaaccuggacuacuacacagagguucuggaccucuccuaccugcuugaccaccuggcuucugacccuuucuuccgccacuaccgccagcucaaugagaagcuagugcagcucaucgaagacuauagccuugucuccuuuaucccucucaacauccagguacuaggggcuaagacgggacucuugacagugcaugggauucaccaagccaaaagcacaggaagcuuugagggcuuaaagaauggucuuugccggcugggcgcgguugcucaagccucuaauccuagcacuuugggaggccgaggugggcagaucaugaggucaggagaucgagaccauccuggcuaacccagugaaaccccgucucuacuaaaaauacaaaaaauuagcugggcgugguagcaggugccuguagucccagcuacucaggaggcugaggcaggagaauggcgugaacccgugaggcagagcuugcagugagccgagaccacgccauugcucuccagccugggcgacagagugagacuccaucucaaaaaaaaaaaaaaaaaaagaguggucuuugcccuggguugaguaucacugagaguaaccuuaguuucaggaccaggggcugcuguaggggcagaauuccaguaaagagaguggaccaaacuuuugcccugucuauuuuguguugcuggauccucucuucacauguucuguccucugugaaaaugggugaguucagaaagucaucagcaagaaaguucaccaggaccagggacaagucucuuaagcccuuucaacugggcaacugucuguugacuuugcaaagugguacccaaccccugugccucucaccuuuacccugcagagauaaccugggagacgcaggugcauguuagauuccuuucugcaguggguggacuugagcuaacuugucuccucccuucuaaugccacacucuucugauaugaggagaugaacucuauaauaucaaucacaacaauuaccucuuauuuauggcuuucugugcugggcacugugcuaaggacuacacauacauaauuuugcuuuguccuucccaccaugugauauauggacuguucuuaucacuguauguggaugaggaaacaguuauaguuuuuuuuuguuuuguuuuguuuuuugugacggagucucacucugucacccaggcuggagugcagugcguuaucuuggcucacugcaaccucugccuccuggguucaaccgauucuccugccucagcuucccaaguaacugggauuacaggcauccaucaccaugcccaacuaauuuuuguauuuucaguagagacaggguuucaccauguuggccaggcugcucuugaacuccugaccuuaagugaucuaccugccuuggccucccaaagugcugggcuuuacaggugugaaccaccgugccuggcccaguuauagauuuaaaacaugcauauucauuggaugucuacuuaagagaaguacugugccaggcacugggaauacugcgacagaugaccuggcccuaagggguguuuaguugaguaggggaggcaggugaguuaauaggcguuuauuacauggcagggauaccauguacaauagguguaaacccaggggacuguggauaugcauaggggagcuuaucuguucuaaucugagugaguugguggucaggaaacaugagauuuauccagccuuuggggacauguagaacuacuccaggccaagaaagcuacagguacagaggcaagauggaggaagguguauuuagagauugcaagcaguuuuacauacuucuguuucacucacagaacuguuucucuccucccugcucaggacaaggagagcauccagcgaguccugcaggcuguggauaaagccaauggauacuguuucagagcccaagagcagcgaagcuuggaagccaugaugucugccgcaaugggagccgacuuccauuucucuucguauccuugccagcuuccuggccauagcagagagggugagacaugggacucaagaauggccacaggaggugcagucaucaaccuuguggaugaccaauuucuuuuuuuuuuuuuuuuuuugagauggagucuugcucugucgcccaggcuggagugcaguggcacgaucucagcucacugcaagcucugccucccggguucacgccacucuccugccccagccuccugaguagcugggacuacagccacccaccaccacgcccagcuaauuuuuuguauuuuuaguagagacgggguuucacuguguuggccaggauggucuugaucuccugaccuugugauccacccaauuucuuuuuucuuuuuuuuuuuugaaagggaguuucgcucuuguugcccaggcuggaucgcacaauggcgcaaucuuggcucuguguaaccucugccucccauauucaagcaauucuccugccucagccucccaaguagcugguauuagugugcgccacugugcccaguuaguuuuuauauuuuuaguagagacgggguuucaccauguuggccaggcuggucuggaacucuugaccucaggugauccaccugccucagccucccaaagugcugggauuacaggcaugagccacugcgcccggccguggaugacugauuucauauugaucaguugggcuuccugaugacugucucucaugugcaaagguggucccuuggcuucagaguugguuguacugaggacaagagaggauauugaucaauaggaguaacaaauacagaggcccagaaaugagagggcauuagucauucgggagagaugcaggaguccaguuccugguguguugcaugugaagaggaaagggcguugcagggguacaggcagggcugccgagggaggggccugagugcccuacuaaggaauguggacuucaguucaugggugggcagugggagcaaguauucaagcaguacuguugaacagggugugacacaaucagauguacauuuuagaaaagccccugcaauuguggaaaaugcauuuaagggacgugauugggggcaaaagaguuuuacagucuugcuaggugagaaggguugaaagauuuguagugagaauagaaagaaagguguagaauggaaaaauacuaaggagauagacuguaagagucagugacugaaugggauagauggagcuggaguagaacuuagcuucccagaucucuggcuuagacggugggugguuguacuaaucacugaggcaggaaaaggaggagggagcagguuugucacauggaugaaagggacaagagcuggcagaugugcuguguucagggguccaugggacauccagagcuguccaagaggcagccagacuuuuggagcuugguuagugacuaaugaggcuggagccaaggucauggguagguguccaucaggucacagaggccaugcgugaagcaggacagaaaaguccaggcccucuaggcugaugcucucacagauucagcaucuaugcagcaugcuggagacaagggggacucaggagucuuaggguauagaggaaaauaauuccagccaacacuuacugauguuucucgagccauaugugggaaacaaagcucauggggucgggguuggaggaaugacuuauaaaugauggcaguagagugugcagucccugaugaagguacuaaggagcugcgucacaccugcaguuaauguaggccaauuggacugcaugugcucagcaaaagaggggaggagcaauuuuuuuuuuaaauuuaagauggacuuucuuuugcuguuguugcccaggcuggaaugcaaucuccaacuccaggguucaagugauucuccucccucagccuccuaaguagcugggauuacaggcaugcuccaccacaccuggcccuuuuuuuuuuuuuuuuuugagacggaccgucaaucuuguugccccaguuggagugcaauggugcaaucucagcucacugcaaccuccaucucccacguucaagcaauucuccugccucagccucccgaguaagugggauaauaggcgcccgccaccacgcucagcuaauuuuuuguauuuuuaguagagacagcguuuuaccauguuggccaggcugguuucgaacuccugaacucaggugauccaccugccuuggccucccaaagugcugggauuauaggcgugagccaccaugcccggccugcaacuuuuauauuuauuucuuagaggcagggucuugcuccuuugcccaggcuggagugcagugaugcaaucauagcucacugcgaccuugaacuccugggcucguuacccucccaccucagccucccaaagugcugggaucacaggcaugagccaucguccccagcugggaagggcaguuuauguuuguuuauuuugugaggcagagucucacucuguugcccaggcuggagugcaguggcgugaucucagcucacugcagccuugaccucccugggcucaagugauccucccacuucagccuccugaauagcuaggacuaugggcgugugccacuguggccagcuaauuuuuguagagaugggguuucaccauacagccuaggcugggagaagcaauuuaaauaauguaguauuuuguacaccguacagaugguucccaacuuaugauggcucaacuuuaugauggugugaaagcuauaugcauucaguagaaaucauacuuuggguaccuaucaaucauucuuucacuuucaguacaguauucaauaaauuacaugagauauucaauacuuuauuguaaaauaggcuuuguguuagauaauuuugcccaaaugcagcuaacguaaguguucuaagaauauuuaagguaggcgaaacuaagcuaugaugugugguagguuauguguauuaaaugcauuuucgacuuaagauauuuuugauuuaggauggguuuaucaggauguaaccccaucauaagucaaggagcaucuguacguuacuuuauguauucguauauauaaaggauucuauucacaaaaccauguaugcugcauuuaacaaauaauuugaggaauuuuaaagaguauuuuuaaccauauacauuugugcugauuuuagauucugcccugacccuaacccccuuaagauucagcagcucucuguaagagaguagggacugauacaaauaagggaguggucagcuuugcugaaggguagguggguaaggaaagcuuuauggaggcaugacacgugaguugugucauuucaaggugaggguuagccagucuaaugaagaagaaaagggaauucaaguuaagagaacaugcaaaggcauagggguucaaaguugagacagguuucaaggguugcaaauaagauggcaugggccaaguguaauggcuucaugccuguaauuccaacacuuugggaguuaaaggugggaggauugcucaaggccaggaguuugagaccagacuggguaacauagugagaccccaucucucucucuuuuuuuuuuuuaaaguauaaaaauuuauuuuuggccaggcgugguggcuuacgccuguaaucccagcacuuugggaggccaaggcgggcggaucacgaggucaggagaucgagaccauuucugucaacauggugaaacccugucucuacuaaaaauagaaaaauuagcugggugugcuggcauguaccuguagucccagcuacucuggaggcugaggcaggagaauugcuugaaccagggaguuggagguugcggugagccgagaucgcgccacugcacuccagcuuggugacagagugagacucugucucaaaaaaaagaaaaagaaaggucuguaacucgaacaucauuuggugggcuaagugcuuuacuugcagggucauuuaauccucauuucaaccccuuuuauaauugaggcgacaggcccaaggucccucucccgggauguuuuggaagaacaguucaaaccuugguuuugguggguguagaaucuguuucuuacuuuggagccaucugguaguacaacagccaugguguccuaacauagccaaccuagccauggcuaaccuccauguccucgucagaccccagacccagacaucaucagguuuugaacucccuuagucuggcuccagagcaugugccauaacgcaaaauugcaagguuaguacuguccaguccuuugauccgcagcaguguguggaagaggcagauagaggagcauuugagucuggguguuuuuggaggcuucucauaccugauuggucccuauaauuaugaggaagagagggauggacaugguuggaguguaggcaucagcggaagucagauccugcccagaccagcuccccauccucugccuaugcuaucagccuugacgcacccuuccucagcacacugggcauccaggagaaguaccuggcacccucgaaccagucaguggagcaggaagccaugcagcuguagcaacaagguggacccuggagagcaggaugcauaauccagcacuggggaaaguggaggcuccugaugcaggcugcagacccaagagcaaguccucccagccagagcuggcgggcuggcaaggggauauucagcucugcaaaggacuucuggccaaaaagccagacauggugccaagcagaacaccccccauacugucagugguguccgugagcucugggcccugccaccagaaagucgagcacugguccuagucaggcugugaugaaaugugcuacaauacaagaguuuauuuucuacuuuuugugacuuccaaacuuuucuucagucuuccgggcccagggguuuggggaagaaugagggagugucaccuagccuuggaau

SEQ ID NO: 14161 - RNA, 2877 nt, Homo sapiens
uuuucugggaaagacuuggaggugggaacucaagaaguuauucucaaaacugugagcugggaaucaagacagcgugacucaauucagcaccguggacagagcugcuggagcccucaggacccuggacagagaagcaggccgcgcauucccggggaaccgaauucgcaucacuugagaacccaccuagagaagccagagcguucaacuccccuuucccucccuuuucuucagccagaccucagccacuugcuccugagucuuaggaacagagguacacggagcgaauauauuuuaagggcgccacuaacagcgggagauaagacuuuugggagaggagaauuauguaaauaaaaauggcuuuggcugauguacuaggagaacucuugauaauucuaaauuagaguccucagaugggaguggggcacugcuaauaauauuuguuaacgauauguauuuuuuaggcggagcagcaaagggccacucuuguccuuuuuaccccacgaagucccaccucccauuccuuacgcucaaguuuucauuucuuggagagcaccccguacgagagaaagggaaauaacuucugcagucucuugcuuuccuccccaucuuccccuucccuacccccacucauccggucucucugaaauacacaugugcccacauccgcacgugcacacacacacacacacaaacacacacacagagccacagcgugagaauuccaaaagguucugcacacucgguggagaagauugaauucagagcaagcggaugcccccgaaagcaggcucugucccuuuaaauggguuguaguggugggggaggggaacuggccggagcuggcauuguccaguuugaacugaacaccggaagugaaggggcagggccagggccgugcacugagccccgggccauuguccaucuccgaccagggcaguagccacccccacuagccagccgucuuuaucuccuagaaggggagguuaccucuucaaaugaggaggccccccaguccuguuccuccaccagccccacuacggaaugggagcgcauuuuagggugguuacucugaaacaaggagggccuaggaaucuaagagugugaagaguagagaggaaguaccucuacccaccagcccacccagucccucucucagcaguggauggggaugggguggggguaggacgagaaggcagcugguggagaaacagcuucaagacucuuuggguuccuccugcucuccagggagcuuaccuggggcuaacuuuagacacacagguuuggagggaggaaagaaggaagaauucuuuacaacgaaucaauuaagagcacuuucucuuuucuaacugggggaggcccagaaaaacucugagucagaaacucugggaggcagacauucagauguagucagaggcagacagacuuuggaaggcagcgcuuuggucaggacagaucagcccuguguguccccagccucuccccugcucccccaucccgggcuucccaguguccagaacuccaggucuaucuaagcacacggggguggggggugagagcgggucagcuccaagcagccgggucagcucagaggccugagggggaagagagggggaggggagcucaagggcugggggagggggagggcccauucauuucucccuugacaggugguuuguguuucugauuggccagcgccgccaggcucacaccucccucccccaacucucuggaauguauaauuaucugcccgggggguggggguggugugugugugugugugugugugugugugugugugugugcagucacgugguuuuaaaacuaccccccccaccaggucccccaccuguaucugcuuuggggaccccuacugaguccaaagugcaggaucucaaauuccgggguacucaagucuucuagggcagacagacccaucuccaguugugcguguggggagggggugucaaaccucaagguucugagaagggacaccccagaggugucagagaccggaguugugggggagggccggagcuggagccggagggaaagggaggggaaaggagagggaggggaggggagggggcugcccgcgggggguugggucauugucuuuuagaauuugggagccuuugaaaagccgugggcccucccaccgcuauugugcgggggaagauguagcagcuucuucuccgaaccaacccuuugccuucggacuucuccggggccagcagccgcccgaccaggggcccggggccacgggcucagccgacgaccaugggcuccguguccaaccagcaguuugcagguucgagcucgggacuuagcggggacacuuuaggauucaggggcggccaggagccacguagaagggagguggggaacugaguccuaggcugcccaaaggaccccaagacggugcggccuucugcuucauagggccgucucuggggccaggaaccuuggugucccaguggcgugcgcgccagacuacguggguggauggagaggagaggcuugucccgccgugagucucugggaaacgcguugugggaagaggagcaaaacuuucggggcacuacugucccgguguacgcuaggggaacgcgggaggcgaccgggauagguuucuucucuucuguugcuugguagcugcccccuccuggcuguccacuuguggggcuggauacucgggucucccugccuggggcccgagacggcccuccgauuccgugccccccagcuaagugcccggcccucccucucuccagguggcugcgccaaggcggcagaagaggcgcccgaggaggcgccggaggacgcggcccgggcggcggacgagccucagcugcugcacggugcgggcaucuguaagug

SEQ ID NO: 14162 - RNA, 18415 nt, Homo sapiens
ggacuccgcagggagccgcugggcucacgucucuccccucauuucggaccuuuccccuccccgcuguucucggccccacuccaucguccuccuuccccucaucuccccucucugccuccagauucagcuuuucucccgccccgacuuucugggcgaccacuucucuuucgaagaugaccaggccgcucugcccgccuccuuccgaccucaguccugccggguccacggcggcaggugagaacguggaggggcggagggcugggggcgcuggggcagaggcggggcugcaggaggagagucuuucaaaugauuuccuuccuuuggcuaccuugcgaugaacuguucugucuugcgcaauuuuaaaacaaaauaagguuuuaauggaaaauguaaaacuguagauuguauaauauaaagauaaaucuuguuuccucuauccgugugcucuuuuaaauuuucgguggaguauuuuaaaucccugacccaacguaaaauuucauggguacacacuucaacgugugucucuaauaugaaagaacauuuuccccacguagcuacaagucauuaucacaucuaauaaaauuaauaacaauuuauucauauuacccaauacccaguccguguucagauuucucccauugucucaaaaaugccuuugugaaauuaacuuguuuuucucagcauccaaauaagguccuugggccagguuuccucauguuggccaggcugaucucaaacuccugggcucaagcuauccgccaccucggccuuccaaagugcugggauuacaggcaugagccaccgugccuggccgaccccaguaguuuuuuuuguauuguuuuguuuuguuuugagacagaguuuugcucuguugcccaggcuggagugcaguggcgcgaucucagcucaccgcaaccuccgccucccagguucaagcgauucuccugccucagccuucccaaguagcugggauuauaggcaugggccaccaagcccggcuaauuuuguauuuuuaguagagaugggguuucuccauguggauuaggcugguguugaauucccaacaucaggugauccgcccaccucggccucccaaagugcugggauuacaggcgugagccacugcgcccggcgaccccaguaguuuugauaacuuucuugauauaauaagaugcuccaggaucauuuuguacauuuuuuuuuuuuuuugcuccaaaucuagaauuggcuauuugccaaggaacccugguucuuuuuaguggcaaaugguagagaccaaaaucugcaugcuagguguuucaaaguuauaaugcccuuauuacaacuaauaguaaaaaccacugaaugcuguugggaguuuccuguuuuuuguuuguuuguuuguuuguuuuguuuguuuguuuuuuugagauggagucucgcucugucgcccagacuggagugcaguggcacugucucagcucacugcagccucugccucccgguucaagcaauucuccugcuucagccgccugaguagcugggauuacaggcacccgccaccacgcccagcuaauuuuuguauuuuuaguagagaugggguuucaugauguuggucaggcuggucucaaacucuugaccucaugauccgccccccucggccucccaaagugcugggauuacaggcaugagccaccgugccuggcuucuugugguucuuuuuguccucaagauauucaccuauaaccuauuuguuauauauucguucaaauuaccgugucuuaaacacauuugaaauaauacuuuugugugugugguuaugucaccaaccuaauauacaauuagguucauuaauuuaauuuauuuucaguuuuaaggaauauuuuucauuuuuaucuauuucuggauuuguuuuuguuuuuguuugagacagggucucacuuucuuauucaggcuggagugcaguggugugaacacagcucagugcagccuugaccuccugggcucaagggauucuccuacuucagccuccugagaccugggaccauaggugcacgccaccgcgcccggcuaauuuuuuaacuuuuuuguagagaugggggucucacuuuguuacuuaggcugguuucaaacuucugggcucaagcaauccucccuucuuggucucccaaaguguugggauuacaggugugagccacugcaccuggcccuaguucuguuuuccuaugaauaauuaccaugaagcugggcacaguggcucaugccuguaaucccagcacuuugggaggcugaggcaggaguccaggaguucaagaaucaccugggcaacauaaggagacccugucuugacaaaaaaauuuuuaauuagguggauguggugucaugcaccuauaguacuaccuacucaggaggcugagaugggaggauuguuugagcccaggaguuggaggcugcaguaaacuaugaucacacuacugcacuccagccugggcaacagagugagauuuuaucucuaaaauaauaauuauuacaugaaauauuuacauggugccuuagcucaggcugcuaucacaaaauaccauagucugugugguuuaaauaagagaaauuuauucucucacaguucuggagacuaggaaauucaagaucaaggugcuggccacuucacuuccagagugaggccuuucuuccuggcuugcagaaggccaccuucuugcuguguucucauguagugaagagagagaauaugagcuccugucucuuccucuucuuuuuuuuuuuuugagguggaguuucacucuuguugccuaggcuggagugcaauggcgcaaucucggcucacugaaaccucugccucccggguucaagcaacucuccugccucagccucuugaguaccugggauuauaggcaugaaccaccacacccggcuaauuuuuguauuuuuagcagagaugggguuucuucauguuggucaggcuggccucgaacucccgaccucaggugauccgcccaccucgcccucccaaaguguugggauuauaggcgugagccacggcacccggccucuuccucuucuuuuaaggacacuaaucccaucauggggucucacccucaugacccccucuaaaccgaauuaccuccuaaaggccccaccucugaauaacauuacauugaggguuauggcuuuagcauaugauuuugggaggacacagacauucagccuauaacaguuccaaagccaacagcuuucaucucugucccugccaacuuuuucccucccucucucccgcuguuagaaaucuuuuuuuuuuuuuuuuuuuuuuuuuuuuuuuugggguuugguguguucauccacuggcuuuuuuguuguuguuaagauauaagcaaauauacacucauacauuuccauauaacuauagaagccaaauauuuauauuuuguuuuccuucuccuccauuuuauuacauaaaagggaacauacuauaacuggguuaauauaauaaaaaaaacacuaaauuguacaccuuaaaagugugaauuuuggccaggugcaguggcucaugccuguaaucccagcacucugggaggccgagguggguggaucacuugagguuaggagcuugagaccagccuggccaacacggugaaaccccaucucuacuaaaaauacaaaauuagcugggugugguggcgcaugccuguagucccagcuacucaggaggcugaugcaggagaauugcuuaaacccaggaggcggagguuacagugagcugagaucgcgccauugcacuccagccugggcaacaauagggaaacuccaucucaacaacaacaacaacaauaacaacaacaaaaagugugaauuuuauggcaugugaauuauaucucaguuuuuuaaaggaaguuugcuauaagcacuguuaugcaccugcuuuuuucaucuguuuggagaucacuuuauaucccuuuaagagcucuuuuucauuccacuuaacugcugcauuauacuccacuuuuucuuucuuuuuuuuuuuuuuuuuugacacggagucucgcucuguugcccaggcuggaguguaguggcgugaucucagcucacuguaagcuccgccuccuggguucaugccauucuccugccucagccuccugaguagcugggacuacaggugcccgccaccacgccuggcuaaucuuuuguauuuuuaauagagacgggguuucacuguguuagccaggauggucucgaucuccugaccucgugaucugcccgccucagccucccaaagugcugggauuacaggcgugagccaccgcgcccagcccacuuuuucuuaauuuauucagcuccaauccccuauugauggacaucugggcugcuuccccccuuuucuauugcagaagugccauaaugaauagcccccugcauguguuauuucauguuuucaaaugguguccuugggauggauuccuagguaugagauugcugaguaauuacucauggaguuuugccuaauauugccaaauuccccuccauaggggcaguaugauuucauucagucuuuucuuaggucugaccucauucccugcugcuguagugccuguucaucccaccuccccugggacaggggaucaugaucaagucugcauucccucuucuguaucucaggggaaccugggcaggccaaggacagguaggcucagauacccuccauuucuuccccuucccuagcuggauccuguuugaugagacgaacuucgagggugaccagcacauucucucugagggcgaguuccccacucucacggccaugggcugccucgccuccacaguccugggcucucuccagaagguaucccuggugaguuuccaugucugguuccaggcaaucccggaagcagaaguugcugcugugggacuucuggacacagaaccugugugcuggugcagggguugauuccaguguuuuuagaacugccccagguccccuugacucuggggcuguaaagccaguuuaguuugcuagcucuucauugagcacccacugagagaggaccuggggacauggaaagaaaucagacacagcccugccuguaaggaacccaugaucccauagacauaaagauuacaugcagaguggugcauccagauacaggaguggugcggggauggugggacuaacacucagggcuuggguggggcaggggccagugcugccaaggugauguuccaugcagggaggagugacaggaccagcuagaaagauggcccugccagccacagaccagugagaaggggcaaggcagugggguugcugcuacaaugacccagaaugaauugugauguccuccaccuaggaagagauggauggaagugacggggccacaauaaggggcuagcaucuguaggacuuggugacuguguggccagugggggcaguacccagucagaacaggugaugcuuacugagugcauaguaugugccaggugguguuuaaaaggcuuuccaccagccaggugugguggcucaugccuguaaucccagcacuuugagaggccgagguggguggaucaccugaggugaggaguucgagaccagcuuggccaacauggugaaacccuaucucuacuaaaaauacaaaaauuagccaggugugguggugcacgucuguaaucccagcugcuugggaagcugagacaggagauuugcuugaacccaggaggcagagguugcaguuagcccugauaacgccaccguacuccagccugggugacagaacaagacuccaucucaaaaaaaaaaaaaaaaaaggcuugccacauauacuaaagccuuuuaaucuucuccacaaugcuaagagguguguuaccauuauuaucucccuuuuccagauguggaaacuaagccacaggcuccaggucacauaguugguaacaggcaaagccaggcucucccccaggcagcugguucugggguccaagucccuugcaaugacacgcugggcucugacgacaaauaaaccugguucugaagcccagcuuuagggcccugagcaagcgauuuacccucuccagccuguuuccucccuauuaagugggggauaauaauagcuucuaccuuauaggguuguugaagaguuauaaugagaucagguaaagcacuuagcauaacauggccuguaguaaacccugaugaaugugagcugcuauuauuaucaguauuauuauuguuguuauuguuaucaugaagaugaaaaggagaaaucuagaaugaagccaagugcaguggcuuguaccuauaauucuagcacuuugggccgggcguguuggcucacgccuguaguuccagcacuuugggaagccaaggcgggcagaucaugaggucaggaguuugagacuagccuggccaacaugaugaaaccccgucucuacaaaaauuagccgggcaugauggcacaugccuguaaucccagcuacuugggaggcugaagcaggagaauugcuugaacuuaaaaaguggagguuacagugagcugagauugcgccacugcacuccagccugggugacagagugagacuccaucucaaaaaaauaaaguaaauaaauuauagcacuucagcaggcuaaggcaggaggaucacuugagccuaggaguuugagaccugccugggcaacauggugagacccugucucuacaaaaaauuagcugggcaugguagcaugugccuguagucucagcuacucaggaggcugaggugggaggauugcuuuagcccaggaaguugaggcuacagugagccgugauugcaccacugcacuccagccugggcaacagagcgagacccuaucucaaaaaaaaaaaaaaaaaaucuaagcugcgcaugguggcucaccccuguaaucccagcacuuuggcaggccaaggaggcagaucgccugaggucaggaguuugagaccagccagacuaacauggcgaaagccugucucuacuaaaaguacaaaaauuagccggggaugguggugcgugccuguaaucccagcuacucaggaggcugaggcagaagaauuguuugaacccgggaggcagagguugcagugagccaauaucgcgccacuguacugcagccugggugacaagagugagacucugucucaaaaaaaaaaaaaaaaaaaagccuagaauaagccccagguuuccauccuggcucagagugccagguuaguucugagaagugcuauuuacuggagaggagguuugagggggaaacuggggacccagccuagcgcuuacugccucugagaaucaggagcacucggcuggcagcguccaagaaucaguggcccugcagaacugagcucaggagggaagaaggccugacauacagaucugggagucagggugucugggauuguggggcugcgucugggacuugggcucucagagccucacccucuucugucuccugggccccagcacuuuucagagccuuccauuuuccuguauggacucgagugcuucgaggggaaggagaucgagcucagcagggaggugcggagccugcaagccgagggcuucaacaaccaugugcugucugugcggaucaaggggggcaugugagugcugaggggaggcaugggugcgguggcugcugguggggaugagucauggcaagacagagauccugggggucucuggccucuuuccccuccccacuuuucccccacuccccuccaagccaggaaggagggagaagugcggacugagaagggucacuggcucucagggcuuagaccccagcuuggugggcuucucaggauccuucuuuacccugaaaaccccaaaucuacuucccagccucccucuccgcccugggaacccuauuccaggcagaggaaucccuccaugggagaagaggagguggagaacguuuugacgucugugucuccuccuccaccugucugucugucugugugucugugcucuucucugugucccugacaccugcugggcccaguugggugcuaugugaacacagugacuuccggggccgccaguggcuggugggaagcugcgagaucaccaacuggcugaccuacagcggcacccagagggugggcucccucuaccccaucaagcagguggguagcguggcuggagcugagcgugucuggggcugagcgugucugggcaggccuuucuggaugagugucuagcuguguguuucccaaacacagcauuuguguacuuuugucacaacuuuugccacaucgucauuccucuugagccauugucuacuuaauauuuuucucuagauuaacucucuuuuuaaaagucuuuuaauuaauuuuuauuucuuaaaaaaagcuuuuuuuucucuuucuuuuucuuuuuuuuuuuugugugacagagucuugcucugccacaaaggcuggagcgcaguggcaacauccuggcucacugcagccuccaccucccggguuuaagugcuucuugugccucagccucccaaguaacugggaccacaggcacgugcuaccacgcucagcuaauuuuuguauuuuuaguagaggcaggguuucaccauguuggccagacuggucuccaauuccugaccucaagugauccaccugccucggccucccaaagugcugggauuacagacgugagccaccaugcccagcccuuuuuuuuuuuuuugagauggaguuuuggucuuguugcccagguuggagugcaauggcacgaucucggcucacugcaaccuccgcuucccagauucaagugauucuccuaccucauccuccgaaguagcugggauuacaaguaugugccaccacaucuggcuaauuuuugguuuuuuuuuuuguuuuuuguuuuuugagacggaaucucgcacugucaccugggcugaagugcaauggcgugaucucggcucacugcaaccucugcccccuggguucaagcaauucuccugcgucagacucccaaguagcugggauuacaggugccugccaccacacccggcuaauuuuuuguauuuuuaguagagacgagguuucacuguaauuggccagguuggucucgaacgccugacuugugaucugcccacuucggccucccagagugcugggauuacaggcaugagccacugcgccuagcuaauuuuuguauuuuuaguagagaugggguuucaucauguuggccaggcuggucuugaacuccugaccucaugugaucugcccaccuuggccucccaaaguguugggauuacaggcaugaaccacugugcccagccccagcccaguuuuuauuuagcuuucugagucugugcuugugccuucaacacuuucauaaggauuuuuagcugcugcauaaggaaagcaggcuugauccugccacgaacacauuuagcauaccuggaaccaccauaggcccuccugacauguuuuuuguuuuggacaaucucauaagaacuuuagaccucacaacaugaaccccuugaagucugccugggcacacgccacaugcagauuuuggugcuuucccaacuuuguagguauagaggucaacaauucuauuacgaggggcucaggacagccuaguuuuguuagaggcuguaccguaggaaagccuaugacaauaugucaaaugcuggaacauucucagugccucuagacaauauccccagaagaggaaaaagaaaaaaaucacauuuuuuuuaacuuuauccuuguccuaaggaauaauauccauaaagucaugaguuugauguguacauaugauuuucuuucuuuuuuuuuuuuuuugagacagagucuucuugcucugucgcccaggcaggagugcaguggcaugaucucggcucacugcaagcucugccucccggguucaugccauucuccugccucagccuccugaguagcugggacuacaggcacccgccaccaugcccggcuaauuuuuuuguauuuuuaguagagaugggguuucaccauguuagccaggauggucucgaucuccugaccucaugauccgcccgucucagccucccaaagugcuggguuuacaggugugagcuaccaugcccagccugauuuuuuuucuuaauagauguaauaaauacauugccauuaauuuuucaaaaaugaguuuauaggcugggugcgguggcucacuccuguaauuucaucacuuugggaggccgaggagggaggguugcuugagcccaggaguucgagaccagccugggcaacauggcgagaccccaucucuacaaaaaauacaaaagaaaugagcuaggugugauggcuugugcuauagucccagcuacucgggaggaucaccugagcccaggaguuugaggcuacagugagccaugauggcuccacugguacuccagcgugggugacagagcgagacccugucucaaaaaaaaaauaguuuagccacauaggacugaaagugaucucauggaccacccacugguaguaagcauaccucacuuggggaagcacugccugcauauguguuucuguauguccgugccugcaugucugaacaucaguaucauuaaugcacaugugcagauaaaugguaaggccaugggcucuguguguaugugugugugcaugcauguucccaucugaggguauuucugugcucaucagguuauuuguguccaugcaucugugugcucuggugaugaccuguguguguguguguguguguguguguguaucugugggagugcauucauuuuuuuaauuuuuauuaauuaauuuauuuuugagauggaguccuacucugucacccaggcuggagugcaguggugugaucucggcucacugcaaccuacaucucccggguucaagcgauucuccugccucagccucccgaguagcugugauuacaggcgugugccaccacaccuggcuaauuuuuuuguauuuuugguacagacaggguuuugccauguuggccaggcugaccucgaacuccugaccucaggugauccacccgccuuggccucccaaagugcugggauuacaggcgugagccuccgcgcccggccgggauugcauuuaugacugcgcaugcuuguacuugugacaccauugacaguguguguaucuuuguauaaggauauuuguguaguucuuguauucaagacucauaacaucauugcugggagaaaucuuggagauuaucuccaccccucacauuuuacagauggggaaauaaaggcccagagaaguggacacggauuugcucugcaaucuugggcaaguacuguaccuccuuagaccuucguuuccucaucuuuaaaaugaggauaacacgugucaugggucaguuuugaggacugaagauaauguagguaaaacauuauuagaacagugcuugagugagucagcucucaacaaacguuagcugugauuauuguuauuacuauuauuacuuuugcuaccaucuaagagcuccagcugauuuauggcagagccaugucugaugucugacaguccaguguccaucccgucaggaacccucuucaacacaggugugugugcauuucuuucuguaagugugugugcacaucuguaugcccacacacauccacgcuuuuagcaagcagaacugccugguauggaguagacugcauggaucuaugguuagaacaugugaguuggauggcugcauguauccauguguuugugucuucugugaacuucugugccaucauguguaccagagguguaucugucaguuugucccucugcacacaucuguggguaccucuaugaccauggaacugugugugugugugugugugugugugugugugagagagagagagauacaugugcucuccguauguguguguaaagaagcagugacuuagaaauagagucaaggaagguuuggggacaggagggagggcuugggagccugauacuggagaguccagaguugaggguacugggggcccaggucaucccuccccggcaccccugacucucagccucuuucugccaccagcgccggguuuauuuccgccucuggaaugcagcacuggggggauuccuggcagugccggaccauguggaggacaugaaagcaggccgugugguggucgccgacccccaagcuggagguagcugcaucugguacuacgaggaugggcugcugaagaaccagguacugauacaggggcuggcacagggacacccuggcccuaggcauuugcagguccacucuggggagucccagcccaaucaggaacacagagggaugcacacagaagccaggacccuggggagagggagagugcagacuguucccccugggcaagucgugcucuucucugggccccagucuguaaaaacaagagcaaugaacugggugcuucuaagggaccucccagcucuaaugcccaugacagaacuugaacccuauuaauaaugguagauuuggccaggcaugguggcucaugccuauaaucccaacacuuuggaaggccgaggcaggaggauugcuugaggacaggaguuugaggccaaacaaaaaauuaacugggugugguggugcaugccuguagucucagguacucaagaggcugaggugggaggcuugagcccaggaguuagaggcugcagugagugaggauugcgccacugcacuccagccuuggugacagcacaagaccuggucucaaaaaaaaacaaaaauaaaaauaagagaaaagguagauuuacuccacagacauuucuugagcaccuacuaugugccaggcucuguucuagaugcuggggauacagcaguuauagacagaauugacaccugccguccugaagcuuacauccuaguggggagagauagacagaaauaacuuaaaugggcagaauaucuuagugucuuacaggaugaaaguucaauagaggaagauaaaucaugaaaggggaauaggccaggugcaguggcucacuccuguaaucacagcacuuugagaggcugagugaggcaggaggaucucuugagcucaggaauucaagaccagccugggcagcauaaugagaugccaucuccacaaaaaauaaaaaaacuagccggaugugguggcaugcaccuguagucccagcuacucaggaggccgaggugggaggauuacgugagcccaggagauugaggcugcgguaagcuaugaucacaccacugcacaccagccugggcaacagagggagacucugucucaaaaaaaaaaaaaggagaauagaaaguaucagguaugguaggggagccuuuccgaagaagaugacauuugagggaggcagccaugcagauaucugagggaagaguguuccaggcagagggaacagccagugcaaaggcccugaggaaggaacaugccugggauuuuucugggcuagcaaggcuagcuggguggcuagagugaguugaguaagggggagguagcaggagaugaggccagaaagguuauaaggacuguaggucuuuguaggccauugagagguuuugucuuuuacuuagaaugagagagauggcugaccacaugccaggcucugcauugaguucuucacacaaaugccuccuauaaucuuuagucuagaguaccguggggcaggucuuuuuauacuccccauuuuacaggugaggaaaccagagcauagagagguuagguaauuugcugaaagucacacagcuaguaaauguguagagauuugucugaugcuaaagccuaugcuuuggaagccaaucauggaaggauuccuggaggaguuaauauuuuuccagcccuuuuauguuuucucacacugaacccucacaaaagccagcauuuggggauucccauccccgagaggaaacugaagcugaggaggauuaagagacuugcccagggccacagucccuaagagccaggauucagagcagaugggucaaggguuucuuggguacaguagagucccuguggggaggaacaaugccugaugaccuccuggggccucagauggcccccaccaugagccuacaggugauuggacccccuagcccaggcuccaagguggugcugugggccgagagccgccugccgcgccagacguggagcaucagugaaucgggccacaucugcagccagauguucgaaggccagauccuggacgugaaggguaaggugggauguauggggaagagggcuccugagggggcugagagccauggagucccagcucucucugacuaucucccuaucuuuuaauccccaucccacccccaggaggccggggcuacgaccgggaccacguggugcuaugggagccggaugaggacagggcaucccagaucuggacuauccacgugcuuugaaacuuuuccccucacccuccagcccuggaggcuuuugcugggaugaauguuuuuauaggguuuuuguuguaacauaagcuauuuucuaauaugcugccagguacccuugucucugugcaccuugauauuucggggugggguggggauuuguucacuugccuucuucccugacgcucaggcuggcuucuucccuccaggccccagcuuucggguucagauguuaggccuccuucugccaucagagggcgcccugggaccagacuaacuggggaguguagucucgcgcagccacccaaaugaaguguugugagagcaggcucugagccggguggggcccuaggcugugcgggcacagacacaaacugagccuuucggucccuguccuuagggaacgcacagucccacagaggauccugacagguagggugaugcauccaugagaagggaggaaagaaguagagggacucacacagcaggaacaucacccccacaagugcagggcaggcugacaugucucucugcacacgucagggaccugcagcugagauauuaggguggggaguuagccaggcuccaggaggcagagaaagaauauucuagggaugcauacaaguccagggugaaaacguggagguuagugugaugggggugcagugggccaggcaugggagaugagugugagccacacccugaagggcugugcccccagggcucugcugcacucaccccaacucuggucuuagagaagccaggacagggcauccaggucucuaacccagcucagagagggcaggacauagaagagagggagcucccucugucccuggagguccucaaggaagaagccaaggugggaggggcccuuggggggugcccuggggcucccuuccaucucugcagcacccaccuccgaugccucaagcccaggagggugggaguggucagagcagcugcuugcccuuccugccuucccagccccugggccagcgugggagguagacagccacccaucauccuucuccagccccagaugccuguggggcugguuugcuggggaucuaaauaccuuguugaggggugucccugggacuggggauuucccuggaucugucauucugaagacacccagguagugggguaggggcucucugagccugggauguccagggugguggcaucucuaguaccaucauucccaaacacccagggauggaugaagcaaacgcaacugcaggguuggugaggcugccagguucugggccuugucccugcaaugugcuucuaaggggaagggcccucagcauuggaauuuagguggggaagcugggggcugcucccuggugccaauuucccugcugauggggacaugggaaacucccuggugcugcugcacagcuggcucuuggggcguagggauguccaguaaccacaagcaggaccccacugcaaguacaaggguaacuuuauugacccccagcugggcacugcuuggccccuacaucauuaccccccuauuuuggcuguugcccccauggcacugccugucaacuucuacaaccuggugaugucuggcaucaaccccucccaaagauggaggggauucucuugcgagugaugguggcagcuguuucagggggcacagggcuaaggcugagacgugucaccucaacugaagcagaagagguggauuauggcauuggccacgaagaaaaggaaaaugccuccgcuuauguugcuggaugcugaggggcugcugguuuggcuggugucguuuuguccugagaguccaguuuguaucuguaggaggagaagugggauaagaucaggggacuuuuuuuuuuuuuuuuagagguggagucucacucugucacccaggcuggacugcagugaugcgaucucggcucacugcauccuccaccucccggguucaagugauucuccugccucagccuccugaguagcugggacuauaggcacgugccaccacgcccggcuaauuuuucuauuuuuaguagagacgggguuucaccauguuggucaggcuggucucgaacuccugaccuggugauccacccgccucggccucccaaaguacugggauuacaggugugagccaucguacccagcccucaggggacuuuugaauagcguguuuguuauuuaaagaugcaguccccuuucuacccuccccgcccuccauccgcccaccuccauaaaacaguccucaguucugccccaugugaccacuacuucuuccacaagguccugucaggauguuugacugcuuccugcuuugacacaggcagggacagaggugaucacugccccuguccacccccuuucacagaaacuuucuguuuuuuugagauagaguuucgcucuuuugcccaggcuggagugaaguggcaugaucucgggucacugcaaccuccaccccucaaccucccgaguagcugggauuauaggcagccgcuaucacgcccagcuaauuuuuuuuuuuuuuccgagacagagucuugcucugucgcccgcccaggcuggagugcaguggcgugaucucggcucacugcaagcuucacccccagguucacgccauucuccugccucagccucccgaguagcugggacuacaggcgcccgccaccacgccacgcccggcuaauuucuuuuuguauuuaugguagagacgagguuucaauguguuagccaggauggucucgaucuccugaccucaugauccacccgccucagccucccaaagugcugggauuacagacgcgagccagcgcgcccggcucgcccagcuaauuuuuguauuuuuaguagagacgggauuuugucauguuggccaggcuggucuugaacuccugaccucaggugauccgccugccucggccucccaaagugcugggauuauaggcgugagccaccgugcccggucacagaaccuuucuuuucaccuuuccccagcgaccagcccuucuggcauagagggagacaggggagcccuggcccuugaccuuccuagccuggcaaagggcuuagcuucccugagccucaguuucaucuucugaguggggagaaguucaucacaguugugaaggucacaugagccagggcugagugagaaagcacuuggcaaagcguggguggcuggaugugggguggggaaguggccagauggugaucgagcuguccuuaaugcuugauggagcugcaacuagaacuguucuugauggagauuaagcugguuuugauggugaucaagcuguucuugaucaagaacuugauggcuccggucugcuguacugacuccccucugggcaccugggaugcuaccaaagcugccuccuggaauagcagucgcuuuugagacuccaguuguuucugaaaugggagaguccugucuucuuugcauuccugaacauccaggcuucucucuggcaggggaguggggguuagaguguccccugucaccuccauaaccacagcaggcuccacuuggacaucuccuggccucuccccaaaggaccaucuccccagacucccugugggccgaugccuuccucacucaggguugucuucccaagucucuuaguucucuauuauuccacaacaccccuugggugccccaacgcgccuagcacccuguaagugcuccccagcuguggauacagguuucucucagggcagcccgcaagcagugcagccccagccagaagagcuggaaggcugggcggccaggcccgcuguguccccaguuuuccuguuggaguccaucugcugugcucucaggagagaaggcugggucucugggagcucacauccuguaugcccucccuccaugccaagcaacuuuggggaguccuggcaguggugccaggcguugcucuuaccuguaccauaaccaggaggcugauggugaguaggaggaagaggaagcgcuucauuuugguaggaucuucguggcugucuugguagcagcuuuuuaggugaucucagggcugucuggaggcuucuuuugguuuagcugcuuuugaaccaggaggcagag

SEQ ID NO: 14163 - RNA, 24385 nt, Homo sapiens
ccuggucgccuaggaaaccgcgugacaacaagauggcggcgcugcgggacggcuagcggcccugcguggugagucuggcuuaagaccuuucugccccuggaguccccacgcaggcuggagcccgagccccgagggccugcgagcuccgcggcucccacaggagagguucaagacccugcuuaccaugacuacgcguggaggcggaaggaggcgacacggccuccagggcuggguuagaucgugauagacgucgcucccugagcgcguccugggggcauuagggaguccuggcagcgggccggaccguguccccgccagagcucugggcucuggggaugacggagaggccgaggaggugugaagaagaauguugugagucaagcacagcacugaguuugguuccaaagauguagaggcauggugcagagauuugcucucagagccaggucugaagugggugacaacucugccuuaaggaccuuuuggccugagggguagucacaguccugcccuuggaagccccaaagugaaggaguuaggcgacuguccucagggcucccuaaucugaaggagaaagagauaugccccugcccucaggaguccccccaaacggacagggaaaugcagccuuugccuucaggggcccuuguaaucugggagaagauuaaccuggagacaaugugucggacuggacuggagugacacuggaaguagggaagucaguugggagccaugugacagcccccagaaugggcagugagagucccacuaggacggccgacgguggccauggaaaggggcagcuauaugugagagaguuuagccugcaggguuugauguaagaggcaagauggcguaagagggaaggaaggagagaaaaaaugugguugggugauggggucccauuaagaagggggaagugggaggaagugaguuugacgaaaauguuggauuugguuuaggaguuuuguuuuuuuuucccaugacagcuuuauugagauauaauucacguauuacauacuucacuccuuuaaaguguaaauuucaauuuuuaguauauuuuaguauauauuccauuuauaugaaaugugcagugugggcaagucuauagaacagaaaguagauuugugguugccuaaggcugccuuggaaaaggggugggggcuggaggguaaauugggggugacugccaaaggguacaggguuuguuuaggcugacgaaaauguucuaaaauugugaugguaguacagcucugugaauauacuaaaaagaaaauuacacuguaagaaggugaaauaugugaauuauaucucaaagcuguuuuaugaaaaagguugcauacuguauaauuccauuuguguaacuuuuuugaaguaagaaaauuauagagaugggccaggugggguggcucacgccgguaauccuagcacuuugggaggcugaggcaggagaauugcuugaaccugggaggcggagguugcagugagccgagauugcgccauugcucuccagccugggcgacagagcgagacuccaucucaaaaaacaaaacaaaaaaaguauugaggggagcugggugaaggauacaaaggaucuuucuguacuauuuuccuaauuuccugugaaucuauaauaauuuucaaauaaaaagcuaaaauauaagugaaaaacaaacugaaggggaaaaaaaagaguuagcuggccaagggaagggugcagguaggaguggggagaccguucugggaguggggggauugagguugaggcaggggggauacacaugcauuugaggcauugcuagaaguugagguggcucaagugugggaggcggcaagaugggagaugaggucaggagacauaagcagggaccaggucaccuauaucaaggaauuaugaauuuuuuuuugagauggagucuugcucugucacccaggcuggagugcaauggcgcaaucucugcucacugcaaccuccgccuccuggguucaagcaauucuucugccucggccucccaaguagcugggauuacaggugccugccaccaagcccggcuaauuuuuguauuuuuaguagagaugggguuuugccacguuggucaggcuggucuugaacuccugaccuuaggugauccacccuccucggccucccaaaguguugggauuauagguguaagccaccgugccuggccagaauuuugaauuuuuuucugugggugagaagugcugggauuauaggcaugagccaccgcucccggccugcuuuauguuuuaagaucucucugguagcacaugggaacuaaugaagggagccuuggccauacaacccgugaggcugcccagacagggcaggggcuggggcaggguggggacagauuugggaggcuggaugcugggggugaagaaacucugggccugauccuugaggagggcuccuuccaaggaaggggcagggcaugauucucaaacucugcagugaaggcauuggaggcugccuccaggcagcauagauucccuugcugacugacuucagaaguaggguugaggccagaaccagacaucuucaaaguggaacuucuuggauuuguccuaaaaaauuugguccaggcugggugcaguggcucaugccuguaaucccagcacuuugggaggucgaggggggcggaucaccugaggucauuuacugaauagaguaguagccuucgauuauguccuucaggugcacuccuuuuuccagaaggaagaggaaaggaaaggaaacuaacauuuacgagugcuuccuauguggcagcaacagcaaaaacaacagcagccccaacucacauuuuucagugcuuccuuugagcuuggcgcugggcuagaccuucucuguuaucucugaaucugcucagaacccugccugugccaguacuauuacgacccccauuuuauacuaaaagaaacugaggguggguuacuccagugaguggcaaaaccuggcaucuuaaccuuggugucacauggacugugucuuuuuuuuuuuuuuuuuuuuugagauggaguuucgcucuuguugcccagguugguuggagugcaauggugcagucucaucucauugcauccuccccaccuccuggguucaagcgauucucgugccucagacucccaaguagcugggacuacaggagcacgccaccacgcccagcuaauuuuuguguuuuuaguagagacaggguuucaccaugucggacagcugaucucgaaccacugaccucaggcgauccacccaccucggccugugucuugauugaauccugccuguggguuggccucucuggcucugagauguugggaguggcaccugguuucuggugggagggaaggagauacuugggcuuugugucacccagcuggcugauggacggacagccuccuggguaguagcauuuucaggcucuaaguuugggaaaguuccaggcuucugacucauuucugcaucccaucccacccucacaguacuuucccaagcaccaccaggccaaaggucucucaguucagagcagaaagccguauacccagaggagcaggcagauaacagaaacuuccagaaaccucuguggagacaguggaagaggcaaaagguacugcugccuagacagcgcuucccauuaggaagaguagccagggaaguggaaacuucaggcuacccccugggcuuggagcccugagucuguccccaggggcugacuuccugcauuccucuagggaguuccugacagcuggauucuagaaguagaacuaugagcucaccuuuggccucccuuagcaagacccgaaaagugccccugcccucggagccuaugaauccuggguaaggagccagccucaggggucuuucuguccccgccucuguauccucuucuauccuuccauggccagaggacagugacuccuagugucuuggggaauacaaagaagggccacauagccuucccugaccacugucuuuuucuuuauaccuucuucuggggcacccaacuuuggaucugagcauaaacuggguugugcuuuuaguaagguaugggcccuguaggaguggcuuggcaucccaucuguucauucacuguucauugauuaauucugcaaacacagauggucuacggaccuauccugggccaggcccugugugggguucaguaaagggaaucuuuuacaucugucuagcacuuucauguuuucaaaacauuuuuuaccucucuuccuucuugcucucuggaauaccacuuugagucuuuuuuuuuuuuuuuuuuuuuuuuuuuuuaaagaccaagucucgcucugucgcccaggcuguggauugcaguggcacgaucuuggcucacugcaaccugugccuccugaguucaagcgauucuccugccucagccucaguagcugggacuacaggcgcaugcuauaacaccuggcuaauuuuuuguauuuuuaguagagacggguuucacuguguuacccaggauggucucgaucuccugaccucgugaucugcccaccucggccucccaaagugcuggaauuaccagccaccgcgccuggccccacuuugagucauucuaaggccuagaagauucagagagguuaagcaacaggccucacagccuuugcagagcagagcuggggcugagcucaugggcuuugcaagccuuguagucuucccaccuaagacucugcucuucaccccuuccccauccuucuccacugggugaagucagacaccucgaagccugucccuugucucaccccaggcuggggcugggauuuggggcuggaaguccucaggaguuagaggcccugcuuccaucucuuugagcuuuggcugaaguccggugcccagagccuuaucccugguaucauuccaggggcccuaacuuauauuucuuccuucuuccugccuggguucccaggaggcgaggaauccgcaucuauggagaugguaagugugccccgcccucgugcccucuucgccucucaugugcuugcaccuccuacaguuggaccgauggagagaaaucacacgagaaaggcccuugucagcuggagcagcggccuccaccguguucugugcagcucccaugcuguccucccugagggcugggcuucccuccuggaagcucucagauuaggaggccccauacccuuggcacagauguugccacucacauuugaaccccuugacccacugugggacuggccagugugugccuagaaaccaagugagggccaagagauuacccagcccagggguuuggaucccagccccccuucccccuccagccuccuccagugugacagccuuucucccgggaggccuguccacacauugccacccugacucuuguagcucaggccuuuggaucccugccccccaacucuccaccauggcauuggcauuggccaugccagucccccugggagcaggacuggaagaacuccaaaacagccccauucugguuggauccuugcuccccagccuugugaauucucucuccucaaacucccuggggcacagugcauaggccgcgucacacuggcgagggcccagggccugaguuuccucugggucuccgccccagagcggugaccuaggcaucccugucugcagaagaugagguggacauguugagugauggguguggcucagaagaaaagaucucagucccuuccugcuauggcggcauaggugccccugugagucggcaaggugagagcagaggccugaagggucuggguccuggcugcaggagggggccccagagacggggcaaggccuagggaggcauggcccuuccucucgccuguuuggucugaggcagcugcuuccacuccuggcugauuguggcagggaccuggcuuggcauaaagccacacaagccccacccuuagcucaggaggccgaggcccagccccagccccagccccaggccaggcuguggcuauaguuaccaggugugauaucagugggcucaggauucagggucagagagggaugaagucugaggguagagcucagcuuccugcuucugcagggcucuggcaaggcccaaagucgccuagacagucugcuuagcuuggcagagggcuguggcaaugcugagcucauggaggcaccuaaagugggauggggcuaaucaggguggcuucccagaguggggauuuagcaggucugagaaaaggggagacaugggcaggcagggaugagcccugcagagugcugggcgggaucuggggaugcuggggauaagguuagaacuuuccacuagcucacuagcugugguaucuugagcaagcaacuucgcaucucucugucucugaggccuccucugugaagugggcaugggaacagcgagggcagcguguugggaggauucaaugagaugcuccucgguggagggccccuggccagcgccugucacgcgaggugcucagugugguggcugcccaucaggaggccagccauagggaagggccugaugauucucccucaggccccuuccauuuuaccggaggagggaauugagguggaaaaagagacaggaagagccuggccuaagguucugcggccauuucaccacaaagccaagaucuccuauacccuggcuggggucaacuuucuuuuuuauuuuauuuuuuuugagacaggguuuugcucugucauccaggcuggagugcaguggugcgaucauggcucacugcaaccucagccucccaggcacaaucaguccuccugccucagccucccaaagugcugggauuacaggcaugagccaccauacccagccaggucacuuucaguaguaaccauggcaaccagguucucucuuugaaagagcuccagguguccucucccugcuuuccccugucauccccuccucucccacucccagccaauaucugucccuaccaagguaacagaugaggacuugccuaucuuauuuuacuucucugccagcaguguccuauacuguccacugcuccuuccuucucaggaccuccaccaagcucuuaggcaccaagcugcugcccucccauuacccucugcuucuaggcucugucucuuagcugucaucaccaccuccuuuuuucucucagguuuuuuuuuuguuuuuuuuuuuuuuggagacugccuugcucuguugcccagccuggagugcagcggugcaaaucacuacuuacugcagccucgaccugucaggcucaagcaguccucccacuucagccucucaaguagcugggacuacagacacacaccaccaugccuggcuaauuuuuguauuuuuaguagagacaggguuucucuauguugcucaggcuggucucgaacuccuggucucaagugaucugcccgccucggccucccaaagugcugggauuacaggugcgagccacugcacccaggcccucagcuuuucaaugugauguuccucuggccuggauucuccucuguguccacugugccccagugagcucaccugcacuccauguguagacaguucccaaauguuugucaauuaagaugcauuuaacuauaagucaaagaaaacccuuccucagccaacaagaacauuaaggaaguuuuguuaucccacaugcaaagaaauccuaaagaggcagcuccagggguguuaauucagugacuccaagacaucaucaggggcucagguuucuccaucuuuccacugaaccugccuugacaugucagccucaugugguuguaggaugauggccgcgguuccugcuucauacauagaaaggacacugucuaggggaagaaaaggaaaaggccugcuucuuccuguagguuucucuucuuuuccauuuucauacuuuuuuuuuuuuuuuuuuuuuucugagacagagucccucacucuguuacccaggcuggagugcaguggugcgaucuuggcucacugcaaccuccgccuccuggguucaagcgauucucgaguagcugggauuacaggcaccugccaccacgcccggcugauuuuuguauuuuuaguagaggcaggguuucaccauguuggccaggcugguuuuggacuccuggccucaagugauccaccugccuuggccucccaaagugcugggauuacaggcaugagccaccgcaugcccggcccuggcuacuguuuucuacagcaccccgcauucuggcuuugucuggcaguuugcccgugggguauuugccucacuccucuaucugcuguuuugcguaccaacuggacacuagauuuggagguuugauuagaucgagggugaaauucuuggcaaugcuucagggugaugucacccauauguuacaccacuuccuuguauauguuggacaaauuacuugaucccuuugugucucaguuuccuaaaacaguucauuuaccuccuggguguguuucaaggauuacaggggguugaucuacaugaaguguuuagaacaguuccuaugaugccagugggagcugcucucaguaccuucauuuccauuccugggaccccuauccuccucccucccccccacaacucagccucggcucuaggucugggcucuaaagacuuugugugcuuggcagucccugcaucccaugacucggagcugauggccuucaugacgaggaaguugugggaccuggagcagcaggugaaggcccagacugaugagauacuguccaagguggggcuccaggugggagagggccaggggccggucugagagguggagggacugggcuggggaggccaggaguuggacuagggugggugauucuagaaccgucuaccacacugaccugcccaguucgaggaccagguguggccugggccugaucuagguccugugaccugagccgagaggcuggggggucuuccccucagcugagcaggacccaguagacccuggacuggguggcacaguggacugcugagcagagcgcggcacccucagauguggggguccucaggugugggccgcaccucucccuaccucagaggaacugcgaggguuaucugagguccgggagaaguggcugugccaaaggguggcaggggcuugcugcuccccagcauccaacauaggcaaagcucuggagcuuccugucugggcagggcucugggaaccacaggcccugugcucacccugugucuuaugcuacaggaucagaagauagcggcccuagaggaccuggugcagacccuccggccacacccagguagggggcucuuggagggcugaccugcgcccccagucaggcaccuccccugggcccagggcuccuggaagcuucacaauggcuucuggcaucaagagcaucaagcugacuacuugguggggucuggacagcugagcccacagaggggcugcagcauauccaggacagugcuggagucacuccaugcccuccuacaugggaccgagucccaucugaaguguggaggagaggaggcucugaggggaguggcagccuccuagggcccaucaaggcaccgccacggggucagaggagaggccagagagguggggggccaagaggcaguucuugggggauccccagaacagcuucuccagaugacccucagggcagaggugaccuggcagugucuugcuggggcagcugaagccugucccugucuuucccugaagccgaggcaacccugcagcggcaggaggaacuggagacgaugugugugcagcugcagcggcaggucagggagauggaggugagagagcugggccccgggggaugcgggcagccagcaguccccagcucuucacggcauguuccucaggagcuggguccgagcccaccucucugggccucuccucgucacaucccacccagggacccugcccugcauuucccuacccaggacuggcccagacuuuaaagagccagggaggugucuggggcuggggcacaccccugcuuuugggcccucugaacaugccucuccccugcuuagcagaccucauggcucccacugaacugaauucuacaguccucgcuguggccccugcgggcuggccccugcaugccucuucaucuuagcuugaaccacucuccccuccagccaugaggcccuuccucugggucuuugaccucauggagcugcuucccaccucagggccuugggccgugcuguugcuguucccucugcugaaauguuuccccaccucccccaggucaguuccacuguccucagucauaucccccgggccuccuaggcagguuuuccaucccgagcuuucucagugccucaucucucuucccuugugggacucugaacuccacgacggagggagcaguuuccuccuguaugucacugugcacccaggaccuagcacugaauugguuaagcaauuugcugccucuggcugugacuucugcucacuggggacucagugaccccagucaccuuucuuucccccgcucacagacccauucaaacagcaagggaacuagagggacaccaggcacagagaagggucccaggcacgcaugggcccugccagaaguucuuccugggauucagccucucucccucuccacgcagaauugguuuccaaagucccaaucuaauuuaaaaccuuggcagcaaaccuccaauugcagcugagagcccuucccacuccaagcuguucauaccugggguuguccccgagcaguggccacaggcggugagggcugcaccagagccucggggcaggggcaugacugcccuugcaugcgucuccgccacacaguuaucacuucauucauuuaacagccucaucuggaggaucugcuuggggcaggccuggggcagagcaugaccaagacagacauagucccccgccugcaugaggcugccagucuguggggaggggaacaaacgaguacacagguacacaaguacagagagugcugugacuugaugaaaugggugacaccacagaggcaaguugggggaccaccugcgggggugacauugggcaugaugucuggugagugaggaggggaauggggugagaggauccaggccuuagacagggaaggugccacuucccgccacauaacuuggcuugcggucgguggcuguguggaggaaggagaagaacgggaaaagagaagaggucgugggggccuuaucacauuggagccgcccgugguucuggcuggauccugucccgaaaaaaugggaagccauuggaaggcuucuguuugagagguggcaugacaaaaagaccacccugcuuugugggguuggguggugugggugaggagaggacgggggaagcaggcgccgccccuggauuguccaggagaaagaugacgguggcuugaacuagggugguggcagcagauggagcccaguggauggguuccaggcugcauuggagggggcaccacaggccuugugggucauccuggaggaaugggcgacagaggauucucagguggagggggugccauuucuggagacaggaaaaccuggcacgggggagguuugacagggggacaagagccacagccauuagacauccaaguguggacgguuggaaaugugagucuggagcucgggugaaaucugcauaaauacaaacuuggguucugucguauauauuugggagagcguguggauggagcugggcccccaugaguugguguuggauaggaaggggaaacggugaaggaaauuggaaaggaacagcccaggagaugggaggaaaacuagcagauggugaaagauagacagaaaugugcccaugcgcuuggcagcggguagguuggugguugcagcaccuugagcaguuucagagagguauggcgauggagccagguuagaguggcuugagaaaagaagucgggguguggacauguagacaguccagaaguuuccuguggcagaggggacaugcggccaagcccuagggaggcuggcacaugguucacaucccucagcccugccuccuucucacacuugggccaggccacgugauuucugcagccaaggaggcugaccuuaccgagcccucgcaugggcugggcgcugaccugagugaucuuacugagcccuccucacaagcuuauguggcaggaacugucacuccauuuuauuagaggagucgucugaggcucuagggacugagguggcuuuccaaggucacagccaggaaauggcaagaucccccuacucaucccuuugucuggucagcucugggggccccauugccugcagacugaggcugggcuuugggcugacacugccuuucccugggaaggggcugagcugacggugccccgcaucucccccuucuuucccacagcgguuccucagugacuauggccugcagugggugggcgagcccauggaccaggaggacucagagagcaagacagucucagagcauggcgagagggacuggaugacagccaagaaguucuggaagccagguagagcagggcgucugccccaggcccucuucaaaaggaauucuccaacaguuugcuguuggccggcagcuccccagaggccuaucucauucgugcccgggucccugacccaagacgcccugagagcccacaacuugccccugagacaaugugggagcagccuuggccuccaucacugaccacuuaaccugcuggcccacuucuccacgguccuaccucugcucucucuugcucaucugucagagacccagagauacaagagguagcaaggccuuauuugccucaggucacauagucuacaaaacgccaccaaucuggaagauguugccguuuuaaaaaaaggcaauccuucuguucuagaagcugcugccaaauucccagguuuggccucccucuccagguuugcuuauggcccuuggaauccaccugguucugugggccccuaccaugucuuuuuuuuuuuuuuuuuuuuuuuuuuuugagacggagucuugcucugucacccaggcuggagugcaguggcacgauuuggcucauugcaaccucugccucccagguucaagcaauucuccugccucagccuccugaguagcuaggauuacaagugugugccaacacacccagcuaauuuuuguauuuuuaguaaagacgggguuuuaccauguuggccaggcuggucuugaacuccugaccucgugaucugcccaccuuggccucccaaagugcugggauuacaggugugagccaccacgccuggccuaccaugucuuauuuuuaacuucuaauaucuagagggauuccucccacaguccccuccuauagacccacagauuuggguccauaaaacuggccauuucugaaaaccaggcccauucucuucaaagaauggagauugucacccaaaagaugcuucuccaggcucuagagucaggcacaccugggcccucaacucgacucuaccuccuaucccaagugugacuugggcagaugaccucuauucacuucaucaacaaaacaggaguguucuucccugggaguuacaaggagcaaaugaguuaaacgcagagcgccuagcucuggccuugcagccauuguuguuuccaaagucugagggcaggggucccacgggaauaggagcacagcuuccaaggggcccauuuggaagaugacgacaccuucuugguuuccugcuagguaaaaacccagauuccaaacaugagaauccugccuccuguuuaggccugggcucuggcuggauccccccagaucucagggucuaacgcccucacugcuuguucucaaaacaucacuucccauuuuugugccauuugcagcuuucuuuuuuuuuuugagauggagucuugcucuuguugcccaggcuagagugcaauggcacaaucucggcucacugcaaccucugccuccuggguucaagcgauucuccugccucagccuccugaguagcugggauuacaggcgcccaccaccaugcccggcugauuuuuguauuuuuaguagagacagcguuucgccauguuggucaggcuggucucaaacuccuaaccucgugaucuucccgccucggcaucccaaagugcugggauuacaggugugagccaccgcgcccagccauuugcagcuuucaaagcauuuucuuuuuucuuuucuuuauuuuucuuuuuauuuuuugaggcagggucucacuuuugccugggcugagugcaguggcacagucauggcucacugcagccucaaccuccugggcugaagugauccucccaccucagcugucugaguagcugggacugcaggcacgugccaccacacccagcugauuuucuuuauuuuuuguagagacgaggucucgcuacguugccaaggcuggucuugaacuccuggaugccagugauccugcugccucagccucccaaagugcugggauuacaguugugagccacugugcccugccagcaucuucauagccuugacaggggccaggaguuacuccauuucacagauggguaaagggaggcacuuaaggagucuguggacucauuauugagggaagaggggcaagacuuaaggcugacagcccacuguaaggcaguuggucacugaggcagaagaugagaugaugcccagcuugaggguggggauggugagaagggaugggcagagagauuuaaguagaauccguggccuuggugucuuuacaugagggagaggaccagaggagucagggauaacccgagggagcacagcugcgggaaagaugcugaguacacuugggacacagcaaagcugggggcugugcagucccuaugaugcuaggaaggggagcgugucccugcugcccagggcacuguaggcccaggcaugccaacuccaaagcucuaacugaacccagggugggugucguggggagaguucucaagggaccccuggcaugagugagaggugaggcccuauuggguggcugcaggugcucugagaaugucuauccuggaucuaggccagaggcccacaagugccgcacccugggcccugcuguggcgggcugggcucaggcuucagguaggccugccaucuuguugcagggcagccuuccuccuggccaggggggaccuccuugcuccuugccagguggcugguuucuggaccuggcucuguggauuccuacucugcccuguuugguuguuugugcucugagugccucaagucaaaguaacuugugaaaaacccugcccuccaucuuggaggcccuggccauaucuguggucccuccgugcguucucuuccuucuuuuguucuuugauuuuuucagcaugggcggggggccuugauucggcucuuucugccagaugaaugacguuuuucgucgcuagcagcuucuguuccugggacaucucuccggcguccccguuccucucuccccaggugccacccugcuccgcccaggggccucaggcucacagccuggcccccgcuggccugccugacacucggcugauugcucugcucucccucuguuggagaggcucccacaggcgcugggguggaggccuguggagggugagccagggccgucugugccgagccaguggggugaucaaacuuccuggagccugggacuccuagggaggagggccgguggggccaugaaggggcuuggccucaggcuggaucgcucacucucccccucucucugccagcgucacagagcaugcugugccaggugcuucagggucuguggagacaugaaagggacaguccugcucuggucacacgccacuggggccagguguugggccucggggcugagagcucuggucagcucugaaguucucccuucccccccacccucugcaucucugagcuccucacuccucacuacuucccuguuccccugagaauccucacccucucaucccccucugaaauccccacuuccccuacccaagucagucccugccucccuccauggcuccaccucucccugccagcaccccacacgccucccuccuuccucucaagccccacacuccugagucuggguuggaggcccccugacuccgcagccugcgugacuugccccugggcuugcccuucaaucccagagccaccuggcuugaccccuccccaccugcacuucugccuccagccuuugcuccugcucuguccccacagagcgccuugcccgcuucccuccccucugaagcucagggcaaauccaaccuccgccagcaaacucugacugcccugugugggcugugcugcucuguggggagggcucugcuugagggaaggggcuaaaagcucuggcugaggcaggguucaggucgggucagaccccagaucagcagaucgcugacccccucugaguucauuuccuccucagucgugcugacgggcuccuagggccacugaauggaugugguaauaaacugugacagccacugucaccuagcuguugucaugcaugucccagugcuuggcacaugggcaaggguguguguagcugcaugugauuggcugugaugcccgugugcccaggcuuggaugaucagagcacauuggaacagucaucugcacaugaugagguggggacaggguggugcguagcucaauggcaggggccagagagagcugcaggugggacccggcaggccugaguucagauccugccaguccacaggcugguugaguguucuggcggggaccagaccugcagggccuccuuuccugcacuggcuccucugaagagcagagugacugcaguaaaguccccagagcggggccuggcuugcaggugugugguaauagugguuccacuuccuguugcagccgucuuugccugagggucaagggcaggcacauggagggcggcaccgcgugagcugccggggugcccugggcacuugugcagugaggggcugccaccucuccacugagcaugguagggucuggcccucuucugggcuccacagcccccacagugauacuuacacaugccauugucgccauuugccgccccgucuucuucacuugagucugagccugaggauggcaggacccugggcgugggcaucgccaugaugggcagggccuagcagagcacgggugcucagacauuucuggaaagcaggauccaacccugcuuuuaguggcccagccacucugggccaggcccagggcucaaugcuccugagcucaaggggugcccagcauggcuggaaggcaaacaagcaagcagaaagcagcggccugugacgagggccaagggaguaggugcaagggcuccaggcaugcagccucaaggcagguuggggguggcuccuagcaaggcuucuuggaggagguaggggugagugggcacagcuugagcccagcgaugaguaggcggugcuagggacaacaacagccaccaucugccaaacgcuuccuccaagccucacagcagcccugugaaguguggaaacuuuuaucguccucauuguacagaagaggaagcugaggcccauagaggcccaggguuacagagcucggaagugcccuccagugcccaccagagcgcaaggcgaggggcauguugaggguuggcugggugcuaaguaagggucuugggaguugggacaaagagcuuggacuugagcucccuucucauuuuaauacacucgugggcucucaaaguuggaugaggccucagaggugaucucccagcauugccacucucccuggaaaagggaccccaguaagcagccucucaagaaccaauauugagaggcagccuaugugaucacugagcacugaggcugagucacuugggcccugcaagcugcaugaucuggggcgugacagcucauaaggcccaauuuccuuaucuguaaaacagaaauggugaugccugccuccuggcgcuuggcacagggcugucauuuacagacagguucaccagcuggaucuugcaggcaguacaggguucuuaccaucuccccauugcacagaaaggauggcuguggcucaaagaggaagugccuuuccauuugaguucugcugcuagcucagggcagaccuaggacuugcccucugaccuuacuccugcugugugacuccccagcugcaccucucuccauccacgggucaggccucaguugaacccuggugggguggugggggcucacuggcuucacaaggcccugcugugguagcucuucccaccucauucucucagugcugguuugcccagagcugugguuccuucuuccuggccccuggucucaucuccacucuaucauauccagcaucugccugggccaccugcuuuuacuucuuuaagccagggccauuuucuuggcaagcuucucucuuccccuucgucguuucuuggcauccucccuggucucaccccaucccaugucaaccacccauguucaucagccugaaaaacccccggcccugggaggcggcaggagcauugaauuaggaguugguguauuuggugcucuuccuggcucugucuggucugaucaggccaugucaucugaccuuucugggccucacuuuccccaucuauaaagaagacagagcccugguaacacagcgagaccccaucucuacaauuuuuuuuuaaauuaauuagcaggguguggugaugccugccugugguccaagcuacuugggaggcugaggugggaggauaaguugaacccgggaggucacgguugcaguaucaugacugugccgcuauacuccagcuugggugacagagggagacccuuucucggaaaaaaaaaaaaaaggguugaggcaggcauuguaugagaugaucuauucugcuauuguuuuuagguuugccuauuuguccuuaagguaguuguuaaaagaaaagugucuugguaucauucuguuaggcgaguuuuuccugggaaucucagggacuauguggggagcccccggaggggcugggggcagguauagccccuucaaugguaggaaauauaggggagaggagaaggccagcuggggccuaccauuucaccugcugcaaaagcaacaggaaacacaucugcaccucccugguacagccacugcaccacugagaggaaaggaauuagguccccagagcccugacccacauccugccgcagccugcuuguccuguugaaaaacagccucucugaggccccaaaaguuauugguguguuguagggcacacccaaacagaugacuuacuugggggccaggucccaucaaagaugacagaacaggccccuggucuguacccagccagcaucuaccugcccuccaccuuucugcucuguugucugucacggcuguccccaccgcuccguauucuccccugaagccagaacacagcuguaugcgccacacguguuucagaagaggaggccagagcuuugucagcuucucaaaggggucugugacccagaaauaguugcacaaccuaaggucugucccauaucuguucuggccagcagcugucccuacauccucccugagagccaucugucccucuucugaccucccucuccugauggugcagaugggugggggaaacagacuugagagucagccccggcucccuucccaguuccuccucucaccaaguggcuugggacgagucauuuuucaucucugugggccuguuuccucauguguaaaauggaacuaaauaaccccugccucagccuggcgugguggcucacaccuguaaucccagcacuuugggaugccaaggcgggcggaucaccugaggucaggaguucgagaccagccugaccaauaugaugaaaccccaucucuacuaaaaauacaaaaauuagccgggugugguggcucaugccuguaaucccagcuacucaggaggcugagauaggagaaucgcuugaacccaggaggcaagguugcggugauccaagauuguaccauugcacuccagccuggacaacaagagugaaacuccaucucaaauaaauaaaaauaauuaccccugccuuaagccucaggguuggcguaaggaccaugugugcaagguggaguugggcacaguagcaaacauggacagggugcguguuccaagcuggcucuuaacaugguuacuucuuggagccuuacagccauccuaggaggcagauacuacugucauccauucuagaagagaaugcugcagcacaagcauuaaaugaccuaaggucacacagauagaagggaggaacugggauuugaacccagaaggccucgauccagagcugggagcucugcccuguacuuuucagcugccaacccagugccugacacagaucugggaucagauccugcuucugcugcuuacuacuguguuucucacaagccauguaacuuucucuaacccucaguuuccucaucugaaaaaauggaggugauuauagccuuuauagauaggcuugauaagaagugggaauggaauauggauaguaaaccccuagcacaaaauaagugcucaauaaaagacagcugcuguuauuaucuagcguuguccuuuuccccaggcagucaguuaaggagacauuaagaccacugcccagcuugggagggagccacagaggcuagggcugcuagggacaugacagccaaaaggcggcucacaggugucuguccucuuugccaggggacucauuggcgcccccugagguggacuuugacaggcugcuggccagccugcaggaucuuagugagcuggugguagagggugacacccaagugacaccagugcccggcggggcacggcugcguacccucgagcccaucccgcugaagcucuaccggaauggcaucaugauguucgacgggcccuuccagcccuucuacgaucccuccacacagguaggagcgguguugggggggguggugcucuagugccccugcugcccacuguuaguuggggaugaugaagccagcucaccccaggcccagccugcccuccacggggcacccaggcccacacacgacuugcagaggccccucucccaaggccugggacucugaauguuuccagagugcggcacugggugacccuggaucuagggccugccauccagaccaguggcagggcagggugggcccaaggcccaggccacccccucacuuuuccucuucccuugcagcgcugccuccgagacauauuggauggcuucuuucccucagagcuccagcgacuguaccccaaugggguccccuuuaaggugauaagcugcuccucaaaccacaccuuuggggauuuugaagggaguggggauacacagccuccccagacaccucccauucugaggggaagccgcugcacucccugggggaccccagucugaugcccuccaggaggauaagucugaagccgggcugggaagggagcggagaggcccgaaacagagcagcaggcagcgcccucugcuggcacccuggagacagccucggcugcggggccccugccuucuaguccuccccagcuuucaggacaccuugacaaccuggggucccugcagaaguggcccggcugucccccaagucuccugaagcuaucuggguagggugggaggcagugcugugagccacaaaugcaaagcagaggggacagauguugggacucaaagacaugagguagagcuggccccauggguaggugccaccaccagagcccaugaggcuucguguucuagaaggugguggguuagugccgcacugagggcguguccgggagggagcaugugucaccagggcucaggaaacagcaugagucaugacgcggggguguuuaaggcauucgugccacagcggggaccucggagcuaugccuugauaaggcaagugagguuacauguacgaugaugcgguuugugcugcagacuggaaaaaagcaggggcuuuguccucuccugacccccucacacucugccuucacgguaggcuccugagaggggggucuccaaggagggugucaguacugcagcuucagcuggcguggauggggugcuuacaggagcagcagggcugagggagaugacagcaguacgaaccguggcucuccugaggccuggguuuccucauauguaaaauggggguugcauuagaccauacccuuggccuguguuuaggcaaauagggaugaaaguggggccaagggcugaagagcuggguccgcugccgucguugcccuucuuucuugccaggugagugacuugcgcaaucaggucuaccuggaggauggacuggaccccuucccaggcgagggccguguggugggcaggcagcugaugcacaaggccuuggacaggguggaggagcacccaggugaguuuggccuccaggcugagccagggggcugggggacugcagaacaaacuccaggggggcuccaccaccacucauaguccuuccugggccccgguucccaacucugccuguaggcuccaggaugacugcugagaaauuucugaacaggcuccccaaguuugugauccggcaaggcgaggugauugacauccggggccccaucagggacaccuugcaggugaggccaaugcuaacucccccagcccuccugggggaacuuuagcaccagcccugguccagccugccagaacagugucuugucagaaggcucaagcuugaggcaccugaugagucccucagagcuguugcuccacugucuccuggaaacugugaggcuggugagggcacgggcugggccccggaaagcagguggguuagcuguaagagggcuaaagucagaguccaggccaggggugagcccaaggcccaggccaccccaucaaggucuaggccaaaauauccaacucaguacuggguacucccuucgugguugccucagacucuccuuggcccucaucauucugucuccucgcucccuauucugcuucuccuccuagguguccaccugugaaaggcaccaaaccuuaguuucucaggccuccucugccucccucacccacacauugcuaaguccugucuggucuguccacccccagaacuucucccagaugcaucccuucuccacauucccaccacccaccacccuagucuaggguucagagugucucucccagacagcugccucccacugccacuccugccccugcugaccauccuccaggcugccuucccuguugaaauguuccagugguucuugagauaaagccagguuccuuaugcuggcacucaaggcccguccuauauugccaggccccuccucacaccaaccuuuuccuuccaguccaauugagccccagcuucagccacacauaaugcuggcaguugcccaaaugugucgccaccucuaggaagcuuucccugaacccaggaucuuuguugaugcugucuggaauaucccugcauccauuccauuucuaaggacucccauucauccuucagucacagcucaguugucauuuuccgagggaagccuucccugaccccaggcuggggugggcuuccagccugaucaucgucugugugggguucugucuccauuagacugaaacgggggguuaccuggggggaaccauggggcugccucccagaaccuucuuccccuuccauugccucuccucuggccuugguuuauacagaacacccccucccgcuuugcucacuggucucaucugucccuggucaaggaagugucccucuaagguuuguggggaugacucaaauggggccuagggcucuguccacccuccacugauaccuuccagaacugcugcccauugccugcccggauccaggagauugugguggagacgcccaccuuggccgcugagcgagagaggugagggcgggaugaggaggugagggccugggggcguugggucaccgcgugcugauggccucugggcugugcaggagccaggagucacccaacacgccggcacccccgcucuccaugcugcgcaucaagucugagaauggggaacaggccuuccuacugaugaugcagccugacaacaccauuggggacgugcgagcucugcuagcgcaggccaggugggugcagggcagggccagggccacagaggggcucuggucccacugcccagccugaucugcucugccugguccccagggucauggaugccucugccuuugagaucuucagcacauucccgcccacccucuaccaggacgauacacucacgcugcaggcugcaggccuugugcccaaagcagcacugcugcugcgggcacgccgagccccgaaguccagccugaaauucaguccuggucccugucccggucccggucccggccccagucccggucccggucccggccccagucccggucccggucccggccccagucccuguccuggacccagucccagcccccaauaaagcacccgcccccucaacccgcug

SEQ ID NO: 14164 - RNA, 1508 nt, Homo sapiens
cgagcgcgaugacuuggcgggcggagcaggaaggaaaccgcucccgagcacggcggcggcgucgucucccggcagugcagcugccgcuaccgccgcccucugcccgccggcccgucugucuacccccagcaugagcggccugcgcgucuacagcacgucggucaccggcucccgcgaaguaagugcgcgcccggacuggcgcugggggaaagcgcagggcuguaucccggugcuuuggacccuagcgcccgggacccacccccaggacgggggcgggguggggggagugcgucggcgaggugcugggcacggucucccggacccggucccgaggccccauccugaaugucuucaucgggcauccuggguccuuugcagccgcggcaugaacuucccgugcccaucccccaucaaccccacacccauucucugcacucccacuaccgggcugacccugaccacgaccgcagccugcccuccccuccccuccccacccugagccugaucccacuucccuucacucugacccccucccccguggcugauaaucccucucuucauccugcaccaccucaagccugacucauccucccaacuccuagaggccagaacccuccccuaguguggaggggaauggggggacaaaagcuccuggucacagccucucucacccugcccagcauuucccccauaaauccuccagccuauccacuaaccccuacccacccucuguccccagaucaagucccagcagagcgaggugacccgaauccuggaugggaagcgcauccaauaccagcuaguggacaucucccaggacaacgcccugagggaugagaugcgagccuuggcaggcaaccccaaggccaccccaccccagauugucaacggggaccaguacugugggguaugggcugggggacggggggguggggggaguguuggaagaggacucuagccagggucauaucugccacaaagcacuugggcccccugcauucaggugaccaccccucgccuccccuucuccaggacuaugagcucuucguggaggcuguggaacaaaacacgcugcaggaguuccugaagcuggcuugagucaagccuguccagaguuccccugcuggacuccaucaccacacuccccccagccuucaccuggccaugaaggaccuuuugaccaacucccugucauuccuaaccuaaccuuagagucccucccccaaugcaggccacuucuccucccuccucucuaaauguaguccccucuccuccaucuaaaggcaacauuccuuacccauuagucucagaaauugucuuaagcaacagccccaaaugcuggcugcccccagccaagcauuggggccgccauccugccuggcacuggcugaugggcaccucuguugguuccaucagccagagcucugccaaaggccccgcagucccucucccaggaggacccuagaggcaauuaaaugauguccuguuccauuggcacugugucuggu

SEQ ID NO: 14165 - RNA, 2191 nt, Homo sapiens
ggguuggaagucagaggcugaugggagcaggucagauuucccgugcagccugaauggagucacagggacaugucccugccuuggauccaggagguggaggugaggcuggaaugaggagugaaggagagaaguguuuuccccagggccuucccagggcagaccucaaccugcacccuuccccaccagcugcccuguccuaccagcccagucuccaggacuguccccaccaccuuuccgugcaaagugcauuuccccaucuacaaaguggaaguuucucauugugugccccccgggaaugggguaggagaucaccauuagccuucaaagagcuggggagagguggacaugagucggagcccucauuagccaugggucaucccccaccauccuggcaggcuuggagcucggguacagagcccaggccaacgggcugcacgaagggucugccacccacccucuggccaagagcacucaccccaguccccacaggggggcagauuuccaauucgaauauggaaguaaaguuacauguagacucauucuuagaaaaauugacuuuauuugguuggaaaguagcccucauguaaaauaaagaacaccuguacagaccugguuugggggagaacugccaaggaacuggaggggcagggcuguggccccagagguuggaggauuuggggggagaguuucuucuuuggcaagggagaggguggcacaaagcccaggcagaggggucagcucggggugagaccaugacuagcaguacuacuucccacccugaacagaauccagggaugcucuguccuggacacgucagaagcugggguugagguggcccucgggucaaaggucaggagcuagagugcuggccagggucagaggucaggaggucggaggcugcucucugaggucagggggcagagaugggagugcucuucagggucagagggcagggaguggggggacuguucuguggagucagaggucaagaugugggagcugccuucagccugugccacuccccaggcccccaggcccucugaguacagcucccgguucugcuccuuccacuggcggaacuucucuccugucagcucagggucacccagcacuucuucuaggaccugcagcuccugcagcuuugccuguguggagaggaggggcuaagggaccaugaucacccagggaagugggcagagcccgaggccagacuucacuccggagguccggugccuggaagccagcaccuggccagcguggcacgaggagccuaggugagacucaaauccccacucggaacccagagccuggcccaguccacagcugagcccgcugucagcugcuaagcccaggguccggagcugagucuggagucuggagucuggugcccaggguggaggugacagccgcaaaccaaagccugaagcccagagccuagucccuugcugugcccagagccccccagcugaccuugagugugcucuguagcgcccgcacacggugcacucgcucauugagcugagggucucgguugcgccgcaugaaagagcuccgccacuguuccugggucaggggcuguggcuggccuaggagggacacgccacccugccucagcccccguaccauuccuuccagugccucuucacugcugucugugggagggaagagcaggaugaggaugugcccaccccagcccccagcccagcucccaacuccagcccagcaccugucagagagccaaaggagguccgugggcugcgcuguguggggguggcugcaggugaugugucuccauggaggggacucccagcuugagcagggcugggcugcaggcaggguggaaagcacagaggguuucugucugagcuccacgcccuguuguuuauccccaccuccuacccccggcagccccccacucaccgaggcugagugggacccagccucaucguccggguccucugcuucggucucacuguagcagucuggggugaggagcagcaguggguuuuugggaggccagggaguggccuagggcauuugaguuccuagcccccaucccaggaaaggcacaggcucaggugaggguuccucccacucaacccugcgagacaccuaccuuccucucggggugggggggcccggccuggagacugguacuuggagaugcagguaaugagaugacgcacccacc

SEQ ID NO: 14166 - RNA, 3336 nt, Homo sapiens
aguccuugcuguccacuccugcccucagucuggaccugcccaaggaccccugcaauuaggccucccaugcagaggugaguguacccugagcccagggcugggguaagaaggaacccaggggccugagggcagggagacuggugccaaacuagugagccuaaaagauggcccaugcccagagcagaagccuugggcagaguugagaccacaaguuucaggacugggagaaggcaggcaaaggaauggagggcccgaggcugccugccaggcuucuagggcgggaugucugagguccggccuccaggcuagcccagaaggcagggaagaggcuguggaugacagacuauuuugguccuugugauuaggaacuuuuuauagucucccugcucagggcuggggagaagaggagaggacagagggcacccauggggucagacaagcagugccuuccugggaccuuggaaucugacccacugccaaggagacucccugggagacagggagggggacacugccagacucuccuugguucccaggccucaacuaccuaugagcagacugacuacacacuagaugcugggugcaggggugggcuggaccuggcagggucucugccccaaggccucucacagacuccuuccccacuucccuggcuaauucuguuccuuuguuguccccagauccaaggucccucagccuccaggacucagggggaguaggggaagauagggguggggucgggugugcagggccauguggguggcccauucuguuacugccaagagaacugucagcucuugauuuacaaccccuccucgcuccuugccccagcagaagggagguggaaaagggucaugaggucuuaggauaaaaaagggacaaggacccugggggcaaauuucugggagugggagcgcagguuauuaggaagaauuaguggaaggaacuuuuuagugaggcaaggggcccauuucuaacggaaauugcuugguuuuauagcagcgggaauacacgcaaaauaucagugaguucuuuuuuuuuuucuuuuuuuuuuuuugagacggagucucgcucuguugcccaggcuggagugcaguggugcgcgaucucggcucacugcaaccuccgccucccagcuucaagcgauucuccugccucagcuucccaaguagcugggauuacaggugugcgccaccccgccuggcuaauuuuuguauuuucaguagagaugggguuuugccauguuggccaggcuggucuggaacuccucaccuaagguaauucacccaccucggccucccaaagugcugggauuacaggcaugagccaucgcgccuggccucagugggaaguucugauaggcaagugagagauccaaucugaacugcaaggcaagaaaccugggugacaaagcaagacuccgucuaaagaaaaaaaaaaaagaaaccuggguuccaguccuggcuccuaacucucaauaggaccugagcaagccccccuccucuccaagccaguuuccucuucaugaaauggaaaugcaaagguuaaacaaggugauguuuacaguuuggcauucugcgauccccuuggcaggggcagaguagcuggcaguagcugauagggccuggggaccaccucccucuccugccccgauggcccugcugggccugggcagggcaguuggcugcaauuacuggaggcuccuacccugugguuauauccccgaccucgguguuugggggcgggaagggugggcccugcuggagccagccuguggcugggagccuucuugucuugggcucaaagcugcuggguugggaagagguauuuuuuccgguugaagccacuuucaggaauugggccgggaccagcccuguuuccuuuuccaaguguccugcuugcuaaggccugcuugcacgacccuguggccagauuggggcaccuucaaaggggaauauguuucugaguggccagagagaccccacucaaugucucugaaggacagggaaaggggauggccugagccucugcucccuggauguggcaccggcuaaccuggaugggagaggguggcugacugauccuauacugaggaaugccggcaggagaggaccaggggcauuuccuacccuuccccugaccuuccucucucccugcaggucagugagagcccaagccaauugcucuaggccccguggcuggcuacuuauggggcacuguccugaccagcucugcuaagaugcuccuggccccucccuccaccccguccagaggacggacccccagcgccguggagaggcuggaagccgacaaagccaaguaugucaagacgcaccaggugauagcuaggcgacaggagccagcccugcgugggaguccugggccgcucacgccgcaccccugcaacgagcuggggcccccugcaucgcccaggacgcccaggccgguccgccggggaagcggcaggcggcugccgaggccugauucccucaucuucuaccgccagaagcgggacugcaaggcuucggugaacaaagagaacgccaagggccagggucuggugcggcgccucuuucugggugccccgcgggacgcugccccgagcagcccggccuccacagagcgaccugcggcuucaggggguugggcugcgccccaggaugccccggaagcggcgggaaagcgggcgcugugucccacgugcucgcugccccugucggagaaggagcgcuucuucaacuacugcggccuggagcgcgcgcugguggaggugcugggcgcagagcgcuucuccccgcagagcuggggagccgacgccagcccgcaggccggaacuucgccgccgcccggcuccggggacgccagcgacuggacauccagcgacaggggcguggacagcccgggcggcgcgggcggcggcggcggcucggaggcagcgggcucggcgcgggaccggcgccccccggugucggugguggagcgcaacgcgcgcgucauccaguggcuguacggcugccagcgcgcccgcggaccgccgcgcgaguccgaggugugaccgccgcggcuccggacuggccccgggacuggccccgggcacggaaaaggacaccccucuucuggcgcgcugggugccuuugcguaagcccuuccuucuggaacucaguuucgcgucugaaccuuggggagguggaacaaguugcugccgaaggcccuucccugcucccgcggcgaagggggagggagaggccucuuggucccuguggagacccggucuggggagucacgauuggggugggagaugagcaaaccugcugaauaaaguuaaaacguuauuua

SEQ ID NO: 14167 - RNA, 2191 nt, Homo sapiens
agaauuccaaaaccuaccuuagacaacccuugcuucaaguccccaucuuaauggaagugcucucugccaucuaaccuggcucccuccugcugcugcagcugaggccuaagucuaccaggacuaccugguucucccaucucaguccugccuucuacccucguuuuugggcuugcgucuauuccagcccccucccauccagcccccaaggcaaaagguucacuuacugcccagguccagggucuugcucacagcgcccaucccaggggcaggcagaggagccagugucugcugugcgccacccaccccucuccucuuccagggcuagcagggcuaccccgggcugggggcuguguugccgcagcuggccaggagccccaccucgcaacgggugggcuucagggagaaaagggagggccacaucaaagccgggccggaaggaguccaccguggggcuggccucagccaccauagccugucccagcuggaagguccuggggcagggagccggguggagacggaggaccagaugguuccugccccuguuccauugcagaggcauugagcugcacucuccagucugggcguccaggcugaggaggaggaggaggcaggccccagcagggcugaauguguagaagcgagagcccucaauggaagccaggauccugcgaugagucucagagaugguuccaaccgcuggguacacgaauaccuuaaggccaucgccccugcacuuugagguaucaaagcaagauucccaguugcagcugccaccaugaggggcuugaggaggugaaacggcaucuucugggagcucuccaggcugggagaagcucugcaggagcucugcauccagccagcggggccagccuugggaagccccgggccgaggucugggaggcaaugccaggcggagaagggagaagccucccagcaggacaagcaggagccaggaggcugacagugccagccacagggacuuucuucuccuccacgacugcauguggccacccacagucagggcuagggaagcugggaggccucugccagcaagcaggaagagcagggccuggggcgggagaccagagcugggaccgaccugcuaguccugugcugucauuguacagaugggaagacugaggcccaucgagaccaggccgccugucuaaggucagauagugagucaccagccaggcaggaggaggccaggugggacccagcuugcuggccuggccccccugcucucaggacucugccuucucggccuuuggacaaccaagccagccuuuucccucccagcagggaccccugccccugggcacugcucuggcugacgcaaccccuguccagaaugcagggccgugucccccugcccuccuggcugcaccccuugaccuugcccucaacugagaggagggcugucugccaggccauggggaccagucagagcucccacaggaggcggcuuggccagggacaggcuggagggagcugggcuggucuucccacuccuccccuugccugagcagcccuggcugccccugugcccgcuggcagacgcuucugggcuguggccccuguggcuggagcuaaaauuagacccugcaucccauguggaucaucggcgucagcugaggucacagccugggugcagccggugucccccugccuuggagggccaggagggcucgggguccugauccuuauccacucugccgcugcaccagcucaggaagugcagccccucuuccccgcagcccagcagcugccuugcaccaucuggcuuggagcuaucacagugcagaggccagggccgcugugccaagccccccaaacccuaugguaucuccucccaucccucuccagucggcaacuggcccauccugaucucuuuccuuagcagcagccuggcuccuccccucccagcccugauucgcuccuggcugggaggcagggucuccauuuaaccccuuccaaaccaguuuccucaauugcuaauccaaccagcaaguacugcaacucacagcuggccaugaguuaucacagccucugucucucaguccuccagccacccuccaaggcagagauuuaccugucauuucuuacagaugaggaaagcucagagaggggaugaacucuuccuaaggugacccagcuaagaaguggcaggguggggauuucaauccugagc

SEQ ID NO: 14168 - RNA, 2191 nt, Homo sapiens
gcucaggauugaaauccccacccugccacuucuuagcugggucaccuuaggaagaguucauccccucucugagcuuuccucaucuguaagaaaugacagguaaaucucugccuuggaggguggcuggaggacugagagacagaggcugugauaacucauggccagcugugaguugcaguacuugcugguuggauuagcaauugaggaaacugguuuggaagggguuaaauggagacccugccucccagccaggagcgaaucagggcugggaggggaggagccaggcugcugcuaaggaaagagaucaggaugggccaguugccgacuggagagggaugggaggagauaccauaggguuuggggggcuuggcacagcggcccuggccucugcacugugauagcuccaagccagauggugcaaggcagcugcugggcugcggggaagaggggcugcacuuccugagcuggugcagcggcagaguggauaaggaucaggaccccgagcccuccuggcccuccaaggcagggggacaccggcugcacccaggcugugaccucagcugacgccgaugauccacaugggaugcagggucuaauuuuagcuccagccacaggggccacagcccagaagcgucugccagcgggcacaggggcagccagggcugcucaggcaaggggaggagugggaagaccagcccagcucccuccagccugucccuggccaagccgccuccugugggagcucugacugguccccauggccuggcagacagcccuccucucaguugagggcaaggucaaggggugcagccaggagggcagggggacacggcccugcauucuggacagggguugcgucagccagagcagugcccaggggcaggggucccugcugggagggaaaaggcuggcuugguuguccaaaggccgagaaggcagaguccugagagcaggggggccaggccagcaagcugggucccaccuggccuccuccugccuggcuggugacucacuaucugaccuuagacaggcggccuggucucgaugggccucagucuucccaucuguacaaugacagcacaggacuagcaggucggucccagcucuggucucccgccccaggcccugcucuuccugcuugcuggcagaggccucccagcuucccuagcccugacuguggguggccacaugcagucguggaggagaagaaagucccuguggcuggcacugucagccuccuggcuccugcuuguccugcugggaggcuucucccuucuccgccuggcauugccucccagaccucggcccggggcuucccaaggcuggccccgcuggcuggaugcagagcuccugcagagcuucucccagccuggagagcucccagaagaugccguuucaccuccucaagccccucaugguggcagcugcaacugggaaucuugcuuugauaccucaaagugcaggggcgauggccuuaagguauucguguacccagcgguuggaaccaucucugagacucaucgcaggauccuggcuuccauugagggcucucgcuucuacacauucagcccugcuggggccugccuccuccuccuccucagccuggacgcccagacuggagagugcagcucaaugccucugcaauggaacaggggcaggaaccaucugguccuccgucuccacccggcucccugccccaggaccuuccagcugggacaggcuaugguggcugaggccagccccacgguggacuccuuccggcccggcuuugauguggcccucccuuuucucccugaagcccacccguugcgagguggggcuccuggccagcugcggcaacacagcccccagcccgggguagcccugcuagcccuggaagaggagagggguggguggcgcacagcagacacuggcuccucugccugccccugggaugggcgcugugagcaagacccuggaccugggcaguaagugaaccuuuugccuugggggcuggaugggagggggcuggaauagacgcaagcccaaaaacgaggguagaaggcaggacugagaugggagaaccagguaguccugguagacuuaggccucagcugcagcagcaggagggagccagguuagauggcagagagcacuuccauuaagauggggacuugaagcaaggguugucuaagguagguuuuggaauucu

SEQ ID NO: 14169 - RNA, 4304 nt, Homo sapiens
gauccuuggagacaaagcuucucuccuuuuccugauacaacuuuuauaugggagguuuacaggaacaucaggaaggcaguugaauuaguccauucucaagcugcuuauaaagacauacccaagacuggguaauuuauaaaguaaaagagguuuaauggacucaguuccauguggcuggggaggccucacaaucaugguggaaggugaaagacguaucuuacguggcagagaacaagaaagaaaaugagagccaagugagaggggucuccccuuauaaaaccaucagaucucaugagacuuauucacuaccaugagaacaguaugggggaacugcccccaugguucaauuaucuccacccaggcccucccaaaacacgugagaauuaugggaacuacaauucaagaugagauuuggguggggacacagccaaccauaucagcagugaagggggccccagcgucagauaaagagguaggaaugcuccaccaacugcugccaucucuccugugaccuugagcaggucacuguaccugugucugggguccuugucagcuauagggagucauguucccuucccugccuaccuucuggugaugaugugaaucaaaugaaacaagcaauaucagaaacagcuugagaaugucaaaaguacaauacaaacccaaagcaugauucugaacaucuucauacaaaaaugagagcugguggcccucagguugcuucuuucauuucuuucauucauucacgcaaugcuaaaaaaauguugaauacauucccugcgccagacucugcauuagguaguggggacacaagggaguccccaagcuuugaggaauucaaagggaggagagacagauucaaaccaauaauuaugacacauagaugggaggccuuuuauuuuuguuuuguuuugagacagggucucccucugucacccaggcucgaucgcaguggcgcaaucauaacucacugcagccuugaccuuccaggcuuaagugauccucucaccccagucucccaaucagcugggaccaugggugucuaccaccacacuuggcuaauuuuuuuuuuuuuuuuuuuuuaguuuuuuguagagauggggucucccuguguugcugagauuggucucaaacuccugggcucagggcucaagcaauccucccgccucagccucugaguagcuaggaagaaugcaggcuugcaccacugcauccaacuaauuuuuaaauaucuuauagaaacagggucucacucuguugcccaggcuuguccugagcuccuggccucagcgaucuucccaccuuggccucccgaaguguugggacugcaggcauaagccacugcacccagcuggugugaggccuuuuaaagaggugaccacagccagggagcccugcauugaggugcccacagaugcuguggaaugugggguuggggggcagugagcaacaguuggagccagagaagaccccacaagaggaggaugaguagggggcugauggaaaggggagggagaagggaaagggcagaggaaacaucaggcacaauggccuugugagucauuuagcacagcuggggcacaggcuacuugaaggaaguuugauagccuuuccuuccuuccuuccuucuuuccuuucuucuuuuuuuuuugagagagucgcucugucacccaggauggggugcaguggcacaaucuuagcucacugcaaccucugccuccuggguucaagcaauuauccugccucagccuuccaaguagcugggauuacaggugcccaccaccacgccuggcuaauuuuuguauuuuuaguuggccaggcuggucuugaacucccgaucucaagugaucugcccgccucggacucccaaagugcugggauuacaagcgugagccacugugcccggccaugauggcuauuucuuauugugggaacggaggcugcuggucauccuggaguucuuuuugggacauguuuagguguguacaucuguguguacugguuugccucucugggcugcaaggaagaagcccacguaaaugaucucagcaauagagcuuugcugugaggccccacgggaagcaagauuuuuaggaaaugaucucagcugcuagcuggacgugugcugggaccuuaggcuuccaacucagugcagugcaguccagguuuugacccgaguuccagggucccaccuucucugugagcaccugguguugguuauuggugguuccugagagcagaaggguccaguugcauugguuugcugcugacugguguaacucuccccaucaggcagggcuucagccuagccaccauggcaggaguugguuuccacuggguccagcauauaccaggccaccugucccagguccaagcaggacuaguuuuaaucauaaugcacuacaaccuuauaugaagagaacucuggaucuugaccugguuccuccuacggagagcucuguagauuucucucuuggagagauggcugaggagaacccuuuagagaucacagucccauuuacucacuucacagagugggauaggaaggcccagaaaaggcaguagacuugcucaaaccuguacggcaaguucacugcagggccaggccuagaacaggucuccugacuccagucaaauuuuuugguuggugcauaaaugugcuucugugcuguugacauguucaugaacccauguacuguguacaaggcagugggccauguccugagaauggacaggccacauaaucccuguccuccagaauguuauaacggggguaucagagcacacauagaaaaagauagcuguucaauuugcaguggcccugggggaagccaauacaguuaggcaaauuauaccagguccagggaaaaaaucugugagacucugccugccagacccucgaugaccuucuaagaaaggugauuuuugugauuuuuuuuuuugccuauguugccuaggcuggagcguaguggcuauucacaggugugauggugaugcaugacagccuggaacuccugggcucacgcgauccucccaacucagcuucccgagucgcugggacuacaugcauuugucucugcacucaccuaagauuuuuuguuuuggucugguuagaaccagacaagccacagcaggacuucuggacccagccauaggccagcggacagcagggagaagccugaggaaauggaaagggguaagacuggggacuucguugcaugugacugauucccuaagccaucugcucuuacaaaucccuacuuagcagcccagagcagcuacagagagggacaggggucuuugaaacacaaaucaccagugaugacaaggccacaggguaugaggcuguuuguucucuuccugaguggauaagguuucuaagggauaaauggaguguucuuucuggcuggcccaggaccugcugcucccaugcaauggcuaggggaugcugucagaggcucuagggagugggaauggccugacuuccugaaagacuaguugaaaacucagcuacaagguaagcuccagagccuggacccuggcaaauuagucuuuuggccugguugccauggagacaggcaggcagcagcugcuggggaagaggaaacagcagcuccaccaacaucuaggauucugaaacagccaugaugggggagggggcuugacaccacccuuucucccccagaaacugaggucccuguuugccccccaccccccugacccccugacucccagacucacaggaucuggugaguugccaggguaacaaaacaagaccguggcaguacuggauccugaaaccccaguuuccugcuuccaagccagugcccuaccccuacuacaccacaguugccuccugcuucagagcgaaagaucuuccagugcacugcuccugcgcccugggaggguucccaggcugccuccuuggaggggauaagucauuagaggugaaucccagugugcuggccaccagaggccaauuuggcccagugcucugucgcugucucucuggaaaaccuggcagcgucugcgugggucugugaccagccauugucuaggaagggagcuugaagcggagcccagagggaacucagcaaaugaugggguuuguuguucccucauuugaugcuacauugauaacauuaauuugcggcuucaccggccaugcugccuggcuggccgcccuccaaguccugaccucccuagccugguggaaacagcccuuggcucucccucucuuagggguuaucucuggaaauugaaggugggagaggaggggcuuaggauccaggucaccugagucc

SEQ ID NO: 14170 - RNA, 6711 nt, Homo sapiens
ucaagauacagcccaagcagcagaggcacaugcguuagcaacacauggaccccaccgcaguauuagcaaucaucuuuugcuauaagugcuuggcuuccaagagcuuuuauacagaugucugagaggcacaaaauauguauaauuaggcuauuucucaaauagcacaggaaagcugccaaaggcguucccugaauugagaggcaaagcacugacaauggggacuauuacagccucuggauacaagaugacguaucugccaaccuuaaccacccgagucaaaugcuacuuuagaaauaauuaagguucccuuuagucauuucacaggaguugcuacagcaguacauaaaguuuuauuaauauucugauucucgugucauagcuuuuauggcaggaaaggaugaggacaugccccaccuguaacguagagcaagcaaaccaccaaguagaaucuugagauucucucucaacuguucucuagaaacacgcuugugcuuuuaaucugccuuuuaaaagggacacagaacaaaaaaugguuguuugcaaauaaacaucugaaagaaaguaacagcugaccugggcugaggcauccaaacaaagcagucauuguggaaggagacaaugcaaaccacacuggggcaagaaacggggcagagaacgugcggucauuugugcguuggguauuucuaccagccccaaaggccccaucuggaacaaguaucaaccaggaggggcucuauggcuugauuuauuaaccuaacucaaaagaagucacugccaccaacagcacugugcaguuuuauuaaccauucaaguccaguagcaucugguaagauugggacagaauugggauugaaaagugaacagauauucagcaucuaacaguucaaaagaagccacuacauacucuuuucacaaauauguuuucacagagccaauacaguacuagccauuaacccaguacaccaaguguacugaaguagaaaagaugcaacaagaaaaauagcuacauuagaaagaccaacacuuuagaaaaagaguaaaacacuuucaguuucuccccuuuagccccuaaaacaacaucuuacagucuggaucuggaucuaccuauacaguccuacauuagcuucuaaaauauuugucaggagggaaaaaauaaaaugacacuggccaguacagucuuuggauauuuaggaaggggauggggagaaagucaguucucagaacaaauuagucagcuucagucucgucagcagggucuuuggauucuuuguucuuccgcacuucuucaaugugcuuauccuguaaaggaaggguaaggugucaucagucaaaaaaaaaaaaaaaaaaaaaagccugucaagucacgacccccagcccccaccucaaagaggcccaacacaaccucagugcauauauuacagccugugggaaccacacaauuuaaguucugagacaucaucaucaaaucuccugggucccuuguagaaccuaacaagcugccuacuggacuuccaaggacugugcaauuaugcugggaauuacugaauauuccaucuuaaaauauaccuuucauuuaauauguuaagccccaaaauggaugacaaaaagacaccaaacaccuuuuaucaaagcacuuaguucaagccaacucauuggugcaucaaacuccaagcucaacccuuuuacaaaguaagaaaccaaccuucucucgcaaacguuccaguuuggcagccauuugugccucucgguucucuuuauuagcuuccauuuugugggucaguuucucuucugccauuuuacugaaguuguuguucucuucuauugccuucugaagcacuucuuucucgugcucucguuucucagccagcugcuucaagaccucagcuucaugggacuggaaaaaaaaguuuaauaggcuaggcacucuaaaauguauucaggcugggugugguggcucacgccuguaaucccagcacuuugggaggccaagguggguggaucauuugaggucaggaguucaagaccagccuggccaacauggugaaauccuaccuauacuaaaaauacaaaaauuagccgggcgugguggcgggugccuguagucuaaguuacuugggaggcugaggcagaagaauugcuugaacccgggagguggagguugcagugaacugagaucgugccacugcacuccacccugggugacagagacucugccucaaaaaauaaaauguauucagcauaaguuaaaauuacaauaaaaauaauuuacuaaggggauugaaaaggggcagaaaauaaggucccuuuaaauaacaccaaaauuaggaccugaauuaucccuaucauaaaauacugugaaaaugauauucuuuuucuaguauuuguauuuaacuuuggaaaagugcuuaucuguucagaaaucuuacccaauuaguccuuaaggaaauccuuguaagauuuacugcuuaaugguaucuggaugacuugaggaauauguacuugcgaguggcacuuuuauuguaaagaauuucacuauuuaacuucaaaagcuacccaaagaaaacuagcucauuguaaaaauuuuaaccauaacugauaaaacaaugauaggaaauucaagacuaagucuguagauuacuauuuaagacagaaaaauuuguuucaaggaaaaggcuuauuagcuuuugucucaggaaacugcauuaauuaccagaccauaccuugguaugaccccuucaacagaacagcuuguucucaaaacacauuggaaccacugacuugcaggauaaccacagagcaucugacacugguucuauugauucucuucugccaaauccuagucaugaugggaguuucauuauauuuagccaguuacuauguaaagcacaggcuaaugacuacagggccaggguugaugucuaaaaagcuuuccacuguccaaccuuugguuguauugcuuccuccuacuccaugaacucacacuauugcauagaagacgacuccuuaguguaagcacugaggcucuucgggcggguguguguguauacuacaaaucacuaugcuggucuggggaagguuauuaccuuaccuuuugugccucacuugccccagcuuuaaaaucaauccuaucaggguuguugagaaagggaguuaaaugaaaaguuauguacaguuguuaaugaguaacauugaauggaaagaaacacaccaaaauguuaacacugguugcuucucggaagcgggauaaugaauacuuuuaauuuccauuuauaaauuucuguauuucccaaauuuucuacaacuagcauauuaauauuuauugauucuucugauuagcuuuuaaagauaguuacuuuauaauagaauuguuuagauaagagaaaagcuaccaugauaccagcugagcaacacaaucacacuagcaauuuaaaauguuauuguacagcucucaaaaaacaaaaccaaagugccaaagaaucaucuggcaacaaaucuuuucaaagaggaagcaugagagaagcaugagcuuugguuuaagauagaccagggcuugaauucugaccccaacacuuacuaguuguaugacugcagaaaaacgacuuaacauuccugaaacuguuucuaauuuccauuauuugaggcaacaccauguauuaaaggagaaaaauauaaacaaaggagcgggcauguaacaggaguucaauaaaugaggacugguauuuccuuccagucacuggcauauguaauaaucacaguguagcuacaauucuguuuucuuccuguuauagaaauaaaauugaucugcccauuacauaaauuaauauccugcuuucugugaauugcuucguuuaccuugcgucuuucuucugcagcuucuaauuucuucugaauuuccuccagggaaagauccuucuucuuuggaggggaaagggggaauucuggaacagauucuuuugaccgagggcugagaaucagcucaaaagccuggccugaggcacgcuucuccaguucuuucaccuggauaucuagaauugauuauauuuauaauucagaaaaccaggauucuccuguucuaauaaacuguacuauaauuuucuaaaacccaaaucaauuuaauguauuaaacuagggcugaugaggaaaguuguguuuuuuuuccccuuuuuauuccuaucagucuacugacacuaggggaagauguauuugcaggcaagauauuauuaucuaaauaccauuucccaaggccagguaccauggcucaugccuauaaucccagcaccgugggaggccaacaugggaagaucccuugagcccugaaguuugagaccagccugggcaacaaagggaaagcccaucucuacaaaaaaaauuuuuuuugauuaggugggugugguggcccaugucgauagucccagaugcuauggaggcugaggugggagaaucgcuugagcccacuugagcuccagaagucaaggcugcaaugagcuauaauuaagccacugcacuccagccugggcaacaaggugagacccugucucaaaaaaaauaaaaaccaucucccagaaaaacaaagcucaacauuuuuggauuaauaaauacuguuuugagacaucaguaucugacaaucgcuuucauaaacaaaagacuugugcaaacuccacaauuuugcuucagacuaagccaaacuguccaauaaacaauuacgagcucucggcacauucaagugauaaucauuuuuaaauucuucuccuauucauaaaauagguuuugguaagaccaaaacauaagugccaaaucaaaggcgaagaccugagccaucucaaucuaaaaucauaagcccauuacaauuucagauuuuccaaauagauuaccuaccagaagaagccauggugaauagaagacaagcgacaggcaguguauucugcacaaucaacugggauaaggaaaguccugaaaaugauuuucaaaaacaugcaaucacuuucuuugccuuucuauaugucaucaacccaaaaaaaucucacaucacaucuacauacaucgucagaaaaauacguggaauaaagacgucuaaauuaaccacgaaaaaaauuaucaaaaucuacuaaauaaacauugggaaauaugaccugaauaugauauugguuccagaaaaucaaguuaacugagcuuucucggucauaaaacucuuggauuuuuaaaaucagacaaagucacaagggugaagaauuuuucccccauaaacucuuuaacauuucaccgaaacuguaagaagauauuccagauucaacucaacagugcccccggagccaucuuaauacugccuacaacucauugugcaaaugaaauacccaccccugcuuugucugugucugacgugguggauaagaaaacgcccaagcuaauaguaaccaauaauguugaacuccuauugucccucagguuuaagcuuccuugcccaacagcaagcaaaauguuuaugaaccucuagauuuugacuuauauuugcugccguuaugucaugaaaaaugcuguaucucuuguugaucuuuuuaacauuaugacuuuuguagacgccagcuaguaccaaaaacguaggaugacagguucccaaaagcuaggaauuaaaaucagaggcagcgacaagauuuaagaaaagcagagaauuagacgcagcaccggacccaggaugggcguggcccugguccgggcgaggaaaagaggaccggucgcccccggccaaucagagcacgccuugcgcuccggccccuggccccgcccccuuccuccccgcgccuuuucgaaucuccccgaacucaacaccccggagcccgcgcgcgugggaaggggaggggugggcggggcuaacgguccaauccggguaacuccgccccugccugacucccccugcgcggacgccccccccaacucccgccaaaaacaccuccaggccgccgccaccacccccuucacaguucagcggguggggcaggccccgggaacaggcccccggguggucccgcggugagcucgccaccgccucccgccguccccaugcccaaccugccgccacccacgcuguccgcgcguccggccgcgaagacagaagaacccucguggggcccgggagcgccgccccucaaucaccagcugcggucgccaggggacggucgcagggagggucgcggcccuggcugcccgcaguuugguccuaaagccgcuggucccuggggcaccgccccgucccuucagacaauggggaacccggcggggcccgcagggaagggagggagggagggagguaaacgagggcccacgcccccuauugucuccucgacggcaccccggagcggacgcccggugaucgcccagcccccugcccacgaacagccgcgcccccggagagcggggacaaaggcgaggcuccgcccgagccacacacaaagcggagcgacccccgcccaccaaccccuccgaggcccgcagccccgcccgccgcccugcagcagggggucgcugccacggcccagccccucccgccgaccgcgucccucuugcuggccucagccagccgccgccuccuccgagccccgcacccaccugcucaguccgagccgccugaccacacucugagcaccaacagacccgggcgcgcacaaaagcgccaaacagaggcacgugaccuccgcgcggggcuccgcauuggccgag

SEQ ID NO: 14171 - RNA, 13094 nt, Homo sapiens
aaaugcauucucucuccaaguccuuccuuuaaugucagguagugcuucaacccaaacacaagcaguauacauaccauagagaaagggaccugagggcaucugagucaugcauggugugguacauacaaaccuuggcccagcccaaaggagcagucaagggccuggaagaaagaugguuugcucuuucccccuccuccucucucuuuccuaccgggcuuaaaguccguggaagagaaaguuuuuaaucaguggaacugauaaggccucagggccguggaggguagauuugguuguucaguaauauaaaauguguuuaagaaaaaaaacagcccaggcuucccagcaguagcccauguguuggcugguucagcagccugaccucuacaucuagacaaggaagugaggagggugauugcugggcauugguguagguuuaugacggagcagcauaagauuuuccgugcccugugaacauguauacaaacauucauagccccuuccccucagcccugcucugcugcaaggaagcugcugagugagugacagcugggcacaaagugucuugugagaccagcuauagggucuaaugcagugaagucagucauuuaggaccuauuuucacacaggggcaaggaaaaaccagaaacaacuucucucuuacccuuuaaacuaagauacuucauucuacacgauuaccugaaacaaaugucucaggucaaaucacaagccuuagcuucugcuaggguuugaagucugggaaauauauaauccagcucuucucuuucaguccaagcucuagcuugucagcaagacuguugcagaagaucuauccuuaagaggcagaaacaucugcggugaggaaggcagcuauugaagguauuccaggagcaugagacugaguuugcagagcugaggguugucaauuuccuuuucuacugauaucuucuuccuuuagagcaaacuuccuccuuaggaccucagagauaagcacagcagggucuuccuccuucaauaaacuccgguuccuagagacacaauaauagcuugaguacuuacucuuuccuguguagugcuguauaucuuuugaauacauuaucucguugaauccucacaacaaucuuacgagguaggugccauuacaauucccuuucacagauaaggaaauugaagcacagaaagguuauacaaguugcccaaggucacuagucacucagcaaguaagcggugaauccagaguucagaaccaaacuagcugguuccagaucucaucuauuaacuagaaugcuuuacuauuuccugaaauagcuauaaaguaugggcaaaguaaaggaccaucagucuguuagaguuggccucugguggcuaagcuucugccuucuggcccuguuuucuuaguagcauuuccccagagggucagcaggggaagugacugaugacucuuggcuauucugacccuugauaguucuggagaaaaggugugcuugggauuuccuaccaccgggucuccccuucaggggagaugauuuuuuaugagagccagaauuagagcaaaacauucacauaagaaacucaugggaacaaaaccaacuccagacugaaguaggcccaaguuaucugauacaucauauaagaggguccuagauaccuggaaaauaguugcuugaaauccuagugaacuuauauacauucaucaugaagguguuuuacuggugauuaagcuaaauauaagagccaagacugacuauucaaccuucaaagcaaaaacaagagggacugcguuugguuggugacauaucugaaccuuugcugacugggguacuuucccauucuuauucacugacccagcuccuucugaucugaggacacaagugggaggagggggcuagcaauaagggucuugaaucuaauuugguccaaaaggcaaguaagagaaaguuugagagucaaccuauaaaacauuuuguucagaagaagacagcucagagaagaccaaaaacagcagcaacugaauuugggaauguggaagaccaaagagauaugggugaguaugaccaaccugacuagggccagugaaggaagguuaagagugacuucccuaaaugggucaacugccaggaagcaaugagggagucacuuagccuggucuacuuuucagagggaaauggaucccaggagacaaaaagggauccagggcaaguaacuuucccuuuaacaagaacuuuaucaacucaggagaggaccucgcuucccuguccccaaaacaguuuuucaucugcauuaacaaacagagcugcacaagcugggugcuggccaucaaggucuggcucucaaaugcccaggaaccugcauucaaaccaagcuccucuggugaguccugugcagcuguugaaaccgcaacccacaacuggagaaacacuaugcaauggggugacucccugaggcuucuuugccagaugaaguuuuucaagguagguauuccccaaagacccucauacuccaucggaaaaaccuagagcuccacuccuugggguucuacuuuaguaaguuaaagguguauuuuuaacaaaucugagcaauucugaugggcagcuagguuucggaacuacuggugagucucaaaagccuuauucucaaaucacugaaugugcaggguuuguuugcacaauggaccacuguauuuuaaagcagaaaucuccaacuuuaugaaauucuccucccaccaaaaaagucuaccaauuugagauaagaaaacauaacaaaacauaaugucaugcaaccccucacuuugaagggugggccaugaagacacugucacuagcaguaugaggacugaagugguaaagccaccugaggacagaaguuggauuagaugagccuucuuguaaaaucccuacuagccucauauuugguuggggugaccaaacccaauaaauguaguguugcucuuuccucaaacuggggccccaggcacuggcaagcagguagucagcaagcuuuaugaaugacauaacauaugguacuacuaagaacuuacuauguaaguauguugcauuacauaauuggccaugggcaacucugaguaaauagauaccagagcuccucaucagauacuuacagaucuugacucuguuucauucggugaaaguccuucaggauacccaucaugucugcaaagcugcuggccuuggacaaagagacgcagucauccucuucagacgaacugcaggcagcuuuguguucugguuugcaacauucagggcuggcagaacaaagcagggggacugauggaagcucagggaccuccaccucugucuccucggugaugucacuaaugacaaaggaaguuguagaguggaaugaggauccaaaacaagguaagggagaagagacauuugaacuuccuggagauaagaaaucuggcguuaaugaagccgaagcugaaagagaaaacaauaggcauggguggacauuggggcuagaacacaguagcaauaucuucuccccacagcccugccuacugaacauucauuuccugggcugacaccaugacaaucugggagagccaggaugguaucuguagccaguggagggucauuccacuaugcuucucacucgggggcucagaaagcuguagaagcacugggcuuuuccaguguuccaggaaggcaggaaaacccagccccauaauggccuuggcauuuaaaagcucccauuccacaauaggcuguggagugacagcccugucauaggccaaagcagcagagauaagagcuaaggccugaauuuguccuuuucucuaacuagacuagugcuuuugacuaugcuccuuugaaaucuugcuaucugugaacuagaagacauguucugagcaaaaccagaaugguaacagaccucccaaccuccccaaauuucaguggagagaauuuccucaguuuuuacauuucuaaaaauacuuuaaaaacacuaaauacacuaaaaacuauguuucuaaaaaagauguuacuucugcuugucucuuggaugacaaaaaaguagccaagaaauaacaaaguuucaguacaauucuucauaaaacuuccaugugaagaaauuaaauacaugaagauuucaaagaacaccaugauuuucauguguccuaccaaaugauaaauuucagagcuaugacucugagucaaugcagagugaaaaaaugaggaugggaggaauaugaagauaagcccugagcaucuugggagcgauccaccuguuggcuguccaugccucugguuaaggcaggcuucccauccauuuccagugguucugccuuaacuguagacagaaagcuggagggguggguuacagggcuuguuugcauaauagaccacuguuuuuuuuuuuucuuuuuuugagacggagucucacucugucgcccaugcuggagugcaguggugcaacuucagcucauugcaaccuccaccucugccuccaccuccaccuuccagguucaaggcacaugcugcgaugcccagcuaauuuuuguauuuuuuauagagacaggguuucaccauguuggccaggcuggucucgaacuccugaccucaggugauccacccaccucagccuuccaaaguguugggauuacaggcguaagccacagugcccgaccacuguauuuuaaggccaagaucuccaacuuuaugaaauucuccuuccaccaaaaaaguccaccaauuugagauaagaaaacauaacauaaugucaugaaacuccccacuuugaaggguggggcauggggacaaugucacuagcaguauaagaacugaagugguaaagccacuugugauuccugguagaaacaacaaggcaagggaagauaggugcuuaaaaaggguaagucucaguggugguggggggaauguuuacuucuuguauugaaaaggaaagcagggcgcgguggcucaugguuguaauccuagcauuuugggaggcugaggcaaguggauugcuugagcucaggaguuugagaccagccugggcaauggcgaaacccuaucucuacuaaaaauacaaaaaauuagcugggcaugguggcaugcgccuauaaucccagcuacucgggaggcagaggcacgagaacugcuugaacccaggagguggagguugcagugagccaagaucgugccaccgcacuccaaccugggugacagaaugagacucuuguuucaaccgcgggcacaguggcucaugccuauaaucuuagcacuuuggaaggccgagcuggguggauugcuugaggccaggaguuugagaccagccugauuaauguggcaaaaccccgucucuacuaaaaauaaaaaaauuagccaggugugguggugcacacccguaauuccagcuacucaggaggcugaggcacgagaaucgcuugagccugggaggcagagguugcagugagccaagauugcgccacugcacuccagccugggcaacagagcaagaaccaggacccugucuccaaaaaaaggaaaacuggcugggcucgguggcucacaccuauaaucccagcacuuugagaggcugaggugggugggucaucugaggucaggaauacaagaccagccuggccaacaugguggaacucugucucuacuaaaaauauaaaaauuagccaggccugguggcacaccccuguagucccagcuacucaggaggcugaggcaggagaaucgcuugcaccugggaggcagagugcagugaacuaagaucgugccacugcacuuccagccugggcgacagagcaagacucacucagaggagaaaaaaaaaaagcuacugugggcuuauguaagaugugaucuuaaagacacuuagaagaggguaucaguuugggggcuaagggagggacucugccuggggucacagguuaauauuuuguucuuaaccaaaccauucagcccaaaauggcugguagaaaccaucuaagaggcacuacuggcuagccaggcuucaggacaaccccagggcccggaaccuaaguaccugcaaaccaaggauuaccacuuucuuuaccccuauccugcccaagagccaggggaaaggaacagccuguuacguucuggcccuggcacaggggcuccuaccugcaucagcugccacuaucuuugcaaucuggcugcgcaaguggcucagcucguccugcagcucaguagugcggcuuagggcuggcagagcuggcuucuucagggccagaagccucuccucggacccacgcagguugggaacagaggcauugcgcugcaugacaaucagagggcuggguuuccaggugugccucagggggcgcguaucacuccuggaccagggaaaaccaaguagaucaguuagagacagcaggccacugugcuccuaagguuccuucccccacuucugugagaguaguauaguaagguucugcuccucucugagcccacaguucucauuccucucuccuugcugccugccaccucuucugggaaguucuccauuccuuagcagaccagcuacugccucaacuaccugacccgggcauaugucuccucuucauccgcagcaauccaggcgaugucagccaggguagggacugggggcacaucucucaaacacaggucagagauguugggcagggucuauggagaagcaaaagucaucaacauuuacagaugccaugaugagccaaucagaaacugcagaauacacaggagggguaccuaauccggcacugggugucaggaaggcuuccuagagggggcagaagaagguuccuggucgaaaacauugaacagaggccagaugacagucaggcaugguggcucacaccuguaaucccagcauuugggaggccgaggcaggcagaaugcuugagaccaagaguuugagaucagccugggcaacauggcaaaacccugccucuaccaaaaaauacaaaaauuaucuggguauggugguauacgccuguagucccagcuauucaggagacugaggugggaagauggcuugaaccugggaggcagagguugcagugagcugagauugcaccacuguacucuagcguggacaacagagccacauucaaaaacaaaaacaggcaagacacaugagagucuaugggauuacaaacaguucugugucuucaguggaaaaggccugagucaccuuuuaguagagauggcaacugucuaaaaccacugugcccucuggugaaaauacaaguacaaggucauccacaaccuguuacagcaauaggaaauuuuuccugacuagcuuuuuauaauccuguauagcuaauugagaucuacauuguuacagcaaugcuguuuuaaacaaaccugaaaauuugaauauauuuagauuuaaauaaaaauaaaugauuauacaaaaggaaccauaauaggauuucuuaaaauagcuccucaaccuagagauguugaguaaagugaaaaauuaggauucagucauguugacugugauuacaacaaaguaaaaaacauccaucuagaaaaagaggacuacacuaagacauuaauaguuauuguauuauuacuauguaauuauagguaauuuauuuuccuuuuacuuuucauaauuuuaauauuuucauaugcuuaaauuuucaaaauaaauugguaagagucccuuaaauaauauuuaagguaauuuaauaauaauaauaaaugcauauuuacacacaaguaagauucaacuguuucugcuacaaauuauuugguaugguagauggauccaggauugaucgcuccugcauuuagauaggaaaccugggacucacaggaguuaagugauacuccaaggucacacagagaagaacuuccagugacccaggaacuagugcuaaaauagggcauuugggggaagccuccauuuguuuuccugauuagcccugaaugcuccuuugcucuuggcaauuaaaugaguaaacaaauauaaaguacagcacagugccugacacauaguaugugcucaguaaauguuaucuaguauuaccaauacugcucacauacauuccugcucugugagagccugugcccuugauugucucugcccagcaucuggccaaagaacugaagaggguauagccaaguguggggacggccucuaugcagugagccacacucccuagcugucucccuuuuuuuuuucugaugcuucugaggcaaguuaggaccaguuccugcccaggaucuuuagacaauucuggauagcuggcaaucugaauacugggacagcuuuuccugcccccuaccccugcgacacuuccaacuccauuccugacccuaauaccaacccugacaccucuucuaauuccagauccaguuccuacagacucugcuucuuagcaucuuuuauacagauuuggcuccuucauuucuguuucuaccugggcccacauccuuucaugcacauauuucuaucuccucuguguggguagaaagcacaaguauuucuuuuguaucccagcucuccaaaugcacacaucugaaccauauaguuuggggcuggugcuuaaccauuuaguuccuagagggaggcagcugggacuaauaaaugcuacuuagcuuucuaccacagaaggggucucaagagaccugggccagguaggaaucucugcugcugagugggugcuaaaggaucccuagacacagagguaagaccaaagcaccccaguaaaggaugcccagauuggccaaaaagagaaggcugaggaauuauggccucagagaaacacuaaaaauaguggagcugggcaugguggcuugugccuguaaucccagcuacauaggaggcugaggcaggaggacugcuugagcccaggaguuuaagaccuagccugggcaacauagggagaccucaucucaaaaaauaauaaaauaaaaauacuggcuacauggucaauucuuagggcuggugaagaaaagcagaguucaacucaaaaaucacaauagucagugucccaugugggggaccugucagguuccuuguggucacagguuuguaugcacucaggaggacacagugaccaggauaucuuauaagcauuuaacaaauauuucauaacagaaugaaaagugaccaggaaacaaccuacuugggcaguaccaagggguuuggggcacagaagcagcacugucugagccucuacucuccugcccuuccaacauacucaccucaaaggacgcccgggcacacggcuucaaggguagguuggucccaauucuucuuacuacacuucgagcagccccauguggcuuguuuugccagauugggauggucuggagcaaagagacggagacagcuacaaccccagagaaugaauccaacuacuguccuuguccucuccucucuagguuuguggagacugaauuccacaaaccuagggacagggcacucucuaggggcaagucaacucucaauuauagugagggcagguuccccaguugccagccuacacccuggccagccacccaagggaauaccugcugcugcuaaggcagucaauguugggagggucagggaaggggagaggaaguagcugaguguagagauuauccaggcuuuccuucccguccucuguacagaaaggcagacauacacugacuccugaagugccccaggaucauaguugguucuucuuagggggagggagugaaacgguggccuugcuccaauuccaggccucuggagaaaggagugcucaacuggagagucucagaaccuuuuacaguacuucagcaggcccagcacccaaccuuccccaccauaccccugcccugggaaugccccuuaccacaguggcuuccauuccugacauuugaaccagcuccugcacuugaaggacaaggcagccacugggcagcuccgggaggcgggaggcgugacuccuucauaucaggccaucuggaggagcaccagauuucccucuugugaaacaaccccccacaguggggauuuaauggucaccacacaagccccaaaaaaccaggcccugcagagccaugacuucacaggggagaaaaccagcccaagaggcugcccucacccaacacuuagcucuaaguccagacucuuaaagguucuguuaaagaucugcggccaggcgcaguggcucacaucuguaaucccagcacuuugggaggccgaggugggcggaucacgaggucaggagagcgagaccauccuggcuaacacagugaagcccugucucuacuaaaaauacaaaaaauuagccaggugugguggcgggcaccuguaguaccagcuacuugggaggcugaggcaggagaauggcgugaacccaggaggcagagcuugcagugagccgagaucacgccacugcacuccaaccugggugacagagcgagacuccgucucaaaaaaaaaaaaaaaaaaaaaagauuugccuagugagcuuggccaacccaagagccuuccugggcucucagguuucuugaggcaaaacuucuaaagaugcaaauagaauccuugguagcuacaaagcucaucuagccaaauuauaaguacuauccaagcccaggauucauucuugaagaugagauguaaaagcacugcugggcccuugcaaagggagagaucagagaaaauaggagaacgaacaccagcucaugccaaucucagucucaugagcuacagagaaaaagagccaaaaaaguuuauccuggcucagccaccuucuggcuuuguagcuacaggcaaguuauuuaacuuuucugaauguugguuuuuccaucuggaaaaaggagacaggaaaagcugccacuggaggcuaccuuaagggucaaugagugaaaugggguugagugcuuaaugaacuguuaaaacaugacacagaugggugaggugacaucugacugcucuucacagcaguccuugcauggugagcagaugcaaucagugugcucguucauucacuuguucaucaaacaccaacaguacccacuugugccaggccuugugcugggcaccguaggggcuauggaaggaguaagacacagucaugcucucaaggaacucgcuguccagcagagugauaggacaugaauacauacuucuagcaaaggcugaguagcauuaggcagguggccagaugaggucagagcucuggcccuagugcccuguaguaaguugcgagggaguaggaaaugaagacaaaacagcaagagcacagguccagcacaagaaggugaaggacauggaaagaggagcagagcaugauaaagcuacaaaaguagggggcaagucaugagguccgggucacuggggagcccuggacaggcucugaaugggagauagacuagacugacaaagcagcucuuucuggagaccuccuguggaggguccccucuucuacccuugggagacgaggugucauucacuucacgauacacauggggaaaggaaguuggacaggggaaggcacuugucuaaggucacucaguggucaugccagugcaaagcacccaaagccugguccagguccugccaccuccugcgugggcuccaucuucucggcucaguucaagccuuuauuaucagagucccucugugugccaggcucugugcugaauguccgugucggccacaaauugcacuaacggugcuuacugccacuuccucuccgaccuuaccuccaaagacccagccgggccuaacccucacacacagccagaggaauccuucccaaacacaguuaaucacaucgcucauccguuuaaaacuggcuuacuagagccaacacaggauaaaauccacaaucagucccaaacccaucuuucucugccgucucuagaccacauucacugagcaccaaggccugcacgcuucgcagccagcccuccugcucucccccuugcccuccagccacacuggcccucaacccccaacacugggcccaccucugagcccugcaucaaacaccagcacccccuucgccgagcucauucuucaucauuccucagagcucagcuuaagcaucaccuuccuucccugcgacagggucagguccuuuccugugcgcuccgcagcacccugccugucccucggaguccucgcgagaggaacuagauaacugugauccccgcgcacagcacggugucugccuaggacacagugagcgcuucaacgcgcugaacuaaacgaaugaaggggaacaccaacucagcugucacccccgcccccaagugucacuggcuagaagaucuucccccgguucgccggcagcaccggugggucuugucaccucugcgccccgcagcccuccggaggcugcaguugcugucugcugacaggcguccccucaggagaacgggagcuccuccagcgcagggcccugcucagcaccccuggucccgggggcccccacggaggccgccgcgcucagugaaacuuugccgcgcgcagcaguggccggagacccgcgcggacccucuccccgcggggacccgccagggcgagucgccccucccccgcggcagacgacccgaccugggccaaggucggccaagugcucgccgccugcccagcggcccuuggacccacaggacccggacccgagugcgcggaagccuccgagccgcggccaggucucagaaugcgcggcggggcagcccggcccgucaagcagcgaagccgaaacuagaagccugaggucuggcuuggucacuguuugcuggggaacuccgacgagcaacuacccuucggggacucaguuucccccgggccaagugagacggacagcugcggcucccgcgagaacucgcgcgggaacaggagcugcgggcuccgcacagcgcccggcacguagacccagucuacuaacgggcuggaaggucgcgcucccgccuccgcgccucccuagaaccuuucucaccucaagcucgggcucccggacucucucaccucacggccccuccuuccaccuugggccgcccagccucaaccgcccucacuuccgcugacccgccccccggaagcgauccuccgcagcugcgcaccgaggcgcaccuccgcgcacccucaggaggcggguccagcucgguggcgagggg

SEQ ID NO: 14172 - RNA, 2500 nt, Homo sapiens
auucuagaaucucacuuugaagacagcaugaaaaccaagaucuugguuggggcagaggguggaccacacaacauuuuaccaaaccaggcugggcaugccaugccaucggcugugugugacggagacccagagugccuaagcccagugcacccagugcacacuggggagcugucacaggaagggucugacagccggcaaaguggacucccaggcugcagggacuccagcgcugccugcugagccagggcugcccuuucucacagcucucaugggagccaggcuguucuccccuccugaugaacugacucacugauggccacucugugccaggugcuaggcugggcacugaggccauggggcaaaucagacaggcauguccucagggagcucccaggcuagcacaugcagucgccaaccauucuacccuuccuuugaugcccagcaggaauaugccccucuucuaagagccugaccuggcuuccccagcugccauaccucagcucugacuuccaaugucccgcuggccuacugcaagcccagcucaugcccggggacuuuccagggcaccaugaacuauaaccccuggacugcgagggggucaagagcagcugugccucagucacccugagacaggccgugcuggggcucagcaggugcagucagaauugcugucuggcaacaaggauucaugacacagcccacaucuguccuggccacaaacgcaccaucugauccaguaccucugugcuggacacuuggcuaagguuacucugggcuggguucagaaguuccuaagcaagcaaggucauccugauuugccaaugucccaagugaccugcagaggcagggccacccagcacaguggggaacacacuggcucugagucccaggccugccuccuaauagcugugugaggcuggcugaucauguaaccgccacaggccuugguaucaucaucucuaaaaugggcuaacaauacgugcaagcacaggggccgugcagcagcuuaaacuagcugguacguguggaugcugcugguguucaagaugugcacccuccuuccugcccuuccgaggcuggcauucaccucccagaggaaggcuuccuucucugaggggcaccaaugcucacugugggccccacuggcaggcugagcagugccacuggggacaaagcagggucucaaugcaaugagacauaccccuguggaguucuaaacuaggcauguccagagaaguggccccaaagggcagccacuggggaagaggugggaucugcucuggugucuagcuaggaagucagccucugccuguggagacacccacuggccagcagcuuccagugucuuccgugguagcuggggcugcuggcgaggcagagcagggcacaccaggucgguugggguuugccuugaucugcacggagaggcacugugcaguggaaauccggagcgcuggggucagagagcaggguucaaaucccagauccccgaguggaugugagacuuuggucaacuuguugauccuccuucacccucagcugccucaucaggaaaaugggacuaggaccaccuaccugguagcaugugagguugcaaggacuaguaucaccaguguuaggugcaaaagaccuaacaggcccaaggguuacuuuauuuuuauuuuuauuuugagaaggagucucauucugucgcccaggcuggaguguaguggcccgaucucggcucacugcaagcuccaccuccuggguucaugccauucuccugccucagccucccaaguagcugggacuacaggcgcccgccaccacgccuggcuaauuuuuuguauuuuuaguagagacgggguuucaccguguuagccaggauggucucgaucuccugaccucgugauccgccugccucggccucccaaagugcugggauuacaggugugagccacugcgcccggccggguuacuucuuaauauacaaacgggcaccuccucugaugagcaccugggaauggccggaggaagaccaggccccaagccagccccccagaugugaaucugccccuauucccuagccaggcuuguugaaaaguccccagauguacaugggaugggaucucuuccugggagagcagaccccaacauccacccagugaagcugaaagucacgucaaaucugaaaggcgacuuuguucucccuggcuucaucccuuaugcaugaaagagcagacggcuggcgcucaggauucauaauccgagacauccggagacuaaagacauuggccaaauuuaaaccgaaagauaaacuuguugggugucuuuucagauuaugagggaaagaagaaaggggaggauuucuuagucauccaugaaccacugagaauucacagggagucagccugaugcugauaugagggcucugccucuggguucuggacgcuuaaaauaccaguuucaaagggauaaagagauacauguccaaguggacccccacaagccacagcugagg

SEQ ID NO: 14173 - RNA, 35958 nt, Homo sapiens
ugacguaauacauagauagauuuuuauuacuaaauaccacgugaguauacaaaaugcaucacugaauaacagcuaaaaaaaguccaagaaaugugaaauacacauuuuuugaaaugauaaaaacauauccaugaaaaauauaaaauguugcauauauauacaguauauuuauauauauauauaacaaaugaaaaucguaaauaagaaauguauacaacagugaguggcaaggcaguaguuuuacacagcggucacuuuguuccagucgaucguuagugcuauuuacauccugcgcugaggaagucugagaaagagacuccaauauagugucuuuuaaaagucauuugcacugaaaaucaagaguuuucaaguuaacugaccaaagguugagaaauccuuugucugaaguugaaggaagacagagagugggggccgcaccagcuggcguggugcugcgggagggagcgugugccgccaccaucuuaacgggcagccugcaggagcaccacugcagacaagggucuugggaggagggaacagucuucuggguaggugguaaccauggugacauuguuuugggguacggggaggcacuggcaggaaguucagggagcagauucaagcauaccauggggauccaggccaggggacccccuaggucucucccuggcccugacgucugugggucugugacucaagggccucuucccucagggaaggcauucaaguaacagcgcugaggcauguggagagguuguguguggcguggggccacgucccugcuggccccuugcaggucgugaggguuuggaugcucgagaggccuuacagcuccuuaaggaugaucugaauuuugccguccagcucccccauguccagcaggaaggcgacgugguugcuguaaugcugaaugauguuguuguccauguugacuaagauucuggaauggaagaggggaugugguuggaacacagcaggcgcccuguuuucaggccuucugagugaccaggaugagugaugggucauacccaguggguaccugccacauuuuaggcaccucacaaaccuucccucugauccucacaacaaccccacgaggugagggagucacagucuccuuuacugcacaaugcccaguggccgagccacaacccaacccaggccugcuggcccccacacucacagcuacugcgccggauugccucucuccugguacacccgaggauggacacucaagcaacuaguauguagaucugggggagacgcagugcucccuuagucaccauauugaggacucggacaugaagugugaguucaagccccggaggggugguggguuggguucaacaagaggcuaggaugugucccucaggcaugccugagccagaggcaggugccacacaagccccucccaguuccauucccaggaagcugaaaucucaggaggauuguccgauagacuugaggggcuaggcccacucucuccccauauucuccaggcaaggaccugggucaaccugagagagacggaaucuucauggcugugggccccugcagggagucagagccauuguuuaugccaaagaaagagcagcccucuagaagcugcuccugaugaaggacccaccaagaugugacuugagcugaucacaucaaccuucuccuugccccuucccugcugucuucugagcauguaauggaguuggguauauccacccacacauucaccauccaccauucauucacauacacacacuccccauccaucauccacccacccaaccacacccccauccaccaucuacccacccauacacacccccaucuacccucuacuacacacccacacacacaccuaccuggcaucuacucguccaucuacccacucaugcaccaucuacccacacccccacccauccaccauccuccauccaccugcccaccugccgucaucuucccauucauccccuauauucacugaggccuuuccaugugcagggcuuugcucaaaaacaaggaccauauggagaugaauuagaccuaguuccugccuuccaggaguuuugaaucuaguagggacugggaggaugaauccucauauuaccccaguucauaaauggggaagcugagguucaaagaaacaaaguuauuugucuaaggucacacaguucauagauggcagggcugggauuugaaccuuuucucuuucuacuguaucauuuuuagaaggaaacaaagcccuauaaauacaaguuaagaagcagcagauagaaggaaggcaaaauccagggcuaugggagaguucuuugaaguggcgcaggagcggcaggcacgaggaccccccgagggcaauggagacaacauggacccgaaggcauggcccacauccaguugucucucccugccgcucucaggaagaagguccaggcuugggcugucagugguuugagcgcugacugccaauguguaaucauaggcuccccuuucuuggguccugccuggaguuccuucauuucacagagggcucuuugggcacgggaggucggaaacagaccaggggagaccagaacugggcagagggguggguccuuuuucaaaaucaggguuguuuugucugccauugauugcgugcuucuaggugccaggcacugugaaguaacugauauguaccagcuggaaggcuggauccgucccacucccuagcagggccuuccagcgcccugagcucacaccugcucacaucugccaagcucacaccugcucacaccugcacaagagggcuuccagaugggcccacagaccccucuucucaaaaguuaaugacagcgggccccugagaggcaguaccacugucaccaaaugugggccucuuguuacuugccaccuucuagcugucuucaguccugagucacauuaaaccccuggccagcugccagcaaaaacaauguauuugcucaucuuugcagcacuuaguggggccuguaaagcugacucuauccaccuucauccagaggacuuucgggaggguuuuaugaaaauaaaccaggccuuugaucagaauuuccuguuucucacaugaggacucagagggaggcagaagaugagccuggccucuccucuccuaagaucuauuuuggggaacacugucauucagacauuucagacaguccuggggcugauguuuucacggccguggggguguguggggugccugugaagggcugcugagugaugcccuggcuauggugcugggcaaauaaacuggccagccuggcugcauccuuuauuugcacauugcguagugauuagaggaacaagcaggaggcaggauaacagaguggaugccuguacaggcuuuagaaguccaagaugcuucugccaguuccuaacucaugaccuuguaacuacugcagaccucaguuuccccauacguacaaacagagauaaugauacccagcucaaagggucaacgagaugaugcuugggagugaugcagcccagugccuggcauguaggaagugccccauaaauggaagguuuuagaauuaugauuucaauagcuggcuggggcuuaaggggaagccucuggcaacucagccaguggggcuggggaacauccuuguacacacaccccacccucccacccccccaugcaaucacacagccuggccuggagugggauugguaagggaggccugccacagguggggcuggagccagggggcaugggcacuggagcugaagggagaguggggcugggcuugucuggggaaagcagagccugcccuuugccgugaaguggauuucacucuacagagcaugugagacucagauggaaaccgaaacuuggaaaaaaaagacacacgaaaaacucuagacaugcaugcagcuaaaaccaaaaaaaacccccuucccaggggcugcagggauggacaccuucccccacccucagccuucuauggaaggcuaggaaggaaccaaggaggaggaaggcaggcagggcugggccugugaggaaggcggccaggccccuaggccugaugagauggggauucagcuugaguacaaaacuugccucgcuuugcaaagucuucuacaaaggaagauccacuugcaguagccacggggcaaguggcugagcaccuccaaggggcuacuagcaaaugucgcucgaguuagacuauccacagcaagaggaucagauuggagcugugggcagaggggcuaggagugcauuucccagggcucugguucuggggccucugggcuggcaacagcaaugacaauuccucacugucugggggcccuaugccaggcuggugaagucaccuacucaggaagggcugcagaggacaggcucacuagcucugaccaggggacugaugucuggaggacaguuaccaugugacccuaccucccuuucccaagggaucuucugagcagacaacaaagguacucuggugcccaggagcccaugguaggcagccaggcacugccugcccccuggaggguacagcuuuauuccuggccuagucugucuagcaaagauggaggaggccuguggagcaucccuggcuggauucccucaaaaugacucccaaucacaacuccuuuuccagacucaucgccagccacucccuuccugccuacggcucugucaguaacaacuuuguugggccugccugccucaugccuuugauccacuucuccugccccugaacacugcuuauuaccucugagccucaguuuccuuaucugucaaaugaggacuaugguauuuaccucuuaguaugguugugagaguuaaguagugugugcuuagccucgugucugacacauagugagugcucaaggggaugguggucacuauaaucauuaucuuuauaaucaaauggcuugguuucccaguggccuugaaccugggucuucugacacaugacccuccacuucucccuccaccccacccaggaggucauauauguaacaacccuuccacuugucucccacucccauccuucccaguugugacccaugucuggucucugcagauggagaggugaccaguggcuuuggccuggcuggggagcucuccaccccaacuccacauccccucagccccuccacaaaggccaaguacaaacauugcucagcacugagcaaccagcugggggagggugaacuaggcacucacccucgcuugcauuucuuguagacuuuguaaauguucucuucagggaacccauacuucucagagaucuggaaggaaaagacaggugauucauugccugcugcccacgcuagauuuauacaagucuuuuaugccaucacuuuuuuuacuuccugauuacaaaaguaaaacauaugcauauugugggcaaauaugaagaagaaaauuacaaucaucuauaauccuguuucucagagauagacaccauuaacaucugggugugcaucuucccaucuuuuggucauguguacguacgguuguguguauaaauguuuuuagguuccacaugguuuuauauaucuuuuuacuuaucauccuaguauaagccuuccuaugucacaacaaacacuugucaagcagcauuuuuaguggcugaaaaauauccugaagagcaucuaccauuucccugaacuugcccaugagauauugaaacuguccuagugcugagggugcacccauguaccagcuggcuggccucgugcaagcuaccuguggagacaggaacagugcccaccucagaggguugcuggaagaauuaaguggauugauccacauuaaacacuuaagacagcuccuggcgcguacugagcccugaauaagcggucaguguuguuuuuuucagaagcagagcaaugaagaugcugcuugcccugcugggacaggggaaagcccagacaucucccccuuuuaggccggaauuauuaagcccauuuguugggcgagcaugcggagcucaaacagcauaagccacgcgcccaaggccuagaccccagguuaacugacuccgucacauccgaaaauguuggaacuuacuucccugcaugaggagacugugggucagaggcuuguugagugaccugccugagaucacacagccagugucagccugucuccccagagcuucugaaguuuccucuggggcaggcacauccagucuggucccagcugcaccaccuggacgugcagaacuucgaacaggccacucuuacuucucugagccucgguuuccucacuuguaaaaugggcauaguaauaggauguacacacacugugguucugcacacgaacugagacgauuguguaaagggcucagcccagugccugucccagggaaacagcucuguaagacgucgguguugauuaguacuagcugccuagaagcugcagcaaaccucagguccuggguuucagguggaggucauccucucugggcauuuuagaaaaaggaucagguucagcuucucaguuauucucuacccuaacagagauuccuccuggcaagagaguucuuagacgacuauuucuuuuaaugaugaugugacugaaagcuaccaggaagaagaucucaagucaaucuaaggaagaacucaggaacucucucaccaucaauuggacaaauuggacaaagacaccaugggcugccccacagguaguaaacucuccauuccuggagguacacgggucaaaagugggcaccagcuuggaagcgcugcuggagagagggagugcaggcacuagauggggagcugacccuuuaagguauuguccaacccaaagccucugagucuauauuuaggugacauuaauggucuuuugugagcccagcuuccuggggcugaugccgagcagggcugacggugcguaaagagaacaagcagccgaguagcaugaggagagccugggcuggcaucccggcucugucaccuggagcugaguaacccuggcaagucaccugaccucucggaggcuguguccuugcgggaaaugaggagauacgaauaguacccacuuuucaggguuguuaagggcacaugaugagccagugcaggcggcaugucugaccaacugccuggcacauagugggccuucaacaaaggucagcuagcguuacuauuugaugccauuuucacuccgccagccugaaaucuugacaccaucuggcuuuuccgagugguuccaccuucagccacagcugacccugguggacgcuguguuugcuuaguuuuugguggagccacaaagcuggcuauggguuuuauucaggacugggcuguuuugcccacucucuggugguguggggggcuggggaaggucuccuugcacagacauugccuucagcuaccccagccagcggcccccagccaaccacaagcaggcagaaugaggcccccugggaaagaaaaagagagcgucucuggggccuggccuuuuuggguuccauucccauuaaaacagaaacagguuugcaaagccaacaaaaaacccuggccugucagacagcagccaucagaucaaggaggauuuauggugugugcgacucccaggguggagucaggguucuggcugggagauaacaucgcagaggcacacccccaccggcagggccccucaggcccccuggacagggugggacggguaggccaccggcaugccaagguucccuccugugggaaaucagaacugcguggugaggaguggggacaggagccuagagggggucugccauggggggcgggguccacaggcagcuuaccgcauuccucagccccuucaggucuggggucuucaacaugagcgcgucaaacaccuccucagucucccuccgcacauacagcagaacugaaaagcaagggccagcuugagugcaaggaagauaaugugaacaggaucaucucaggggcuggggaaucugaaaacguuacuugaagauugacuucugcugcgggucuuugcccagcugggaggcccuuuggccggcucugcagauucccaugcacccucuuaagcugugcuuaugugggggugucugaaccccugcucuacuaccugccagccaggugaccuugcaaacgugauuuuaacaucacggagccugauuuuauuugcauguaaaauggaggcucuguccgcuguuucguagagucauugugggaauugauggcagugucuggaaacacgaggugccacgcaaagcucgauucauggcugcuggaagcuuuugagcuuagcugcuaguugguuucuuccugauggccagcuacagcccccagagguuugggcuuguuccccaccccaaggaaguaacagauuuagagggucaaagcaagaaagccagacaucaaaaccccacccuucucccacuccccaucagaaaaagugggagaggggggacucgcccagcauaaucagccugcugacuaugccagcugcccaggacucccacguccacacgaggucaggagacagaagccgccaguccugugguggucucuccaagcagccugagguucccuccuuacccccacccccaagucuuaaccuaaaccuagcuccaagggguaaggcagcgccucgugccccaccccaaggaggcuuugggaaagcccaugagggaggugggagcuggggugggccuggugaguaaaugaggagggcgggaggucaccucucugaaggucgccuuccuuggccugcuuggagggcagaggcucaaacuccucagugaagggcgagcagguacgcuucagaggcagccuguggggauggcagugggggagcuugugagaaacuuggggaccccuagaggcucaaggacccugcugggccuccaggggcccuagaaauggggaagaaaacacaaggguggaugcaaagcagagggacaguggggguaaagcagcaggucuggaguuggacugccuggguuugaaucccagcccugccacgcacuaggugugugaccugggugagucccuuagcccaucagugaccccauguauaaaaugggaugaugagaaagcaaugauagcaauacuucauagagggaugugaggccacaggagaccaugcucacugcgcuuagaacacugugacgcacaggagggccucaauaaauguggacucaucgucaucaucaucguuccuuuuuaaaagaagucaggucagaugugaggcgggguggggggguggaaggacugggggcuuuggaguaagacaggcuugggguccaguccugcugcggugacuuucacagcuagaaggcacuucacuucucugagccucaguuuccgcauccauaaagcaaggcaauaacccugcuugccuaacucugaggcuguugugaggugacaagugacauaauuuggggugaaagcaccaagugaaaaguacauuuuguucauagggaagaaacugaucauaacagcaaaugaucuucauaaagugcuuucccacuuacgaagauuccauauccacaccgcccuccucacccucucgaggcuguuuuccucaucugacaaauguguaggcugaggcucagagaggugaagggacugcucagggcacuaaggcugugacugacagagggaaggacacaaaggcccuuccuaggccaaagugucaaggggugccggccccagcuaggccccccaguggggguguguuggggaaggagauggaggguuuucauccccuaagccuccagcacagcuucccucuucucucugaaucugcaccaccacagacucuuuuccuuucccuuuuuacaagcgggugucucgccagagauucgccgacuuuucacauaaaacaaacccauaaaaacccaggcaguuucagugagaaagaagcauggaucuagcuugggggcugggggcagaagcugguggcuuccuccucuggccccacacccuagcuugcaaggaacagggagaaaagcaggcugggggcaaugggcaugguacagugggcaugguacagagggcacagguguagaggggguacagguguggcggaggcacagguguggaggggcacagguguggagggggcacagguguggagggggcacagguguggaggcgcacagguguggagggggcacagguguagagggggcacagguguagagggggcacagguguggagggggcacagguguagagggggcacagguguggaggggcacagguguaaagggggcacagguguggaggggcacagguguagagggggcacagguguggaggggcacagguguggagggggcacagguguagagggggcacagguguggcggaggcacagguguggagggggcacagguguggagggugcacagguguggagggaggcgugugguuguuucucuccauaccuguuggagcugcuggguccugccgagggggcugccugcaaugaagugaaaaagacauuuuccaucacacgcaggaaaaugagaggagccccuggcugcuggaggcucucugggaggaauauuuuuggugggagguggggagaauacuguuacaaugccuuucuagcccauucugcucagacaagugcccuuaagugaccugagauguugaguggaaaggaaucacccagcccgagcuggaugggucaaggacucaaugaacacacaggaggugcuaaagccauguugucagagcagagucacacugagccccaccugggccccagcaugcccagaagggcugggaauugcagaugguccugcggccgguaacuaggcaguuggagcugagggccaagggagcaagggcaacagggcuuuuuuuuuuuuuuuuuuuuuuuuuuuuucuggggggaaagagucucccaggcuggagugcagucccaccaucacagcucacugcagccucgaccuccugggcugaagcaauccugcggccucagcuucccaaguagcugggauuacaggugugugccacuaagccuggccagaggcccucuucuuggacccuacagugugccuggcacugugcgguguggggcaggcaucagucagucuugugagguaagaagcugaggccuagagagagcagagagcucuagagaugacacgcccggcaggaggcagagucaggguucaaacucaggcucucuguuggcuauugcccugggcuuccccucucccaggcucacagguguggagacuggcccacccucaacccccacagguugacugucaaccuagccacaggggccuucacccugaguggucaucuccuuacugagggccucuaguuggugagagagugaggagagccaagagagaacagguucacacagccgccugugcugcggggccacagcgcagcucccaagauggcaaagagaggagggacacagacagugcucugcgccugugccaagcucugucagcacuggccgcucuucucagcgccacugucuacaccucauuguccuaagucaauacacuaaacaugccuuguacaccaagguccauuuguauaaauauuccugaagaaacagugcggagcuguacccuuaaaggaaggaaaugcucagacucuccaguauggaagcgcacuaggagacaggcucuggggucuugacccugccauugaauuguugugggaccgugccuggaaaaggggguaggugcagucucucggaggacagcuguaacagggaacccagcccacuccuggcugccaggcgcucagucccggcugcuugagaggcggagcagcuaguggggaaagguguggauucugaacaggugccucaguccagauccuggcucugccacuuacuagcugugcaaucucaggagguuucuuaacuucucugugccuccauuucuaccccacagauccagggagacauuauuauugacuucccagggcuguagagaaggguaaggacggugaugccugggaagcgcucagagccgcaccuggcacacagugagcaccacaagugcugccgugagaauuccauggggcugcaaucaaauuuggggucagauaucagaagccuccucuuugugugcccuaagcaugaacguuuuaaugguuacgaaaucuguuucuucauaacauucuucucuucaauacaauaggucacugaagcuauaggaccauauauacauguuuaaaccccuaugauucaauaaaggucuugaaacuggcugaggggcaggcugcuccccacuggucugugcuaaggcaggccccaccuaggagccaggacccucucucggcuccuucccgagaccccagcccuggccucaccccuccagagcgcugcaggcuggagaagugcacauuggggaugaacagcacggguggcgucuccaggucagucucuggccgaagguaggucgucucauugccccugaagcccgacagcaggcagcccuugacgccugaugggagaaggaagccaaugugccccgaggucccuccacucaagucccucccaccucuggucuccuucuccccuucacgccagccgagcccacccaggcccuggauccccacugaccacuguugcuggagucagggcacuugaccuuccuccggaacugcuuccgcucgucaucgcgcaucuuccucucagcucccugcaggggagaaggagagagggucaccaagggccugggaggggcuagcuacuuucacagcugcugcuuugcaucuuaaauaugggccaagcuucugguccuucuuuuuuccagaacaagaccaggaaaugggaagguaccagcacuuaccuggcccagccuggccaguggggccuggcccugcuugccugaggucacuacaggccaugagagaggcggacagacagaagacagaaaagaagaaacucagagagacagagagauggaggaguggggguggaggaggagaggggaaggaggagaagggauagaaaaacagagagagacagacaacccagagaagcuaggaggacgcacgggucaggguuuggcccuucuaccuccccgggacccaguauagggucugcccaguccagccaccuugucacagaagaucuugaucuggcagacagcacgguguaccaggcgcucagugcccaagccacagucauaggugucaaucugcagguucagggggacacccuucacccccuuuugugaggaaaagucugugcucagacaguuuacgccgaugaacaccuggagacagagggggccgcuggguaaguggccugcccagguggccagccccaccgucccacagugauccuguauuucuagcuuucugugugccugcugcucacccuuaagccucacuaggccccuagaaggcaaacaucagcacuccucuuucacagauggggaagccaaugcucagagagguggggcaacuuucccgaggugacacgggcaguguguggugcagcagggguuugaacccagacucacagcccaggcuuuucaccgcuguugguacaguuuccgcuagacugccaagggcagcccaagggguggagacugggggggaugucaagaguccuauaggagcuuaagauccagagccucguuuuucugcaacucaggacaaggagguggaaaagggcugaguccccuguccccagcacaaggagaccacuuuccugcuggcccagagacacagccccucuccaccccaaccacccacuccagccauagcaggacccucuagugagagguucuuucagcugauuugaucccaccccacauacagcaagggagcauccuagucaccccaucuuacagccggggaaacagaugcucugagcagggcuauaauugcugccguuccccuagggagucaggcguggggcauaacaaagugagccuggaggaggggccgcccacaucugcugcaggaagcugggcucugccgcucacuagccauauacggcuucagacaaauccuuucaccucacugagccucgguuuccuugucugcagaaugaggauaaugaaaccuaucuuguguggcugugggguguguaggcuugauauguuauaaccguugccaugagagggacagcuggaagucucaucccaaagccuaugcccaacugauggucgccuggggucagucucagcggggcaaacccuggcaaggucaccuggugauuguccuccucuggggcuccaugggaaccccgguccccccgacgcaggcuggccccuggucuuuggaacauuuccuuuggaaaugacccugaugcaaacaggaugugggggggugugucugagcagacccccuucuuucccuggcugugcagaccaggcccccaggcacaugccagacauaccucccccucagccagcucugcccucaugcagcccccgcccagcucgcaccugagaaagacccaagccugggggcuuaaaaggcugugagaaaauccccaccgaaacccaucucucccuucccacgaaacuccccacucccugaacccaaggccccagcuccuccuccagcccggugccagucugaauaauaauaaucccugccuuugugcucccuuuguguuuucugagcuccugcaccuccaucuucuccaggcagccuggccaucccuggaggcaggcagggaggcagggguuagcuccccagccucuccaggccagaaaugccccugagaugagcuggaccugacccugcugagugagguaagccugguccagggaggggaagggacaggccgaaggugcucagcuccugacucccacacuagugccucuccaccaugcuggcucucuaaacagcaaaccaagacacagcgaggcccaugcgcacauggcaagcccgcggcugggcucaagcacuaaggcuggaagaaucuuaauggcuuaacuacuggcaugaaaacaucaccagaggcuccaucucucaggccucuccgguuuguagacaugcaugaucuugugggcucugcacuccaauccuagcaggcagguuacuguucucauuuuuacaggcucagagaagugagauaacugggauucgagcccucauucaccggacuccuucgcauuucuccugcaugcgacauucugcgcuggccaagaagucaggaaacgugggugcccccaguggcuugcugugugaccaugcaaaaggcucaguuuucccaucuaguaaauggguggacuggaguaauaucaacaguugccacuuuugggccaggcgugugcuccaccuuuuacuuaucucaccugcuccucacuacaaccuaccaguugguacuaugaugccacuccuauuuuauagucaaaacaacuuaggcucagagggacuaaggcacugguccaaagucacacuuuggaccaauagguggaagggugggaugcggacccagccugccuggcuccaaagcccaagcuuccauacuacacugcauccugccuccuccaugagugcccucgucggagcaaaugacacuauccuaggugcaagaaagccucuaccccagaauagggacuuccaggcagcccagucccaucccagccacugcccucagcacugaccuuggccucuucauucacguuccacacaaaggacagugcauuauaggccaccuccucaaugugcuccacaguguugaaguuuucuuugcagucagcugaaaccacaggagaccagaaggagaaucaggaaggaagggaucugggaccacuugaggagggaggcauuaaaaacugggccucacucggccgggcgugguuucucacgccuguaaucccagcacuuugggaggccgaggcagggggaucacaaggucaggagauggagaccauccuggcuaacauggugaaacccuguuucuacuaaaaauacaaaaaauuagcugggcaugguggcaggcgccuguagucucagcuacucgggaggcugaggcaggagaauggccuaaguaaaccuggaaggcggagguugcagugagccgagaucgcgccacugcacucuagccugggugagagagcgagacucugucucaaaaaaaaaaaagacaaaacugggccucacucuuggcaggggcauacauucucucccccaagaaccacacuucaauccagggaggaaaagggauuccugugcccuggauuacagaugggaaaacagguccagccugagaagcagaucugcccaaagccccagagggaaucccaagcuuugccaaauagucucaucauguuggggguagagguuauacuuuucaccagggcugugauuugggacuucucccagaugaagcagcagcagcaguaugguaauaacaacaguaauagggggaguaagagcaguagcaaaaguaguaggacuagcaagugccauuucuucaacacuuacaauaugcuaagcccucaguucauccuucacaacuaugcuuugaguauucaguuuacauaugaggaaaacgaagcucagagagguuugguuacuuggcuaaggucacucagcuaauaaaaggcagaauaggggcugaagcucagaucugucuggcuccugaacccaugcuccucacugcuaugcuauccagccucucggacaagucauuaaacagucccguguguaucauguuccccagggcacauagcugcuaagcugaaaucagcauuguaagcaggcaaggcagcuggccucagcccauuugagaguugaacaaacugaggcucaggaaggugaggugacauagaucacacagccaggaagggaguaagggagccagaagcugaagacuugagggcgggcugugccucccacuuguuucagggcuagggauggggaccagguggcccccacagggagccuuucccccgcccagcucccaaaagcugaacguccugugcugugccucaggccuuccgaaccugcugccugcaccuuaucuugugcauuugugucuucaucagccuccugauggagacaaacaggccagcaucgcaggagccuauuuaucucacacugcuaggguccccagggcccuguuuaucccaaagcaauacagaaaagacgccacaacuucuagucaacagaugcaaauccuugcaaaccccacgguguuugaccuggagacagaggucagagccagguagggaaacaggggugaguaagaaaaaggccugauugaugcggggguggggagagagaggggagcuggaauggaggcuugagaaggcucucacccacgucaaugacccgcugcuuggcaguggguugccgggaaugccagugcuuccagaagcgcagcugcucuacugggaccuucucauugucgaagacaaccaucaccacacucugcaagcacaguuggucacagucacucccggccucuuccuagagccugguuccaauggccugcccuuuugccucaguuuccccaacccuguggcaaugggcuauuaucaaacagccuuuccccaggguccguggcuagcccaaggaggagguauaucuugccccauuccaccccuucugaagcugcuccaggccaacgcaccuugacuuuguuggaggacaaggcaaggccuuugccaccugcugggguccgcagggugacgggguagaacuggccuuuguugagguaggccaugggugacucgccugacuugauguggauggcuuugggggagcccaggguguauucaaagucacugcagggaggagggagaggacagugaggcugggcucccaggcaggaagucuccuagagggcaguggggcaggaagccugaggcuauguuacagacuugcuguuugaccuuggaaaauaaccuuacuuccuugggccccaguuuccucaauuuggggguucuauuuaauggcuuuguugagccacaguccugcugaauaaugagggcccaaugaaaauuagagagaaccuugaggggugacaaaaccagggaaaacuaaggauaaaagaaccucaguuuucugauaagguacaaguucugagcucccuaucacagcccggggacaggaugugggaaucauucugucucccucuaucuaucugccuucaucccccacuucucauuaauugauugugccugcuaugcucuggggacaguguggggcucugucugcagccuccugcccacugcccaggugucugaggguccagggagaccaaguuaccuuuugaggcugggguaguccucuggacauggggguuccggggagguuuucaggauaucugggaagagcaucgacugcagagaaacacagccccaagagaauaaaugcucacauucacucugggaagccucagcccagggcugugcauuacagcuaugcagguuguacaguguacaacuuggacaauaguacauggcaaucccgucucagcucuaggaugcuuucccccauggauuccaaagcucugaucuguucacuaucuucucucauucuguauaugcacacacauaucuaugcuauaggggagcggggaugcgcccucaccuccugugggucaucuuugaaggugcugucuggcugccagcgcugugugggcggcaccccaugaaugcucucaaacaaggaguugagggagccauuaucauacauaucagugguggguaacagguagcuguccacagagccggccuccagcuugcuggggccugcagggaggggagcugccuugccaggggugggcaaggcccccuccaagcucaucagguuauucuucuugagcaaaucuggguacucugggguuccagacacguucucugucaggaauuucaugagguguguggggcuuucaaggggagugagguccgucucauauuccaugccaugguaguaccuggggagaaagaaaaggggcugaguguacuucucucuggggguaaaggggggucuuuggcuagagugcaaggcaacugacacacuggccuuugauccaguguaauguuuagguccauccagcaugcacgaaauaagacacuguagcagcccaauuggccacagggaugagcagggaggugcugagaauggaaccaagcacaggcucaggguuaagggagcaacaucuguuuuauccauuacaguacuuauuaaaaaaaaaaaaaacccugaaaguuuaaucguuuauuuuuagccaaagucaaaugucucugugucaaaacgucccuacuucaaaacaacuguauugagucaacccuagcgggguguguacaaaguggggaggguggaagaaacguguaucucugaguacaauuaacacauguuuaggaaaagaucuggaaggauguaccccaaacuguuaagcgggagagggguacaggauuauaggaauuuuuuuuuuacuuuauacauuucugaagaguuugaaucuuuugcaagagacugguguugcuuuuguaaucagaagagcuaaugauauuuuuaaaaauuaguuuugaguggcagggcgcgguggcucacgccuguaaucccagcucuuagggaggccgaggcgggcggaucacgaggucaggagaucgagaccauccuggcuaauauggugaaaccccaucucuacuaaaaauacaaaauauuagccgggcgagguggcgggagccuguagucccagcugcucgggaggcugaggcagaagaauggcuugaacccgggagacggagcuugcagugagccaagaccgcgccacugcacuccagccugggcaacagagcgagacuccgucucaaaaaaaaaaaaaaaauuaguuuugagaaagguccccauguacccaaacccacuguuccuggcaguggaggggacuggcccugagccagcugcaggcccaggcuggguuaugagaugagcugcaaugccuguuugaauuuuucaaaaggcuucccagcagaggcccuacagggucauuugugagaagucaccugauuggccaggaaggagaaaguggagaaagagggacaaggucuuuccagugcccaucuagucuuaagcauggccugggccgcuuucuaaaggaaaggaacaucaaugcccuggggcacuaaugccaggggaagaaguaugggaacccagaugucccucccccaacacaggucucccucccccaacacaggucucccucucccagaggcugugggucuucaggggagaggguuuugaagcugagaaagaaaagcuguccccagggcuuuucuauuacuaaggcuuugaaguuuguuuucaguaaacuccagcccacauggccuauaggcaucuggggugugugucuguguguguguguguguguguguguguguguguguguguguguguguguuuucaagcugaguuucauuaggacuuucaagagcccuaggcucugccuucacuggccucuuccaaaacauuuaaaaauaucuuuaguaaguacaaugguauaaagaugaauauaauccaaguuggauuauauugauuuuuuucuuuuaauuuuaaaauaaaugaaaacauuaucaugaaucccaaaauguguugugggcccucagcacugugccuccugugccuaauggauaagucaaaccuguguggaagaggcuccagguggagguggggaagggcaaagaggcagaggguguuggcaagccucaccucuuuccuuggucauuccugcccccagugcuggaggacaauauccgcuucuccuugggacccugagaagagagaaaggaaggauuuaugcauggcuaagcuucugcugguaggagccucaauccccuccugcagcuuuggccaggcaggggaguaacuuuggugauaugguucggcuguguccccacccaaaucucaucuugaaucguaguucccauaaucacaugggagugggagguaauugcaugaugggggugguuacucccaugcugcuguucucgugacagugaguucucaucguaucugauuauuuuauaagagggcuuucucccuuucgcucgggacuuuuccuugcugccgccaugugaagaaggauguguuugcuuccccuuccuccaugauuuaaguuuccugacgccucccuggccaugcugaacugugagucaauuaaaccucuuuccuuuaaaaauuacccaguccuggguaugucuuuauuagcagcgugagaacagacuaauacacuugcucacuagaaaacccuccaguccuucccacuggcuggagcucuagcuaugauuagucugagccccaagucagggagugggaagaagaaccucaagcuugauaguuaaggagcaugaaauuuggagucaggcaggccuggcguaaguccuagaaaugccacuugaaagugcacugugacuuuggauaaaugacuacaccucucugagacucaguuucuucauaugucaagugagugguuauaauaccuacuuaaaggggauuaugaauauuuguuaauaaaaaauacucccuuuuuuaauagaguacuucauaugggcuaggcauuguacuaagugccuucucaucucuuaauccucacagucacucugagaugucuacuaguaucaucaccauucuauggaugaggaaaugggggcucagagagacucuauugucuuaguacuuacaagcauagacucugaauccagcuuucuuggggucaguuccuagaccuaccacauacuagcugugugaccuuacacaagucccuuaaccucuccauuccucauauccucaucuguacagagaucaucauauaauaccaaacucagggggucacuuugaacacucagaauagcaccuagcacauggagagcacuauauaaaugugaccuuucaugaguauaauuauaauauuguuauaucuuagaacauucuaaugcauuugucucuaaggcugauacagcuagaaccaggaccccaacccagcauagccuccaaagccuguacucuuaaucaccccaagagaguaugaaggaaagugccugacacagugguggacauucaauaagaaaugguaagcaguugccuuuagcacuauauuacccgaagccagauuuguggcaggacuaggucucaaauucccgacuuggugcuccuuccacaccaucagaccaugucaucacuguccagggggcugcucugaauccagagugcucuggaauggggaggccagggcagguguaucucacugagacacuguacuucgcuaaaaccaguauuaucaaugucaccuucagagccucucuucuaccauacuggcccuggaauggcuucuugccaaggggacaaggaguuggauuguaucugauggucgauccucaaccuauaaaucccaggcugcaguuugaaccuagaucuagaauucuggcuccuaccauggccccaagccaaggcagccauucaaacuccucuuccaucgaccugggcugaacacucucuggaugccaccagucugccggggaggagggagguaggguaaccagaccacuccagaaggagaaccaaagccagaggauaguuuugggcuuucuccuaucuggaacccacuuggccucucaguucaaacaaagaauuugccuuuauucuugagguagaguggauaaaacacuucuugggcuaguaaguuugaggucuucuguacaagguggcuuuaaaucuucaaguuucucaauaauuggcuagcugugugcccccaucccccaaucuaggaaaguuucuuggagcaguuacccagcccagggacagcaagucaguuugcugucuugugacaauucagacagauaaguagggccuaccuggauuacuacauugacaaagauucugcagccuccugugcccuucaugagaaugcaggcugcaauccauuagcaaugucuagcacacgcacuggaggugggagggggguugugucauguguuauacccucgugauuccugacugguccaaccccuacuuaucagauaugggaggaccuaauuccuauucucaggagcugacagccucucagagacaaggccaagacccuagaaguaguuagagaacaguaaaagacauaauggcagcuggaguaggaaagacaguaagacccucaggagagggagaugagguggcagauggcuucuaagagaaggugggccuugggaaggccccgaaggaagggaauggguuaaagaguaggagguauacuccaggugguggggcuguaccagguagguugggaugacagggaaacguaagauccgaggacaggggcaaaaagaagauggugggguaugagaguguugcugucacagaaugugcuuggaccaggcaacgagugggucaggcacuguccacuuggucaacacgugucacagacuguguggcaggcuguauggugugcugaagacucaguaaugauccucuaggagcuuagucucgugcagaagauggaagaaauaaauguguaaacagcaagccucuaagcauucuugauggcaucaaggacgacgauggugguugcugagggcacccagacaagaaagccuccucuccagugaaugaaugaagugacauuuaagcugagaccccaaguugagaguagggguuagccaugggaaagggagggugccaggcagagggaacagcauugugcaaaggcccagagaugaggggcugggguggucauggugggcugcugagccaugaggccugaagugaagacacccauucagucaaaacggggcauguccagaggggguagacguaccauguaguaaucauagaggaagcucaaggccgcaacacugucaucaucuccauugacucucaucauggccuuuguggcagcugucaacggguuuucuagguacgucuuccaggccucauccucacuaguguaagagaauuucugcaaguugacugggucguucuuuagcagccgcacagaccugaaacugaaugcaaguaaggagagucaaauuuaggcuaucccagaggaagguccgugaaugggcagccgcaggccaacgcccaggaauucagaguuauuagcuuugaaaacaugaaacugccucuucugccaccauuaggcaguguggggcagcagaauggacacaaacucuggagcuggaucgauuccaaauguugccauguagaagcuguugaccugggccuuaguucccucuuccacagcaugaaggccaucauccugaucuucaagacuacagaguggauucaauaaaauacuuucauagugcguacuuauucaaagagaauucguguaaugaaugggaaaugccaaugauaagcugcaaugugauacgaauaaaauuuccagauaacccaucaugaguucuacugaagaaguuguccucaagacugugaaaggcacagaaggcguagaucauuucaagucugggagaaagcguggucuaugacagagagagccagggcgaggaagcccuuaggcagaaccuggucugggaaauggcauuucaggccaauuuuauuguagaguuuugagcaguugcucagaagccaggaacuggaguugaaggcugcagggcacacagaggcaggaaggacccggguacuggugcugagaagcuuggacaaauacaaggcauuaucucgcucaagagacaagccacaagggcucaaaggaaagagaucaggaaaggcuuucuggagcaggcagacauuuuaguuggggaaacucagcacuggggauuauuucacucagcaauguggggaaggagcagggaccuaacagaaaaauaagaauggaaaaauaauagcuacucuuuauugaacacuggccaugcguuaggcacuagcuaagcacauuucauaaauuaccauguuacuugaaacaacccugcaaggcagauacuauuauuauuccuauuauacaguggaggaaacugaagcucagauaaguugagaguuguccaaggucccaguaagugaguggcccagaggggauucaagcuccuucagggugaugcaaugguacagaauaauguccucaaacuuuagcugcaugagaaugacuuggaaggcuuguuaaaacauagaucgcuuucacagcagggugacuacagcaaagaacaauguaguguauacuucaggauaucuagaagaguagauuuuuaauguuaucaucccaaagaaaugauaaauauuuaaagugauaaauauggcaauuauccugauuuggucauuauacaauguaaaggugcacugaaaucucacacuguacucuauaaauauguacaauuauuauauguccauuauuuuaaaauuaauuuaaaaacacacagauuguugggccccaccccuggagugucugauucacuggcucuggguggcugagaauguacauuucuagcgauuucccuggugcugcugauucugguagucuggggaccacauuuugaagaaucacugguuauugcacaugcucuuaaccacaaacaaaggcauagaagcagaaaaguucuaguuguguucaauuuagagcaaagaguguaugaagauggggugguccaggcuaugaagagagagccccagagaugaagugggcacuggcuggucuccugguuucccagugccucccuuucuacaugggccaggcagaaucucccauguuagggaccuaagaacaaugccagcugccauuuacgauaaugcauaugaauguucucuguucguuaggccgugcuucuuacaaggacacuacaagguaaggaucauuugcuucgucuguuaagauaaaggaaccugagucuugcagagaacgagaaaauguccaagaucauccagcugguccgugagacaaccaggauuucaacucagccuuaucgagcacaaaggcacacacuugccacgcagccacacugcuuuuccguugaugcaggggugcagucuuuaucacagcagaaaaauguguuugugguaaaacuguggcacaguggcagacuagugggugggcagagaccccuguaaucaggugcaugaaguacccuccugcugccaggccacuagggcccauauccucagacugcagugggaacagcaggccaggccauaccucagcauacaggaggcggcagcucucccagcggcuucauccaggacagugucucccaucccaccaggccccaaggugugaggagcugggcucugagaggaagggagguggagcugucacgcaggaaagagaaaugacagaaacuuuccuguucuaggggugcggagagcgggaggcacacccugaguuucuguugcuauaaaucaaggggccucaaggagaggugagaagaggccccuccucauugcuuccugggccugggguuuagaagaauuuacugagcaaguccaggguggccacccucacugucugcccagcccggagcuaauggaaacucccaaccaacgaggcaugggaaaagcagggaaaugccugacugaucccacccccuggaucaacagggaccaccagugcuuagcacuguuccucauuuguaaacgagucuaauaaaagcacccaccaaauaauaucaugaggauaacgcaucagcacaagaaaaugcuuaaaacucugacuggcacaaaacaaguguguaauucaugcaagccaucacuguguuccaggucagcuuggggcaagacaucaagggguugcaaagugguagaagacaugguuacucugcaagucaguggcaggucugggccuggagccccaaucugcugacucuagggguugaccauuaucagcuuugaugcugugaguuaccuuacccuuuaaaaaagauaaauuuuagaagacaacgauaaagugacaccgaaacaaaagaacagacaaugucugcuauucaccugggugggucucuuggccuauaaggucuccaaucuaucuuguugguaucccaaagucugauuccuugauaaacagcagcuucuguacuuuaaacacuuaccacuggcaaacauagugccaucuguuuuugugugucaucucaucuacuccacacaacagcccugagagauaggaauuaucaucuccuuuuauagaaggggaaauugagacucaaauaggugacaucaccugcucaaggucacucagccaauaagugauggaggcucagcuugaacuuggagcugucggacuacacaguaaagcauucaagcccugugcuagucucuuuucuagaugccuuuccuauucuggaaauuucccuucucaaaauacauugaacuaauucucuguugcaaggcagaaaggaauuucccacccacacaaggcaggaggaaggcggcaagaugaugacuggaagaguuucuggucaggggcugggagucccaaugcccugguucccaugccugcuccugccaccaauaaccucauguucuagaacuaagaauuuggcuucuagaaagucuuaaugaauaagguuaguauugacuuguguguugaauccuaaaauccaagaacuuuuggcucucuggucucuuaaagauuacaaauaaggauugaggagccaguaggugagagagggggaaaaaaauaaguugucccaggagcugauacuggaucaaugugaaaagaguucuaagaaggagugaguccuacucaugggugauagggccagaagaaagaagggaaaccaggggacucccaaccuaugaggucagcuucccuggggccuccacaaacucucuguugguguccuuguccaagacugaacuaaacuaucagaaagugaaaaggaaaaugagggaggagggaagaccugccauggauagccugccaucagaucucuaccagacacagcacaccugaaccugcagcacauagaaggaggcagcaccagggucacaguguauggguuuguuaacuacauguccuuggguaaggcacuuagcccuucuauuuccucaucuguuaaaugggucuauugagugucuucuaugugccagugugccagucagggacucuucugagcacugggaaucaacuaaaaugagacagauaagacucugcuuccauggaacuuacaaucuaauuggggaagauagaccauaaacaaguagguaaauuaguuauuuuuaguuaguaauaagugcuaugaagaaaauuaacauaguaagauaauggagagucaauagggguggcuacuuuacaguaggguucaucucauggguuguuaggagaauuaaguacauuaagguaggaaauguguuuaaccuagagccugccagagaauaauugcucaguuaauaauaaccaucaucaccaucaucaucccagaaccuccaaaugggaguaaaggggauacucugccugagguucuuaaauuuucauccucccacaagccuccugucugugaaugggguucuguucaaaagaaacaaaagagauaguguaauaacaccuugcccaacuuccauuaucucauagagccucccaacauacaugauguguuauuaucccuacuuuacagaccaggaaauauacaauagagauguuaggugaccuguugcaggguacugaaugagugaagccaggacuccuagggucuggccugggaacucuauggcuagcacuuucucaagagggaaaaaacuacuacuuuccaagaagggauguaggagagauuuaaaaagcaauaaaccuggguggcauccauccacguaaccauccaucccucauuuuuaacaaauauuuaucaaguaacuacuaugugccagaaccuguccugggagaauaagauaacgaggucaucccugccgacacggagguugcauuuuaguggcaguaagaccuacaugaccacaaaaacaaacaguuaacauuagaugggugaagagagcuaugaagaaaaagaaacaagaggacuucugaccugccugaacccaagggagugacggauguugguuaagaagagggguggaggggaagagggguggaggggaauagggguggaggagaagagggguggaggagaagagggguggaggagaagagggguggaggggaagagggagaauggagaugaguugggaggaccuuggaccuuccagaucaaaggaaaggcaagaucaaaggcaucagccuggcacagcucccagagcuuguccgccuacugugugccaggugugagccagguacuuugcauaugccaccuuguuuuaaggaaagccagcccacuaaggaggaaauccaagauuugauaaucccucacauuugcauaguguuauauuuuucaaugugcuucucauacaucugucaucaccucugaucuuacaacgccccugucagguagggagggaaguuaugacuguccucauuugaggaaaaacugagccauggagagggccacuggcuugccuaaggccacugagcuuguaccucaaggcaucaggccuagaacugaggucucuggcucccagcauccagaaccuucacagagccgccuccucagagucuccccgucuggcuucuccuccauuuaggagagagcaggcaacaagaucaagagagaggagcucaggggucuaccugauaggccucacuucuugaggccucccguccagucugugaggaagugcaaauugccggggccagugcucugggaggaggggaugggaccuuuccccaguucacuggcacucggcacaacagggguguggugccagcugcuccaugcccagucagccucagccuucauggcuccaacaugccucauucugggcaccaggauggugaaagucuagagugguaaagugggguuucaucccaacaagucucuucugagucaaaaugcccacugcuuucuggcugagcuacuuaaaacccccaauaagaccaaggaaaugcugucucagccaucaguugagaacuuuugguaucauuuccuucuguuagaauccuagcaauuuaggaugcagacagaccucagaggucuaguuccagagaggcaccugccuaaggacaugcagcauacggcaggaugggacucaguaguuaagcuacagaaaagaaaguacucacucaacuuuccagaaggugggaagaaaacccaacaccaaaggagguggucucaagcuccaccaaagaagguguguggcacaggacagauccagcaggcuagaccccacuucccuucagccagagaaggaagaguuccaggggccgccugagcuggguguugacacccagauacucccaaugacuugcuaaauccugccaugagccacccaaccucauuaacagugaucaaucacucucuaaucacccacagggaggcccugacacaacugcucacagaggaaucauuuuccagucagccccacacacgauguucccugggcacgacaggggcgccccaggguucucgugccugccaguggcccaucugguuuucuggguguacagauugugaaaugugccucgucacaugggcugggggcucauuugggggccucaauggggaaauggcagaguguagggcauggcucuguaaugacuccaguuugcaugaggcaguaugaacucaucguuaugggagugggcccagagcuuugcagaccuggguuccagguccagcucugcuacuuacugggugacuuuaagcaagcaaccugacaucucugugccuguuuucuuaccugcaaaaugugaggcaaugagaaugcuaaccucacagaauugcuaugagagcuaccguucauugagggauuaccaaguaccgggugcuggcuaacaacuucuagucauugucuuuguuuuuuacaacuuugugaaguauuacuguuggaagaugcaaugagguaaugcagguaaagcgaucagcauagugccagcacauaacaaugugaacuacuuuuauuauuauuacuaauacuuugugggguaguccccagcaaacugcacaauucacagccuuuuccagccuaugaaucgggauaucucuuccuagcuggcagaaucauccugaugcuuggagauuuccacuuaagaggaacacgcacuaccagcuucaucgucaggacccaggugggcaaguugacgguggucaggcugcagcagacacuuuuaguugcauguaaauuaucuaggugcccuuuccuaauuagagaagaaagugaguuucugcuauuuuaaaaauucuucccuguaugggaauuuuucuuucaugcuauauucuccucuuggugucuugucuaauuuuccuuuucuccccccaucuauuguucaacugaggugugaaagaaguugaaauccaccuguaaacccgggggugccacaucccuucauuuauucacucacugauucacucaacaaacauucacugaggauuacucuguaaauggccacguacugggugcugaggacaaaaaaggugaaggccacugccauucauguggcuacacuguucuguccccuuucggucccugcccuugaaaguucccaauucuugcugaccuccuggaaaagccuagagaaauaccaucaaauaacggagagauaauuucccuucaagacuuucacuaggucaguuguucuaaccuuuuuaggaggcaaaaggaauagagagggggaggcagccagccaggauuauuugcggcauuuuagauaggaaagcugaguuccagagaggggagggaaggcaagagagggaaaggaacucaauuauuucauagagucaggccuugugccuuuuuauucucauacaugccuugugagguggguauuuuuaucaucauuuuacaugggcaaaaacugacacuuagguuaaggagcucauccaagucacccaaucuauagguggcagagcugggcuuaaaacacaggugugaucuuggaacuaagcucucagccugcugacucagcaacuacacugcaggucaguaguggauuugggaaccuccugcuucccaguccucugccuggucuucuaggccaacaguuuuacaacuuggacacgcaucagaaucaccuggagggccugugaaaacacauaacgcugagccauacccccaguuucugauucaguaggucuaggguggggcugagaauuugcauuuuuaacuaguucccaggugaugaugaugaugaugaugguccacggaccacaguuugagaacacuguucuagguguucucuuucaaaauaaugacucccucucuuccccuuaacgacuccaaagguaacauagguuuguaaaauacaacaaauauauaacauguagaaccuacagaaaaauaggaagaauggaauucauccacauucuucugcucagaaauaaccacucuuaacaguuuggcacaucuccucugucuucuuuucagaggcuaagcacagaggaagcgggguggccuauggcugcucggcuaagacccgguuaagaucccagugcuuccgugagaccuugggcaagccugaaccaggucuggguccccucuucggcaaaacugcauuuacacucccaucccgcauuaguuuguugggaggguuuaaagaagagcguguauuuaucaagcacucgacacaaugucagaugcggagucagcgcuccauaaauguuggcugucauuuuuguucuaacguaagagaaagcuggaugaucccaucuggguuucagccccguuuucccucuucacuccuccggugggucagugggagcucugccgaccgccuggcugcggccacucacugcugggacugcgcagccugcccgcucccagcagcuggcggagccgcaggacccccgcgccgcccgggccgccgccguuaggguuggcucaagccucucggcccaguccgccaguuuuacagcccgaacucaaagagggcuuuuaacuuuucauucagcagcagcguagcuccgacuuuuaauaacacaccucgugcacgacaaaaauuugcuccuggcaaucaugguuucgaccacaaaaccacagcggggaggcguuccugauuaacucuuucagcgcuccaggcagucuggagccggcgcuccuggagaucagauagaacggcggcggcggccgcggucaggacugcgacgguucuaguccccuucccccaaccgagucgcgucucugcgaggcugaggggagacuccaggcggcagcgguggggcccagagagcagggagcgaggccgcgggggacgcuccugccucggugccuuagaccuacugugugccaagccccuuugcggcgaaacucucccuuccugggcugucaacggggccugccuggagcgccggccggcccuccagaggggaacaacaggucaccggggaggucgccugcggcuccagcuccccgggggccccgacgcaccuucaggaaaacccgacgcugggcagcucgcgggcgccggcuguuuuccugcgagacccaggcggucggcggcgacuuccggcgcccucggccgcagcccaggaucccuugcgcccugcgguagcccggggcugcccagggcugcgggcuccaggcacccagagcgcugcgaccacaugaaaggcccggcgcucagcacccgccagccaccuccagcugguuucuaacuacaccgccggggccuccaugcuucucagagaccagccuucgaagugccgccuuacacccggggccuggccaccgggcgggcgcggauggagcucugguccacauuugggagcucacaguuguuccugccagguagguguuacagacagaugagcagacugagggucagggaggacaaacaaauucaccaggauccugcuguugguaaguggcagaauuuagagugacaggcaagucccacuuuugccacuauaucaaggccuggccagaguuggccauuccaugagggcccaagcuguaagcuauggccaguccucuuaacuuggcacuuuuuaggagaaugucgaggccgcagaagcaacagcagcucagaacuugcaagccaagcgccgggugcccuccccuuaccaguaggggcagcugagcccccaggcucugccacuguaaucucaaaugguggcuuggaguccgccugcaauuacucagcaggcaacuggcuucccucaccccaccccaaacugagaagccucaacugucagcggaucugacuucaaauccaaaccauuagggaggagaaaagcaagaaaccuuucuguucaaguaacccagcuucagaacacauacccccuaacgugcaguaaugaauagauucugucuguagccuccgcaguuuuagccagcaaauuuaagugggauggagacacaugucaagauuuuuuugcgcguucaaaguauggaaaaauagcaagagguuugggaaugcucauugauugguuaguucuacaugaaaugacaaugguguuacugguguguucuccaccagccuuaaaagcaaucacuauucuaaaauugucaaauccucuaacaaccccaugagguggauacuacuguuggccacuauuuacagaugaggauuaagggacuugcucaacaucacacagcuauaagugcuagagcugggacuugaacccaggugucaguaccaaugcuccugcucuuauucucauugcgguccaauugucaauacauugucaaccccgggaaauucauucaaaagaaaugugccuguuaacccaagugauugugcugugaacaugaagagcugaagggcuagcuagaacauagaauccggucugcagucaggaccuagcacugcugucugcccacagaucuucaaguucuuaaaagucuguugaggagcaguuagaaaaaagaugguacaauccuugccucugcccacucaccucugaggguggcaggaaaaggagagccuguguuuaaaggauucuggcuucuccugccagcucccugaacccaaucuaaagcagcccagaucccagccucacccuaccuucucuaaggucuggaccccaagaaggacaucauggugaagaucagcaucagucagucaggaucuuaaaucucagaugugggcaggaaggcacaugcauccucccagccaaaagaggugaccuaccaaaaaucacuucucaucuuccccagccuuagaacugccucugaaugagaggaaccacauuuuacugaacgcaucuucagaccauagcuuuaugcuaagcauuuuacagcauuuaucacacuuaacucuuuccagaauucuacaaagcauucuuguacccauuuuccagaugaggaaaaugaagcccagaaaaauugaaugucuugucugagaucacccagggacagagccuggauuugaacuuaggucaagcccacuacaaagaguacacaugcuuaaccaccacacuguaaccuucccacuugggacuguuccaacccagcaaacaagucccuuuagagaaacccaacucucugccuaagacagcucuuagaacuaccuuaaagaaguuccuuuuggcaagaagauagaaagccucgaugggauuggggucgucugauuuccaaggccccuucagaggaucaaaaaguggugccagaaaccuucacaguuucagucuuguguuucccugccuggcucgaaacugcucagcaaagagaaugagaaaaacuauuuucccagggaaacacucaccucuagcuugagacuggggcuugccuugacacgccaaaguaagaucgucagcccauucauuuacccuuacaaauugcucugugaaucccggugccggccuccccgcucuucccccuccaggaaaccccauccagccuccacgcucugagagcggcagguauccaccgauguuuacucacucaaguucauucgacaucuuccugcucccaagcuccgacgaucagcacugaggcucugcugaccgcuugucucuaauucuugccugacacagacauucucugcccgggaaaguguuugauuuauguugagguuugggugucgagauuuugcugacagguagguucccagcagcgcuggcgcugauuggcuacagguacaggugccggcgacug

SEQ ID NO: 14174 - RNA, 746 nt, Homo sapiens
uaugccuucaauucaguugcagaguuuugauggagagauauuugcaguugauguggaaauugccaaacaaucugugacuaucaagaccacguuggaagauuugggaauggaugaugaaggagaugacccaguuccucuaccaaaugugaaugcagcaguauuaaaaaaggucauucaguggugcacccaccacaaggaugacccuccucccccugaagaugaugagaacaaagaaaagcaaacagacgauaucccuguuugggaccaagaauuccugaaaguugcucaaggaacacuuuuugaacucauucgggcugcaaacuacuuagacaucaaagguuugcuugauguuacaugcaagacuguugccaauaugaucaaggggaaaacuccugaggagauucgcaagacauucaauaucaaaaaugacuuuacugaagaggaggaagcccagguacgcaaagagaaccaguggugugaagagaagugaaauguugugccugacacuguaacacuguaaggauuguuccaaauacuaguugcacugcucuguuuauaauuguuaauauuagacaaacaguagacaaaagcaguggcaagucaauuguauuagcagaauauuguccucauugcaugugcaguuugaguacagauuccaaaccuauggcugaguuucuucuaguaugaucaaaaguuucuuuuuuuuuuuuuugcucugaauaaaacugaacuguggguucucuaua

SEQ ID NO: 14175 - RNA, 18687 nt, Homo sapiens
ccagccgaggcccggaaggggccaggcgcgcuuccgucuccgccggggaugcacggagggcggagcugcggcccgaggacgcgacgcgagcccaguuccggcgaggaggccgcgccagugacagcgauggcggcggagucggcgcuccaaguuguggagaagcugcaggcgcgccuggccgcgaacccggacccuaagaagguaagcgagggggcggcgcguagcgggaugggcguugggucggugagggccccguaacggucgcggcccgagcguggcgggguucgggggcugggacccugagccaggccccgcggggcuggggucgugaaguucgcggccauugaccgcugcccgcgcguugggaccccgugcgucgggcgucgggacgcggggccccggccgcucccccucccucacgggcccgggaugggggcgcgcccggugcggacaccgcgugccuagcgcuuccucccagaggcgcuccguggcgucccgagccagcuguuuccugcgggagagcgugcccggggcgggagggcgcuggccgccgccucguuggccucccggugccugcgcuggugcccggcuccccgcggagcggcgcggacuccccagcgggugcguguucgcugggaggagaagacgggcgcccgaacgcugcggagccuggacucgcggucugguccgcgccucucggagacgcgguuacuacucuccggcuggauaucagagcguggaccuuucgcuuucucagugaaucccuuucaaaacagaauaaagccucgcgucaccuaagcauacuccugaaaacuuagguuggaauugaaaaagaggcgggggcccgggguuggaagucgcagcuagguuuccuuuuggccauuaauaggaagguaagagcuaccguuucucguuguucgagugauggacaaccauuuuuaauuguaguuaacuaguuuuuguuguuuauuguacaaacugaauauuaaguuaaacgcguucuuguaccuuuucaucuuucugucacucacuucucuggucuccaggagacagucuggugguugucaggauuuuuuuuuuucuuuuuuuuuuuugaggcgagucuugcucuggucgcccaggcuggaguacaguggcgcgaucucggcucacugcaaccuccgucucccggguucaggcaauugucugccucagccucccgaguagcugguauuguaggcgcccgccaccacgccuggcuaauuuuuguauuuuuaguagagacaggguuucaccaucuuggccaggcuggucuugaacucaguugucaggauuuuuuaaguggaaguacaacgaugaaaaagcacuuauguguuuggcauucuccgucaucauucuggccggggcgggcaguucuaggaguuggaacucaguccugguggaaaaggaagucguggagggagggcuagggccgugggggaacugcucugcugagccucuuccucaccugcugcuuccuaggacuaaccugaaaggcuaagguaccaggcugaaagucagugcucagaaaaccaaucgucauucuuugggguuuuuuuucuugaagagccacuuucucuuuaccuuguucuagccuguuggagguaggguuucugcaauuccaaaggccguacacagccucucaccaucagaccacuuuuuaaggcucuucguucauaccuagcucgaagauucacuuccucaggaagccauuuuaguuacaaaucugggaaaacuuaaaaugcuuucauugugccauguuuucuguugcagcuucaguaccguaccuaguggucaggcauacuuacaaguuucuuuuuacaguaaccccuuguggacaucuaauaaauggucauuauuuuuuaguacuaguuuguuuuccugaacacuguaagaucugugacugacguuugauaccuuaaagcagugccauauaauaacuacccacuauuuguucuuuauuucugucagauaaaaauguucuauguagugucuacagucauuuuuuuuuuaacuagaauuuagauuuggaaguaguuuuucuauuaguugauuugcaugaaauacaaaauuaggaaaaggcuuauuccaccucaaccuaguugaacuauuaaugauuuuuuuuuuuuuuugaggauuugggcucuuucuagauagaaaaucacccugaacuucuagcuuugcauugugaagugagcaucaugaagaugagaaaauguugggagaucauuuuugcaaagggcauaauagucggcauucagauaugaguuaacugcagagggaaaauugcaagcugucauguuggccuuguuccucucaaccuucugguaaccuaacaagcuccuacagguuguaugugaaauugcaagaugauuauauagcccuguugaauuuacaaccagaucuugcuuucaaaccauuauuagccaaggguuugauuccacaccuguguucauggauuuuuugguacuagacauugcuguaacucuguuuucacuuuuucaucuguuaucuuggcucacuuaagggagaagguaucagcagccuaggaccacuugguuucuguuuuuauguuucauaguucauggcugauaaaaauuaccuguccuuaggccgagugcagugccucacaccuguaaucccagcacuuugggaggccgaggugaguagaucaccugagaucaggaguucgagaccagccuggccaacauggugaaaccccuucucuacuaaaaguacgaaaauuagccaggugugguggcaggcgccuguaaucccagcugcucgggaggcugaggcaggagaacacucgaacccgggaggcagagguugcagcgagcugagaucgcgccauugcacuccagccugggcaacaagagcgaaacuccgucucaaaaaaaaaaaaacaaaaaaaacacacacacacaguuggccgggcgcaguggcucacgcuuguaaucacagcacuuugggaggccaagaggggcggaucaucugaggucaagaguucgagaccagccuggccaacaugaugaaaccccaucucuacuaaaaauaaaaaaauuaguuggucauggugguggugccuguaaucccagcuacucgggaggcugagacaggagaaucucuugaacccaggaggcggagguugcagugagccgagauggcaccauugcacuccagccuggacaacaagagcaaaacuccaucuccaaaaaaaaaaaaaaaaaaaaaaaggauccucguccuguguuacauuuucacugugaaagcuaccaagaacauuuugauggcaggugacauuaaaaauauuuuuugcuuuuuuggguugaaggauuguacaggggacaacugagaugccucaacauguaccuugcaaauguuugauauuucucaguugccuguuaccaguucuuacaagcucuauaguugguaucuuguuugauaacagcaaguuucgauccaccugaggaugcccaaugugccuuugccuuguuauugcuuuguucuuucuugaaauuuacugaaaauagagggguugugaaguccuuuuuucucuuguguuagacuaaaugagucugaaaaucuugaggguuuuaguuuugucugcuuuuaaaucaccccuaauaacccaaaguaaagcagaaagacaggauuuguucuuccaguuagugcuaggcuuugagauaaacacacccacagugacuuccagccucauccuuauauguuggcuuuguagagguccugggacaccuuuguucccuuggugaccuccuuuacuauguggguucugaacugucuaaugacaucacaggaggaguuuuucugcuuucuugcaaguaugcuaagaaguauaugugcugccgcucuauuuucauuuccuaaggacaguguucugauguuggaugcuucuccuggcuuuacuuaacuguaguagacacauuugacuuuccagcuuguuaagcaaguuaccuaaccugauuggguucaguugcaauaucugucaaauggggagaauaacauccacuuuauagaguugguuagugggaaugaaaugagguaacguguaagagcuuaguguaguagcugacacacaauagaugguaugugaauauucccaaccuaccccuuccaaggaauggcauuaugagagaaccacuuguuuuugaccuuuucagugauuuaaaauuuuccuuuaagugaaggaauuggcauuagucuuugcacccauagcuuggguggcaagaaacacaaaauuuuuccugaguuggaugaugguggugauaggauuugaagugggggauaauuuucacucaucuaugaaggugagacucccuagauaugccacuuggccucuuacuugaucucaagauuaucacuugugauccaauugcucugucuggugaccauguuaaguaaugauugaaguagaaugaccagaaaaacagacuuguuacuccaccuaauagcaauauggcauaccaauuauagucugggccacacaugguaaaagcagaucuuguuauauaauauuuaaaugcaaagguaaccacaguuaucuauuuuaaacuacuuguauuuugaagcacuccuuguaugguaaguauguuuagauacacguagacauuuccuagagaaagguuuggccagucauaacuuuuguuagagcaaguaggaauuggcugaggaauaucugguugaagaucaagggcagaacgcugaaagcugucagucgaugaaugaaaugauaaguauuuagugagcuuucauaguguucuagacacuaugacuaaggacugcacaugguuugucucugaauccucauaguuugugaaguagagacaggaccaaguuccuauuuugcagaugaaguaacugaaguuuggggagguuuuugacuuauucaagaucacucaucgagugacaaagccagauugucaagccugucucugacuccagaacuccaucuuaacagcucugcuguacugauuuugaccuaguuuuaggaacuauaggaaggaaaugugaucaaacccagaucacuuuucuaaucuacccaggcauuuuguguccaccguuaacauccaagcucugauucuggcaacuugaaauuacucuuggcuuuacacuuauguagaagaaaacaauucuguuaaacacuguggcccuucuggaaacaugauggucuuuuccuguagaggccuuuucuuccuuuuacuuccucugugccagguccauggguaauuccccuaaaauugguaccuuucucauaaauucuaucaaaacuagggcaaaaaugauaguuguugauggcuuuuaucagaguugguaaguuuugauucucuucucuacaucuuauuuccccuugguguagcacagugguugaaagcagggaaucuaaagccacagaccugagugaaucuugccccacuugcaucuugggacaagaaacauaacuuuuaugagccuauuuucauacuuguaaaauagggauauuacuuacuacuguaaauaggcauaauacuuauacucauuacuguaaaugguuagcacuaagcacuuaauaaucagauauucuuguuaaagugaauuugacuauugaaauuaauguuuucuucucugcagcuauugaaauauuugaagaaacucuccacccugccuauuacaguagacauucuugcgguaagaacugugugacuuuaaauauuauauaaugauaucccauucccuucucacuggagaguguguagaauaagguuacaaguaugggcuuuggaagugaaagaaaccagacacaaaaggccauauauugucugauuccauuuauaugaaauguccagaauaggcaaauccauagacagaaaguagauuagugguugccaggggcuaggagaauugggaggaacaggauuucuuuuuaggguaauguaaauguucuggaauuagaugguuauaaugguuauauaauauugugaauguucuggaaaccacugaauuauguacuuuaguuaaaguggugaauauuguuaaaugacuuuauuucaaaauuagaauuaaaagaacauugacuuuggcaucaauuagucccagauucaaaucugaguucuaugacuuuaggcuguuccuauguaaaaugggucugauuccugcuucacaggguuauuguaaagacugauucagaacuguaugcaaagcucuuaucuuagugccuaacaccugcccuaaucacucuuguuauuaaaguucugaacuugguacgcuuugcuacugugugucauuagagauuuggggcauagacacaaaguaauuuaguguuaagauuugcaggguauguuguaggaaggaaguauugcuuguugaguuucucaaaguagaaagccuuauuucuuuagaaaaacguuagccuaguuccagaccccucuaacaauuacuuugucaaauuuuaggagacugggguugggaaaacaguaaauagcuugcgaaaacacgagcauguuggaagcuuugccagggaccuaguggcccaguggaagaagcugguuccuguggaacgguaagaacauuucucuuuagguuuguucaauuucaugguuaaauuuacagauagaaaagguuuucuuuauuauuucucuuuugccuucugaaauuguuuugccucaauuauaaaaaauaauccaugaucauuguagaauauuagaaaauauuaaaaauagaaaucaaaauuuccuauuucuaucacgcaaagacaaacguuaugaacauuuugguacguuucuuuuuuuuuuuuuuuuuuuuuuugagacagagucucgcucuguugcccaggcuggagugcaguggcgugaucucggcucacugcaagcuccgccucccagguucacgccauucuccugccucagccuccugaguagcugggaccacaggcacccgccaccacgcccggcuaauuuuuuguauuuuuaguagagacaggguuucgccguauuagccaggauaggaugguuuugaucuccugaccucgugaucugcccgccucggccucccaaagugcugggauuacaggcgugagccaccgcggcuggccugguauguuucuuucuaacugcuccuuaaauggcauuuuuuuaaguugugaacuagauaaauagugagcagcccccauuuuauauaacaaauuaaacauguccccauguuuuaauaaaucuccacauuuucauguauaugagauauuugaucuuugcaucuugugguuaaacucaccauuucucauuuggguuuucccaguuuuaagauuugaguaucuuuaagcauaaccuacuuaucuucuucuuaagaccuuguuguuucuaacucugcaucuucacuucuuuggugaguucagauucugugacuuugucccucaagaagcaagauuuagaccuacuuugucugcuuuuucuuuuauuuuagaaaugcugagccugaugaacaggacuuugagaagagcaauucccgaaagcgcccucgggaugcccugcagaaggaggaggagauggagggggacuaccaagaaaccuggaaagccacggggagccgauccuauagcccugaccacaggcagaagaaacauaggaaacucucggagcucgagagaccucacaaagugucucacggucaugagaggagagaugagagaaagaggugucacagaaugucaccaacuuacucuucagacccugagucuucugauuauggccauguucaauccccuccaucuuguaccaguccucaucagauguacgucgaccacuacagaucccuggaggaggaccaggagcccauuguuucacaccagaagccugggaaaggccacagcaaugccuuucaggacagacucggggccagccaagaacgacaccugggugaaccccaugggaaagggguugugagucaaaacaaggagcacaaaucuucccacaaggacaaacgccccguggaugccaagagugaugagaaggccucuguggugagcagagagaaaucacacaaggcccucuccaaagaggagaaccgaaggccacccucaggggacaaugcaagggagaaaccgcccucuaguggcguaaagaaagagaaggacagagagggcagcagccugaagaagaaguguuugccucccucagaggccgcuucagacaaccaccugaaaaagccaaagcacagagacccagagaaagccaaauuggacaaaagcaagcaaggucuggacagcuuugacacaggaaaaggagcaggagaccuguugcccaagguaaaagagaaggguucuaacaaccuaaagacuccagaagggaaagucaaaacuaauuuggauagaaagucacugggcucccucccuaaaguugaggagacagauauggaggaugaauucgagcagccaaccaugucuuuugaauccuaccucagcuaugaccagccccggaagaaaaagaaaaagauugugaaaacuucagccacggcacuuggagauaaaggacuuaaaaaaaaugacucuaaaagcacugguaaaaacuuggacucaguucagaaauuacccaaggugaacaaaaccaagucagagaagccggcuggagcugauuuagccaagcugagaaagguaaccccuucagccccuugguggcuucccacccagagcaccuggcccugcagagcucagaggauugcccugccacuguuuuccuuagcuugcuuuuggggggcauguugaauuucagugugcaguaauuuccucugggcuucacugguugucaggguauaugguaccgcaaauaagaauuuucugcauuauucucuugugaugggcucaucuguauuuauuuccugacugagguggugucagacaugacuguggcccccuccaaccuggaucuuccugugcaagauguccaguuaaugcucccgggaauagacuguaggaaagagagcugugcuucuacucacugacucuccacccaugggucuguccccugcaggugccugauguguugccaguguugccagaccucccguuacccgcgauacaggccaauuaccguccacugccuucccucgagcugauauccuccuuccagccaaagcgaaaagguaauuuucuauaucuucuuuuucuuaaugggaaaaagauuuaaaaauucauucaaggcaggguacaguggcucacaccuauaauuccagcacuuugggaggccgagguaagaggauugcuugcggccaaggguucuaaaccaaccaggcgugguggcucacuccuguaaucccagcacuuugggaggccgaggcgggcagaucaccuuagguaagaaguucgagauuagccuggccaacauggugaaacccugucucuacuaaaaauacaaaaauuagccaggcaugguggugcgugccuguaaucccagcuacuccggaggcugaggcaggagaauugcuugaaccugggagguggagguugcagugggccgagauuacgccauugcacucaagccugggugacaagagggaaacucuauuucaaaaaaaaggaguucuaaaccacccuggucaacacagcaagaugcugucucuacaagagaaaaaaaguagccaggcaugguggcacaucccagguacucgguaggcugaggugggaguaucacuugagcccaggaguucaaggcugcagugagcucugauugcaucacugcacucuagcuugggugacagagcaagacuguuucaaaaacaaacaaaaaaacuaucaccauaacaucagauuuuugaugcauuuccuaagugcauagacucugaaguuugauggcuuggguuugaaucccaacucugguuucugcaaguuauaugaccuugagaaauaucuuaauuucuuuggaccuuaguuguauauauuguguaaaugggaguuauaaugguaucugccccauagggcucaguuuaaugaauucagaagugaugccuuuuugcucuggguuuaucacauaguaauuguucaguaaauugcugcugcuguuauuagcagcccuuuauccuauguguuacauaggauuuuugucugaaagaaaaaaaugucuaauuuucauagcaaaagaaguagaagccacauaagggucuaucagcaggagacuaacagauaaaucaugguucaucuacacaguggcauccuaugccacaguaaaaaaaaaauguggaaagucuaugcacugacauggaaugaucucucagauguggcaaaugaaaaaaagcaauguauguagugaguauguuauuaauugauucauuggcuuaaaaggaauaagauacauuugcuuuuuuuuguuguugcuguugagagucuugcuguguuacucaggcuggagugcaguagcuccaucuuggcucacugcagccuccaccuccuagguucaagcaauuccucugccucagccuccugaguagcugggacuacaggugcauguugggcaggcugaucucgaacucuugaccucagaugauucaugugccuuggccuccuaaagugcugggauuacaggagcuuauuuuuaaauucucuggaaggaucuacaaaaaucuguagcguggauugccauugggaaagggaaguaggaggcugaaggggguagaaggagaguuuucacuggaucacuuagggccuuuuguguuuuucuugcccuauagcguucucuucaccccaggaagaagaagaagcuggauuuacugggcgcagaaugaauuccaagaugcagguguauucugguuccaagugugccuaucucccuaaaaugaugaccuugcaccagcaaugcauccgaguacuuaaaaacaacaucgauuguaagucacacgcuucucucuagcucucaagcacauuguagcacuuggaccuuaucacuggguggcuuggcugcuacucagugucuucaccuuugguuucucugcagcaaucuuugaagugggaggagucccauacucuguucuugaacccguuuuggagagguguacaccugaucagcuguaucgcauagaggaauacaaucaugugaguauucuguuugggugggaagagggcaguuuucuggcuuguaccuccagaaauagcuuugucccugugacuccgcuguggcugaagggcagaucaguggucagagcauuguucuggauauauuugguuugccacugggccuuuaaacaagcauguuauuagcacuugcuccuggcaccuuaagugggccucuugggcuaggaucagggugggauucaaagggagaagaaaaacacuuaacaucucccuugagcuugccuagucaugaagguaaagggagaauucuggcagcagaguagcugggacccagggcggggaaagcacuuuguguugacacucugacaucuggugauuggcuggaugucucuuaagaaacaucaagauuuauccagaauccuccuuaggauguaggguauacacauuugauugcaucagcugucucucuuuaauucugaaaguucuaugaccuaacaccuuuuuuuuuuuuuuuggagauagggucuaccucuguugcuucgacugcaguacagaggccuaaucauggcuuacugcauccuugaacuccugggcuuaagugauccucccaaguagcugggacuacaggcacauaccaccacagcuggcuaauauuuuuauuuuuuagagagauggacucucagacucuuggccuccugaagugcugggauuacaggcaugagccaacgcgccuggccaauaacuuaacauccuucuuagguugccccuuugccaucacaguucagcguaguguugggaaguaccugauuugacuugaucgcaguucuacccuuugcugauuuucuaaaggaaaagacugauguuacacagauuuuugugauauucugucacagccaccaaaagcaacuagcauagugccucacacuucgcauuuuuaaaauuuagggaguuauuuuuuuccuagaauugugguauuuuaacauacuacuaagaugaagaccaaaaaauuuuugggaaacuggucacuccuagguaauuaaauaaucagaaaaagauaugaggcugggcauggugacacacgccuguaaucccagcacucugggaggccaaggugggcggauuaucugaggucaggaguucgagaccagccuggacaacauggcaaaaccccaucucuacugaaaauauaaaauagcugggcguggugguaagcaccuguaguccuggcuacuugagaggcugaggcgugagaaucgcuugaacccaggaggcaaggguugcagugaaccaaaauugcaccacugcacugcagucuacacgacagagcaagacucugucucaaaaaaaaaaaaaaaauauggaaaagugcuuguacacaaaugauguccugguucugguuucagguauuaauugaagaaacagaucaauuauggaaaguucauugucaccgagacuuuaaggaagaaagacccgaagaguaugagucguggcgagagauguaccugcggcuucaggacgcccgagagcagcggcuacgaguacuaacaaagaauauccaguucgcacaugccaauaagcccaaagguaacagagacgggagagcugggggagaacuggcaggaugaguguucuggucaauagcaggguguuggugggcuuggcugguguaggacugcuugccccuacaucagguagcaggguggguauuucuucugccaccgcccauucuacccuacaagugggguuucagggcacucaaaaagcccguggauuauuuaaauaacaguagcaucucugcucaagaaggcagauguucaucuccauaauuccacaggccgacaagcaaagauggccuuugucaacucuguggccaagccaccucgugacguccggaggaggcaggaaaaguuuggaacgggaggagcagcugucccugagaaaaucaaguaagaucuguguucuuaccuggcuuuugugugcuaucaacccuuagagguagccauagcggcaggaagcaaauugcuuuuggugaaagugaggcagugcagacugugggcucuggaggcagaccucaucagcucagcacuucccucaccucccucagccuccgcuucuuggacugcagugcaaggugauaauuaccccugcccuaggguagucaagauuaaauggagagcaaagccuggcuuaugggaaacauucccuuaugcuuucccuuuucccaucuaaacaaaaaacacauuucugcaaugauuguuauuuugucuaagccacauuagccuuuucaaaauacagauuuauaccaaaacagugaaaaguuaguugagauuaucauuuuuucugaaaggauaauggagacaucucugagccaccaccagaauccagggugauaggguccauuggucaaagccacaaacagggugagucauccucacacaggccagcuucaggcuguucaugcucagggcagauuucuugugcucaugccuaaccaguguuguccuguguugcaggaucaagccagccccguaccccaugggaagcagccaugcuuccgccaguagcaucagcuuuaaccccagcccugaggagccggccuaugauggcccaagcaccagcagugcccacuuggcaccaguggucagcagcacuguuuccuaugauccuaggaaacccacugugaagaguaaguaacuuggaguuccugcucaaauauuauuucagcacuaguuuuuaacucucaaugucauuauucacuguauuacauuuuguggacugcauguugcauguacaugaugccuugcacauagcuggucugaaugucagucccuccuucccccugcuuuguccauagugcauuauaucucuuaaauaguuauagugagucugggugcaguggcucaugccuguaaucccagcacuuuggcaggcugaggcaggaggaucccuugaauccaggaguucaagaccagccuggacaacauaaugagacccucuacaaaaaauuaaaaaauagggcauagugguacacaccuguagucccaccuacucaggagacugaggugggaggauuuuuugagauggagucucgcucugucacccaggcuggagugcaguggcacaaucucagcucacugcaagcucugccuuccagguucaugccauucuccugccucagccucccaaguagcuagaacuacaggugcccaccaccaugcccaccuaauuuuuucuauuuuuuaguagagacgggguuucaccauguuagccaggauggucucgaucuccugaccucgcgaucugcccgccuuggccucccaagugcugggauuacaggcgugagccacugugcccggccgacccugucucuggaaaaaaaaaaaaaaaaaaagugaaaguagaaaauaguaucuggccaggcauggucccugucucuauuaaaaauagaaaaauuagcccaccaugguggcaugugccuauaaucucagguacucggguggcugagacaggagaauugcuugaaccuggcaggcagagguugcagugagcugggauugugccacugcccuccagccuggaugacagagugagacacugucucuaaauaaauaaauaaauaucauugugaaugaccauuuuggcacucuucuuuuuucaccuaaauauaaacugacuucucuaggcaauaccacaguguucauaauuacuaauauuaacagcuaaaugacaggcccucuuacuguuuuuuuauagucuuauaacucuagcuuccaaauauuuauucuuuauaucuaauugggucuuccaauuuauuuauuuauuuuuuuuuuuuuuuuuuuuuuuuuuuuuuuggagacagagucucacucugucgccugggcuggaguacaguggcgugaucucggcucacugcaaccuccaccucccagguucaagcgauucuccugccucagccucccaaguagcugggauuacaggugcccgccacuaagcccagcuaauuuuuuguauuuuuaguagacacgggguuucaccauguuggccaggcuggucucgaaccccugaccuugugauucgcccgccucagccucccaaaguccugggauuaccagcgugaaccaccaugccuggccgggucuuccaaauauuuauucuuuauaucuaguugcgucuauuuuguauuuuguuaacuuuauuaccauagacuauccccaguauccuaaggggauguccuaacuuaagucuuauucuguauuaauugcagggcccaugggagggugggaguccuggcuugagcuacagcuaugcucagaugaaccauucaggaggcaggcuggccuuccuuaggcaguacuugcauagccaccuuagaccuguuucuacacuggacagauuggggguagacgugcuguuuacugguuuggcuauuugugaggcaaaguuaaguuaugacugaguauggccuuuagagucuggcaagggccggggcacagugguucacacacaccuguaaucccagcacuuugggaggcugggguaggagggugcuugagcccaggagaucgagaccagccugagcaacauagugagacccugacucuacagaaaauaaaaaaaaauuagccaggcaugguggcacacuccuguagucucagcuacucuggagucuaggagguagaggcuacagugugcugugauugugccaaugcacccuagccagggugacagagugagacucuuuccuuacaaaaauaaaaacaagaaagucugacagagauugaauuguaauucuguaccuuacuguacaaccaugggcaaguuggccaggcucucugagccuuggugcaggugguuagagagagugguggucaugccccuggcagguccuccgaaagugucugcucugugcuguugcuuuuauugcauugugaacagaggagauaguuacuacuuguaucucugccugguggugcacagccaagaauagcagagcuggcuuugacuguaaacuacugggggugugucuaagccgccacagaucugagacagcugccuuguuucucuuuucacagaaauugccccaaugauggccaagacaauuaaagcuuucaagaacagauucucccgacgauaaacugaggacuugccuuggaaauggaaucuggggaggcaggaauacaaggacaguggggguuggggaauggaauucuacaggagacuggagucuugcuuuguggauccuuuuggucuccgaguccugcagucugcaggugcugccccugggaaccugcgugccacagccccgccucccugccuggagcacacuuuagaauucugaagaugugaagccucugucucacugaggauuuuaaaggucaauuauacuuuuguuguucauuagcaucuuuguaaacuauaagacguaguuuuaauuaauaaauauugcccccagauuguauuuauauuaucccccagguuuguuuuuguuuuuuguccucuaccacacauuuagccuuuuaucuuccagguccuuauuaaaaucagaugaaagccuagugaaagccagucuccugccccagcucagcucuguguggacucugguccagacagaggacugggcaucuccagagccugcacaguaccugcugcacguagggcaaggaaugagcacuagaccgccuguccccaagggagccucaguggggcgacagggugcucggcggacuccaccucaggcccuccccacuguugcugugcauuccugugcaggugcaucucuuucuuacuaacugguauuuauuaagggaggugcucuguaggucuggagccuuucccucauccuuuuugcgaguccccaccuuuuuguuuuuuuuuuuuucuuugaggcucacuagaggacgcagaaccuugggagauugauuugcacagaacuccccaccucccacuuuuacaauuuccaguuucugauugaaaauuuuaggguuucuccccacugcccuucccuaucuuuccuuccccucaacaccaugaaggaaaaacacacacggcagggcuuuuuguagcccugaaggcaacuuuagacauuuaaaauccagcacuuuaaucucuuguucucugugaaucacuaugagaagugaaugguuuuaaaggcuguaaugcuauguuggaaauugguuuguuuugccuuuuauugaaaagguaagaucaugugauuggaagaacacaacuguuggcuugggaagaggacuuugcugcugaaguguuuucuaccuucugaguguguuuaaggcaggauuuggagggaaggaccagcuuagggagagugucugagccacagcgucaggaugggggaaaccacaugggauccaucaaguuccaguugaacaggagcaagaucagaacuuaggagggcagugucagcucccuuguuggcugucaaggaacaccgaucuaguagaaacccacuugguugugacccagguagagguagaugccauacauuugagauaugcguccuuaaggaaccugacaagcagacugaagggaugguaagugugacagccugauaaguuuucucaaagcccaggauacagagccaguguuuucuguaacuggagaccucaguuaggccaacuucgaauuccagagcaacguaggaagucuauucagcagaaacucgacauuguucaguguguauugcugugcagggugccuauugugacaggacacaaauguuacuauguuuuaauuugcuauauuuuugaauggguaaagcauuacuuuacuucucuugguuacuuguaccaccauuccaccccuaucccuagccugccccacaaaucuaauauuaggaagccucuuaacugaaaccaaaugaacauuugggucaggugccagaugucugcugccuagaauagcuuuuucuaggugucuaccaccuugaauuuaucucuuaacuguguguucaagucuuugucauugaaacuaguuuuucauaucuuagauucaguuguguaugauuuaaugucccuuauuaggagucuuuaggcagggagggaagaaaaaacagauuuguucauagcaaugucaguauccauuuuggcacauaaagauuuuugaugagcccuguuugcauagagccagauguuuuccccucccccaagaguaucuacaucagggaugugacuuggugcgaagagucaggggaaagaggaaaaacccaauuucuaaaugaccuccuugcccagcuuacuaaaauggcugcagagcagacacaggaugaauuugaaccugacacaggaugaauuugaaccuuuggucucauuuauggaaaaacuugugcaauuuuuuuucugugcuacacuacauacaaaucaccaaauuacaaauuacccuuuugugauccuugguguacugagcaguuucuuuggggcuuuuucuuucugggaagcgggagggaaaggagcaaggugucauccugcucuucauuuguauuuuggucccaaaauguaaauacaauuuucuauguuacuuuuuugugguaacuaccgagaugaauauuuuaauuagauaaguuauaugaaaaggaaaauuccaugucuaaauaaaaaacaaacuccauauac

SEQ ID NO: 14176 - RNA, 3913 nt, Homo sapiens
uucauccacucagggagcacuggacucucugcugagcccuaaguucucagagauuagaacgguucucuuuacccgagagaaguuaaaguaccuguucacacaaagacuugaaaugaauguaccuagaagcuuuauuucuagcagccccaaacuggaaccuauccauaagucccaucaaccggugaaugaauuuaaaacauugugguagacugggugugguggcucacgccuguaaucccagcacuuugggaggccgaggcaggaggaucacuugaggccagaaguuugagaccagcuugggcaacauggcaaaacccuaucucuacgaaacaaugcaaaaaauuagccagaugugguggugcauaccuguggucccagcuauucgggaggcugaggugggaggaucaccugagccuggaaagucgaagcugcagugaacugugauugugccacugcgcuccagccugggcaacagagugagaucuugucucaaaaaaugccaggcaaacugugguacauacauacaguggaaaccacucaguaauaaaaaggaacuacugauccacgagacaacauggaugagucuccaaaaucauuaugccgaaauaagccagauaaaaaaggguuuuugcccuacauacucuuuacauaaaauccuuaaagauacaaggucaacuauaguaacagaaggcagaauugugguuguuuaggauuggggauggggagggauggauuagaaaggggacaggaagaagcuuuuggggcugguggcugugcuuuuaucuugauuguggugaggguuccauggguguacacguauguugaaacuuaucaaauuuuacacugcaaagugugcaguuauuguaugugaauuauaccucaaaaaagcuguuuuuuguuuguuuuguuuuguucgaguuggagucucgcucugucacccaggcuggagugcaguggugugaucuuggcucacuguaaccuccaucuccugggcucaagcgauuuuccugccucagccuccugaguaacugggauuacaggcaugcgccaccacgccuggcuaauuuuuguauuuuaauagagauggggcuucaccauguuggccaggcuggucuugaacuccuggccucaagugacccgcccaccucagccucccaaagugccggaauuauaggugugagccaccaugcuggccaaacuguucuguuuuguuuuuuaaaaggcucccaguccucacccugcgaaguucacaguggggagguaagggaaggacgcuacaggcacacgagcaacaauaagccaggaaggaauucauuugggaggaaagauggggaagggggagggcauuccuggggagaggcacagcagaaccaaaggcuggaggucaggagccuggcucagaggguuugaacccagcagguggcgggggaugaaguuagagcaccaccuaggacagauuguuucucgucucucuccuuccuucugccccuugccuguccuucggccacaugucugucuguauccuccugcucucuguaccaagaccacacaauagucagagaagccuggucaggacccaggccccaguccucaccuuguggccucccacaggaaggggcccuggaccuucugaagaagcugcacagcugccagauguccauccagcuacuacagguggggcgggggugggaagccuugggacagugccuggggggagagcuggugggggagggaaagaccccuggugggggaagguggagucugggaggaauuucugaggggggccuguggggaggggaucuugagguggagaccucccagggagggacugagggggacacaggggcaucucgggggcggagaggguaucuucuagguguaggggaccucugggccuuggagcaagacugguucgcuuuucuugaauaccccaauucccaaggcccugggccugugggauccaagaggccaaugauccagggagagggaaaagcccccauuuaaaaucccuguguagcccuuaaaguccccagauuuaccaaaagcuccuggcccugaaaaaucagcacagacagaugcaaggucucauagccggagcugcugucucaguugaaacuggagcucaaagacacuagagugagcuggccacgguggcucauaccuguaaucccaucacuuugggaggccgaggcaggcagaucaccugaggucaggaguucgagaccagccuggccaacauggugaaaccccguuucuacuaaagauacaaaaauuagcugggcacgaugaugcacaccuauaaucccagcuacucaggaggcugaggcacgagaaucgcuugaaccugggagguggagguugcagugagcugagauugcaccacugcacuccagccugggcaacauagcgagacuccaucucaaaaaaauagacacuagaggguugggaaugggagggguccugacagucagccaagugccacccccaacccuagguucagguuucaccaaagcuacagauauccuccaugucaggcuuagcccugggcccucggccucgugcagagcagggccuuaguuacaguagugggguucugaccucagccaggagucagggcuaggacucuggggguccagguuggaaggggagguggugguagagcuggggcaggaucugccaaugauggcagccauuccuguguauccauucccagauuaugccuuaacccucucacuuugcagacaaccaggauuggaguugcuguuaaugggguccgcaagcacugcucagacaaggaggugguguccuuggccaaaguccuuaucaaaaacuggaagcggcugcuaggugagagaggacaagguugucuugagcccuguuuuucuccuagcacuugggacaggacugggccuggcucauagccagcacucaguguaugucuguugagugacuuaaucagugacagauggccucuggauccgggagguagcuagugggggacugccaauguuuguguacacaagugcaagauuuguagacuugugaguuuuguguacaugugccacuuacguguuugugcucucaugcauuugucuauauaguacaugucuacaugcacacauuugucuuaauaugugcagagauguguuugccaauguauuaauguccccaugugagacuguguauuuguacacacguuccuguuguuugugcauuuguguguaaauguguuuguguguguguugggagugugugugcagcuguccucgucccugcccuuugcucucuccccacuaagucaugcuggguucugcugagacagagcuuagcugagggacaaugccacccuuuuguuuucagacuccccuggacccccaaaaggagaaaaaggagaggaaagagaaaaggcaaagaagaaggaaaaagggcuugaguguucagacuggaagccagaagcaggccuuucuccaccaaggaaaaaacgagaagaccccaaaaccagguauucuuuuuugggauggagagaagggagcugacacuugucacguccucugacagcaacucaguguauauuaucucauuuaaaccuuucauccuggggaggaagauauugguauuaucuccugcagugcccccucugggggucuucuuuggcucaaccagauguuagacucacaagacccaaauaggacauaaauggcacuggcuuugccuagaaggaugcagggacaggaaagagugcgucugcgggagggccuccagcauuucucuacagagaguucccauaggagaccgcacggcagucuagagcucuucucuggcccacccaggcaacagccuaggugcggggaaacaagaccacagcggguauaagccucacaucccgaaucuuguaacagucccaaagacaaag

SEQ ID NO: 14177 - RNA, 1771 nt, Homo sapiens
cuugcuaggugggguucgcuggggacgauaaccaguggaauuguugguaagaacuuuuuuuuccuauuuuuuuuuuuaucaguaguggggcauuaagugugggagaaugcccauauccuauaagugggcaauuaugucagccuuguagaaaaauaggacuuuaauauuaaauuauuuuguucuuaauaggaacauauaauaacacuucacuuacuuuuaaauugguagcagaucagcaggaaaggccugcaaguaugaaguaaugaaauacucaggguauauuuuaagugagcaaaauagacaccuuauaaucuuaaaaagucucuuggagagacaauaaauuugcuuuaacugucauuucagucuaguauuauauuuucuauauuuuguuggauagauuaacauauaaugcaucuuaaagagauauuuauugcacacuaauuuuagugaaaacaagaagacauugauagaauggagggcuuaaacaccaaagauacuauuuuuaaaaaucuuccaaaguaaucuuaacacuguaaaaugaaacuuuaaaaaguuuuagcaguuugacaauaauggccucaauuuagagauauguugagacaaugacuuugggucaagaggaaauuacauagcugaaauauuaagaccuugaacauagcagaaacauaaaccuaugaacaacuuguguuuugugugaaagcuaggguagcugauaggauuagcagauauugguagaauuaagagucaauauuuaaauuauugcuaaagauuaaaaucccucaucuuauaguuuguaggggauuccaugaugguaagguauagauugaaauuaaauuuaguaacuaggcauuucugaccauaccauauaaaaaauaauuguaauaugguauaaacacugauuaaaaguaauuauggauuuucaugccugaagaaccuucucaguauucuuacagcacuguaucuucuuuauugguugagaauaucagucuagaaagacuuuccuagauguuaaaugugcuagucagugucaugaauauaaacccuuacuuguaaguuugcuauagacuaguuguacaacacuagaaugaaauuauguaauacuuuuaagaauuguagugauugcaggguuguguuaagguaacauuuuaugcaugugucagugacagaaaggaucaggguauaaaacuuagcacuaaauagcaugcuccuuaggaaguuuuaagguaagcaguaggaauauucauguaauucugaugaguuuauguaaguuaaggaaaaugcaaugccaguuuguugacuuuaaacacuaaaaacaaaauacauuuuguggaaccaacaaaggagacauucuggggaaaaacuuaaauugcucaaauuuaaauaagggcucucacuuuauauaguagauuugucaggaucccaugaacauugcuuuucuugauuucucacauaugaggguugggcaaaagggacuucucuagccucuucgauaauguagguagacuuguacuuagugaaucccauuauaauguuagguacuauguucuaagacuauuucuauaauuggacugaaggcuccugcaaacauaaauugcugauauggauauaguaacauaagaaauaccaaaauagggacauuugcaagaccuuuuccauuuaaucaucaguuuaauaaaaaucaugcuuuugguacaguguucauguaccauaacuguauuggaauauuuguacgauguuaaauauuuuuaauaaaauuuaacauguucaaaau

SEQ ID NO: 14178 - RNA, 1472 nt, Homo sapiens
uuuuaggccuagaugucuauuuguuaagaggcaggaggggcucugugugguggugguucuugcugguaauccuagcacuuugggaggcccaggugggaggauugcuugagccccggaguucaagaucagccugggcaacauagggagaccccaucucuacaaaaaaucagaaacuuagcugagcaugguggcacacaccuguagucccagccaccguggaggcugaggugggaguauuguuugggccugggagguagaugcuguagugagcugugauccugccacugcacucuagccugggugacagagugagacgcugucuccaaaaaaaaaagaggcaagagauuaaauuagacacaguuuagucaugccuuuuaaaauaacaaggaguuugaucauuuuaagauucuuucccaugggguaaaggugagaaucaguauugucaaguaugguaacgguggugagaaaaggagcucaguuuuuaaguauguuaagggguaauauuuccuuaguuacaaaaauacugcguuauugcagaucucaauacuguuuaauagaauuuggaaacauuccuguacgcguguucuugggagauuauucuguacuucaguuaggaauccuuuaagucuguaaacuucaguuucagccuagguuuuuaaguagauuaagcaaaguuaauacuuuucuuuucuuuucuuuucuuuuugagacagagucucccugugucgcccaggcuggagugcaguggcgcgaucuuggcucagugcaagcuccgccucccggguucacgccauucuccugccucagccucccgaguagcugggacuacaggcgcccgccaccacaccuggcuaauuuuguuuuuguauuuuuaguagagacaggguuucacuguguuagccaggauggucuugaucuccugaccucgugaucugccugccucagccucccaaagugcugggauuacaggcgugagccgccacacccagccauuaauacguuuuaaaaggccacuauuuuuaucagcuaaaucacuuuugaaaauuuuguguguuauguguuauacucaaaauauuaucaaaacauucuguuuucauuugaaccuauugauuagaauggugcuuauuuauuuggcuguuguucaaguaccugaauuggcuuggucagaaggacuuggguguucuagcuagcugucguauaacuaaauauuuuugguuaagugguacauguuuagcauuggcuugucauuuugaaauuuuuccaugcuuccuguuaagaaauagaaccuuaccaaauuagucauauuuaaauauaaucuguauagaguugguauggaaaacgauuugaucuaaauacaaccaacaauaaauauuuuuauugaaacuuccuuuuaauugaugaguaguaauauggaugucuucauuaguuguaaugucauuucuauuuuacuuuccuaaaugugaaagaaaaga

SEQ ID NO: 14179 - RNA, 3038 nt, Homo sapiens
ucaugcccacuugaucgcggacggaaagcagccccguucagcgcaaaggaggaaccugaauuaacaaggacgcgauuuccuggcugcgcucccgggguaggagguuugcgcugggucccaucccccggccgguccugcucaggaaacgcggagagaaagccaggaaccaggccugccaggcccugcggccccucagcgccgucccuccuccccggcccucggcugcaggaagccggcuggcgggaacgcccugccuggugggugggaaaggccgagagcgcgcccggcaccggcggcuucccaggcccgcggccggcuggcggcgcggagcugucacugcggcaaacggcgaacgcgccggcccccucccccgccgcccgcaagccuggugcagucggcccaugaguauuucaugaagugccgcagccggauucauggcucacuggcgcaggaggggagagaggcugaguccugucaagcgccagcgccccacccgucacggagcgcacgccgcgggggccaggcuggggagggaaggguguccagcccucucuuuuggguggugagaugcugaggccugaggguuucuaggugaguguucaaggucauggcuaguaaacggcagggccaggaugcaacucggggucuguuucauccuaaaguuugugccucgggucugugguucugcuccagguuuuugggguguuuggggggcggggguuacguucuugccgcaccucaagaaccagaguucuguacccuggggcuaccgauguccucucagaggucugugaaccccuuguaauuguguaacauguuguguguguugcauuuuucuucgaaguuucaaaggcgucagugauccaacaaggguuaagaauuauagcccucugcagggcaugguggcucaugccuguaaucccaccacuuugggaggccgaggugggaggaucgcuugauuccaggaguuugagaccagccugggaaacauagugagaccccccccccaucauccuuacagaaaauuuaaaaauuaacuggacgugguggcacacgcuucuagucccagcuacuguggaggcugagacaggaggauugcuugagcccaggaguuugagacuguggugaggggugauugugucacugcacugcagccugggugacagaggccagacccugucucaaaaaacaaaaaacaaaaaaccccccaaaauuauagcucuccaagucugcuuugaggaccccagcuucaugagagguugagguuccucuaugucuauagccucuugagaauauuucugcaaagccccagcuguuacucuguagcaacuugggggccucuacaggaucccagaucuuucuacuggaucuugagacucuuucuauagggucuugagaucucucuggggauuugagcuguuuaugggguccuggugucucuuucugagguucugacaucucacuauaaggucggaugguccuccauggaaugaauucuaaaccugggccucagaaugccuaugaacucccugaaauuguaugcaagauuuugugggucugucuguauacauggaauucuggagacagguuucauggauuucacuagauucuuaaaagaaucugugaucccccaaaagcugggaaaaaauauugcuuuagagcauucauuuggacaggucuuacuccuuucucgucaauaaaagucaaggaaguagggggcugggcuauggugggucacaccuguaaucccagcacuuuuggggaggcugaggugggcagaucauuugaggucaagaguucaauaccagccuggccaacauggugaaaccccgucucuacuaaaaauacaaaaauuaacugggugugguggcgcacgccuauaaucccagcuacucgggaggcugaggcaggaaaaucacuugaacccaggagguggugguugcagugagcccagaucauaccacugcacuccagccugggcgacagagcaagacuccaucuaaaaaaaaaaaaaaaaaagucaaggaaguaaaagguggaggaaauaaaagacagauaagagacaguguuuucuaguagaguaugggcuuuguacucaggcauuccuggguuaaaaucccaauuuugccacuuaccagcugugugaccuugagcauguuccuuacccucucugaggcuccaugccaccucuucuaggaagccuucucuggcuccucaauucaguuagguccccacccugcauucccccaaucccuccuggcauaucaccugauucuuugcagcacuuaauggaauuguuauuaaguaauuguguuuaauguuguccuguuucuccacuccuccaguccaggaaacuugggacuuuugcuguauuacagucuguguagugccuggcacauguuaggcacucagccauuucuuaugaaaugcauaaaaauguaaaggaauggagggaugcaggccagacacuguacuagggacagaaagggaucagaaauuaauaagcaucauuccugucgucgaggaagucccaggcuggagggagaaauaagaugcaugagaggaagacuguccuaauugcgcuaaugggggaugaacacuaauggaggcaaacacuaggggggaaagcaccaaaagguccaaagacgagugagaccuagucccugaagagcugagaugccuuuccuuuguauuauguguuacgauuuacaaagcacuuagcuuacaugaaauagguggguauacacuuacucugcagaggugggaaaacugcugcugagaagaguucaaugacuugcccaaagccacccagccaauaauggcugccugagugcauagcuuauuugcuuuggaauacaguccauuuccuccuggacuugggcuuugauguugcacaugucuugguuuagauccuacuagaugugugaccaguaagugacuuucccugucugagccuuguuuucccagucugcaagauagcaauaaugacccccuauaaccuuuaagagauaguauaugcaauauacuagcaauaauga

SEQ ID NO: 14180 - RNA, 3038 nt, Homo sapiens
ucauuauugcuaguauauugcauauacuaucucuuaaagguuauagggggucauuauugcuaucuugcagacugggaaaacaaggcucagacagggaaagucacuuacuggucacacaucuaguaggaucuaaaccaagacaugugcaacaucaaagcccaaguccaggaggaaauggacuguauuccaaagcaaauaagcuaugcacucaggcagccauuauuggcuggguggcuuugggcaagucauugaacucuucucagcagcaguuuucccaccucugcagaguaaguguauacccaccuauuucauguaagcuaagugcuuuguaaaucguaacacauaauacaaaggaaaggcaucucagcucuucagggacuaggucucacucgucuuuggaccuuuuggugcuuuccccccuaguguuugccuccauuaguguucaucccccauuagcgcaauuaggacagucuuccucucaugcaucuuauuucucccuccagccugggacuuccucgacgacaggaaugaugcuuauuaauuucugaucccuuucugucccuaguacagugucuggccugcaucccuccauuccuuuacauuuuuaugcauuucauaagaaauggcugagugccuaacaugugccaggcacuacacagacuguaauacagcaaaagucccaaguuuccuggacuggaggaguggagaaacaggacaacauuaaacacaauuacuuaauaacaauuccauuaagugcugcaaagaaucaggugauaugccaggagggauugggggaaugcaggguggggaccuaacugaauugaggagccagagaaggcuuccuagaagagguggcauggagccucagagaggguaaggaacaugcucaaggucacacagcugguaaguggcaaaauugggauuuuaacccaggaaugccugaguacaaagcccauacucuacuagaaaacacugucucuuaucugucuuuuauuuccuccaccuuuuacuuccuugacuuuuuuuuuuuuuuuuuuagauggagucuugcucugucgcccaggcuggagugcagugguaugaucugggcucacugcaaccaccaccuccuggguucaagugauuuuccugccucagccucccgaguagcugggauuauaggcgugcgccaccacacccaguuaauuuuuguauuuuuaguagagacgggguuucaccauguuggccaggcugguauugaacucuugaccucaaaugaucugcccaccucagccuccccaaaagugcugggauuacaggugugacccaccauagcccagcccccuacuuccuugacuuuuauugacgagaaaggaguaagaccuguccaaaugaaugcucuaaagcaauauuuuuucccagcuuuugggggaucacagauucuuuuaagaaucuagugaaauccaugaaaccugucuccagaauuccauguauacagacagacccacaaaaucuugcauacaauuucagggaguucauaggcauucugaggcccagguuuagaauucauuccauggaggaccauccgaccuuauagugagaugucagaaccucagaaagagacaccaggaccccauaaacagcucaaauccccagagagaucucaagacccuauagaaagagucucaagauccaguagaaagaucugggauccuguagaggcccccaaguugcuacagaguaacagcuggggcuuugcagaaauauucucaagaggcuauagacauagaggaaccucaaccucucaugaagcugggguccucaaagcagacuuggagagcuauaauuuugggggguuuuuuguuuuuuguuuuuugagacagggucuggccucugucacccaggcugcagugcagugacacaaucaccccucaccacagucucaaacuccugggcucaagcaauccuccugucucagccuccacaguagcugggacuagaagcgugugccaccacguccaguuaauuuuuaaauuuucuguaaggaugauggggggggggucucacuauguuucccaggcuggucucaaacuccuggaaucaagcgauccucccaccucggccucccaaaguggugggauuacaggcaugagccaccaugcccugcagagggcuauaauucuuaacccuuguuggaucacugacgccuuugaaacuucgaagaaaaaugcaacacacacaacauguuacacaauuacaagggguucacagaccucugagaggacaucgguagccccaggguacagaacucugguucuugaggugcggcaagaacguaacccccgccccccaaacaccccaaaaaccuggagcagaaccacagacccgaggcacaaacuuuaggaugaaacagaccccgaguugcauccuggcccugccguuuacuagccaugaccuugaacacucaccuagaaacccucaggccucagcaucucaccacccaaaagagagggcuggacacccuucccuccccagccuggcccccgcggcgugcgcuccgugacggguggggcgcuggcgcuugacaggacucagccucucuccccuccugcgccagugagccaugaauccggcugcggcacuucaugaaauacucaugggccgacugcaccaggcuugcgggcggcgggggagggggccggcgcguucgccguuugccgcagugacagcuccgcgccgccagccggccgcgggccugggaagccgccggugccgggcgcgcucucggccuuucccacccaccaggcagggcguucccgccagccggcuuccugcagccgagggccggggaggagggacggcgcugaggggccgcagggccuggcaggccugguuccuggcuuucucuccgcguuuccugagcaggaccggccgggggaugggacccagcgcaaaccuccuaccccgggagcgcagccaggaaaucgcguccuuguuaauucagguuccuccuuugcgcugaacggggcugcuuuccguccgcgaucaagugggcauga

SEQ ID NO: 14181 - RNA, 64301 nt, Homo sapiens
cgccgcucuauggcugcgggggaggggcggggcucgugggugucuccgacccuuuuugucccggcgcggcgggagcgcgcuuggcgcgugcguacgcgacggcgguuggcggcgcgcgggcagcgugaagcgaggcgaggcaaggcuuuucggacccacggagcgacagagcgagcggccccuacggccgucggcggcccggcggcccgagauguuaucugggaagaaggcggcagccgcggcggcggcggcugcagcggcagcaaccgggacggaggcuggcccugggacagcaggcggcuccgagaacgggucugagguggccgcgcagcccgcgggccugucgggcccagccgaggucgggccgggggcggugggggagcgcacaccccgcaagaaagagccuccgcgggccucgccccccgggggccuggcggaaccgccgggguccgcagggccucaggccggcccuacugucgugccugggucugcgacccccauggaaacuggaauagcagagacuccggaggggcgucggaccagccggcgcaagcgggcgaagguaaggcucgacccuucccucaaacgacaccgccuggugccgagcuuccccgaggcuucuccgcccucccccgccgccgccgggucuugggcccugcgaccacucagaccuccccuuguaucgcugcgcacgccacguccccucuagcuggacggguggggugagaaaggaaaagucuuugccgguguugacugcggucuuugugcugggucccgagcgacgugggaaggggcaucgaugauugcugggagggguauuuuauuccuuaggucuuucuugcacaccuuuucauuuucuugacuggaaaauggcucccugacgugggguuacgguuggcguucuuggagaccucacuuguuuguucacagauaggucuggaagcuguugggcgauauugauggcguuucagcugggugcacgagggggcuguagguugaugcugaagaaaucgccuuagccggggagaugaaaagaaagggucguuuuugcuuuuguuuuuguuugagcaaaacccugcugugugguaggaguucuagucuuuuuuuuuuucuuuuuuaaaauccucucagcgaucuuuuggcgcagaauuuugcagaugaggaagcugcugauugagagagcaaauaauagucaaaaugcaaauauaugggaagaaaagauuugacuccaaacaguauauacagacagugacugccucaaaugucuguguccuagaugcuauauucagcgugucaccaacauuacuuuuuuuuguuguuguuaaauaucaacgggcagguauugcuagcccuauuuuaggaaugaguaaacugaggcacacaauuuaagcaacuugccuaaagucacaaagcuaaauaagugauggaaguggaauguaauucccacauucauguuguuacaggguaucaucagcccuugaaacaaaggaccacaugggacacugugugcagggcacuggggcaguauuagggcgcagacuuuagacuugggccuuuucuggagauuuaauggucggucuaguuggaaaaaacaaccuggauauauaugugcguguagucaacauuuaaauaaaaauuugcagauuauauaauuuaugccugaaaaaauugucuacauaauuuuuaagugggaauaccaagucaguguguauggggagcuucuugagaugaguauuacccagucugagagcucucauauuuaucugccuacuugagccaacucucuaaaguauaaccagugcuggaugaaagaccguuuuggaggcaagacuuucuggagcuuuuaccaaagcauggguuagaaaagcacagagguuggugacaccagcccucagaaaugaaauaaagggcagaagucaagaguguuauuuuacgauuucaauagacagguggccagaagccacguauaagauguuuuuaaaaacagauuuauuggcugggcacaguggcucacuccuguaaucccugcacuuugggaggccaaggcggguggaucaccuguggucaggaguucgagaccagccuggccaacaugaugaaacccccgucucuacuaaaaauacaaaaaauuagccgggcgugguggcgggcgccuguaaucccagcuacuccggaggcugaguuagggagaauugcuugaacccgggaggcagagguugcagugagcccagaucgugccacugcacuucagccugggcaacaagagcgaaacugucuaaaagcaaacaaaaaaacaggcuuauugggauaaugcauguauaauaauauucaccauuuuaaaauguaugauucagugguuuuuagcauauuuacaagauuguacagccaacaccacaauugauuuuagaaccuuuucaucauccccaaagacaucuguaucauuagcagucacuccccaguccucccuacccccagucccuggcaaccacuaaucuacucuuugucuauggauuugucuauucugaacauuuuauauaaaaucuuauguagccuuuuguauuuggcuuuagcauguuuucaggguucauucacguuguagugcuuucauucaguacuugauaacucuuuauggcugaauaauauuccauuguauggauauaccaaauuugguuuacccauucaucauuugacgcacauugggguuuguuuccaagucuuggcuauuuuacauaaugcugcugugaacauuaauguacaguuuauuuugugaauauguuuucaguucucuuugggugugggccuaggaauuccuggguuuuauguuaauucuagguuuuacuuuugagguauagccaaacaguuucccauagcagcugcaccauuuuacauucccauuaguaaauauaugaggguuccaguuucuccaauguucuucuucguuuuuuuuuuuuuguuguuguuguuuuugagaugggguuucgcuuuuguugcccaggcuggagugcaguggcaugaccucggcucacugcaacauccgccuccaagguucaagugauucuccugccucagccucccgaguagcugggauuauaggcaugcaccaccaugcccggcuaacuuuguauuguguuuuuaguagagaugggguuucuccauguuggucaggcuguuucaaacuccugaccucaaggugaucugcccaccucggccucccaaagugcugggauuacaggcaugagccacugcgccuggccuucuucuucuuuuuuuuuuuuuuuuuuuuuuuugcugagacagucucucucugucaccacccaggcuggagugcagugaugugaucucggcuuacuacagccuccuccuccuggguucaagcgauucuccugccuuagccagccgaguagcugggauuacaggcaccugccaccaccucuggccaguuuuuguauuuuuaguagagacaggguuucaccauguuggccaggauggucuuaaacuccuggccucaagccauccacccacaucggccucccaaagugcugggauuacagguggagccaccuuguugagccuccauauccuucuugacauuuaauauuguuugucuuuuacuguagccauccuauuggggguaaagugguaucucauugugguuuugauaugcaguucccuaaugacuaaugauguugggcaucuuuucauguguuuauuagccauuuuuauauuuuuguugaaaugacuauucaaauccuuggcucauuuuuaaaaauugaguugucuucaucauuuucuaguaagaguucuuuacauauucugguuacggaaauuugugauuuugaugagauccaauuuauucuuuugcucccuuuacuucugguguuauaucuaauaaaccauugccuuauccaaugucacgaggauuuacuccuauguuuucuucuaagaguuuuuuaguuuuagcucuugcauuuaugucgaugaucuuuucucaguuaauuuuuguauauggugugagguagggguucaguuucauuauuuugcauguugucccagcacaguuuauugaagacuauucuuucucucagcgaauaguuggcacccucauugauuaacuauaaaucuaagaguuuauuucuggacucucaacucuauuccauugaucuauuauauauuuccguccauuccaguaccacacuauccugauuacuuuaguuucauaauaaauuuugaaauuaggaaguguuccucaacuuuguucuucuuuugcaagauuauuuuggcuguucugaaugcuuugcauuuccauaugaauuuuaggaccagcuugucaguuucugcaaaaagggcugcugggauucugauugugauuguguugaaucugcagauuguaaguuuggggcacacuauuagauuuuacuguuauuuuuuaagcuaucuccuacaagaaagauuucuuuuuuuagcuaacugauuaauuuuuuggaggcagguucucacucugucacccaugcuggagugcaguggcucaaucauagcucacugcagccucaaccucccaggcucaagugaugcucuuaucucagccuccugaguagcugggacuacagcuguacacaaccaugccuggcuaauuuuuuauuuuuuguagaaauggcuucucccuguguugccccagcuggccucgaacuucugggcucaaucauuccuccugccucagccucccaaagggcugagauuacagacaugagccaccucacccaaccaagauuuuuuucuuuguaauucuccuguguuuauuuuaacucaucuuacuuacccuguuuuuuaaucccccauuguaauuagcucuuaaacuuucaggaaaaaaauuaguuauguguuuguuuggggcagcaacuacuaggaagcuagcaacuauccagucuugggauccagaggaaacagacuuuagaggauagaguauccauuuaaggaauaaaaagcaagcugaggccaguauagauaggccaugcuucaguaguucuucaguguaugcaaggaaaaaagugcauguauuuuaugacuugggagcuuauccaguuuugaggacuguacuuuaacaaaauuauaucauuacauaauuaaaauuauguuuaggguauuggaaggaguucauguaauugagugucccugaagcuucaguuucauuaguuucagaauaaauucacuuuugggcauguguaugcuaaaauuauggcaaaauauuuaagguuuuaaauugguaaauuggguuggaacuucacgaacaccauacuccuuuaggaaugguggccuugagcuaggccaugaaauggcagaauuuagaaaaguguucuggaaaaggguggacuuuuuggaguuuaaguauuucaucuuccucugauucauuuuccucagguaaauaagcccuaccuuguaaaguuuagauauaauauaaacaaaaugcuuauugcaguguuuggcguauaauuaguaggugaccaguaauuaagauacuaccaguggagaaaaggaagugguuugagaagcaucagggaauccagaguggacaacugaauguugagaacaauggacaaaugaauuuaauuagaaacaggaaucaucuaggaacaagauagauugaagggaccaguagcguugggguuguagaguuguguccagguuguagugagcauuagauucuugcuguccaauaugguagccuguagccacauguggcuauuaaguuuaaauugaaauuaaaaacaguuucuucagucacauuagcuacauuauaagugcucaauauagcacauguugaagccacagaauuggaagcacagauagagaaguuuuccauuaugacaaaaaguucuaucagacagccuugaacuagauuaugaagugcagaccauaagugcugugagacuucagagaagaugaaagauuuuuuuuuuuuuuuuuugagaugaagucucacucuuuucccucaggcuggagugcaauggugugaucuuggcucauugcaaccuccaccucccggguucaagcaauucuucugccucagcccucagaguagcugggauuacaggcaccugccaccacgcccagcuaauuuuuguauuuucagcagagacggguuucaccauguugguaaggcuggucuagaacuccuuaccucaggugauccacccaccucggccucccaaagugcugggauuacaggcaugagccacugcaccuggcagguguauuuuuuaaauuuagaauaauuaagaaauaaucuucagaggagguggaccuugaauauauggcauuggauuaacagaaaaagauggaaguagcuuuagggaacuuagagguugguagagcagcauugaggacuuuuuuacucguguguuagugauuagaauuaaguuugaauucaggccagacauggugguucaugcccguaaucccagcacuuugggaggccaagguggacagaucgauugagcccaggaguuugauaucagccuuggcaacacggcaaaacccuguuuauacaaaauuauaaaaauuagccaugugugguggcaugcgccuguaguccuagcuacucaggaggcugaggcaggggaaucacuugagccugggaggcagagguugcagugagcugagaucacgccacugcuuuccagccuuggcgacagugagacccugucuuaaaaaaauaaaaauaaaaauaaaaaaggcaguuugaauagucaaggccagagaguguauaugcugguuugaaaaauuugacguucauaucuguuaagcuauuagaaaauaucacauaaugggaaaauuaaucuggcagcuuugccguagauaaaagggagaaaguuuuuuuuuaauuuuuauuuuuugugguacauaguagguauauauauuuaugggguacaugagauguuaugauauaggaaugcaacgugaaaggaaaaaguuuuguuuuuuuguguguuuuuguuuuuuguuugucuguuuguuuuuuuuuuuuugaggcagugucucacuuugucacccaggcuggagugcaguggcccgaucauggcucacugcagccuugaccuccccgguucaagugguccuccugccguagcccccccaaguagcuggaacuacagaugugcaccaccacccacagcuaauuuuuguagagauggagucucgcuauuuugcccaggcuggucucaaacuccuuagaucaagugaucugcucaccucaaccucccaaagugcuaggauuacaggugugagccaccaugccccgcccaagaaauauuucuuuauaaagacugaugcuuuaaggacauugaggagugaaugaaucauuguaauaaggguggggaggagaaggaagagacuaaagauuuaaauuucagagucaucaaugugaaaguaagaauaauuacccuacucacucauagucugccuguugggacaucuuuauguccuugguuguaaguaguuguagaaucucugaagucuuugggguuuuuacuuagggaugagagagucccaauccuuuagguucaaaguacacauuccuuuucucaggggaauaguuuuuauugaaguuuguaugauucuuucagaugguuuuaaaacuuuauuaaauggucacuucuuggcucugggcaauuuuaaaauuaucuaaaaaaaaaaacuuuauuaaaugaggaaagccuuuuuuauaaaauaaaauuuuaagcaaaaaucccaaaauaaaacacacuacuauuaaguaguauuaagaaguuaaaauuuauaacauuuauuuuaguugucagucuaugagaaaaugaggugaagccaaauuugagauuggaaauuaagcaugauagucuucuuuuagccuuagaauccauuuuuuucccccagcgacuagaccaccagggaagaauccaauuuuguuucuguauuuugcuuuguuuaugaaguauuguggcagucugguacugauuugacaaauugugcaaaagguagaagguugguuuuguuugcuuuuuuuuuuuuuuuuuugagacagggucucgacucugucacgcaggcuggagugcaguguuuagaucacagcucacuguagccuugacccccccccgcccccaccagguucaagugauccaccucagccuccuuaguagcuggaacugcaggugcaugccaccacaccaggcuaaguuguuuuauuuuuuuguaaacacaggguuucccuguguugccuaggcuggucuagaagugggcucaaaugauccuacacuuucuuccuuccaaaguacugagauuacaggcuugagccaccgcucccagccuuuuuuuuuuuuuuuuaagcuugcuuugucaucucaggaugcucucaguugaacagacauggcagaagaaacuucauucugaagucuaccccaaauugaguuacccaagcagcacaaguuaauuguguugguugucucuaaaggauuaagauuuguuuuaacacaugaauguguaauacauuuaaaaaauuaaaauucuaaaucuugaagaauccuaggguucugugaaacaguuuuguuuuuaauaauaccaucagauauuauugcuucuaccuguagguauuuuucucaucucuuuuguuccuaaagacuaagaacccuuucuagaccacccuuuuccaaguguauuccuuguuaauuauuucuuugucaaggcauuggauuaaacaauguugaaaagauuguuuuugaugcaaaacuuagcaguaccuuuauuuucuauuuuuuugagacagggucugucucuguugcucaggcuggagcacaguggugcgaucacagauugcacccuuggccuccugggcauaagcgguccuccugccuuggcaucugccugccucagccucccaaagugcugggauuacaggcaugagccaccacgcccagccuucucaguaccuuuaaugugaauuaugacuuuccuagagggggccuguaaagauugcaguuucccagacuugauauuggauacuuuacuccuucaaagggcauaguauccaauggaacauccuuugggaaaaacugaacuacaauagaaaagauuuuguauuagucuuuguuuuugucucaaaauuugcacauuguccaguuccauauuagguacuuaagucauuauugaaugaauaggauugauggggcagaggaucaaaggacugaaucuuuggggaagagucaagcacuauugagggguaaaaggagaaagaaaacugcauacuauaaaaguuuauggucuauucugacuucucucccccuuugaaacuuuuuuuuuucuccuugcugcauuuucauccauuauccugagaccuauuuccacaguuuaucucagucaguuaggauaaaguuuaguauaauaucaucuacauuucuggagucuuauugcaaagacccuguaugagauggucaccugaucaggaucauuuaauugcaacuagauuuucagcuuuuuaggggcagggacacagucauaauuguuuucuccauuguaccacguacucaguguucaguauuugaguaggugaauacaauuauucauguauuaaauaagauucuuagagcaugggucagaacuagucaguucauucuucuuaauuuguguuuccauuuucuaacccaaucccuguuuucaguaacacucuuguacuuccagcaaccagucccccgcccccaaauccugugguccuaucauuuaaaaaaaagagcaaaaagacaguauaaaaacagcuggccaucuaaagcuauaucaaagacauuuagcaaguuaaaauguauuacauucacuauaauccacaggacuauucaucuuggaaauguaaaacauuagauauuuguggaaaccauguugucuuugcuuuuuuuccacaucuaauaaauuaucuuuucauggaauuaauaauaauuagaauuuuuuaauugauuccauaauaauuagcuguaguuucuuuuauuaggaagucacaaugaugauuugagaauguuccaauuuugaagacuaucuguaauaccguauuacacauuuuggcuaaccaauccauaauaaucuucccugucuuacacuccuuuacccucaaugacacauucacuaagacugcuuccucuuuuugcuaaugacauaccucccucuccuuuauagccagugugaauuaguaguaagaccuguauccuccauuuccacgucacuuauuccuuaauuuaucuuauuuuuauuuuuauuuuuuuugagauggagucucacucuguugcccaggcugcagugcaguggugcgaucuuggcucacugcaaccuccgccucccagguucaagcgauucuccugccucagccucccgaguagcugggauuacaggugccugccaacacacccagcuaauuuuuguauuuuuaguagagaaggguuuucaccauguuagcuagguuggucucgaacuccugaccuuaggugauccuccugccucagccccccagagugcugggauuauaggcgugagccacugcaccuggccucuccuaagugaauuuuuaaagcaaaugcaccuuuucauaguuucaguuugacuguuguuauuuuccacuccaugcccuccauuugguuuuuggaauuuuuuugcuauuuuccccuggaguaguaguuagaagcacagacuuggcuuuagacagacuugguauucuaguuaacuauauuuuugucugagggucauuuuauucuuuuguuggaaauuccaguaugugagcaugauacacacaauuaaaaagguuuuugaggaguuguagagagccuuagagucaaugauuugaaugucagugcuaugauguaaaacuuacagauuaguuugaaccugaacugacacaagauuguuucaugagggcuuuguuuuuaauaacuaccuauuaugagcugccuuguuccuuguuguaugcuuacuucccuuaaaaugugagguuaacaauuuacauugacugaugguuccaaauagagucccuaauuuuaaauguucacugcauuuagcuuucccugguaugaucuccauauagguagaguacagagagauggaugaaagcuuggccaaccucucagaagaugaguauuauucagaagaagagagaaaugccaaagcagagaaggaaaagaagcuucccccaccacccccucaagccccaccugaggaagaaaaugaaagugagccugaagaaccaucgggugaguuguaguauccaaccacaguucuguuuuaucuuagaaauaagaaugaauggauuuauuuccauuuugcaauauuauuuaugucuuuaucuuugguuuauaauaaagucugauauugagucuccugccaugugugucuuuguguguguguauacauauacauguauauguguguauguauacacauagauacguacauacugguacugauacucuuuuugugugucuguacauauacaggaggaaaguaaagggugggaauggaaggacaguggcaauauaaggugguuggaaaguaggagaaaauaaaugauuagaaaaaacauacagaaagccauauccaaagcaccagaccucucaaugacaguucugauucagaaauuguucuggcuaaaugauguguuuaccacguaguuagauacuuucugauaaaacuuccacgguguggaucgguuuugagaagugccuuuuccuggugaacaaauguaaaaauauauauaggccagaaaaucuagaaagauuaugggagucuauaguuuugguuucagagcuucaaacagcuuuaaagaauucucacuaacauccccucaaugcugaguacuagcuuucugaggauggcuggaccaaucagggauaucugccuuucuguuuuggagagaccaagcaaaagcaguauuuuaaugaauuuuuguaucuugugcccuuaaugacauuuuauuuacucuuuuugacuuugaauuuuuacuaaguuccucuucuugaaauaauuuuuauguuucgaauagcuucagacccacacaccucucugguucuuuuaguccuguaccuuuuaaaaacaaaauggugguuucagaccccaucugcuauaucuugcaugacuuucguagguacccagauuaagacauacuucauuugagauguuuuaucuuuuguuuuagccuuuuuuuuuuaaggguuuucuccccuaugguguuacugugaauuaccagaagcaguacugaugcuucacuuuagggcauuaccagucaaguguuaacuuagguuuggagcuuaucaaagucuggcuaaaacuuaaaaaucaaauuuauaauuuauaggauuguaauaaaguguacuaaaggaauacaguuugagaacauucagaaaaagauucugguuucaguucauucaaaagucagggauuuucuaagaagagugguuuuccuaaaacuuucuuaaaaugauuucuugggcaacuccuuguuugaagguuucuaguuucaguaguauauuaccuuuggggcuaaugucccaggcaaauguagcugccuuuuuacuuuacaccucucguuauucauuuuucuucuuccucuuucuagucuuauacauuuagcucucuuccuucuguucuuaccuccaaccuuucccuucacccugugcucuuuucuucuguguucuuuuugguucuuaccuuucuucuaccuuugcuguagaccugcuaaugagauacuuggggauaacccuuuuaaugucugcgguggcucaagagugggcugacuucuuaguucaagggcucuaaguacuacgcauugaugaucugauaucucagaugcugccucaccuuuuuugugugguugugucuccaguaaauaauugauuuaccauagguuccaaguugauaaacguuucuuugaaaauuuuaaaccauguguugguguugcuguuugcuuuuuucugaaagcuuuuuuuuuuuuuuaauuucauaaacgucagguauuguucccacaaaaaguaaacgucuuagcaaaaggauuuaggauuugggagcugucuuuauuguguuguaguuaauuauaaugcagugguuuaguuuaaguuaucuuuguuuuuggggggacguuaaaauuuuaaguugaggauaucuucaaugcuuagaaaugugcugauaacagccagaacuuacuaauauauuauuugugguuaugaaaauagugauucuuccuuuaaaacaacuuaauguuuuuuuugaaaauuucuggggugaauuagggauguacuuucccuagaaaaaagugucaacuuacuagccuaaacuacuuauguaguuuagcaauagauuggacccugauggugaaucauaaaauauuaucaggugaguuaaauauuuggacacugugcaggguuucuaagucuuuugucuuucacaagaguuuuuagucaaaaauugaacggaagcauugcuauaugacuauauuaaaagcuugagagaagauauagguuuguuucguuuugauauuuuuggagacggagucucgcucugucgcccaggcuggagugcaguggcaugaucucggcucacugcaaccccugccucccggguuaagcaauucuccugccucagcccccugaguagcugauuacagaugugcgucaccacgcccagcuaauuuuugcauuuuuaguagagacaggguuucaccauguuggcccaccuuggccucccaaagugcugggauuacaggcaugagccaccaugccuggccuguggguuuguuucucuaccaaaccuuuucuuguucucagucuuuuuaaaaggcaaucacuagaaauuauucugucaaaaaauauagguuagggccaggcgcgguggcucccagcacuuugagaggcugaggcaagcggaucaccugaggucaggaguucgagaccagcauggccaacauagugaaacucugucucuacuaaaaauagaaaaauuagccagguguaguggcacgugccuguaaucccagcuacuugggaggcugaggcaggagaauugcuugaacccgggaggcagagguugcagugaucugagauugugccacugcacuccagucuuugugagagcaagacuccgccuuaaaaaaaaauccaaaaaacaaaacaaaacaaaaaaguaagguuugcauacauuucauucuuaccaacuuuuaaauuuguuuagaaauuuuugcuuugcuuucugcaguguguuaaucuuaacaggaaguaaauauuuuguuaauuaugaaagcacaagguauucugaagucagugggucaaauugacugaauaagguuccucugggagaguacugagaggaagccagaauggugggagccauauugugaauagccuugguugacuaagccaggcuaaggaauuugagcauuaggagugucagcgguagcccugagguuuuuugagcaagggggguuacacugaaauauguuuuuggaaagaccaaucucaugcuaagcgugaacuaaaggaguaaagaagcugagauuggagagauaauuuaggcuauuggucaauggaaaaauguucuuaauaucaaaguugaauuuuuauggaaagaaaaaguuuggguguuuuugucugauugcacuuauauaauuggaaggaaguucucucuguugaccuaaauauuguuuuuagauuuaucaauuuuugaccguaaguuaaugugauauuguaguccuaugguagucaaaauggguaaauaauggauuuuucauaccaaauauuacuguuuauauuuaaaaacuaccucauuuuguuuuccuaaauauuuccaugcauuuuuauacuuacuauacuuuugaauauauuuguuuuaacacaugaugguuuuauuugguuuccuaguaccuuuucugugaagaugaaaguuuuuuuaggucaugccaacuaaacuugacagguugucuuuggaauugaguguguuugguuacuagcagcgucacauaauaguggagcguuuaugaaauagagucaaaucuccuucaguuggacuucauugauuuagaauaauugucccccaguaaaguacccuucuguuuauuggagaaaugccuuuccugucuuugcucagauuguuacccuguguaccuuacauuauuuuccucaaugaguuuugcauuccuguauuaacugauucuccaacacuuacuuggcuuuuuuauuuucacauggaaacaugacuccauuuuuuuuuucccuccacugccuuucagcagucaaauuuuaccagaaaaaucuuacuaguuaguuccuggauuuaaauuguguauuggguaacuuuucacuagagaacucaagauacauucugaguuagaaguagcuuaguuguacauagccugagacuuucauggaaaguuauucuaaaauaaguaaaaggaaauuugaaauggguuauuaagaugccuuucuuaagccuuuuucaaguuaauggauuuuucaguagagacaucagaaguguguguguauaugcaugugaguguguguaucauuuuucuaggcuccuugauguccuaguccuuaagacuaaugaagcccagaagcuuccauuaagucauugguuaacucuucaaauagauuuuuuuagaugugauugguaacaagucuguauuauaauuuauuuuauggaaugaccaugggaagaaucacuuuaucuccuuguuuauauucuuauuuguaccagaggaagcccucuucucuauuauaugugguaauuuuaaaaguuuguagguguguguuuuaaagagauguaggcuguuuuuguuuguuuguuuguuuugagacggaguuuugcucuuggugccuagucuggagugcaauggcaugaucucggcucaccacaaccuccgccucccggguucaagcaauucuccugccuuagucucucaaguagcugggauuacaggcaugcgccacuacuccuagcuaauuuuguauuuuuaguagagaugagguuucuccgcguuggccaggcugaucucgaacuccugaccucaggugauccaccugccucagccucccaaagugcugggauuacaggugugagccaccaugcccggucaggcuguuagauaaauuaacaaaaaucauugaugugagagaaugguaagauaagaaauuuugugugguuuuaauaaauuugggggcuuguucacauaauaaucauacuguagguugaaaauauuuuuuaaauuuaccuaaaaggugauguuaaccugaauuaguaaaaauacuaaauuacagaaaauacacaauguaugaguagaagaauuuaaagagucaaugaaauuugaucacaaaugcuguuauaaugaaaauuucauauaacaaaagauugaggaccaaaaauuugaugaauuauuuaguagagaaaguauuaaaaggcagaaucuucuagaguauucuauagaacuugguauaauagaauuugaucagaaaagaguugaagauugucuuacuuuaaaagaaaaaaaauaagugguacuaauauuuucaccuuauauuaggguaguucuuuguuuauaagauacccugaucucuucccugugaggcagucauacugagugcagucuggugguugccaagcacugaguuuggcagcauagauaguaauggccagaguucaggugaaccacuuuguuuuuuuuuaaucaugcuguaacuauucucaaguggcuaaucccaggcuuuucucucugauuucucucuccaugccugcaaauggagccagagagaaggacuagcuuucagguuuagugaggauugacucagauuaccaccacagggaagaugauaggauucuauuacauccccaggcccagcaggagacccuguuuuguagguuuaccagaagugacuagggaguucauuccugacgggguugucuguguugucauuuugacaugcuaguguaaaauaaaugccugaaaucauuugaauucucauuuuaugaaguaugaugcauacauucagaaaauaggcauaggguuaguuuucuugccacgcccccccccucccccgcccccucaccacuccagccuuuuuggaacacauuucgguguucugauuuggaccuaugcuccaaaauaccuuacuggagggcugagggaagaaagugacaagcugaaaagguaauucaacagaauucuuauguucuuauauuuugaggcauuaugaauggaucaagauaaauacgcuauacaacacacgguccccacucucagauaauuuauagccuaguaugagacacaaguguagacauaaaugcauaauggaaagcaaaaaacucuuaagugugauaucaauauaaaaauucuagaggcauauagagguaggaagggugaagaguagagaauugguaguauggagggcaaauuuuuuaaaaaauaggcauuuucuacaaaaaaauaagauucccccaaauguaguaguuccucauugacuuuauucuacaaauauuauuguacgaugauaauuauuuugucacagucacagugcuggauucuaaggguucaaagagaaagaguacauccaccugcaaagaauuuguaguccaguggccugguguggugcaugccuguaaucccagcacuuagggaggccgaggcaaggggaucacuugaggccaggaguuugagaccagcccagccaacauggugaaaccccaucuccacuaaaaaaaauauauauacacacacacacacacacacacaaauuagccgggagugguggcuuaugucuguaaucucagcuacucaggaggcugagguaccagaaucacuugaaccggagaggcagagguugcagugagcugggaucguaccacugcacuccagccugggugauagagugagacccugucucaaaaaaaaaaaaaaaaaaagugcaauucaguuuaggguuacagauguuaguaaguagcuacaaugaagaaacuacaauagaaauguauagaaaguauggugagaacucagaaguuuuuauuuuuuuaauugauaaauaagauuguauuuaucauguacagcgugauguuuugaaguauaaauacauugcagaaugaccaaauuuagcugauaaacaugcauuaccucacaugguuaucauuuuuguggugagaacacuuacccacuuucuugguauuuuucaagaauacaauguauugugauuaacaauagucaccauguuguauaauagcucucucagaagcuguuuuuaaauaauguuucucccuaaaauuggguuuuggaaauuuuguguuaaacaugaaaggaugaagcaguuuuagauccuugauuuuuaacuauuuacugcuuuuggucgauaagaacccuugaaucagaugcuacaaguuuauguuuggucuuugagagauugaccugcuuuucuuaaugaugucauuucauugauuuguuguacuuuuuauuaaggcaaaauaguaauuuguuuagcugaucaccuuuauuuuuauaauuuauuugaauucuuuuuguugccaucauuuauugggucugaucauguuguaauagaagaacaagauuuguaaggauuuucucgucuacaaaaugagacuuguuaugagaaucaaaugagaaaaugcgaaacccaccuuuauguauaaacaucuuguauuuauuaagcagaguugauugaacaaagaauaggguggauugguguuuuauuuaggaaaaaaaucagggcagcuuuagaccagacagacacacauacuguguuacuuugggaaaguguuuguggugggccauuuucaguaaugagucgauuaugaaauagauaacuuuuuaagcaucuggaacuguuuguguguguguguguguguguguguguguguguguguaaaacuuaaaucuugauaauaaucuuuuaaguuaaaucaugagaaugacagacuuugggacuuucuaacauaguuuuuuuuucuuuccuuaagagaauaauauaauugaaauucuugcaucggcuguugaguuauaagaaauguuuuguaagcuuuguuauuaaccagacacaccuuaagcuugguaguuggacacauaacaucugaauuguaagcuuucucuggaacauuuugaaaagugaacacaaaccaagacugcagcaaaauaaguaaggaucaggaaaauuucuacuauggaauguggagggaaauaauaugugaaaaaguaaauucuuuccauuggcuucuaaagcuuugcauuucucccuagcuuguagggccuuuuacuuucuuuugauaagauccuugcuacuacccaguggaagucuucaagcacauaucugugguguuauuguucuuucagcaguucaguggaaguuccaggcaagcuccugcuucaagcaaaacaauuuuucuuuuuuucuaaaccuuaagaaggcuguuuuacuucaguauuuuacaugauacuguaacccagggauugcuauucuaguuggaacucauaauuucauuuugacuguugcucaggcuggucuugaacuccuuguuguaagugauccuccugacuuggucucucccaaagugcugggauuacaggugugagccacugucaauuccuuuuugaaacugugacuuuccuuauguucaugagauuaaucaugcauuuaugacugcuucaaauuaucugagccuauuauuacuuccaugcuauuuugaagucuuuuagccccauucuuacuucugaguucuauuguuuaauuuccaaccaucuuuagaacauuuccauuuaauuguauuagccagucucccaaauuucccauuuuguuuguagcauuacuagucuucugaacuuaaaacccuagagucauccugaaaguucuuuaucccuuuuaccaagucuguuguaaagucaugcaucuuacugugcagucuuuuucauuuuuuaggccuuacccauuuuuacugucaccuuuuucuagugaauuucaacuuguauguaaauuauuucaauagccuuugaauuggaucuccuuuaucuagguuuucccucuaauccaucucguacaaaguggccagauuaguuuaacuaaaauagcauuuguuuuguugucuuugugccaaagaucacacacuuuuccuucauuacuacuaaaaucacguucagguuuggguacuggaaagggaucauuuuaccaauccacuugaucucccacugcuuuuucagaccaucuccuucugaaaguagguaccgagcaguccucugcacauaccaugucugugcuuuucucuuuaucuuuguaaaugaucuggaccauagucgugguuucacugccucgcagucuauccagaucucucgggaauuguucugaaagcuucccugauucuccaagacugugucagcuucucguuucuuaacaacaaaaguuuccuuguagguauuuuucaucuuuucucaacuagauuauaagcuuuuugaaaacagagagucuaccuguucuacuuuuguauuugugcuuugcaguuuuggggcagauacgguaaacacugauuauuaaauaagaaacucaauuagugcguuaauacgguagagacauauauuccaaguuggcuuuaacuuuugaaauguuucuuucaccugcuaauuuauuaaauucaauugaaaucaguagguuggccuucacuuuuauuccauaaauuuggccauuuugguaaauuuaucuucuauuggaaaaucguugcuuccuagauuuagaaguuucuuaaaauguuuguaauuugaaugugauuccaagaaacuagucaaaaugugaaucuguguuucuggaaacaaccaaccagugauuuucaccuccuuguuuguuugccagauaaaagcauuugaaagucaacauagacuuccuuuuaagauguuggaagagugaucucuugaguauuugaauucagaugagaaaacauucaguaaugugauuauaacuacaacacuucacgcuucaagaaggacucuuagaucugaaggucuagaagacaacugaaaggcuguuauguaagauaaaucaaaaagaucuucauuuucaauuuggaguagcuguguacaaauaagcuguaugaagagucucuacuuuaggccgauugugguggcucacgcucauaauccuguugcuuugagaggcugaagugggaggcuaggaguucaaaaacagccugggcaacauaucgagaacucgucucuacaaaaaaaaaaaaaaaauuagccagguauggugguacaugccuguaguccuagcuacucaggaggcugaggcaagaggaucccuugagcucaggaguucaagguuacagugaacugugauugcaccacuguacuccacccugggcgacagagcaagaccuugucucuaaaaauaauuaaaaaauuaaaaagagucucugcuucaagcuugaggacuauuuuguagguuuggugguuugggauaaaaacaaaagggaguuucuuguguaguggugccaaaaucaaggugauauuacaaaguugcuuuugaauauuuucauuuucuguuuugaauuugcacucauggaaagcuaacagcgcuacuugccugcuguuaauguguccugagccacuaucagaaacagaguccuaggcuggaaagacccaaagagcagaugaauaagggauuuuauauauaucauaaucagagacuacuuggaugaaaaguuagcugcaagcaguguuguguaugugcuguuuuuaagaaaauguucaagaauuggucuauaauauacugcuaguaaagaugaucuuucaguugucuuuggagaaguaggcaucuucaaaauacucucaaguaugauuggagugaaaauaauaacuucauucuuuauuuccaagcaaguuaaaccauuaucaagagauaaauaacuuguuucuuaauuuaauuuuaagcacuuuuaaauuuuguuuuccaucauuucuuaugugguaccuucugcuugguuucuuucuacuccucugcuuaaauaauacuuuugaguuucuuuucuugcuuuuuuuuuuuuuuuuuuuuuuuuggagaccgagucuugcuguguugcccaggcuggagugcaguggugcaaucucggcucacugcaaccuccaccucccgaguucaagcgauucuccugccucagccuccugaguagcugggauuacaggugcauaccauagcgccuggcuaauuuuuguauuuuuaguagagacagcguuucaccauguuggucaggcuggucuugaacuccugaccucgugauccgcccaccucggccucccaaagugcugggauuacaggcgugagccacugugcccagccuggaguuucauuucuuuuuugacauuuuguuguuaugggaucccuuuuaaaaaucuuugcaggguauugaauauuuucuacauuuuccugcauuuuuuuaaauuaaaaaaaaucuuuuuaagagguuuuuuaauuccuuucuucaaaaccagaagacaaaaaagacugccucguugcccuuuuguccugguuaaccuauugaguacgcaagucagggguaagaaauccaucuuuuuuugugaaucaaagcaccauugauucacacacaaaaaucagucaagagcuaccuguagcuuaaauuagugaguuuauuguaugacauguauuauaguuggaaaagaagggaaaugagaggaauaggaaagauaaaguaauucaggcuuaggcuagcuucaaaguguguguuuuuuguuuugucgguuuuuugcuguuuuuaucuaaguuuuuaguggugagauaccuucaugacaagagacugucacuuuuauuuuugccaagucagaaacauaauuugaacgauaacagcuguauuauuccuaaucuuaagugugauucuuggaaacuauuuguuucauuguucugagucccucccugcucccuuucuugcccaaauaaaauucaguuuucugauccagcuugguuuuauuuggaaccaaacgaaacaauggcaacauuuuuuaaaaaucuaugaaauauauuauuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccuccgaaguagcugggacuacaggcgcccgccacuacucccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuauuauuauuauuuugagauggagucuugcucugucgcccaggcuggagugcgauggugugaucuugacucacugcagccucugccccccagguucaagugauucuccugccucagccucccgaguagcugggauuacaggcgagcaccaccacaccuggcuaacuuuuguguuuuuaguagaaauaagguuucaccaaguuggcuaggcuggucuugaacuccugaccucaagugaucugccugccucagccucccaaagugaugggauuacaggccugagccacugcacccggcucuacaaaauauuuuuuaugaauaaagccagaauuuacuaagagugaauauaucugauuuuaaguuuauaguagaguuuaaaauguaggaccuauauuuucaagauaaguuugcagauuggauuuaguaacccgaucgucucuucaugauuguaugccuuuuuccaagggcuguaaauagguauaccuugggccuugucugagaagcauaaccuucuugaaccuaaaggacccuucagacgagagcuuaguaaaauaaguuuagaaugagauucuauucuaccuucauaacagagcauguaucuucuagcaacacauucuaauaucauugucagaaauaauuucuuauaucuaaguaucuuuuuauucucuuuguuguucccuucuaacucaaaugguggaauaaucaaucugcuuucuuauugggguacguauuuuaaaauaaacuuuaaugaagcuugucugaguuuaucuagaucauugggaggugguauuuuaugucuuccaaagaucacacucauuuuccuauaguguaccaggugacuagaagcuuaagagcaucauagcaucugucuugaugauagauuuuggaagaguucagaagacaaucuauucuuuaucagauugaauuuucaagcuuugauucuuuucuugaaguuacuucuacauauuaaucagugaggaaaauuucuuaacaaagcuuauuauguagcaugaaguagaagauucaagaucuugccugccuuucucuguguuaccacaaguguguguuuaucuacaguacuuggcacacacacacacacagugucuuauuguguguucuuuaguuuuauuuaggaagcacuggcauauuuaacuguacuagugucuacuguguauaguaaaugaaacuucuuuggagacugagucuuuuaauuauacuccuugcuuugaagagaaggagauaauuuuucauuaaaauuagaaaguuaaacggauauuaaguugaugcugaauugcaaugccagauucuagagucuaugucagcuccauuuucagucuagcagccguuaguaaaagacacucggaauccauuuucccccauccagacuauuaauauuaaauaagacugacagcaaggauuuagugauuagaaauacuauguacuuuguuccacugccuuucaacaagaaucaacauguaaaguugaaacuuccugaccagaauuuggaagacuaugauguaauucccugggccuugauuccagaagaaggagcucucugaauauggguuuacuaguugguggugaauucaugagucgccaacuauuaggccuuuauguccagauauuauccuaauuuauggaguaaggucccugaguucuccucuuuccuuccacagggcaagcaggaggacuucaagacgacaguucuggaggguauggagacggccaagcaucaggugaggguggcauuagaugcuugccacuuaguagcaagagccgccaaguaggaauugaugcuugcaaguguuuuuggcugugguauccacauuuuagccagaagcgcaggugaaauuuaacccacaggacauaauaguauaguaggagagaguguagugagaacaaaggcaagcaaaaccuuuugaaguccucaggccgaucucagcccuccacucuuuguguuuucgaggagauggcggguacuuuucuccccagcagccuuucuauuaauaguaaacaugauauagaacauagacuuaggaaucaugggacccuuaaagagaaauacagcaguauacacagagaggaaaagucacaggcucaaaagucuaaaagcaaaaacaaacgggacugagaggcauucuaggacuagucagaggaacuaugugggcaagugacaucuuuuuaaaaaugguuguuacaggguauuggguaccuuuuuucaguuaacauuacguaguuaaucauucuucaguuuaaacauuuuguuucucaugugaaaaaugucuuuugaaaagucugaaauacuuuuuucuguucagaccaaacaguaugagauuuuuacuucuaggaaaaaguaaagaauuuauaggggccaccaucuggaacaguuaaaauuuaucccagcaauccaaaauaacguaucuggauuucauccuuugucucuugaaggauguuuuuguuccaguugcucaaagcugguuuauagauacguuuugauagaauuggaauaggcacuacuucacuuuuggagguugucacuuuucaacugucuuaagucuacuuuaaaauuauuuguuuugcaguuugcauauaacagguccugggacuguuucuauuucacucucuugaacuaaagguaguucauuguuaauacagcaauuaguaauaaggggauccagaauguuaggagcagacuuuuaaaaaugcugucccaaggauugcagguugauaaucaguacaugguuaucuuagcagaauuaaacccuguucagagucuagaucuguggcauauaaaccuugaagaaugcuuuucaucaaaugacgcacaauuagaucuuccauggaacuguugaagaucagggauggccuuuagaguucuaaucuugaagaaagaaguugaguuuucuuguuuuuuguuucuguuuuuuuuuugugugugacuauuugcucuuuugcauuaaguaaacaauaucauauauugcugaaagugaaagcagacuuucauauaaaagugugcugcugauuacuguuaguagaacaugaauuuuaaguguuuccaggaaugauggugacuguuguaaaaccuucaagaucucucuuccaaucuuugucacguucagaagcaugcauuugugaaaugaucaaucaggguuagaaaugugcuuguaagagaucaacauucuucucuuaaugaagccagaugacccucauggguaucuuggugccaggaucauaucuugacuucuuaaaacccaccucaaguugguguacacauccuaaaucuuagagcuagaagagaacuugaggucaucuugucuaacuuccugccuucaaacaguauuuuaucucccuuauuuuauggauuaggaucugaaacccaaagaaguuaaauagauugaccagcaauacaccagcaguucuggagaaggagaacccagggaucuugcuucuuagugcaaagacuauuccuuacacccuuagaauccuuuaaaauaguguuuacccuagaaauuaaaaacucugaaguauaggagguuguacaauucucuuuucguuuucucucuccucccccuauuccuuauuccuuuuauuuuaaaacauucuaggacuugauaugauacaucucuaguuuucucauauuaaguaaagucuuuaauauguagaucaccucaggcuuuuauuuucacgcuagaaaucuaguuauaguuaucuacuugauauaaaaaauuaaaggcaaguaacucucauggaggccuucuuuucuuuguuaauuuuuauaucucuauuaccuuacugcagucaagaugcuaccuauaucuuacacgaaucaagaggaagugauuuaauggaauagaggaccugucaucucaccugccucucccgcuuuuucuacuucuaauuaaccuacuucaaaaggucuaaauuauuccuucaaauauuuaacuacauuuauuauguauucagagaaaguauaagccagucagaccauuagaaagggcaguucugcuuuagagugacugcauucugaaaggugaugcuggaauuuccuguauaaagguggugagcaggaaggaacugaacagaaaguaagacugguauuuaggcaacuuggagcuuuuuaauaauuuuugaauguuucaaagacaacguuuuggaaacauucuaaauuuucagaauaccagauuccauuacuuaauggaaaacgcaaacaccagaguacaaaacuaucagagccaaguguaaauuacuucugaauuaauguguacuguugguacuuuuaggauguuauuaaaaucauuuguauucuaaaagauuuuuccucugaaagagauagguacucaugaguuagauuauccaaaauggugucuauuacuucauuuugguacuauccuauaagaaggauguuuugauuuagcuucucaacaguuuagguuacaaauuaacauacauuuuuuuuuucuuuaagaaaagguuagcuuuuuaucuugcaggcuuuucacccugguuuugauaauggucuucauuccuuaaaauaaguaucccuaaacaccaaagggaaggaaauaauuauugagaguuuuuagagaccauuuuucauuuuuaaaaaugauaucagaguauugagaauagcuaguuuucuuagaugcuguuuagaagauagagauggagaagaauauuauuccaagcauacauuaaugucaccacauuuaguuucuuuaaaugccuuuguuuaaacuucugauguuugauuuaaaaauacuuugaaacugcuggaugacauauaaauaacauuucuuaaucauuacauauucucaaaaauuccccaaauuagccaacuacauuagagugauuuuugauaagaacaucugaggccaggcgcauuggcucauuccuguaauccuagcacuuugggaggccgagaugguguaucgcuugagcucaagaguuugagaccagccugggcaacauggugaaaccccaucucuacaaaauauaaaaaaauuagacauaguggcuuguaccuguagucccagcuacuugggaggcugaggcagcccagcuacuugagcucaggaggugaagguugcagugugagauugugccccugcacuucaggagccuggacaacagagggagacccuguccuucccccugccaaaaaaaaaaaaaaacaucuguagugagcagccaaauguacuauaaaauuugguauuuuauccuacaugauuuuucugucauugaaaaauaguauuuugcaguagaauguucagugacuacuuauuaaauguauagaagauaacauagcuaaggaagaaaacuaccauuuuuggcagggagaaguggaauuuaauagaaaucauugauuuucauguuaauaguauauacuuaugaauuauaccaagaauugaccuauuuagagauacuugguugaaauacucaggauuuaauguguagauaaguucuuuauaaugugaguuauuuuuagucuuggugguuuuguuuuguuuucaguuuuuauuuauuuugauuugggaaugggagcuggggacaucaaagccauauaguuuagaaaauuucacauuacugaaauaaacuguauccacaauaguaagcauuucuucuuuucuugcuguaauuucaugcuccaccuacaauauggcuuuuacuauuuuuuuauuuuuuauuuuuuuuacccaaggaauaaauuauccugacagucuuuaauuuuggguauggauuaguuaaauguaaggauuguugauuugauuuaguaaugugagacacaauguuuauguccucauuaucuacaguagauggauaguuuuuucuccuggucucuaagaauaguauuucuuaauguguggcccaugauuggcauuaggcguuuuugcuugaccacuuguuaaacaugauuuuuuucuagguaguguuugccauuugaaugucuuuguggaaacagacuccuuaauagcuuagcuauaauuuucuaaguuaacaucuuuaccugccuuguuuuuuuaauucuccuaaucuuacuaauaccuuagcauuaguuuugcuuccauuaucagugcuuccaacuucuuguuuuaugugcuuuaaaaugauuauauaugggcugagcaugguggcucacuccuguaaucccagcacuuugggaggcugagguggguggaucacuugaggccaggaguuccagacuagucuagccaacauggggaaacccugucucuacaaagaauacaaaaaacauuagccaggcaugguggugcaugccuguagucccagcuacuugggaggcugaggcaggagaaucgccugaacccagaaggcagagguugcagugagccgagaucgcgcuacugcacuuccagccugggcgacagagugagacucccucucaaaaaaaaaaaaaaaaaaaaaaaauuauauauggauaucuggcgccuauuuuguuacuuauauguaauuacuuaaaugguauggaauuuugaaacucuuuaaauugaaucuugauaguuuuuauaagcugguggauaaguacaucuauaaggugauuuuagaaauacauuugcauuuauugugcuuguguuuuuaagaucaccuaauaaagguguacuuauccaccaauuuauaaaacuaucaagacaauacccaauuaauugaagaguuugaaaauaacauguuuuuugggagguugaggcagguggaucaccugaggucaggaguucgagacaagccuggccaacauggugaagccccgucucuacuaaaaauacaaaaaauuagccaggcaugggagcgggugccuguaaucccagcuacucgagaggcugaggcaggagaaucgcuugaacccaggaggcagagguuguagugagccaagaucgcaccacuacacuccagccugggcaauaagagugaaacuucgucucaaaaaaaaaaaaaagagaagaacguauuuuacuugcaguguauaguguauguauacacuauauguauauguguuauagauuauacauaguaauauuaguaguauauaguaaagcauuucuaauguuucugccagcaaauguaaauuccuugcauucuucugucuuauuguugucugcuuaauuucucucacugcuugccagcguugaauuaugauuacuaauggaugauacuguugaugggauugugauuuucugcuguugauuauuaaagucaucuuucuguuucaugcuguaauccuaaaagaaggcaugugauuguguuuuucgcuccacagcuucuuuugcuuuccuguuagugcauuuuccuuuauucugguucuuuaguuuuaaauuuuauuguacaccugucaguagugcuaauuuuaauuagaucaucuaauaugauaaaguuauuuuauggacaaagaaacuauuuuaaaugcuuugucuuauaagguaguuguuucacucaguaaaguauaaacuuuggaauguuaagcucaaauaaguggcuaauaucuaaggaaguuucagcuuuugagacaauugaaaauuuuuuaaaaaggucagucugugagugaggcaaaggaauuuaagcgucaucacuacccguuuuguauucacuugcacuuuuccuagauguccuuugcuuucuucguuagguguggagggcgcagcuuuccagagccgacuuccucaugaccggaugacuucucaagaagcagccuguuuuccagauauuaucaguggaccacaacagacccagaagguuuuucuuuucauuagaaaccgcacaguaaguuuccauuucagcuuuuucaccuggauuauaaaaaguauauauggcuuugauagagaauaugggaaaaauaaaaagagaagaaagaauucuaaaauuaucuauaauacuauuauuacccagagauaaccuuuguuaauaguuauuuuucauuuggguauuuaaaaaauguauauauaauuuuuguuuucauaaaauugagauccuucuuggauacauucuuuuggaucccuuuuauacuucacaaccucauaaauacacauuaagaauauuuauuuaggcugggcgugguggcucacaccuguaaucccagcacuuagggaggccaaggcagguggaucaccugagguuaaggguucgagaccacccuggccaacauggcaaaacccuuucucuacuaaaaauacaaaaauuaucugggcaugguggcaggcacauguagucccagcuacuugagaggcugaagcaggagaaucgcuugaaccuaggagguggagguugcagugagccgagaucgugccacugcacuccauccagccugggcaacagaguagaguccauuucaaaaaaaaacaaaaaccuuuaagcauuaaaaaauaauaauaauaaucacuuuguccuucccucugaagagaaaucuuuacccuguucugcucaucuuguucagccucuuccucuggcugaaugauuuaacuucagugucugcauaauauuuugucugacaguuggguuauaauuugacugcuggacauuuguugccgauuuugcuuuauuauaauuaacucuggacagucuuaugcauucuugacucuaccuauuauuuccuuaugauagaauuauagaaggaaaacuacguugucaaaggguuaugaacacuuuuaaauguuuuggacauauugccagauugcuucccagaaaggcugaaccagucaaccccuccccuccgcauugcccugcccauuuuuauuaaaacagugauaaucuaugcuccuauaauuggccaaaaccaucucaguucuuuuucauuucuuggauuacugacugcuuuucacauuagucauuuguauuucuucuguaaauuuuucuuucauaucuuuuauucaucaggaauucuuauuuagccagagaguaaauggaugagggaaaggugcuauucagaacaugcucauguuacucuagggugguacaacgcagaagaaauuaaccuugugauucagcuaacuugaauaugaauauagcucagagaugucauugauaugucugcuuuuuagccaccaccagcuucuuuguuuuggcuauuagauugcaaaaccacugcuuaauuucgauuguuaaagcaauugauagguuauccuggguuuuuguaaaacagaaaagaacagugaagaaaagauggugaguuuuuuaaaaagugaacagaaaauucuuaguguguagucgcugauuugucuuauaauugaaucaguuucuguguauagcauaucaacauuugcucuaaguggauuuuuuuuuagacaaaauugucauuuuuuuguuuguuuguuuuaucugaagagaguuuucacuuuuuacuuagauuugagcgauggauuuacagggaucucugucuuuucugauucaccaaaaauccagauuuggggaaggguuucccgauguuagauuuguggucucuggcugugaaacagaauguaaaucaaccucuacugcaagaauuuuaucaguucucuagucuuaaacuauaauacuuuaaaacugcaacuuuaggauuauugaacuagacugugaccuaaguguuauuuuguaggaggaggaggaggaagacuuguguugggagugaggaacuugggcccaguguguacuugaggaaauccauuuaccuuacaguggccacagaguagaguaucuguguggauuuggucauaaucccuuaguaauuugguuuauuuacauauagccaaauuaauuucuucuugguugaaaguugucuuauagagcagucuuuauuaauuuuuagcuaagacuuaaauauaguaguguuuaguuugucaugcauuuugcaaguauauacucacuuugaagagaauucauuuuagagcccauugauuguaccauauguuuuuuuaugucucaucuguuuuuucagcaguauuugaaauaauugacugcuccuuucuucugaaacacaguacuuccuuggauuugauaacucaguaucugguuuuucuccugccucucugggugucuucucugauugcuuuguaagaugauccuuaacaauuggccauuauguggacuauuuggaguuccuucuccucuugcccuauuuuuuccucuaggaacccuucucaaugcauuugacuucaguuauuacccauaagcagaugacuccagaccuucucucucuucugagcuccagacccuauauccaucuauuuuauauuucuucuuguuaucuuggagcuaaacucauuaucuuauuucuucuuucagugauuccauucagugucuggcguaccaacucgcuuaguuguaccaaaauggagauguuguccuugacaccuuucuccccaaccucgacauaucuaguugaucauuagauuuuuguggauuuuauccacuuaguaucucuggagucauauaacccagguuugaaugcuaguugcucccuucuagcucuauggauuuggcaaguuacuaggugguuuucucuuuuaggcuaaauaaccccagcuucuucaguaauuuacuuauuugauauggcuuuguguucaucaguuucuuuuucaggaguauaacgucacuguuuuaauuaaaggaaagcccauguuuggggccuuaaaguuaaaaggaugauuuuauuuauuuuuauuuuuauuuuuugagguaagcucuugcucuguugcccaggcuguaguacagugguacgaucauggcucacugcagccucgacgucccgggcucaagcaguccuucugccuuagccuccuaaguagcugggacuacaggcaugugccaccauacccagccaguuuuuauauuuuuaguugagauggggucucacuauauugccuaagcuggucucaaacuccugggcucaagugauccuuccaccucagccucccaaacugcugggauuauaggugugagccacugcagccagcuaaaagaugauuuuaaagauagucaaauaacauaugucuauuuguauguaauacaauuuaugucauuuaaaugcagcugcaguugugguuggauaauccaaagauucagcugacauuugaggcuacucuccaacaauuagaagcaccuuauaacaguaaguaguguguucaauaggacuaauuuguacuggauugugaaaauugauacguucuucuaggagccucaugguuccuugauaauuaauuuuuucauucauauuuccauguuauuucaccuugugcugugcaaaaauaagucuuauagaaaaccuguuuucuauguuuuuauucaucuucuggucuuuaaauuguguuaacagaugaguucaagagauugcuaaguacucuuccuagaccuguuguccagcuuugauccauggaauacuucggcgcuucauggcucacuaucugguuuucuuauuucagacuuggcaccaacaaugucuugugauguuuuugccaaaguaaaugaguguuauaacuacuuugugaagguuugguuuuauucucauuccauuugugguggaaugaaauucuuaaaaauuuuaaauuagacagacacagugaugugcaccuauagucccagcuacucaggaggcuaaggugggaggauuucuugagcccaggaguuugaguucagccugggcaacauagugagaccccuaucucucaaaaaaauuaaaaauuaaaucaauacaauuccaaauuauguguuacacauuuuggccugcuucacagacuaauaguucuaagaaucacauugauugagugagugagugauugacagugucuccuucuguugcccaggcuggagugcaguggcgcauucacagcuuaccucagccuugaucugccaggcaccaucaugcauggcuaauucuuuguuuuuuuguagagucggggucuuuacagugauuuauuuauuuuuugagaucugaucuagccugggcuagagcguacagguacagucauagcucccuguagcuaggaacuccugggcucaggugauccuccuuccucagccccccaaguaacuaggacuaugggcaugcaccaucauacauggcuaauuuuuuguuuuuuauagagacagggucuugcuguguuucccaggcuggucuugaacuccuggccucaagugauccuaucacuucagucucccaaagccacuaagauugugugcaucagccaccgugcccagccuuagaauuacuuuuuuaaaggagucacaugacuugaagcuuaaugguuuuaaggacuucaugauggagaaauggaagaguuagaagaauauuguuuaaacugcugaaaauaaaaccguguuuuuaauccacuuauucuguaggugauacugugcuuguccaccgaguucacaguuauuuagagcgucauggucuuaucaacuucggcaucuauaagaggauaaaaccccuaccaaguaaggaccuccuaccuggcugauaaauuuuacauuuuuaaguuacgguuucaggacuguauuuuauaucuaugaugacguuaggauuuuauuuugauucauaagacuauauuuaaaaauauuuccaaguuuaucuucuuaaagucaaguuaaauauaauaaauaaauaauaaaaaauauagucucuuaauaaaugugcauuucccuuaauuucuaguuugauagcuacuuaguaaaagauacuggauuuccaauuuaaaaaaaagaauaaaacaguacaauuuguuaaaaaugagaggaguucauucugagguuuuucucucauugacccauucuuuauguugucaauaguugauuuuuuaaugcuuuaaucauuuuuucaaaaggagacuuaagacuacaagguuagagguuaagggaaauagcuuauaugcagaauguguccuaauguaauuaugaaguaaaugaagcagauuauuaacaaauuaacuaagaaucacagauacugaaacacaugccugagguaaugagaaaauaaaucuuaagauaguggauuugauuuauaaauguucgacacugaauuugaauucauaaguuucagauauuuguuaauuuauuuucagguaguuuccauauuuugaaaauaacucucuguauuuuuuacuuuguaagcuauuauguuaagaaccuagagguuuucaugaaauaagacuguaaguacaaacuuuuauaccuaaaacaaaaucuuuuuuuucauuuuuugcuuuuagcuaaaaagacaggaaagguaauuauuauaggcucuggggucucaggcuuggcagcagcucgacaguuacaaaguuuuggaauggaugucacacuuuuggaagccaggguaagaauuucauuuugaguuuagaggcuugaccuauuggaaauaugguaagcaaauuaucuguugcaaauuaaagaauuauacaacuugaacuaagcuaaauugauuuguauaauacucagaguauuuuggauaguguuauuuauauuuuuaaaaagcuuuuuuuuuuaaugaaugcuuugaaaaguacucugugaagaggguuuuagaguauuucuuuuccugacugauauuuucagaucauuauuucuuguaguuagcucucaaauuuggggccuucauggacauauccuuuguuaggaggcaguuauuuuugaugguggaacagagugaauucccuguuuuugauaaagaaaaaaagcugcuucucaggcaggaaccaucuuuuagaagccaagauacugguuuuuuuccuguuaguccuagagagagaaauggaaacaggaggagcaauaagggauaauggcacacaguaggaaaaagagcaucauauuaggaugcuacuauucaagcuauuuucaugaauaauuuuugaaaucuaaugaucuucuaauggcuuugaacugcuaauuuuuuaaaagaguauggggaaauugaaauuaaauauuuuccugauauacuauuauuaaaaauuuuauauauuuagaaaacaucuuugugcacuuuguacauuuuguauuaaaaaauacaauaaggaauaauaggaccauuuugauuccuacccaugaggaguuuguaaucuaguauguagguuuuuguuuuguuugcauuuuuguuuguuuguuuggaguuccagaguacucuuacauuauuuauaaucauuaaauuaucgcuacaacucagccauacuugaaaaucccucgucagcagugauaaaccugggccuauuuagggauaaaagguauugugaacaggcuauguucaguauggacucucugccccugggcaugggggugcacuggagaaccauuugucagaaaaauuauccaucagauuuuuccccgcuaacuuuggggaucaggguguaagagucagauuacagugguagaaaguugguguuuaaauaguguugggauuugugaacaaauauuuucuauauggguggcccuguacauuaaaagguauuauagacaacuggauagagugguaccugugacuaaauuuaucuuccagcugucaagacuguuuuauaucacaucauuuaauucugugucguuuaguuauaugacauuuaauuauaugucauuuguugccugcuucuccuucaaauagucuucaaguuaaacuucauuuguucuuugugcccauaguacuguugauugcauuccauguaaacucuacaucuuuauuuuuaaauuauagaagacagagccgugguaugguacuaugccagguuugugguuaaaacagaauugaugauuuuggcuacuuaauuucugaaacaggaucguguggguggacgaguugccacauuucgcaaaggaaacuauguagcugaucuuggagccauggugguaacaggucuugguaaguagcuauugguuugugcuauauaguacauggucuaagacucauaaaagaaauuuaaagccagagaugcuauuuuaaaauguauugguuuagaauagucaucuuccguuuagugagagguauagcaguauguggaaaauguaaauuguacauaucuuuugaccuagaguaccuuuuucuaguucuaggaaauuaucauaugaagauaaguagauaauguuguguuugaagcuuuuuuuuuuuuuuuuuuugugagacagagucucgcucugucacccaggcuggagugcaguggcgugaccuccacucacugcagucuccucccucagccucccgaguagcuaagacuacaggcacacaccaccauacccagcuaauuuuuuguauuuuaguagaggcgagguuucacuauguuggccaggauggucucgaucuccugaucucaugauuaacguggcauuguuuuuguuuguuucgagacauggucucgcucuuuugcccaggcuggauugcaguggcaugaucucagcucacugcaaccuuugccuuccaugcucaaaggauccucucaccucagccucccuaauagcuuggaguacaggcaugggccaccaugcuugguuaauuuuuaauucuuuguagagaugaggucucacuauauugccaggcugaucugaauuccugggcucaagcagugcucccaaagugcuggaauuacagcacuggucucaaacuccugaccucaggugauccacccaccucggccucccaaagugcuaggauuaccagcaugagccaccauguauggcuuaaacuagcuuuugaacaagcuuauaggacaaguacaaagaaccccacuaauuuaugcuuguaauuacaaauacguuucauggcuuuagaaaucuaaagagauagguuaguagcuuuaugagccacaacgcccggccuuguuuguuuuuaauagaaacagggucuugcucuguugcccaggcugauguugaacuccuggccucaagagauucuucugccuuagccuuccagaagguugagguugugggcauuagccagcuugcccaucccugguauuguuuuucauagcagaacauuagaaaccacagauuagaauauuauacgaugagaaauauacagccacuaaaaaucauguagcuccguauuagcguaaaacgauguccacaauauauugcuaaguugaaaagauauuauaaaacaauacguauuaugauacuuuuuugugugggucuguaauuuuauacacuuaaaaucuagaagaaucuguaauguuaauuagugggauuauagguaauuuuuuugccuucauguuugucuuacauauuuuuacuuagagugcuuuuuuuuuugagaaauaauuacauacuguaagcuuuugagcuuuuuauauuuugaguaaaaauauuuuuuacuuuaagguuuuuguucucucuucauaggucuauugaauuuaauugcuugaguuuuuuucuaggagggaauccuauggcuguggucagcaaacaaguaaauauggaacuggccaagaucaagcaaaaaugcccacuuuaugaagccaacggacaagcuguaagucgaggacaaacagaacuuucaacauuucuuugguucacuugaaaacaauuuuaggagaaugguauggaugagcauauacauauauacacauauagagguguauauauauauaaacugaggguagagaugaugugauguuauucugguuguuucuuaacucuugagcuauguaggaaaggauuauuguauauauacacauuuaccugucuguuuaacauuuaucuuuagauauuuaaugaaggcuagcuagacaguuaaucuuuuuauuuggcuguggccacuuacuccaagggacuuauggaauugaaaccugauucuucgguuuuuuuuguauugugccuuccaucacgugcuuuagcuccauguguucuuuaugacuucaguucuguguucauaggcuaacauuuuugaugggcuaauagccaaauggugguacuuacucacaugcuuagauaggcuaaaguauuuauugaccagaggcauaggagcuuccuauacuuaguaugacaauagcaugaaagugaugaaugguauggggaauugcacaguuuaaugacuguaagauaagcuuagauuacauaagucaguccuaauuuuuuacaagugagugaaauucaaaaguuuguauuuagcaaaauuuuacugacugccuuuaucaaaaugagagcccacacuucucaggauauaaguacauauugucuuuauauuugggggaaauggugauuuccuauguauacgguggguuuagcuauucuuacuaaaaguaguaggaucccaacucgugaauuuugugugauaugucucaaggaacauccucacuuacuccuaucuaccuuaaggcuuuaugggguucauaucagagaaggacagacucucagggaaugcuuugguuuccauccccaccaucaugguccaaauuucccaccagggcuugggugggguggauaacaggaggcuucuugcagaauaaacugagcagaaugagagagaaaggaugaaauagagaugaacucaacaauugaguaaacuucucuuacucuaccaagaucuguaaaggauauagagaugaauaagguagucccugcuauaguggugcuuguagagaaauaauucuuuuuucccaacuuuuuauuauggaaauuuaaaaacacggacugaaguagaaagaguacuauagugaaccucuguuuucccaaucuuguuuuaucugucccauuccugcacuuuugaguccaggggaagucuggaguauuuuaaagcagaucacaaacauaucauccauaaauauauuaauaccaguaacauaaagugaaagccaaggauuagauagaagaacaaauugcuauggaagaaccaagguggcaagaggguguaugaagguguaagggaaaggacacuaagagaucuggagggaaggagagcauuuguaaauggcaaaucaggauuucaacauguguuuauggaagggaaaagcauugcuggcagaggagguuuaagucuuaaguagagaagucuguaaaggaggguaggauuauaccagcgaggguaggaagauagaaaguuuaggguggggccauguggugguggauguuacuugcuaggcuugauuguagguuggaacuugagagguuugagaacaggggaaaugacacgauuaagucaguguuaaaaguauaauauuaauaguaggcaauaaguacagaauugaggugaggggagggaagcaagucuccagaguggcuauuaccguccucaagaagugauaagaguccacaguaaagauuaaucacugaucauugagacgccaucuuuuucuuuagacuuuucugaauguagagcagguugauuaagucuuucuaacguaaagagagaacuuuuuucuaguagagauauccagagaaauggacugcuuucuugguauuagaugagcuuuagcgcauuuuuuaaaacauuuguuucuguaccacuguuguccucagguggggccugcacuggcugccagucugugaacugucaauuaccaguguggaaugagauaaagaaauuacaccacuaaccacacuguuaauucagauggugacuuuuuuuuuuccugguagcaaaacucucagugaagaaaguggugcguugauuuauccacaucuuaccaggaccagcccuuugaguagcacuauaaacaguuguuaaccucaugugugguuuuuagcauuuugaaugcagggauauuuuucccaacgaaauugguaguugucauucaacucugaucuguauaggauuuuucuaaguugauacauuuguauuuggugcaguagccaagugauaaggaagauuuuaaaccauucucaaauuugggaagggauucuuugcagcuuugaguuaugcuugccuuaguuaaucaaacauaaggcaugcuaauauuucuguacugcugucuccaguagucugucucagagcaagaauggaaaacuguugacuaauaaacuagccuuuuuuuuuuuuuuugagacagagucuugcucugucaccaggcuggagugcaguggcacaaucuugacucacugcaaccucugccucccgggcucaaguaauucucgugccucagccuccugaguagcugggauuacaggcaugcgccaccacgccccacuaauuuuuuuguauuuuuaguacagacaggguuuuuccauguuggccaggcuggucuugaacucccaaccucagguaauccacccaccuuagccucccaaagugcuaggauuaccagcaugagccacugugccuggccuaaacuagcuuuugaacaagcuuaaaggacaaguacaaagagccccacuaauuuaugcuuauaauuacaaauacauuugauggcuuuagaaaucuaaagagauaggucaguagcuuuauucucuuauugcaggagaagaaacuaaagcucacacacguguuugccuaagguuaucauaaucaguaaguugaagagccagaauccauugccugguguucuuguucagauucccauacuuguuugacuacaccuggcugacauuucagggaagauggggugagguuaguguaugcaccucuuucuaacugccugugugacgacaucagcugagucuccuucucugagagcuuuguuguaguuacucuaggagccagcaaggccuaccuaaaguaaaaauucauucagucauugauuuuucuuuaguaaacuuggaugaaaugggguucuguuucuccaugcuuuguggacagcuucagucaaaaaacguaacuuguugguucuguuguuaguauguagaaauuaaugaugucauccuguagaaggccagaaaguuacucagaguuauaucacuaguaauagugucuuaaggacauaucuccauacccagacauuuugcugcuguaggaaaagaaaucauguagcaagugauuuuuauuuuaugucauuguuuuaaucacaaucacaagaaucccucaaaaaguuuaccucucuguucucucuccuacauuuguagcuaguauauugaguuucugugcuuguuuuugacaagggacguuuauuuuauggcuuuggaugaccacaacaaagucuuccuuaguaaagauauuaauaugagagauauaauauaaagauauaauauagggauacuaagcauaucccucuaaauagaagggaucuccacuaccuuaagccuauaaaacagucagagcuaguauagcagcugccuucaguugauuggugauggaguuauacucugaccuaugcugucaucaguaauagcuuuaauuggacaugcggaagguugggaaauaggguaauucauauuucagggaacauuuugcuggucucugcugaggggacugaaagcacaauuggugggggagacagaggaaauggcucugaauauuuucugcaucuccuguacaucaggcaguaacucaugggcuuuacuuuuuuuuuuucuuuuuuuggaguaaugaaaggguaucuuaaucaaauucccacagugcuguagcauugggggggggguguggugugggguggguguguguggguguguguguguguguguguguguaccagcugagauccacagguuccaguaacugcuuugagaaacugagccuugauugcuucuugagaaugguucagcuguuaagagaaagaaugacagacagcaugugaaaaguaaugggugucaggucucuuacaaacaccguuaacuauagguguauuagguaucuaucguaacuuugccgguuuucauuuguguucuuauacaguggugcuuagguuaguaugcuuuugacacaggucuguuggccuucuugguuuucuuccuuugaacaaacaucuucaauaucuuuaugacagucuuucucugcccuuugaaaucauuacugccaauccaugcuuauuuauaaauguaaaaaucucaugccuuccuuuaaugguccugaaguugcaaauaguuuuugcccccuuaauuauaguuauaauacugacuuugcuuuuccaaacuauauuaauuuauucauuuaacaagaauuuacugggcaccucuacuauaugcuaaaaacugcuagagagaacuacuuagacauguugugugugccuuuuccauacacucuaaucacugcuuuaaggaagucaaaaagauuccuuauggggugggaguggggggaagacaacagucucuauagaaucacauugauuauuuuuguuuuuggagacagaucuugcaguguugcccaggcugaagugcaguggcacaaacauggcucacuguugccuugcccuccugggcuaaagugauucucccccucagccucgugaguagcugggaccacaggcacacaccccuacaccuggcuaauuuaaaauaauuuuuuguagaaauggagucucacuauauugcccaggcuggucucaaacuccugggcucaagugauccuccugcuucagccucccacagugcugggauuuauagaugugagccacugcucccagccuagaaucacauugaauuuuauuuggauuaaggauauauucgcccuauggggauaauagcuauaucucauuucccuuggcuguugaggagaaucugaauuagagacucuucagaaguaaauuucuucuucuagguuuuaccaaaugaacuaaucuuaaucuucugcuuuaccauaauucuagaagugcucgauggcaugggauggggagguggagauugacuguggccuccacuggccagauuuggccauuacugccuuuuucugauucuuucuggggauuucucuggcuaaaucucagaacuuugauuaccuagcguacauugcugcauuuaacuccauucugcucugcugcuguagaguuugugaagacuggaaguaagauagguguacaauguuucugaagaccuaaagagcuuguuagaaugauaccagagguagaaagaacuaaagagagcuguccuccuucgagauuacuucuugcaggauuggggaccuuguccagaaaguuguuuggcuuucccacauucugcaugggcgagacacacaggcuucccuuccccuggacacauuuagagacaguccauauaaucuacaggaccaagacaaucaggauugaaccuauuuggaauagugagacucuucaaauccuguuagucuugaaggaacuauuuaccuggagccuuucauagagaaauaaauggcuucaaaaagucaaucaaaaucuguuuaaagugauguccauuuuguuugcuucuuagaacgcucuuaacauuauugguccuuuccccaaaaauguuucuuaguuugcuguuacaaguucucacuguguugcaggguagaaauccaccugccuucuaaugugguacuuaaaacccauuguaaucauucguugaguuucuuucucaggauacaaguuaaggaucuagauuagaauagucagguaagauuuaaauuauugugaccuauguuuagcgauugccaauauuucaauuccauuuuguuguuauuguuccauaauaauuuguagaacuaauagaauccaaggauucucaucaaggggaaauaaaugacuuaaaguauggguaguuugggguuguugggauagucauuuguuaguuuuauugucuggauaugucaaauagaauauuucuaacuagcuuguuuuuagaaaugauccuguuuuaaagguauuaaaaagcacauuuugguuuucucccagucaguauugauuuccuaagggacaaguauuuuauguauuauuuuccaaauauuccuuuaauuucaaagugaaaucuuaauguuaguggggaaaaaaagccagguuucaaagcuaucccuggcugcacuugcaacauuccuguaauugcuuaacuagguggaaauggauggggccugguggcugacaaucucacauaaucucauacaacugagccucggguuagaaugguguaccggagaugcaguccugucaucuggugucagucaaauguggcagcaaucuuuugguuugguuuuuguuuguuugauuuuguuguuguuguuguuguuguuguuacuguucuguguuuuuccuuuccucuuuugaguuuugcuuuauuccucacugcuuucugacacuucccccucacuccccugucuuuuguuaacugccuuucuuuuggccauuucugugccuugacuuucccauuuggucucuguacaaucuguuccuuauuucucuggugguugcagcuucugagcuaacagaaugcuucugucaugcuauguguuuaaagccuugauuuuauugcugucauacaaaacuaaacuugauguggcuguugggcuguuauuuacaguuuauuucucucucugcugcacugguuaaaaggacacugucaagguauuuuuuucauaauuuuucaaaucauuuuccucacuguuuacaauaacccauuaaaagcuugaaaccuaaaucuuuuccuuucaaagauccucuccaucauacauucacacugguuuguuguuguagaguugcgccuauauguugggcuggugccauuugaguuuuugucauugaaagcacguguaaaacauuagguuuuuugugggugguguggguggacuaagggggaaaguguaaugaauccagugggcugcucagcaaacagagggaagaaacaggucaaauuuggucccucuaaccuugacagugucccuuuaaauauuucucuaccacacacccuggaccccaguuacugagccugagugcuguguacuuuuucaguaugaacuucccuuugugauugucauccuaguugcaaagauuaaagcuugucugaagcaagccauccaguugacacuggaagagcuuuaaucuguaccauuugcacacuuguguuugacacauucugcccuauuguagaggcauaugugaucuaguagucccucuuggcugcuauagcauccucuugcuaggcauuuuagaagcaacacauagaaauaucacuuuuauacuccaggaaaagcagucaggcgcauugcaucugugaucaguuaaggucucauaacuaccuagauuucacauugaaauguaauuguuucuccuuuuugaaagaaaaaccaaauuuagauuuccagaaccaucuuuuguagcaucauugcaggauuugcacuagaaguagcauguuucugagcaaaauuucagcauuguuugaguugcucugcauaugaccaucacauaucacaucagugaggaaaaguagcugagaaaguaaaugaaauuccugaccaaagggucucuuccaucagcucucauagcuguguaauaagaacaagcucuuuuuuuggccauugaguugaaugaguaguagaucacagguuuuugaucuaccagucuuagguaccuuccugauauaaauggcaccaaguaucugaagccugauucucugccucauuuaacacaaaccagaauauuuuuagagauuuagauuuucuuuaggcuaaggguaauucuuuaauuauaaagauacccugaucccucccauguauagucuuugggaacuuacuguuugaauaugauuuuuaaaucaguuaugguaucugucauauuuacaguucaaaggagaguugcaguccucuuucuuuuugggggcagauugcccuucuugccagauucuuucugccacacacuggcucaucucguaguguuacuuguguuaucagugaaggagcagaggccaggguucaaaaucgucuguuggguugggaaguggaaaaacuguggaguuucaaaugagagguagaaucuuacugggauggucuugucaacagucaguuaccucugauuguaaaaggucgcuccuccugagucuuaguguuuacuagaauuugcuucaauguuuuauuuuuguguuaccaguuuuagguugacuguauaaugaaauucuguauuuugaaucacauuucccugcugauaucagcccagcuuauaacaaguaaugcuugccuuaaacauauuuuuucuuucucucacuucugccaucaauucaacaauaggauugcagauacaguuuacuuuggggcugaauuaagcaguagcagagggguguuuguaaacuaacugauguuaucaauaggcagggacacagcauggcuuaggaucauggucuuccagcuugaugaccugcuuugcaaucuguuugcuucauccacaucaaugaggagccagaccuucugguccuucauuuacucauagacucucuuaagagcuuuguacauucaauucugaacuuauuggugccauaaaauauuauuacugugcaaaagaauaaaagugcuaguguguucuuauuaguagccaugaauuucauuucucuuuucccucuucccaccugagauucaucuuugaggggaagccagauaccuugggcuucuuauuuucccauccugcccuuauucuuggaagguccucagguuuguugacaugguuuuuguucucugggacuuuucuaguguguuguuugcaugucagccagcucaacuuaaugcaugucagcucagugccacuugugcuccaugugacuucaguuagcaccaguguaaaucuuguggcuguuaauagagguggagucccagcucugacggcaguagugggagaagaagaggaaauugucagggcccaaacauuucauaucucauuuaaauggaucugaccacuucauagaaaagaaaauuugaaucauugugcucaaagguuuccccuuugagauacauauuuugaccuuuauaaacuauagagcauuuguguuuucauggaugguuauguuuaguuuuauaaggaccaacucugcuauacuucggauuuucagguuccuaaagagaaagaugaaaugguagagcaagaguuuaaccgguugcuagaagcuacaucuuaccuuagucaucaacuagacuucaauguccucaauaauaagccugugucccuuggccaggcauuggaaguugucauucaguaaguacuuugauacugcuuauuguauagugaguuccauguguaaagauuugcuauuuauguuuuaaguuuuucugcaagucuuguuugagguaguuuuuacuuaauuuuguaugaaaccauugaauccaaaguuaaaaauuauuuaaaauaauuauaugaucccuuaaggccccuuucacuucuaaaauucagugcuuuuaugguauuauacuauauuuaacauagccuaggaaauaauuuccaacuagccaacuuucuuguuccuaaguaucagaaguuucagugggccuugaugcccuuaaauguuuuugaugggcaccugucuuauucugcaaaguuggcuuugagagcagauuauacauauugucucucuuagguuacaagagaagcaugucaaagaugagcagauugaacauuggaagaagauagugaaaacucaggaagaauugaaagaacuucuuaauaaggugaaauucuguauuuucuucauagcugaagaagcuuuaauaggagaaaaagucuuuagaaauuuuaaaagcauuuccgagauuuuuuccuccauggaagagaaagucugcacagcugggacucauucuuaagaaaauaaugacuaacgaaagagacuguuuuaucugucagucuuucaguguggcauuauugauaaaugguugccagaggaaauagaucuuuccucuuugucugguucccuuuggcucagggguguccagucuuuuggccucccucagucacauuggaagaagaagaauugucuugggcaacacauaaaauacacuaacacuaaugauagcuaaugagcuuaaaaaaaauggaaaagaaaauucaguguuuugagaaaauuuaugaauuuguguugggccgcauucaaaacuguccugggccacgaguuggacaagcgugguuuagcuauucuaaagcuaucccagugcccucagcugaauucuaggacuagcaggagaauuagcuguacuggagccaaguuuucauuggugaagaccaacaaaucagcagccaguucauuggcauaauuauuucucuugaguugcugccacccccaccucuguuccccagggcugaaccguuagggcucuucucugccaccgccuuccagagccccaggcuccagcgcauuaaaguccaaccauuugcuucuccucacccugccagcugcaaaggucgcaucagcuuagggagaaaauagccccuggagggggccuuuauagugcauacucugggugugccugugacuggacucuugccucacucucacugugccucauucuucauccugucuaaugaagagaucuccagcucacagucuucauggauugugguaaggaugaaaugagaagagugauuuaagaacugccaaguggccaggauaccuguaggguggcccagucucaggcuuugucacucuuguccugugugguaucaucagaaaccugaaaaaagcuaacauuaacaaugguuccuuaagauucuuuggccaggcacaguggcuuaugccuauaaucccaacacuuugagaggcugaggcagguggaucauuugaggucaagagcucgagaucagccuggccaaauggugaaaccccuucucuacuaaaauacaaaaaauuugcugggcaugguagcacacaccuguaaucccaguuacucaggaggcugaggcaugagaaucauuugaaccugggaggcagagguugcagugagcugagauugugccauugcacucuagccugggugacagaacaagacugugucucuuagaaaaaaaaaaaaaauucuuugaccuuuuacauauuuaaaaaacacauuauaggaccaggcaugguggcucacgccuguaaucccagcacuuugggaggccgaggagggcagaucacgaggucaagagaucgagaccauucuggcuaacauggugaaaccccaucucuacuaaaaauacaaaaaauuaguugggcaugguggcgggugccuguagucccagcuacucaggaagcugaggcaggagaauggcgugaacccaggaggcagagcuugcagugagccgagauggugccacugcacuccagccugggcgacagagugagacucugucucaaaaaaaaaaaacaaacacacacauuaugacaauuuguuuccgaaaauaaguuuaaguuacauuagcaacaguuuccuuuuuguggagauuaaauuuauuucaauacuggguuuuuucuuuguuuguuuaaauuaaugggacacuccucauccuucucauucguuuuagaaggcagcacugaucuuacuuaucagauagaguugugguaccuuuaugucaagcccuauaagauuucuuuccuauuucccaaauggaaugauguagguuagaacaaguacuuaagaauucucaggaccuugcauuguagcccuguuuuguugggauagcaguuuugaggagccaaaaaaggguacaugugauguagacauaaacuacauugcuaucuggaaugguaaauuuguauuuuuccuucuuagaugguaaauuugaaagagaaaauuaaagaacuccaucagcaauacaaagaagcaucugaaguaaagccacccagagauauuacugccgaguucuuagugaaaagcaaacacagggaucugaccgcccuaugcaaggugugguauacauacaugccuaacugguuuuacuuggaauccuaagaaauagcacagaucuggggaauuuuggaaaagagagccacuagccaaucacaagugccuucagugcaaugaagacgauuugguacauaaggagccauggggauuuaauggguuaguucgguuuaagaccugcuuguccugcagaauucuuauccugucuuaauaaucucaucauuuuaucuuaaaucucaauuuagcccuaacaguuuagaguaagaguauuaaacauggacuucagagucauuuggggucaaacugucugauucaaaucccuaacuuggaaucucgagccaugugaccuuggacuccuuaauugccucaucuguaacauggucuuaacaccuaccuuguaggguaauugugaagcuuaaauaaaauuauguauaaagugcuuacccagugccagggacauggcaugcuuaugaaauggugcuugcuaugauuuuucauccccacuuugcagcacacuaguauguuucuuccauuauuuucuccugugugcuccuugccucccccuaauauuccaggcccccaacuguaacuugucuccaaaaacaaaaaucucucagcucuaucuaaccccagccuaaaauugagccacacuuccuguacaugaucugaagaggaaauaugauccagaccuuauacuuugugguacaaagaaacuagguggauaucugacccuucaggguaacucagguucacuuaauuuuuaucaggaauaugaugaauuagcugaaacacaaggaaagcuagaagaaaaacuucaggaguuggaagcgaaucccccaagguaaggaaaacaaacacaaaaguucagagggagagcuuuuacuguucuuucagcuugauuuggaaggaaaauucuaaaucauaaugagcuuuuauuuauguucagugagugguuuaaauuguuaaauaaaugaaugugugacuacuuuugagguuucuaaauccccugcuccuguauuuuaauguguccuagauaccuaaacagauuguuucuaaagagagagccuuucuccguaagaucugauauuuggauaaagauguaauagauggaaauuaucuuucuugagaggguagaaguugcuguugcuuuacacuuccauaauuuuggaaacuagcgggguauuauacuuuauuuccacuggguuuuugacagugaaugcuggugaaauguuuucacuugcauccagccuccacauaaaucuguucuguucuguauucaagaaugcuacccacccuuucuuuuuuugagaugggaucucgcucuuguugcccaggcuggagugcaaugaugugaucucagcucacugcaacauccaccuccuggguucaagcaauucucuugccucagccuccugaguagcugggauuacaggugcccaccaccaugcccagcuaauuuuuguauuuuuagaugggguuucaccuguuggccaggcugaucucgaacuccugaccucaggugauccaccugccucgaccucccaaagugcugggauuacaggcaugagccacagcauccagccugcccauccuuucuauagagucuaugcuguguguaaaauauaagacauuuuuuacaacuaguaagcuuuuaugauauaaggugauuucauaugaagcauucuuuuuuuuuuuuccuucagacaaaugaggccuacauguaauuugcuuuacguagugagcuuggcacugcucuagacaucagagauaaagagguuaauaagacagauaagaugcuacuuuuugauuuguaauuucuucauauaaggcacagcccuggcuuagguucugacacaguuacugagaucaccuacaucacacugagagaacuagugauaucuuuuaauaauccuguaguccuuuguucuuuugcagugauguauaucucucaucaagagacagacaaauacuugauuggcauuuugcaaaucuugaauuugcuaaugccacaccucucucaacucucucccuuaagcacugggaucagguaaguuucccuuauuguuuauuuuauugcacaugccuuugagagggauuguaagagaaauaguuaauuuuguauguguguuuuuaaacagcuuuaguaagagacaucauuuacauacagugaaauucaccuauuuuaagugaacaguuuauugauuugccagacuucagucauaagcccccacacaaucagaauauagaacaugcccaucauccugaaauguuuucuccugccucuuuguaguuaaucccccaugcucuggcuccuggcccuggacaaccacugauuugcguuaucacuguaauuuuguuuauucuacaguuucauauaaagugaaucauacaguacauagcuuuuugugugugauauauuucacuuaguauaguuuuugagaugugcaugaaguuuuugagauucaucuuuuuugccuguaucaguaguuuguuccuuuuaauuauuuaauagaauuccauuguguggauauaccacuggugccuuaaugggcauuuggguuguuucccuuuuuugacugcuaaugaacgaagcugcuuaagaauguucaugucuuucucuugaguaaauauuuaugaauggaauugcuggguacuauggaaaguggauuuuuaacuuuauaaaucaacuuccaaacuauuuuccaaauugccuucccaucagcaauguaugaaaauuccauuuucuccaaauccucaccaaucuugguaaugccaguuuuuaaaaugucagccauucuaauagguauaguaguauuugcauuucccugaugacuagugauguagagcaacucuuccugagcuuaugagccauucauaugucaucuuugaguaaaugucugcucagaucuuuugccuauuaaaaaagucugauugucugcuuguugaugaguuugaaguuuauuauguucuuuaaauucuaggcagaaguccuuugucagauuuauguuuuacaaauauuuauuuccuugucaucuguggcuugucuuuaauuuucuaaaucugucucaaagaguaaaaguuuuuacuuuaauuuuuuucuuuugagacaaggucuugcuuuguugcccaggcuggaguggugugaucauggcucccuugcagccuuuaccuccugggcucaagugaucuuccugccuuggacucccauuccuauuuauaaaauuuuucuuuuaaaccauguucuuuuucuaucuugaaaagaaucuuugucuuaccuguggucacaaagauguuauccuguguucuccugcagaaauuguauggguuuagcucuuauguuuaggucuauacuccauuuuguguuaauuuuuauguuuaaggaaagguaagugaaggguucauguuuuuccauauaguuauguaauuauuauuccagcacuauccuuuucuucauuugucuuggcaccuuuguugaaaauuaauuggcauguaagcaugaguauuuaggguugucuuuucuguuaauuuaucugucuauccauaugccacuaucauacugucuuguaaguucuccaacuuuguucauuuuugaaauuguuuuggcuauuuuaagguacguauuuccauaacaguuuuagaaucaacuugucaauuucuacaaaaaucaccuucugggauuuugauuaggagugcauuaaauuucuaggucaauuuagggugaauugccaucuuaacaauauugaauauucuuauccuuaaauacaguauacuucuccaaaaauaguuuucuuucguuuaugucagugauguuuuauaguucucagugagcagggcuauaccaucuuuucuuaaauuucagugugauuuacucuucaagugagaaaucacaaggcuucuuggaccaaucucuaaaucugagacuuuggccagaauuaagacuguauaggcuggguacgguggcucacgccuuuuuaaacccagcacuuugggaggccagagcaggaggaucaauugagucaggaguucaagaccagccuggcccugucucuacuaaaaauacaaaaauuagccgggcaugguggcgggcaccuguaaucccagcuacuugggaggcugaggcacgagaauugccugaacccaggaggcagaggcugcagugagcggagaucgcgccauugcacuccagccugggcaacagagcaagacuccaucucaaaaaaaaaaaaaauguauagaaguaaauuauuaaauuuuuauuuauauauuuuaguuuacauuauacauuuuccuaauaaaaauuauuuugacaggcugggcaugguggcucaugccuguaaucccagcacuuugggaggccaaggcaggcggaucaccucaggucaggaguucgagaccagccuggccaacauggugaaaccccaucucuacuaaaaauacaaaauuagccuggcgugguggcgcaugccuguagucucagcugcuugggagacugaggcaagagaaucgcuugaacccaggaggcggagguugcagugagccgagaucacgccacugcacugcagccugggcaacaagagcaaaacuccaucucaaaaaaaaaauuauuuugacuucuuaaucuuuagauuauaaucugauaguuuuaguauuugaagaguuggacuuguuagagauaaagucuugcagaacuaccaguuccuuugugguuuuucauguaaauacuaacuuaggcccuucuagucauugauuuaucauuugauguuucaauaugugucuauuuguaauaguauuaaauuuuaaaugagugauuucagcugaaguagaguguugcugccagcccaguauuuugaucuaauuuccccaagaauuucaugaaauuagaaauccuuaccagcuuacaaaaaaaauguuacauagaaaaauuuucaguaaauucaaagaaguaagaucauuuuggggaucuuuaaauuccuggucaauuccugacuuuuuuuuuacuguauggacugucuugggccacucuuuaugguccuagauuaccuucaucuaguuugacugacuuaguuuuggaaaucuuccucaacuucaaaccuguaaauuuaaagaauaaaaacugauuuugcucucagguaaaagaaaauguaaucaggacugugacccugauauccuucaagucuguaauguauucaaaagccagauaaauaaacuugaaugauguuuaaucaucugaauuuccugaaucaucauucccccuaccaccucccuacccuaaccaccauagaagauccggacuuagugguauuggacuggaaugauaaaaacuauccagggaaggccgagcgugguggcucaugccuguaauaccagcacuuuaggaggcugaggugggugggucaggaguuugagaccagccuagccaacguggugaaaccccgucucuacuaaaaauacaaaaacuagcgggguguggugguacaugccuguaaucccagcaguuacuugggaggcugaggcaagagaaucacuugaacccaggaguccgagguugcaaugagccgagagcacgccacugcacuccagccuggaugacaaagcaagacucuguaucaaaaaaaaaaaaaaauccagggacaaaagaaacuucccuaaucucacuacccgaagauuuagggacauuuuuugguguuuucucuuuuuccuucaguuuccuuugguaacuguagcuaaauacugagugauuuguucuuuaguuugccuuaaaauauugacuguuuccacaagcuuguguuuucauuguuguuguacagaacuaggugcaaaugacacagauuaauaaaagguuggaaauauguucuuuucucuccucuuuaggaugaugacuuugaguucacuggcagccaccugacaguaaggaauggcuacucgugugugccuguggcuuuagcagaaggccuagacauuaaacugaauacagcagugcgacagguucgcuacacggcuucagguaugucacugcuuuacaaaagguaagagagaacucuccugaaacaggacugaucuuuuguuaggugcgaccuaucagguacauuuccugauagaguguuuaugacaccauagguaaaaauuggcauuuauagacaguugagccuauagagucuuuggugguucuaacccuaucauuuuauaaacugggaaaucgaagcaaguuuuagaguuuccaauuugugcaugagcuaguuggauauuacuggucgagcaucccuaaucugaaaaucugaaaucucuaaugccccagugagcauuuccuuugagcaccaugucagugcucaaaaaguuuuccauuuuggugacccagugaguuuggaucuaguuuuguuaaguauauucauaaauaccaggauuuuggccccugggcuccacuaggacccaccccuuauauuucaccauccgcauuuuggucuuuggauucauuuuggcuuuuucuaugcauuugggcuaauucgcuuacguuugguuccuaguucuggagcaguccugcuaauaaguugacuucuucagagauagaguuucccugugcuugcuauggggauaggcucaaugcucauuauuauugcugguuucaggcuacauuugauguaaagugcagacaacuguuggauuuugaacuccucaagauaacuagucaucucccucucugagaacccauguaugacuauguaggcaugagaaauggagacauagccaucaaucuuacccugcgcugccccuuuccuuggaguuacugagaucaccacagauguuuugguuuuuuacuaacaaucagugaaacaguuuuccauuuaauuuucccaucagaggcagcuuguaguugacagugcugagaagaucugcagccuugagccuuuugcaggcagacggagaacagugagaauagauguugugccauuuucucgaguucugcagccauagaaaaugagcauguacugagcuuucauauuuauuuugagauauauaauuucaaaauauauauaguauauaaacagacauucauuaaaaaacaaacgaggaaaacgauguuaacauaauuucaguacccucucugaggucagcuuugaacucauucauacucugacaagcugagaaucacugugcauucucaagcauagcacgcuccacaguuuuaggcugcaucccccagaucugcaucacagccuucuuguagcauucuucuguuggucgauagugagcagcuaaccacagucagaagacauugguucuauugggaugagcacuuuauucuuuauuuuuggucuaaauguacuuaacuugaguaagugguauaagguccuuucauuagucuagaucaccaguguaucaggaggguaguguggggaugacaguugaggauucugaaguugacuacaaggguuugaauccuggcacuuauuacguguguagccuuagaugaguuauuucaccucuaccucaguuuucuuaugugaaacaugaagguaaugaaaauagaaaaaugagaauugagaaauggauguccaucuguuguacacuaaauguucaguguccuuaucagugccauauucaucaccacuagucuuuucccacccaaccucugcaggaugugaagugauagcugugaauacccgcuccacgagucaaaccuuuauuuauaaaugcgacgcaguucucuguacccuuccccugggugugcugaagcagcagccaccagccguucaguuugugccaccucucccugaguggaaaacaucugcaguccaaaggaugggauuuggcaaccuuaacaagguagcuugcccuagacacuccugucuacagaucugauguacaaauagcagucuucguuguuuacuuggugaggagguggccuugcauuuuugggcauuuggcuaugcucccaauugugacaucagggcugaggcgugucaguugauucucuucagugccuaagucuaucaucaagugucuguucauauggacuuagucuuauggggucauuucacaaacucaggccuauaaaaaggggaucguaaaugucauccuaaauaauaaggauugcugggcuuauuuugaaagcagauuagaagagacuuuaaggaagucuguugaagccaguauuaucuggccccugucacuggcucaugugcuucuuucuuaugguaggugguguuguguuuugaucggguguucugggauccaagugucaauuuguucgggcauguuggcaguacgacugccagcaggggugagcucuuccucuucuggaaccucuauaaagguaaaugccuucuaauuuuaaucuuuuccauauccuuacaggaauauagaauuugaaauauuuuggguuuucucaauauauaugccuuaauuucucucuuuauuaacucaacaaacaauuccugaaauaccuucuagguacugggguauaaaaauaccugccuucaaggagcucccaacuuaguggggauacaguaagcggggaagcaggcuuagaacagggcaguagguggccugaugggcugaacgcccagguuacuggagguccacucagccuggagggauaggcccagggaggcuuccuaccaggggaagcuugcguucucauucucagacugacuugccccugauucuuugauuacuucucuuacuauguguuuaugaaauuccuaccuccuguucaguuauuuucuuuuguaauuggacuuaacuguauguagacuuguaauauuuguaccccaccucauuccaagaaaaggcuguaaaaauaagacauuggccuugucagugcagacacaucagcuaaccguuggcuugcuccccauccccaguucuuuccauuacuccucacugcccaguggugaauggucuuucacaccccagagccucuaacuucacagagggggaacuuggcucccugagcacauugcuuucugagagcagcagcgugucuuuucccuuccccauccaggcugucaaguccugucagugcuagccuuacaaucucuugcaaaccuauuuacuuuuuucuauugccuaccucccaguccaagccauucuuaccuguugccuggacgguuaccaauagcuacuacugcuauuccugcuucuuuuagugacuuucuacugcugaaagaaaauguucaaacuccuuaucuuggcccaugcuaagguucuucauuaucuagcucaucucuacuuccuuguccauccccagauuccaggcacauucggcuguucucacauccuggaaggcaccaugcugcuuucugccucagagccucugcguguacuguggucuaggccugggggugcugcuucucccacccccucgacccccuuccuucccaaccugucuuacucagcauucaggucuugacauaaauuucaaaguauuucaaagacgacuuccaggacacaucuccacugccccaaauguaaauuaaauaccccauauucuuuuccguguagccuacguuuuucuucauagcuuuuaaguuaauaauugucuguguaauuuugcaucuguugcucuauuggaguaauaguuuauaucauauuuuuuaucccccuuuucuaguacugugccuaccaccuaagucuguugcauaauuacucaccggaugggugacugaagacaguccugggcuuggaggggccugggauggcuaaaagggauguagucauugucauggagcuauccaagguagucaagguuaagaauucugugccaaaguaaagcgaugcuuaauaauucccuuuuauuagcaagaucugaaauuauaucuucagaacugcuguauuuugccagguuagaagcagugaggugccugagaaucuuacuucacucuagucugccagcuccuacuggcuggugucuggcgacaaagaguucuguaugcuguuucagaaacauaaucugucucuucgcauuugaaugguacugcgugugucuugucaucagauuucagagcaccaggaauaagguggggccugauaaggaaguuuuugaggaaagucuguaggaaaacccuagaauuauccuuucuguuuccccagcuccaauacuguuggcacuaguggcaggagaagcugcugguaucauggaaaacauaagugacgaugugauuguuggccgaugccuggccauucucaaagggauuuuugguagcagugcaguaccucagguaaguagguagguggggcaaggagggaucuaggguucagacucaaccaggguuuaauguauuugcagcauguucuuggucaggacaguuuaagcuagaauugaggucugugcuuuuacaugaauaauuaauguuuggaguucauggccuaagcgugggguucagaaaaccccccaggacaagagcuggggagucugaaggcugcuagcugcauuucuccuccggcuuuagagucacaccagaucccugacauuuuagacaaaauggccaaacuccagugaguaucuccgggaaguuuucagagaaccucuugguacuuuuucguguucuuugaaauacuuuaacccuuuaggauuccuuugaagggaaggauauugugaauuuauaaaagagaauaaaggccaagcccuguguagaucucuggauucauagacaggaaggcaacauggaggggcauccuuccugucugaaguccuuuuguccauguguguuuuaaagcaggcauucaucacuugaucacuggcucucacauguugccccucuuucucuucacuugcaucuccacccaccacugcuuuuccaccuuucaaggauugauuugugcuuggugucucguaaugacuuuugcuccugguuuuucuuuuagcccaaagaaacuguggugucucguuggcgugcugaucccugggcucggggcucuuauuccuauguugcugcaggaucaucuggaaaugacuaugauuuaauggcucagccaaucacuccuggccccucgauuccaggugccccacaggugagaagcuggcaaacuaucugggcuuauuugggaagaggccaggaucucaugaugucccugauuuuuuuuuuuuuuuucagauuuuagucauuccaucuucggacccuuucagauaaccaagagcagaguuaaaaggaugggcagcauuucugauuucucauaauuugguuuuguaaaucuaggcagucuacauucagaauggaggaguccagaguauaagucaaauaacauuuuuccuuauucagguuuucucccuaaaaaacaaaaccauuuuuaauugcacuuccauuuuguaauggcucauaggauugcuguaaggucucaauuacuaggggcuuccagggcauuucugagaaauaacccuggguccuugucuagacccuuaugccagaccccacuccaaagagcgguaagaauuccuuagugucauagcccagaccugcugagcugcgaggcuuaagugucccugaucaccaaauguccugugcuucaggguagcgaggcucccucccagaagguaguuauacaugagggaaggacgcuuuacaacuggguaucuaaacugaugagaacacauguuaagcaucacuuuaggacugagccuagguagaguuuuauugucucauuucuacuugucaauucugggaaagugccuacugauaagggagacucuucgauagaaugaugaauaguaauugggggggucagccuuuaaaaaggucaacagcaauuuaaguacuuagcaauuuaaguacaagaauaaagguauaugugcagccugccaauuuucucuuuuuccccuaaaauagccgauuccacgacucuucuuugcgggagaacauacgauccguaacuacccagccacagugcauggugcucugcugagugggcugcgagaagcgggaagaauugcagaccaguuuuugggggccauguauacgcugccucgccaggccacaccagguguuccugcacagcaguccccaagcaugugagacagaugcauucuaagggaagaggcccaugugccuguuucugccauguaaggaaggcucuucuagcaauacuagaucccacugagaaaauccacccuggcaucugggcuccugaucagcugauggagcuccugauuugacaaaggagcuugccuccuuugaaugaccuagagcacagggaggaacuuguccauuaguuuggaauuguguucuucguaaagacugaggcaagcaagugcugugaaauaacaucaucuuagucccuuggugugugggguuuuuguuuuuuuuuuauauuuugagaauaaaacuucauauaaaa

SEQ ID NO: 14182 - RNA, 647 nt, Homo sapiens
gauuauccaaccacaacugcagcugcauuuaaaugacauaaauuguauuacauacaaauagacauauguuauuugacuaucuuuaaaaucaucuuuuagcuggcugcaguggcucacaccuauaaucccagcaguuugggaggcugagguggaaggaucacuugagcccaggaguuugagaccagcuuaggcaauauagugagaccccaucucaacuaaaaauauaaaaacuggcuggguaugguggcacaugccuguagucccagcuacuuaggaggcuaaggcagaaggacugcuugagcccgggacgucgaggcugcagugagccaugaucguaccacuguacuacagccugggcaacagagcaagagcuuaccucaaaaaauaaaaauaaaaauaaauaaaaucauccuuuuaacuuuaaggccccaaacaugggcuuuccuuuaauuaaaacagugacguuauacuccugaaaaagaaacugaugaacacaaagccauaucaaauaaguaaauuacugaagaagcugggguuauuuagccuaaaagagaaaaccaccuaguaacuugccaaauccauagagcuagaagggagcaacuagcauucaaaccuggguuauaugacuccagagauacuaaguggau

SEQ ID NO: 14183 - RNA, 1832 nt, Homo sapiens
gcucggggagugguggucucccuuuccuggagucauuugugggaguuagggucuuauccugaucuuuccucgucccccgcucccccguccuccgagguggcagcugcguaggugaacguucccccuguccccuuccuucuccuuccuaacccgaguacgcuugcucgcggccacaguggcugccugccccaggagcggggagucccugccuuugggguagggaaaugacugaaaugugggaccugcgggcuccucgggcugacuuggaccucacugcagcucuggagguggaccucguccugggacccuagaagcccauuuccgcacucgggcuaggccuucggagccgcggcagcauagugggaggagucgggcucagcucccccccaccacaaccgggauuauuuuuaucgguugagucaucgcacuaccuuucauccuuguggcuuugggcaaguccccgcccuccgagccucacuuugcuuaucugugaauggaaauaacagugccuaccccaugggcuaucgggaggaucaguugugagggaaugcaguguggggugucuggccggcagaauuccacaaaugguagcagcgguugaugucacuggagguuccuggggcaguaauuuaucaagaguuuaugauccugaacuaaggaucauacggaggaggaucuguguauaacguucggcacaauguuagauaggaaguaagggcgcagugcacuggaguuauuuuuucuuuuuuuuuuuuuugagacggagucucgcucugucgcccaggccggaguugcagugccgcguugucgccucacugcaaccuucucugccacauggguucaagcgauucuccugccucagccacucgaguaacugggauuacagucgcacaucaccacgccuggcuaauguuuugcauuuuuaauagagacgguuucaccauguuggccagccuggucuugaacuccugaucucaggugauccacccgccucggccuuccaaagugcuagaaguauaggcaugagccacugugccuggccuggaguuauuuuuucucacuggguuuuugagcaaagaaaaggaguuauuaacuggugaggauaaauuuguguuugguaagucgucuucugaagcugacaggauuuauaagccggguaaauuguggugcugguucaucuuugagagccagccuuaagaauuggcccacugacugcugggcgugguggcucacaucuguaaucccagcacuuugggaggccgaagcggguggaucacccgaagucaggaguucgagaccagccuggucaacauggugaaaccccaucucuacuaaaaacauaaaaauuagccagguaugguggugggcaccuguaaucccaguuacucgggaggcugaggcagagaauugcuugaacccagaaggaggaaagguugcagugaaccgagaucacacuacugcacuccagccugagcgacagagugagacuugucucaaaaaaaaaaaaaaggaaagaaaaaggcccacugacagucuguuccuagaaaccuggguuguaaagacguugggugcugggagcuagaagaaguaauaaaaggguguuuuccuaaguggguuagggguuuucacucagaaagguuuuugggcaggaggggaaagccugagaaguuuucuuccucuugaguuguuauaaaaguaauacauguguguaguuagaaaacaaugcagaaagauguaaaaugaaaaguguuucccccuucuacuguuucugcccuucagaaguaaauacaauuaauuucuuugauaacuuucuaucuauuauuuggauauau

SEQ ID NO: 14184 - RNA, 441 nt, Homo sapiens
ggcagaaugucucccgcaaagaaggguggcgagaagaaaaagggcccuucugccaucaacgagguggugacccaagaacauaccaucaacauucacaagcgcauccauggagagggcuucaagaagcgugcuccucgggcacucaaagagauucggaaauuugccaugaaggagaugggaacuccagauguacgcauugauaccaggcucaacaaagcugucugggccaaaggaauaaggaauguccuauagggaauccaugugcgguuguccagaaaacguaaugagggugaagauucaccaaauaagcucuauacuuugguuaccuauguaccuguuaccacuuucaaaaaucuacagacagucaauguggacaagaacuaaucucugaucaucaaauacaucaaauaaaguuauaaaauagcaaaaaaaaaaaaaaga

SEQ ID NO: 14185 - RNA, 2568 nt, Homo sapiens
uccagaguggcagcaugagggcaucccucgaggagagcaagaggaggucuaaaucaucuaccuccuaaaacacagagugagaagggagaggccccugguggcaggcggggaccaggcaguaggagagggaagggcaggguccugcagggauuagcccucccuggccucuuacuuuuccagaggaggagaucuggugggguuggaccaggcaggaaagaggcaagggucuggacauuccacccauaucagacccaaaagacaagggcagcugaggggcccgggcuggaaggagggcaggcagcuguuugaugggugggaugugcuuaaacacugcucucuuuucacuaggcagacauggaagauccacaucaagcugguagcaguaggggagagaagucagagccuuccuucuggcuaggggggugggguggagugaguccuggggagccaggggacaauggggacaauggggaauggcacugcuucuggcugggcccagggucaggaggugggguuaaguggaugggacaucucuuuggcuuggucaggucuuugucucugagaaguacccacguuugggccaggaagagugggaacccccauucccucuccccuuguggggugggugaggagauucuguacuuucagagaggacccaggcuaaaucccucgaaaaguucugaucucauaauccagccccaucagcgggcuuaucacaccaccuggcccucacccucauuugggguucuuaaagucaggauccacuuauuagcaggguuaccuauagccccuacuucucaccaaggcccccaucuaugcaggcagagcggguguggugagaauucauccuuagcaggcuacgggggaggccgaauucacugugaugacgugacauugucuguuaggggucaacagagacacccaagaugcuauccugaccccaccacuuacaagcugugugaucuuaggccagucccgucaucucucugagucucacuuuccccaucagcuaggaauagaauaguaacuaccuccuugauuuguagcaggaauuaaaggaguuagcccacagaggacacccagugaggaguguggcacacagugagaguguguauagcauugcauccaugcuaagauacaguuuuuaguaucagggugcaucgcauaguugaugguuagcuuuuugauaugaccucaaaagcaggugugucucuguuggaauuucaccauuagagauucaguccuuggccucuguggucuucuggaguaccugcuucaagggggaaugggaauuuccaaaugugggcuaaagcuaaaagaaaaagaaggcacugccccacuucuaggcgggccccuuggucucagucaucaugauggucuggccuuaugccccaucucucaugcuuucccuggugcauucugaagaagaggcugucgguuuuccaguuugagaacuccugggccugggaggaggauggcaagaggagcaggacauggagcccugggggcagagggaacaccuggagagaaagccuggaggguggcggcagggagagcagcugagcugaacuaacucugucccugccaggccccgguaaccaguaaccaaucuccagacacugucaccgcucagccacaaagcuuuguccacccagccaggaugaugucuggauaccaggcgagccauuccaacacucacggccgcuugggccaucccaacaacacauccuuuccagcccaaauuccaggcuggaccaaacgcacccuccugaaugaggccaagagccucaagcgccuccacacccggaguggcucuggcuuggaguccagcagcugcagcagcugcucugagcagcccuucaaccccacuaggcuuccacuggggagaaucugcaugggccggcccugcuacuccaaguagguagaaacaagucaccuggugaaccccaagguggccagaaagaccgcuuuccagggcagccccugcugccugcucuguaaggauugucccucggacuccuccagccccacuccuccagcucaucaaaggcaucaacuaccuggaccaauccaccaaugccuauaacagcugccacaagacauugcagagccugccaaagcuugcagccaacuaccuggaaagggcugccagcucccucaaccuagaccaccaggaccaccccuugccccagaguuacuccagccccagcaccagcgugaccaucccaaacaacuccaccaccagcaccugcauggugcugucccucaggggugccagugcccugcagugccuggaugacuccaccaacacgaguuauccgugcaggucucauugccagaacuucacuaucgcgcugccacgggguccacguacaaagcugccugagcucccuuugcuuagcaaugggcucuuugccuuagguugucugcccaaggucugggaagcaaucugcucaggcuggagugacccugagcccaucuccaaacccccaagcugguggugacacugacgccaacugugaaacgugcacaugccccucaggccacaguuguggaaaauaaaucguc

SEQ ID NO: 14186 - RNA, 69071 nt, Homo sapiens
cucuguccucggaaauauuuggaaaguuuuauuuaaauguuuuguguucccuuuuaaccaccaccaaaaagagaaaaaaaaauuuuuuuuugccguuccaaacaggagagucgcuucagagaggagcuggcguguguguucagagcccaggagugugagcccugccagguggcucuucccggccugggccacgcuggguaggauggccacccaggcaccggcuuccugggacccugguggucuuggagugagugagugagcaaggccuuguccugaggagaaagaccucaacuccccugaaggagggcugggccuggggacagggacaugagcauuguagggccugggggguuccagagguaaggagaugggagugggagggucaggagaugagacugggagggucagauccagaauguuccacggaggcuucagggccucugggucuggagaaauacguucgcuagaaaaauaagaggcuuugagaaugucugcagucuguacucucugccugcccaagagaaaucuacccuguuggccaaagggcagcggggagggagcaaaggcuggaggccagaaguggguuuggcccuuggggaagauuccagaggggagcgaggugggcggcagacuuugguuucuuggguccccuuucuugcaguugcagaggcugaggaggcccccaccucccugccccuugaggggggggcugccgugugggaaguuggcaucugucacgggcuugugggugcccgggcccugggcccucagaacaggacgcucaggggguagagggccagcgcgagcagcagggggccugcagcaaggcugccugccgagcuggcaggagcacaguggccgagguuggccccgaugcaggcugcauacgccaucacgugggggacguaguucugcucguggacgccgugcagcaggugcgccauggggcccuuggagaagacggccacguccuccccgccgugggucucguggcgcaggggcacagcagacugcgccugguaguuguugugagcugugggccaggggaaacaccugcugagagccugccaggggccuggcgcugcgcacgcagcuuuuccaucucccuuccaggcuggcuugaaugcucccauuucacagaagaggaaaaggaggcucaaugugggaaagucauuuugccuaaggccacgggauuugaaccugagccuguucugacacaggagucugcauucucaacccccaacagagaaaauuaaccucauuugggcugcuuggauuagcagggagaguugacggggagacucuuaccauugcugcaucuuuagacccccuagaaccacugggaguaucaagaacgaaugaaugauaugggaugggaugaacuaacugcaaagucucguauacuggaauauuauagggccaagaaaaaugaguauaaaauauugagcaccuacuugugccaggcacuaugcuaagcucaucagacccauuuggucauucagacaaccgucaaagguagaacccuuuuagagaggaaacugaagcagagaaagaugaagucacaugcccaaagucucagagcugcuagauuguagaaggcgauucaaacugagguuguuugaaucaaacaaccugggacucaacaaucaaacugggacucaagccccagucauucugagaccccugaccuugaccacaagcugacacccuauucccaagcccauccccgaggggugcccuguccccucccagcccuggguccuggaggucucaccauaguccaccauggagacauucucucguucaccgcccaccaccuuguagccaggcccauugccauacaggauggcagugaagggcuucuugucugugucacucagcaugggggccagaccugcacagggaggggguguucaggggucaugcuggggccccaggaguacaguccccagcccccagauuaggcuccuugguggcuugguaaccccugggaucuucuuugaagggcccugcaaugccuccaagaagccaccuucuaaaccuuauuauuuccaacuaaccauuccccaguuuucauuguacccaugucccucccauucauccauccacccauccauccauccauccacccauccauccauccacccauccauccauccaucauccauccauccauccauccauccauccauccaucauccauccaucauccagccagccauccucucucauucaucuauccacguucucgcccagccauggucaacguggccauccauccacccaccugccugucuacccgaccaccacucaacucacuccccugccucacccugcauuuucuccccauccccaguaacucuuccuccccacccaguugucauugaguccccaccaugcucugggcuugcuggcucucccacccacuccugcucccagguggguagacaggagaccccaggaguguccaccccaaagaaggcccaccuaccaaagauagaguugccacgggggguguauccaccaaaugugaagacgugggaaugguccgcagugaccacggucagagugucuuccgaggaggucaagcugccugccugcccgauggcccgguccaucuccaccgccucaugcagggccugcuuggcuuuuccuucauggugcccguggucaauucugccuccuugggacaccaaggcaaaggccucggugagggaggaggggaggaagaucugcuccccagccccacaacacugcugcuggauuaaccuuuguuagcuagggaaggacaggaaccuucgccgggcaccacucugagcuagcaccacagccuaggcauuuuacgcagccauucaaccugacggaggccagagagggacagccccggugccaaaggcacaugcaugggggcugcaaaguccagauguguaaucaaauucaccaggccgggaagcuguacuccucccaccgccccucccagcacugucucuagcugcuugaaggaggcacugaagccuuugggagguagggaagggggcacgcuggaaucccuacaaugugccaggcacgacacacccaugucucuuuuccccugaacagcaaugcugggcagagaggaauaugaucaguccuguuuacagauggagcaacugaggccuaguguggggaagcccacggugggauuugccaggaugugaauucaggugugacucguccuaaccccguuuuucaucucuaccucaaaucauccccucuaaaaagaaagcacggagcucccagagguagugaaaguccccagugccugggcagugccuguggcagguuccacaaagcccugccgaagccugaacccucgcagccuccgcccccgcuucccaccuccgggugagugcaggggccuggcuggaggcuuggcccagcagccgagggcucugugaccuuaaaggaacacuucccuugcuaacaggagggcgcugccugguggacacucccagcuuggaggguccugggcgccaggcagcccucuguucccaccagucugagccucgcgguggcccggcaggcuggcagggcguguccucccuuuguuguggcucugggagcagcuagccugggcggcccauccuggccuugcucacaaaggaaaccgcucccgggggagcccgugcucaccaccgcugguuucuggcuggcuccuuggcgucagaggccuguucggggccaggccaagaccgcugugcucgagugggaaccccgggguuuggcaagaaagcagccaagcugggcuggcggacgcucaccucuggaaggcggaggcgcugagcauguguguaugcguggggagcauaugugcaaacauguucacgugugugcauguguguguauacauaccgauguuagcagggcaacaugaggaacugcggugggcaagggcuguuagcacuggaagguuucuggaaucuuuaucacuuccucacacuuccuauuguucccgccuuaacuauuguguagccauaacaaggcuaauaauagaaacacgguuuauucuuuacugggccccguuccaaguacuuuaugucucugaacacaauggaggcgaaucacucuccaggagacagaugcuauuuuuggcuucacauaacagaagugcacagguagaggucacaccgccagcagauggcagcgccaggccaagaauucaggucugucugcaaggccccuggccggcgcugaaagagccugggaacaucagcacacagcgugggaaagccggggccugcggauuugcuuuucugggcagugaggcugaggggcugcuugccccuucagggccagguccccaagaaagacuaccaaaggggagaaaucugccuccucucccaggaagccuuccuggauugcugaaccuaacuugcaucuccaugcccaaaggagagcagcuugcugggcugggagugucuacagugccacccgucuccuuccacaaccuauucuccuaaagggaccucucccuucacccccaaaccagucaguucccuuuaagagcuggacuucuccauccugacaccagggccguguuuccagcagcccccucucagcagacccggggucccuaccuuccaccagcaagaagaagccuuugggguucuuccgcaggaucuggauggccaccaccaccaucucggagagugacggguccgucacguuguuccuguucagcucguacugcauguccccuggcucgaagagaccugaggaggacgccaggaggauguggaugcugagaggcugugacccggcuaggaggacuccaaggaagcuggggugucucagggaaugcaggcuccccacagccagcuugggguagaguaugguggcugggaggauccuuaucugggugauuuuugugggcccagaauuaggcccccaauuccuuuuuuuuucuuuuuucuuuuucuuuucuuuucuuuuuuuuuuuugagacagagucucacucuguuguccaggcuggagugcaguggugcgaucucggcucccugcaaccucugccucccggguucaagugauucuccugccuuagccuccugaauagcugggauuacagacaugcaucaccacacccagcuaauuuuuguuguauuuuaaguagagacaggguuucaccauguuagccaggcuggucucgaacuccugaccucaggucauccgcccaccucggccucccaaaguguugggauuacaggcgugagccuccgcacccagccccaauuccuuucauuuucauucccaccacuauggcgcggugggaucaccaugcccguuucacagaugaggagcacugaggcccagagguguuccauaacuugcuauugucagcugagaaguggcagaucugggguucaaauccaucagucagucugccuccagccugcagggcucagcacacagcacuguggccccaaggcagagggucacagccuggacucgauggggccgcuagagugugugugcauuuacauguuggauuugaagggcacgguggccugugcagcgaaacagcagaagguuuggaaucauugucccuccugcucacugggcuccguuuucucacuugugacauaaggagaaugauccauuccuugcccauggcacaaaguuccaugugucccaugcuggugcuucugauucugguguccuuccaauucugguguccuuccagaacacccugccccucugugaguggguacacagccgaacaauagcucccaugcacacaggguucacuuggugccacaugcuguuagcgcuuuggaagcaggcaaaagccagccuccaagauggugcccaauaaccccugcccccuggaauucacgcgcuuguguggucuccucccacacuagccuuuguaugccauagaaugccaccgaaaugauggugugugauuucgaaggcuggggcauaaaauguuguagcuucuguuuauauacucuuggaucucugugggaagccagccaccauguaaugaggacacucaagcugcucuauagagagcaaugugccaaggaacugaggccuccugccaacagccaagaccaacucgccagccaugugagugaaccauccuggaagcaccagccccagucaagccuucagaugacugugaccucaugggagacccagcuaagcuguccccagauuccugacccaaagaaauugagugaggcaauaaauguuuacucuuguuuuaaacuguuaaguuuuguuuugugacagggucucacucuguugcccaaacuggugcaguggcaugaucauagcucacugcagccucaaacucuugggcucaagcaagccucccacgucagcuuccugaguggcuggcaccaccacaccuggcuaauguuuucuuucuuucuuuuuuuuaagauagggucuugcucugucacccaggcuggagugcaguggcauaaucacaacucacugcagccucaaccuccugggcucagguggauccuccuaccucagccuccugaguagcugggacuaaaggugugcgccaccacaccuggccaguuuuuaaaaaauuuuuguagaauugaggucucgcuauguuucccaggcuggucucaaacuccugggcucaagugaucaaccugccuuggccucccaaagugcuaggauuacaggcgcgagccauugcaccuggccuaaguuuuuucguguuuguucuuuguuuuuuguuuuuagacggagucuugcucugucacccaggcuggagugcaguggugcgaucuuggcucacuguaaccuccgccucccggguucauaccauucuccugccucagccuccugaguagcugggacuacaggcgcccgccaccacgccaggcuaauuuuuuguauuuuuaguagagaugggguuucaccucguuagccaggauggucucaaucuccugaccuugugcuccgcccaccucggccucccaaagugcugggauuacaggcaugagccacugcacccggccugcaccuggccuaaguuuugagauaauuuguuauacagcaacagauaacuuauacaacacaaguucaugucaugcucaugacaacccagggguugucuccagccccaucacuaucuccauuuuaugggagcaucauuaucccuacuuuauagaagaggaaacugaggcagaaagaggagaaaucacuugcccaaggucacacagcuuagaggugguagagcuggauuugaacccagcacucuggcucuaagauccaugagcaaaaccagcaugauacacgggugcaugcacagcccaugugguacugggugugugccaugugacccaggcaagcaagaggcugugugcaugugucuggaggacccaccaggugcacagcucugagcccauaaccucuaaugacacccaggacgcggagcuguguuccuugggaaaugucugcaggagauuuugccaccacuugcuuggcacuacagacagcuggaaaagaaaacccggauagcugcaugguggugcucagggcugcaucccaccagaccugaagcugccccugggcccucaccacaugcuccccacugccuggggaggagggcaaucgucaggaugggcagagauaacuuggcuggcuucugcccuggccaugcacacaguagagcugacuccaggucccaggcuccauagcccaggagcuguuaagucccaguucccagccagggcucaaacuugccugggccguaccgcugucacuugugccacaugccgcgggccacuccccucucugagcuucaguuucuucuugugcccaaugaggcuaaucccccugcacagccagcagauuucaggccuaauuccaggaaccagaacccccuuccuugccucucccagguccugaagcccaagagcagaggccccuaagugggcgucaggcuagggccuuguccccaggugcuggccacacgcagcuccggccaccaggcuccgagccaugcauccuccccuccacccccuccacuuacccaauagguaguccacauugugggggucaagggucaggaguuccgugcgguuccagaugaagugggagugcuaggaggaagggcugugucagcacaugccgggggcuagggagagucggaaggacugaccccagcagcuaucagagucugaggccuuuacuuguuuccuucccucacuuaaaaaucucucccugaggacccaccaucccugaccucaagaaaugaugaaucaauagcccauuauaauguauaaugcaaggggaugagaauucugauagagcccagggaggccgugagcccagacacaggaccagggagggcuuccugguggaggugauguucuaaugggucccuggaggacaagugggaauugaacagccuagggucaggaaggcuauuccagggaggagggaucauggggcaaagaagagccaggcacaggucuccaggggccuugagugcugacaggugugggcuguuuucuggaggccguggagggccagggaggaagcaaagccccagcucugcuuuggggaccccaucugggaggggagauaaaggcguggcuguuuccccagggaauaaaguccacagaaagaagccagcuaggccaggccuggagagggcaccaugugggccuggaccaggggucccagcacuaccaaggaucugcugugugcccuuagaagacccccugccuucucuuagcaaugacagugggaucaguggcuuugcaagccucaggggcuguuguggggaggagggcagagaggcucagaaaguggggcuccgcacccccccucccagccccugcuuccuggagguggcucuccugugcucucucccuccaggguuguuccuguuauucccucuuuacagaugagggcaccgaggcacacagaccacguagccacugaaugguaaaggugaaacugacucuaaaacccacucuuaaggcaugauuuucuagggauguggggccuacacgggaccugauacccaauguggccaggcucggggccaugguguagacgcucucuccccgucuuagaggucuagaccgaguuccuggguaagcacccugccugggcaaggaggaugaagcucuggccccaugugccacguagagaaacugaggcuggugucucucuggcuugagcuuggagggggcucuggcccagccugagcugacucagaagggauggaaaggguucaaagccacucaguuccacacccccaccauccccacgggggcccuucccuagucccuacccccaccucguucuuggcccagccucaucccacgaggccuccccaggggccaguccuggaacuugcagaaacccaaccccagagugacaucaaaguggcugccaggcuacuccccacugucuucagcccugaccacagucauuuccagaccccagcugccccaggcccgcaggccagcagcucagauuuaaagggccagaggccacuccaaggagcuggagcuugggguccuuccagaggucccuccagccucccuuccccaaucuauuccguccuccagccucccuuccccaaucuauuccaucccccagccaagggggacucacuguggagggcuucuccgcucccuccauggcuugcacacuggggccaaccauguccuccccugauccauccagcgcugccuccucccuccauccuccuacuugcccagagcuucuuggcuccucccugucaucuguccccccagggcgccugcagagccaggcgucccccaugcaggcacacagcauuccauguuuccuuggccaucugacucagccucugugccucacgcaugccccgccaggugccuacauacaauaggugcucagggugacucaauguccacgcagguuauucccuggcccagccuccuccucaccauccgccucucucugguauccccuccaagggaaggaaaugauuagucacugacuaucuacugcuuguauaucucuuaggccauuugagcccauggaggaaagauuuccgaugcccuuucuacagaggacaacagaacuucagagcaggggucacacagccucuccccaucacaggccaccucugcagccacauggccccagcacaggcuaccuuguaucucgguuugaagcucuuccaggugucaacgagguccaggccguccagccucgugccccuggcuuucucgucacucucauacuccacaucaguuuuauucuugggguacauguauuuccggccaccccccaugaucaccuaaaagagacaggagccaucacuucugcaggguuccaagaugcccagaagccccagugaccucggcuuggaaccuggacuccuggagucccuggagaugguguggacacuuucccagccuggugagccaggccucagucaucucugggccuuacuuguccagcguggggagaugaaaucacgagucuauugggacggugguuuggcgcuucuagggauauuggaggagcugauaacuuaccuuacuuggcuucccggaauccacagaacucccacucgaauaagaaucagaccauuuacagagcguucccugugugucaggcacuaagcauuuaagauacauucugacucaacuucauaccaaggcugcaauaaacccuggccaccuguuuuccaacuaaaaaaaugggcacagaaauugguuuuuucccccgaaggccacagagccaggaaguggcagcaucaggauucaaacccagggcuuuuccggcuguggcacuagggcccugcuguauucgugcagcuaagggcagggacucccagagccuccucucccacgguggaaggcugaaugcgugcagggagaggcuccagccagggaggucuuuggggcagcccacagcugggagccagcccaccgcagccugggcaaacagcggggccgggccucacggcucuguagucaccaccaggcuaauuuuacccaccagcuggugugugcgggcagacggacgcgggacuguuuguuuuccuugggaguccauguuugaaguucugacuauuuuuaaaguagggccaagagcauaacagcagccgccugcggugaccaccacacuaguguucucuugucaccgcgggugccagcccgggccacugccccuggcugacaccuugggagugcagagccuggcugacacuggccccagauccaccauuccaggccugcaucucauaggucccuugcucuauccuccacucugucucccaccuuagauccuagguuuuguggaaugcacagggggccaggaacacaggauggcuggagaggugggaaaggugccccaggaccagccuggguccaggccauggucauggccgugagcuuugaagucagacuuggguuugaacccugacucuaucgacuacugaccaagggccugccaccuaaacucugugagcccaguuuuccuauccauaaaaugcgacuggccaggcgcgguggcucaugccuguaaucccagcacuuugggaggcugaggcgggaggaucacuugaugccaggaguuugagaccagccuggacaacauggcaagacccugucuauacaaauaaaauuuguuucgaaacuuagccgggcauggugguacaggcuugugcuccuagcuauucaagggacugagccaggaggagcacuugagcccaggaggcugagacugaagugagccaugaucacgccacugcacuccagccugggcaacagagugagacccugucucaaaaauaaaauaaaauaggccgggcgcgauggcucacgccuauaaugccagcacuuugggaggccaaaacgggcggaucaccugagguccagaguuugagaccagccuggccaacauggcgaaaccccgucucuacuaaaaauuuaaaaaaaaaaaauuagccgggcguggugaugugcgccuauaaucccagcuacucaggaggcugaggcaggacaaucgcuugaacccgggaggugaaggcugcagugagccaagaucgcaccacuacacuccagccuuagagacagaaugagacuccgucucaaaauaauaauaauaaauaaaaugcaacuaacauccauccacagacccaucacaggaggaaaggcagucacccagggaaguccccagcacccaggggguggcugccacuggaaggcauuucuauugccagaaggaguggggaaacaagugguucagagaggcagaguccuugcucucagcugcagccaggagcucagggggcagggugggcugggagaagaaggagaaggggaccccaggucacgggucccuugccccgccccccacaacuguucccacagaaccugaccucuuggcaucuucagaguggaaaacgaagcccccaaucuuccugcagggagccucaucguuuccagcccggcagcgacuucacacgggcucauuaaacucccaaauaacagacuugcuguuuggcuuugggguuuagguuugugucuuucuuucuuucuuucucuucuuucuuuuuuuuuuuuaagcaacaguauuuauuuucaggguggacaccaggauuuuuguuucauguacagucuggggacugggaggcuuuuggggggguggugacggagaggcagguggggcugggagagaaaggaagaggaggaaagaaagggauccucacacagguccuccguccucacucacucccuggcuugugccccuugacguggccccugcggcccccccuccucaucucccacccccucaccugaaacaucuucccuccccucgaauuuccuucaaguuccuguccccugcucaggcugucccugacaaaccccucugaggagcaguccccauguaauuauacccugugccuguacaacaaauguucucacauccaugaccucaucacggccucccacggcccugggagcaagcaaguguggcucucuguuucugcugcacagguggggaaacugaggcauagggaggggaaggaacucgccccaggccacaugucgggugaaggcaagccaggaugaguggcuuggccucagaugucuguucagugaaaggggccaacagcacuguguguccugaaagcggguacuuaauccaccaugcugggaaaagggcagacgugggucucuacuguggaggggccaaguagcccccagaaauuuguggggggcagugcauggagggcugaaggcaggugaguuugucuggugguggagagaaagaggugagguguagcugggcaggggggcuuucucugccccucaccgaauccccauuccaggcucaaggggcagaaguccccagaucgccucagcagucccccacaguaggcaauaaaagccugaaaaggaacgagccgggcauucucacuuaagaacagagaguaagcgucacauggaugacuucugucuccaugagucagcucaguuuguugaaguguguuucagggcaaggacauguggcuccugcguaagugccaccaccuucugggcacucgcuaggccucggguccugugcugagcuccacagggauuaucuuaaucaguucuuggcauaagcuuaugaggcagguacaguucacaaaggaguugugaaagggaagccucagagagguuaaguaacugacccaaggucacacagcuagcaacacgcagggcaaggucuggaacucggaaguuuaaacacgagagcuggcacuagccaaccacuguacacaccagcucuuugccgggcaugcuggugguugaguguacagauauguacccaucugugaccaugugaauacgcagggcaggcagacgacacuuggccaucaccaccucccguguaguggggggcagaggagggcacagcaccagguuucaauuuauggaaucaucccuggaugccugguucuuggggugugguggcggucacaugaggguucaccccgcagccccaccgcagagaaaucccacagugccugccugcccaaccgcaaauccccuaaugggcugggagccucccagguguguggggagccaggccaggcugcuuucuccgggccagccugggccugaggccuccugcccaccagaggccccgccucaccccgucccugcccggcugcccccgagcacucacgucaaugucccugauguuaugcaugagcugguaggcgauguccuuacagcccuggcucaaggccucagggggcaucucguugucugaguaccagucccggucagccgagugggcguaggcggcgcuggggguggcaugguucacucucgugguggucacaaugcccacagauuucccuggggugcaggaggggcggguuuggcuuuauccacagaucggggugucccagaggccuccucccucccuucccccuccccgcuaaagacaggcccccgcuucaguucugaggauugcccgggucucagucuccccauccacagcagcaggugucuggcaguggcuuccaaguagccgagcagccagaacacugccucuggaacccucuccccucaccccgaaggcccuugagaugugagcaccugggcuggaguccuccccuucaucaaggcgcccacaggaccccugagggaucucaaguggacuguggcucugucaccuguauguuggccuugucaccuguguuuuggccuuggccccugacuaaagcuucugggggcacaggcugggccucccaauucugaggagggaaggggcguggccauggacugcaccccacaggcuagcccugggcugacuucucccuccucacaccaacccuaugagggggcuacguucccacccguuuuauagucaaaugaagaaucgacucagagaaaugaacugggaccagaacccaccacugagugaaccccaaacccucagcuuccccugucacggaaggaaucccauggauauuacagacucccagcauaucagagcugggagccccacagagaagccuuuucuagccccuucccaugacacagucagaaagacugaggccuggacaggccacgaagcuggcccugcuccccacugcucccccgacucaccagcguccuuggcccagcgcaggauggaggugaccucguuccccugggugguguugcaccgggaacgcucaguggcugcgcuuacccccacggugcccucauuggccuucaccccacacagguaggcgguggcggugccggcacugucagggaccugggcauugguguuguacgucugcaggugggagaggagggucaggagauggccaggccuucgccccaguggcacccaccccgccuacacucacaccauggggacuggggcgugagggaccagagaggaccccauagccuugaccaggcccacugcccacugaagccccccagagccacaggacuaccuagcugccugcuuccugccaucauucccugcacccuggcagcacuggggcaggaccuuagcucuccaaaguacagagaaguguccggcggaagauuggggcucagguggggucagcggaggccucucuccgggccuggggcugcaggagccagcaagggguuggggagcaggggaguccuggagaagggagagggaggggccuucuugaaggaguggggggucuggggauaggguagugaaagugagggggaaggggacuggggaagggaaggguggggccaagaccagcgcugacuucucugccaccugcccugcggccaccaucacaggguugcccuacauccggauguuuagcagagaccccaaaacuauuugccugucucccuuccccaccagccugagagcaccuugaaggcacagaaggcaccauaguccccacuacucccccagaagugagccuggggccugacccagggucuggagguuauuacauaacaccacuaucaccaccaccaauagcaauagcuacccggcagugcacacugccuugaacaaccuaggucaguacaggcacaccucauuuuaguguacuccacagacacuguguuuguuacaaauugaagaucuguggcaacccugugucaagcaagucuaucagcaucauuuuuuccaaaaacaugagcucacuucauuagcguuuuuuagcaauagcauauuuuuaaauuaagguauauacauuuuuuuagacauaaugcuaucccacacuuaaaagacuacuguagggugcaaacauaacuuuuauaugcacugggaaaccaaaaaaugugugacuugcuucauugcaauauuugcuuuauuacaguggccuggaaccaaacccgaaguauagcugagguaugccuauagucuaauuaacuucacgaacugccucgggaaagaaugaaugaacuggaacuucaugcaaaaguguauacaggccaggcacgguggcucaugccuguaauccuagcacuuugggaggccaaggugggcagaucaccuggggucaggaguucgagaccagccuggccaacagggugaaaccuugucucuacuaaaaauaaaaaaauuagcugggcaugguggcgcaugccuguaaucccagcuacuugggaggcugaggcagaagaaucacuugaacucgggaggcagagguugcagugagcugaugucaugcuacuguacuccagccuggaagacagaguaagacugucucaaaaaaaaaaaaaaaaaaaaggcauauauaggccgugcaugguggcucacgccuguaaucccaagacugggaggccaaggcuguaggaucgcuuaagcccaagaauuagagaccuugggggggucucuaauuauccauauguggugguacacaccuguagucccagcuacucgggaggcuaacgugggaggauggcuugagcccaggaguuggaggcugcagugagcuaugacugcaccacugcacugcagccugggcaacagagcaagacccucucucuaaacacacacccgcaagcagguacagugaugcuauggugucagaagucagggcaguggcugcuccagguggggagugggcuugggcauggagggggcucagggggucaggggaccucuggcugcugucauguucagaugcucgaccuggauacuggauauacagaccugaacugggcuuggggauggggcucaccuuggagagggccacgaaggggaacuuguccaucuccagccuggucuccuccccaggguugugguggagcugacccuugaggaugcgggcagccgucacuguggagacacccaucccugcaguggggagugggggccucagucucucgugcuccugccucuccaaucagccugcuuggguacccagaagcucucuaguucgguaccaaggcaggcucgggcaguuggcacugggcauggcucuguaaaugucagugagcagccccucucucccuucacccccagauccucagggggcugucuggcagagcaggccucuugaauccacagccuggccccucauccuuuuaaacacccuuccuccagagcccuagccccuucaacacagcccccuucaacucagccuggcucccggggcuccuagcuagguguccuguuccaccccucccacaggccccugggccucaccaucucccaggaacaugaugacauucuuagccacguugguguugagcuucugaagcuccagggcauauuucagugucucuugcgcuuggucucgccaguacuuggggucuuucucuuucucuaaacacagagagaggcaguuacuuggcgggguaaggauagccuccuaucuccagacguacagauccccccacuucugauugcucaggcuggaaugccugaacuuggaggugggugcaauaguugcccacccagacaacacaucugugguuuauaaauaugugccauccagauccuccagaaaagccuguggacccuggggucuucuccucacaucucagaaugaagaaaccaaggcucagagacaacgagcaacuugccuaaggccacacagcacaggcagacacuggcagggcuggguuucgcuccaaagcccaugcucauuccuucuacccaguagggagaugagcugcuaaggcagcaaaugaauugugcuagcacaauuaagagaguaauguuuaaccuauucaacaaacuccuuccagcagaagggguccccugauauagccagccaucaauuaucaacucugcuuagcuuauucauuaaaguaggcucagcaggaaccugacuugguuuaauagcagugcuggaaagcgaagcuugccuuuugcuuaauaugucaaauuuaaaggagccaggugaucucacucuuguuaggauuaguuaucaaggacgacauucugcaucucucaucgcccccuccaucccucuuggcugauagugacuucuggcuggggcuuuaugguuuugagauaaaaugagaacuaagaacacuucuuucucucucccucuuucucauguguguguguguccagcaaccaauccacagcuuuagugccagacagaccucaauuaaaaccccagcugcugggcaugguggcucaugccuguaaucccagcacuuuggaaggccgaggcaggcagaucaccugagcucaggaguucgcgaccaacuugggcaacacggugauaucccgucucuacugaaauaugaaaaauuagcugggcguggcagugugcaccuguagucccagcuacucaggaggcugaggcaggagaacugcuugaacccgggaggcggagguugcagugagcugagaucauaccacugcacuccagccugggugacagagcuagacuccgucucaaaaacaaacaaacaaaaaacccccagcugcuccaaguacuagcucugucaccucccucagccucagucucuuccccuguuaaaugacauugcuggcaucauccccucagggucgcucuaaggacugggccggauaaggcaagugacacaccugacccacaggagaggcucaaaaguugccucccauccccauuaucccgucuccagggcuggaccaggacccuggcuaugggagcuggagucccucccagagucugcggggcuccccucugucccagggcccuaucagaucugcucagaagccuagagaggaggcucccuagcgguuuccucuuucaaggccucccacugcacagaacgggaggagagaucaggaaugggagggucuuguccaaggccguguagcauguucgugggcuggggacacaauucucaucuuuuggcccagcuccgacgcgugccuggcucucggaguggccguggguaaagaacagcccuccuuccucacacacgcacuggcucugggcgagaugccagggaccccccacacagcuucucuuauuccucucaacugccuuggcaggugggcaccagugucuccuccacauuaggaaauggagagccugagauuagggccccaagugggagaaccggaaacucacgcgucgccguggcucugccccagccuagcauaggcgcagagcacaggcgaggagccgccagggugcugcagugcaccucuagcuuuggacccaagcacaccccacgccccuccccaagaggccuccccuuacgucaccaccaccccaaucccucagcccacuacccucaucccgacagccccagguccacccucucucuucuggaagugucugcugagggcaucaauuucagauguccccacgcaguccccacugggaauugggagcaccuuggcccuucugcccgacagggugccuuuggacaagaguuucugccccaggaaaugggacacccguagcuauccacaggcaguucuaggaugacaugagauaaagucugggcaaggccggggccagagguuuuccucagaggucccccaggcccaggcugguuccagccucccuccugccuuccucaaaacacaccacggugcuguuggucauagagccucuuuggccaguugggugccacuggguggugaagaccuucuacccacccugacccgcuacaaccuguaccugacuuaacagcuuggaggucccagggcugggcugacaucagcccgccccacaccuguugcccuuguucagcccagccucugccaccggguccccugcuccguugagugcuuguucucucuagacuggagucccacaagggcagaguccuugucuuuuucaccagagccacccagggccugucccugagaaggguuuggagucugguuuaagcaacaauggcucuggacaacuggauuccaagaggcuauuguuuuuggagacuacuaaaugauaugugcuaaugcucacgauagaaugccagggaaagggcacugaucgguacauacuauaugauuccauuuauaugaggcucaaaacaggcaaagcaagucucugguggccaauguaagccugggcaucuccucuggcuuugggaggggguuggcacagggaagcccacagaugccucacaaccagaaauguucugucuugaucuggguggcgguuacauggguauaaauauaugucaaaauuuuuucaggcuauguauuuaagaucggugcccuuuucuguaaguuauaucuaauugaagaaaaaaaagaaggcugaagaaguggcucauccuguaaucccagcacuuuuggaggccauggugggaggacugcuugaggccaggaguuugaggcuacaguaagccaugauugugccacugcacuccagccuggcaacagcagauacaaaaaguugaacugcugaacguuugaagauuuuucauguugucacuuuuucaccuuuucccuuuucauccauuaguucaucuuucacccaggugggcuguaagugcugagaaggcagggaccccgucccagagugaccuuggucccccagggaugcaaauggcaccacgaggucucagacgcagcaauggccugagagcucagcagcucaggcucagugccccacugcaccccaucuccucaucugcugaaauacagccguccuaagagaagagaccaacauucacugagcauccacuccuugccagacacugugacuaucccaugugauucccaugaugacccuaagcgggaggaacucauccccacuggacagauggagacacuggaguguggggaaggcaaguggggacuucuagccacauaauggacugagccgaggaaggcucucuucuccagcuccagauacagaaaugcuggggaaaaaaaaauagcacauagcuugaaaaaggaagaaaagggggaaggaaaauccucaggaggcagcauugaugagggaaucuaaaaccagaggggcccacaggagcugaugcagagaggaacgccugcgacggcaagccagguacagguucaggcugaagcugguuucuuuucuuuuuugagauggagucuugcucuguugcccaggcugaaguacaguggcgcaaucucagcucacugcaaccuccgccuccuggguucaagugauucuccugccucagccucccaaguagcuggcauuacaggagugcgccaccaugcccagcuaauuuuuguauuuuuaguagagaggaguuuuugccauguuggauaggcuggucucaaacuccugaccucaagugauccaccuaccucggccucccaaagugcugggauuacaggcgugagccaccauucccggccagaagcugguuucuuuuuaugagacagagucuuacucugucacccagacuggagugguuugauuauagcucaccguaaucuugaaauccugggcucaagugauucucccaccuuagccucccaaguagcuaggacuacaagcaugcagcacuaugcccagcuaauuguuuguuuguuucuagagauggaggucucacuauguugcccaggcuguccucaaacuccuggacucaagcgauccucccaccucagccucccaacgcacugggauuacaggcgugagccaccauaccaggccugcuaaagccaccacaccaggucugcugaagcuguuuuaagguacacauuuugccuuggagcuauggaagggauagagaaagacagucauucauaagaaaugugaauucaagucaaaucugagccaggucuaaguggggaucugaauuuauaguauaagaauuguaaaccaagaaaucaacauaaaaacuggccuagaauuaguugaaccccuaguguccugaaaacaccaugccaugcuguggaaacacuuccgcgugaaucuccaacagaaaaacaaaaaacucggccgggugcgguggcucaugccuguaaucccagcacuuuaggaggccaaggcaggcggaucaccugaggucaggagaucgagaccauccuggcuaacauggugaaaccccgucucuacuaaaaguacaaaaaaauuagcugcgcgugguggcgggcaccuguagucccagcuacuugggaggcugaggcaggagaauggcgugaacccgggagauggagcuugcagugagccaagauugcgccacugcacuccagccugggcgacagagagagacacugucucaaaaaaaagaaaaacaaaaaacuccuguugaagaugaguucacuagugagaacuacaaaugacaagaaaaaggcugggcacaguggcucacaccuguaaucccagcacuuugggaggccaaggcggguggaucacuugaggucaggaguucgagaucagccuggccaacaugaugaaaccccgucucuaauaagaauacaaaaaauuagccggguguugcggcgcacgccuguaaucccagcuacucaggaggcugaggcaggaggaucacuugaaccuggguggcgaagguugcagugagcugagaucacgucacugcacuccauccugggcaaacagagugagagucugucucugucucaaaaagaaagugucaggcgucugagcccaagcuaagccaucauauccccugugaccugcacauauacauccagacggccugaaguaacugaagaaucacaaaagaagugaaauuuaaauggucuguuccuaccuuaacugaugacauuccaccacaaaagaagugaaaauggccgguccuugccuuaacugacgacauuaccuugugaaauuccuucuccuggcucauccuggcucaaaaagcucccccacugagcaccuugugacccccacuccugcccgccagagaaccccccuuugacuguaauuuuuccuuuaccuaccccuaucuuauaaaacggccccacccauaucucccuuggcugacucucuuuuuggacuuagcccgccugcacccaggugaaauaaacagccuuguugcucacucaaagccuguuugguggucucuucacucggaugcgagagaaaagaaaggaaagaaaggaaagaaaaagaaaagaaagaaagaaagaaagaaaagagaaagaaagaaagaaagaaaaagaaagaaagagagaaagaaagaaagaaagaaagaaagaaagaaagaaagaaagaaagaaagaaagaaagacagacagacagacagacagacagacaggccaggcgcgguggcucacgccuguaaucccagcacuuugggaggccgaggcaggcggaucaugaggucaggagaucgagaccauccuggcuaacacggugaaaccccaucucuacuaaaaauacaaaaaauuagccuggcgcgguggcgggcaccuguagucccagcuacuugggaggcugaggcaggagaauggcgugaacccaggaggcagagcuugcagugagccaagauggcgccacugcacucuagcuugggcaacagagcgaaacccugucucaaaaaaaaaaaaauuaagaaagaauauauauaauauauaugaaauauauauauggaaaaauauauauaugaaauauauauauggaaaaauauauauguggaaaauauauauuuccuuguauauauauauuuuccuuguauauauauauuucauauauguguauguguguauauauauauauaugggaaaagagugaccuauccaacuaacacaugcaaguagcagggcugagguuuccugcucugaacacuguuuucagcucuuaaauacuuuggaugguucugggaccuuaaaacauagacacugcccucaucauaccccaucugcaccaccuuuuuaugccuccaccuguguccccaagcauaccuggcacuaaggaguuaguaaggcaggugccaauggccaguacuaagaauggugaaaucauggugcaccccaagaccugcuuuaucccuggagcccagagaugcaaucgacgugggugggagggggugggcuggcaguggucagauguuaacugauguuccaauccuagaaauuaaaaaaagagaaaaagaggcauguggggcacagcucuagagauccuuuuucacucacuuauucauuccuugauucauucaacaaguauucggugagcaccuauuacagaccaggcauggggcucaacauugggaugccaaacccagcuggucccugucucaggaagcuuaaccacacaaacagcugugucagugucaaugaguuccaugcugcaaagcaguuccgucccauuuccuaagugaauuuccacuuucaauucaucugaagcccccuaccucccagaguccaaucuuuuggugcaguguuucucaaacuguaaggagagcaagcaucugaaucccccaagggcuuguuacaacagauucccggcccacuggugaggcuccgauuguauuucuaauaagcucccaggagaagcugcugcuuugcugcuuugcggaccacaccuugagaagcccuguucuacagcacucggucuucagccuuuuaauuaccugugucccaggaacaucagggacaaaacagagugcaccccuucuuucaggaccccuacauuugcuacauucucuucuagagcuugucguuuaugguaagagauauaaaaaugguaggagucacauaugugaaaaaacuggcugguaaguguggccauuucuggguggugacaucacagacaacugauuuuucuuuuccauugucuuuucugcauuuccaaaauuuucuuuugugcugagauacaguauuaucuuuacaauuuuuaaaaaauauauauauauuuaaagucggauguaauugaagaguuuagguggaaaaaaaaacuggaaggaaauacaccaaaacauuaacugugguuuucucugggugguaggacuaugaaugauuauuuccucuuuauuuuuuugaauuuuccaaguagccuaaaacaagcauguauuaauggcauaagaauguuuuuacacuguggucuuccuguuaaaucacaaagaacaaccccacuggcagcugagaaauguacuaacccuguugcacaugaguuacaagacaaagaauuuuaaguggcaagaguuucacugggaaauguuauugcuucagccaaaaccaagauaugacaccauuuguugugggaaacagcaguaauacacacucuaccguuagaaaaguguugugacagauaagacaccacucuaguccaauuauuauauguuaaguaaaaacaaaauaaaacauuuuuuaaaaguuguuuaaagaaaaaaagccaggcauggugguaacaugccuguaaucccagcuacuugggaagcugaggcuggaggaaguucgcuucaggccuggaguuggagaccagccugggcaacacagcgagacccugucucuaagaaaaauuuuuguauuuuaauuuuuuaaaaguuucuuuucuuuuuaaaaauucuucucuuugcagcuccagcucaaaggaaaaagauuuuuucuuuuucuuuuuuuuuuuuuugagacggaguuuuguucuuguugcccaggcuggagugcaauggcacaaccucggcucacugcaaccuccgccccccggguucaagcaauuuuccugccucagccucccgaguggcugggauuacaggcuugcgccaccaugcccggccaauuuuguauuuuuaguagagaugggguccauguuggucaggcuggucucgaacucccgaccucaggugaucugcccaccuuggccucccaaagugcugggauuacaggugugagcugccgcgcccauccaagauuuuuuuuuuuaauuuaaaaauagagaaaaagaaaaggagaaaaggaaggagggaggggaggggaggggagggaggaaagggaaggggaggaaagggaagggaagggaagggagaaaaagaaaccacuaccaccagaagaaggaucuugauucaaccuuaaaaacacgcaaauggccgggcgcgguggcucacgccuguaaucccagcacuuugggaggccgaggcgggcggaucacgaagucaggagaucgagaccauccuggcuaacacagugaaaccccgucucuacuaaaaauacaaaaaauuagccgggagagguagcgggcgccuguagucccagcuacucaggaggcugaggcaggagaauggcgugaacccgggaggcggagcuugcagugagccgagaucgcgccacugcacuccagccugggcgacagcgagacucugucucaaaaaaaaaaaaaaaaaaaaaaaaaaccacgcaagcugcgcuccagugccagaagugacggcucugggguaggggcuggggguagcggcgcagaguggaaauuaaaaggcaauaucccacaucuaacaucuaacaacacuuaacugugagugguagaauuuggaauuucagaugauuccuacauuuuuuuuuuuguucuacuuuacgguuuccaaauauuucuauagcaaauccuaaaaucagaaaaauguuauuaacugaauacgaaauacuaauucauuaaacuauuauuuaaaaucacuuaaaaaugaagucaccucuuucaggaaggcuccaggauggucacucacucauuccaauauaacaccacugagcuucaugccaccucaaacaucgcauguaccucucuuuuugaagguaauauaguucuuuccugggccaucucagcugccacaccgggaguuucuaagugugaggacuuugucuuguuugucucugcccuccuagugcuuggcauaguaaauauuuacaucaguugaaagccagugcccuaaggaagguuguggggggaagggaagagccauccaaaauuaucuucucugugugugcaggaaaguccaagaguucgugaagauguuuaacuaccggaagguccgcucgccguugguggagugcagacaggcacagcgcaugggaaaaccggcaggaucuaccgaagcugaucauccuaccuguacccugggacccguuucucuccagcagaaugugcacaucagcccuguuuauaauggcuucaaaacugccuccaucuacggcaggcuggauaauacauuguguguguucacaacacagaaaccaccacagacagcaaggagaauggaugauccacagcuccucacaacaacaugaaugaaucgcacaagguaagcuugagcaaaggaagcuaaacccaagagcacuuacagugugauuccgaugacagaaaguauaaaaacuaacccagggcguugggagacagaacggaggcuccacguggaggguacggaaacgggaacgggcugcuggggugcuggugcgguucgguuuaugauugaucugggugggugggugcugguuacacgguggguucagcugucaauguaugauacacacauuuuucucuacgugcauuuuauuucaauaaaauaaauacuacucuuugggagcuuacaugaacaaucuauaaaggauacugacaaaaugaaagcaagucuaugugcugcacuccauaguucauaaagaauuucaccaugauguuucacuaaucagcuaugcaguggacagaaaaggaccuaucaucuccuuuuacagaugagaaaaccaaggcucuggacggagacuugcccaagguuaccaacaggaaguugcagagcagaaaccugaccacagggcuccugauuccagaauuagcaaucagguuaccaucagucacccccuccagagggagggauuucuguugcccccaaguguaaaaugaguguucugacguuugacacauggauagauuuauguaaccaccaccgccaccgucaggacccagaacagcucugccaccccaaaaaucucucuugcguucuuuauaguuacacaauccccccaucccuaaaccuggcgaucccugaucuguccuccaccacuguguuuuugauagguaugguauuaaauccacagaucaaugugggaggguuuacgucuauaccacauggaguugcccagucaugaagacaccacgucucuccacucauucagucagaguucuucgguuuuaucagcacucuguagucuucagccuguagaucuuggauauguuuucuuagauuuauaccuacggguuccaucguguaaugguuagcauucuggacucugaauccagauuuauaccuaagaauuuugcuuuuuggggaacuauuguaaauggcaauguuucugagccauauacuaccgagccaagugcgauggcucacaccuguaaucccagcacuuugagaggcugaggcggguggaucccuuaaggucagguguuugagaccagccuggccaacauggugaaacucucucuacaaaaauuagcugggcaugguggugugcaccuguagucccagcuaccugagaggcugaggcaggagaaucacuugaacccaggaagcagaguuugcagugagcugagaucgcaucacugcaguccagccugggcaacagagugagacuccaucucagaaaaaaaaaaaaaagaaaaagaaaaaagcauucagccuuucggcguuugggguggucuuuugaggcgugagguggagacaaucaggaacuuguuuuuggauauguugaguuggagaugucuuuuagaaguggagacacuaaggaggcagcugaauauuuggcucuggcauuugaaaaagaagucuggguuagaguauaaauuugggaaucauaggcacagggguggcaguuaacacccugaucaaacuugacgugcucaccuagggagagggaauggggucacagaaaacgaugugacagaagcccucagcaaaccagguauugaaaagaauuuccuuaaucugauaaaggcuuuaugccaagaaccugcagaaaccaucauacucgcuggagaaagcuuuggcaaacuccuuuuaacacuggcuuaugauggugaggagccggggcagucucguccacaacuagggaaaugaauuaguaaggagugguggaggcaaugucugcguggcagugguauuaaaacuagauguccaaacagcagcgugguggggucuaaaggcagaggacugagugaugaauguaaagaaucaaacgcaguguauguaagugcaaaccacccccacggacagaaugcuguguaacguacaaggacacuuacaacuccaaggccauauuaaguacauuagcauagggacuucggugagcugugggaauggcaguggggaggcagggagcagggacaaaggaaaaaaugaauaaacaaaacaagaacugagagcuuauuuggguaugucaugugcuaagugagauaacguaucccacucucucugcacugaggguccaaaacaggugagcgaauaaagaaaaauaaaaguguagugacccgggagcacugaaaggcucauccagccccacaugauuauucuuccgguuauuggucugucucuccucccugcuagccugaagcucugugaacguaaagaccaacaucuuacccaucucugcaucccgagcccuugcacaugguagcaguuccauaagugccaccaguucaggcugggaugcucugaauuuuggccccagggauaggcauugagauaggcuuggccuggaggcaggugccuucucccauagccuccgcucaggacaaggagaggguggggaccugggaaagccuucagaacccagagccucccugcuggccccaccccuaggaccccucccccucgcagaggcuccuggcugcucuguggcagcccuggaagcggaggggcccaguuuggggcugugggggccccggcugcccaccacccucugccaaugucugccagcuuaaaauggggccuccgggugugugucagccccaucgccacccccucccucccuucucugccaggcucccggcuccuccguagccugauuacgcauggccagugcagaagccccggcuaggcuguggcgccagaggagcagcuacuuggcaguucagugcagggggcugaggagccaggcaggccuuagcucugaggacugauucagcaacccaggcagagggcccgggagcauccuggaguggggcaaaaagccagccuugggcugggucucagaagaucuggggcaaaugauagaagaaugggacaaacgugucacuaccauuucuuaggcccucauguuccacucagccccaugcuguuuacaucccugaucucacaauauggaugaagagcccccguuuuguagcuuaggaaacccaacagaggguuuggcuagucuucgacuaugcgccauuuaagcccaggcugacgccagggcucaaccucuccgggccuugguuuccccaccaugaagaguaagagaaaugagugccccgcuugcuccaucucacgagaacaaauggaagcugaacgagcuuagggcagggaauuuggcgggaugcagggggagucaggccagcugaguuccccuaccugagcggccuggccaggcggcaagugaagaaacaaaggaggcccaggaucagccccaggaggaggaggcugagggccaccgugaggaccacauccaggaugggggacaggagggccaucuuggggcaaagagggccccugggagcagccaccacgcccugcacacacucggucacacuagcuccaaagcccugggucaguggccgugacccgcuuuaucccuggguuaaucuuuguggauuagucagaagggaugaaacggggugcuggggugggagggggagcaggcuacgaagcuccucucucccauuugagccccgggggagggcccgaugcuuguucauucaacuuuguucauucauuccucacucccaaacaccuacagagcaccugcugaguaucucugugcuagguucuauggaaacagucgggaacgggacagaguuucugucagcuuggagguaacugaccagccaguguggacaaagcaccuacuguaugcuagacauugugccaggugcccuguggggcaaaaacauggaagggaaccccuuggcuaguaacacaguagguuuuccccuaacagcagcagcuguuccagcccaucuaugggccuagaaaucugaguuggugcuuaccccagccagagggaugcacccaugcucagaagaagacgaacugcucuuauugagcaccaacuguguaccaggccccaucugggcuagggacuaguauccccauuugcagagaaacagaggcucagaggugcaaugguggaguugggauuuaagcccaaaucugggggucuccacggcccguaccucagaacugagauagcagcagccuacggaggcuuuagugaagcccugccaggcgcuggccuaaagccagcagucacccaggaggcagcacacacaggcuggagguggacgagcuguugccagcacggaggggccuuuucugcuuccaaaauugucuccccaacccagauccaaucucuccuaaaacauccugugaagucaggagagugguuaugauucccaucucacagauucagaaacggcccagagaggucaagccacuuggauaugcacagcugugcaccauuagaccaggccuuuucugaucacacuuccugucuccugguacaccucagaucccaugguccaaaauacccaaggucaggaggagacacuuuuacccucuuggugccaaggaaaguccccucuucuugaccccagaaaggccacugaccucaccauaacaggaaaacuaaucucguuacuccauuacgcccuuuucuuucucaacauucccguaacucaaauugcgucagauccucacaacauccuagugauacuggcaggguggggauuauuagcccuauugauaaaagaaaaacuucagcugaauuaaauuuaaaagaauugccugcaaucccagcacuuugggaggcugagguggguggaucacgaggucaggaaaucgagaccauccuggccaacaugaugaaaccccgugucuacuaaaaauacaaaaauuagcugggcaugguggugugugccuauaaucccagcuacucgggaggcugaggcaggauaaucgcuugaacuagagaguuagagguugcagugagcugagaucgugccacuguacuccagccuggcaacagagcgagacucugucucaaaauaaaauaaaauaaaauauaaaaaaauaaauuuaaaagaguuuaauugagcaaugaacgaucugcaaauuaggcagccuccugagccggaguaggaaccagcgcagccacuuaguagaagaagauuuaugaacagaaaaggaaagugaggugcagucagauugguuacagcuuagcacuugucauuugaacacgguuugaacaguuggcgacauuugauuggcuaaaacuugguaauugguggcugggcaugguggcucacuccuguaaucccagcacuuugggaggcugaggaggguggaucaccugaggucaggaguucgagaccggccuggccaacaugaugaaacccugucucuacuaaaaauacaaaaauuagcugggcaugguggcaggcgccuguaauccuagcuacuuggguggcugaggcaggagaaucgcuugaacccggguggcggagguuguagugagcugagauuacaaugcuguacuccagccugggcgacagagugagacucugucuuaaaaaaaaacaaaaacaaaaacaaaaacaaaaaaacccccaaaacuuggugauuggcacaaguguaggcuauagucuguuuacaccucuauuucuuauaguuuacaauguagagaaacugcuaggcugaacuuaaaauauguaagaaggcagcauuaggcuagauuugauuuaauaauucccuucuuuuaguuauuuuuuaaauuuugagacauugaccaaaacgagucacugaugucacuaucaccauuguaaauguacuuauuuggucucgaaacccacugggaaacaguaggacaguggguuuuguaaggugggaauaaagacuuuagguuauuuuuuuuaaggguuagaggguauuuuuuuuaauguuggaauguccuguuuacaagaaaaaaaaacaaaacaaaaccugguuuuagcauuuauguguucuuuuuaaaguuuuaguuugaugauaucacauuuagcacaagugacucuauuuagguuucgucuggucucuuggggccuaguguaugcauuuaguccaaaacaacagccucucauaauuuuguuuuuguuuugagacaguuucacuuugucgcccaggcuggcaugcaguggcacggucuuagcucacugcaaccuccgccuuccagguucaagcaauucucgugccucagccuccugaguagcugggacuacaggcgcaugccaccaugcccagcugauuuuuuuguauuuuuuaguagagacgggguuucaccauguugcccaggcuauucuugaacuccugagcucaggcaauccacaugccucggccucccaaagugcuaggauuacaggugugagcuaccacgcccagcucauaauuuuguuuuaaaauucccccuuuuuggucagguucucacuuaggugagagugugacccaaacuuagggccuuagcaccacucucagucaccacauuuugaaaccaaggccuagcaaugaagucacugggugagcugucacacagccagcaaaucugauccaagcccaagcuccaccacuucccagguguguguugcugggucagucccugcaccuccgaaacuguuuccuuuggcgucuaacauugguuucccauucaagaacuacggugcaccaggugcugacugugacacaccugaccugcuguguccucauuaacaacccugagagugagacagagcugucccccuuuacaggugagaaaauggagguccacuuggccauggugaagaggucacaucgauggcagguacugggccaggcccugcacaggccuccaugugggaccuacccagggacaccccugugccaagcucucuccaccucagcucagccgggggccuuccccauccaagcccacccagcucccaggccugcuccaaggacacccuccaaggcucuaccaagcagccuaauaaacugaugugccuccagggagcaucagcugguaugccccagcuuguaccuggcaggacucacagggucagguauuugcccuuagggagcccccggucuagagcacgcagccccagacuguccaggcugggaaggucuuuugcgauuucccaaaugccccgagccacaaaaaucacuugaggugcuuauggaaaaagucuuauucccaagugguuaccuugggaggaggauugacuaggcggugcaugaaggaacuuccuggggcaauggaaauguuuuguuuuguuuuuuuucagauggaguuucacucuugucgccaaggcuguagugcaauggcgugaucucggcucauggcaaccuccaccucccagguucaagugauucucaugccucaggcucccgaguagcugggauuacaguguuucugcccggccggucuuuaucaugaccugagaaguaguuaaacguguguauauuugugaaaaguugucgaggggcuaaucgucccuacccugucuauaucgugagguuuuuggggaggagcugaugagauuucaauaaagggaguguuggggaaaaaaaggguuuaguggagggaugugacuauaugcaaguuuaaaaggacagauuagaaagacauaacagcccccuaaauaaauuccuacuucuccuauuccagaccuacucggucagaaucucccaggucagggccugggaagcuguuuuuuuauuuuuuguuuugagacagggucuuacucugucgcccaggcuggagugcaguggcacgaucauaguucacugcagccuuaagcgauccuccugccucagccucccaaguagcugggacuacaggcacacauuaccacauuugguuaauguuuacauuuuuaaaauagagguggggucucacuaugcugcccaggcuagucucgaacuccuggguucaagugauccuccugccucagccucccaaaaugcuuggauuacagguauaagccgcugugcccagcuggaagcuguauuuuuuugguggggggauuggggggauggagucuugcucugucacccaagcuggagugcaguagcgcaaucucggcucacugcaaccuccgccuucagaguucaagcgauucucaugccuuagccucccuaguagcugggauugcaggcccaccaccaugcccggcuaauuuuuguuuuuaguagagacaggguuucaccauguuggccaggcugaucuugaacuccuggccucacgugauccgcccgccucggccucccaaagcaccgggauuacaggcgugagccacugcgccuggcuggaagcuauauuuuuaacaagucauuuucugagcagauucauuugggaaacuuugucuuagagaucaucccauuguccaaaugggaagacugaggccuaaagaggaggaaagccuugcccggugagaggaaccacuauaagcagacccugcaucucucagcugcuccccaccagaggcacacauagggaacugagucagcuuggagccagcauccccuagccugucagcugggccuucugggcucuuccaaggagcuguggcuagagaggagugcugaguugcccuugugucccuggugggcaugaggaaugaggcaggggcuggggggcaccugcauagcugccuagggagggagcccugcugaagaccagcccaguaacauuucagcugcagagucauagggaagggacauggaauuccucucuccgccaagcccagcaucucuggcaagccuugcuggccaggacuguauucauuacuggaggaaguuauuuauggcugucaugaagagcuggaugaagugcuugcgcaggaauguguggugguuucagagugggcugcaggucagauccaaggaaggacuucccuagagggcagugggccagugcuggggauuauaguaaggcucagacuucuagccauugacagcaccccauccuggcaggaaacagacguggaaguaccccagaggccuggugccaagccacugcaucuuuagggcuuugaugagaacccagcuguccccugagcgcucccagccucaacaccucugcacucugugcuucccagacuagaaugucccaugcuguccaaccaaugaaucccucccccugcccucucccuacccuaccccagcccagacagcaguuucggcuccuccccaagcucccagcacccagugccaugaagcccuuggugaaauuaaucagagccuuagagaaucauagguugucacccucucaccguggugagcuccuagggagcuggaauccugcucugcugauggcagcagccccguggcuggcagaggccggcacaggccggguggccagggaaugucgcuagguggaaggaugauggggucagaggguggguggcugaagagacagcucagcagcagugaagauggaugcuggagccaggcugccuggauucugauccugccucugccccucaccagcugggcagcucagagcaggugaccucaccccuccacaccuaauagaagccacugcguuguuguaaggaugccuucauacacacaaggguguaaaacggaggcugggaugugguaggugcugagugaaugucagucaggagcuaggguuauggggagggggagcaaaugagguggauggacugcggggcagagaugggcaaguggggcagaugaggggcuggagcagagaacggauggacccuuccccgcccacucgaucaagccaccauaugcuuugggauuucccagagaccuguucaccuggauggcugcagacaguccuuccagcucugagacucuagaacccagaagcucaccugccugcugaguacuuucccuucaaagggccuguucuuaagcggcagagguccuauucuuacagucaaagggcucccaucuccaaagagaaccagaucucucucucccucacacacucacuugggaagaaaggaguaaccugccagguagccugacacuuccuuuccaucuugaaggggagagagagaaagucuaggacaggguaugggccagaaguguccgugggggugggucgagcaccaggcuggaaggaugaugggguugagaugagcagagagagagagaggacacucccaacaggaccugaguguuuaaaggcaaggaggcaggaauguguggaguuugggguucagggagaaaggcacgagcaggcggcuugcauucaggacagaggggcagccuggacccaccacaaagggcucugcuccccaagcacggccugguggagagcaggcccucugcaugccucaucucacuacaugccccauugccagcuccauuuuacaggugaggagggugaggcucugacugucacuuacucaaggccacacagcagagcuggaaucagaaacccugagggucuggguucagagaagccaaagcuucucugggggucccugaggcuccaggacggucaugaugccccaaaccaacucugugggcagaggacugaagccagaggacuaguggcaggagagaagcagcagggaggcgcaguagggagaucgcaggggagggagauagcagggcccagagacaccaugccuggggccugcagugcccaggcaggggucgggggcggagcauggcugcuuugcaggcacacagccuucugccaugccauggaaaggacauguucugccccaggccaccucacucugugccaagccuagaugccaaguacagaaagcggugggggaggguggcgcacgcacuacaucugcgguguucgccaaccaccuccuccagcacuucccucagcccucugcagggggagccucccugguacuaggagacauggccggcccauccuugcucucacaaacaacaagaaaaggaaggcacaggccgggcgcgguggcucaagccuguaaucccagcacuuugggaggcagaggugggcagaucacgaggucaggagaucgagaccauccugacuaacacggugaaacccugucucuacuaaaaauauacaaaaaauuagcugggcuggguggcgggcaccuguagucccagcuacucgggaggcugaggcaggagaauggugugaacucgggagguggagcuugcaaugagcugugaucgugccacugcacuccagccugggugacagagugagacuccaucucaaaaaaaaaaaaaaaaggaaaaagaaaaggaagacacagagaggguacacaaccuccccagugucacacagcacaucaggggcagggauaggucuccccacuaaccagcugaggauuuggggggcaauuacuggaaaggcaaggcaguguucaaggcgcagcuuggaugccaaugucuuggacuuccguacauuagugauuugcggcaacugaugaaaauauuucaaacugagacuauuuuagaaaaauccuauuuuacauauuuugucaucguauucauaagauuaauaauaacaaaccuuuucauagaccuuauuaugugccaggcauuguucuaaacacuuuaccuauauuaacucacuugauccccacaacaaccuucaagguaagcacuauuauuauccccauuuuacagaugacaaaacagaagcacagagagauuaaggagcaugcccaaggucacacagccaguaagugagcgagccagaauucagccuuacuuggggauguuucugucucccaggacuaagcauaaacuccucaaacaggaggcaagacuggaaacaaaccaccauuugcccucucugcaauauguacauuacacagacacauuauacuuuugcagaugaagggauugcgugcagcugcuauuugauucacacucacuacacucuguucccaaauguuauuucauuguaucugcaccacgguucccagugggagggcuuccuauaaucauaacuuuacaggagaggugaggugacuugccagaggucacacagcaagagaaugucacaucuaggguccaagucucuucugaucuuugcacgguaucuuguagccagcccugcagugcaacucacuuggggcuugcaguggcagggaggggaggaucccagauucaagaccuggcauucaagaccuggcucugcccccggccaggugggcgcacccuggccacccccacccauaauccccuccuucaacucauccucaagacagggcauuggccaaucccggcucuccccacuccccucccccuagcagaggauguguccauugugcagauggccccacgcaggcccugugagaggaggcugaggaggcgccgggcugugggaaaagggacaaugaacuuguagcuugcugggcagcggccagcacaagccgaaucccuggguggcgggcgcagagggcucagaucagaggaggaaggacgcggguguucccagagacagugcucagggcagcugggcuccagauaacagcguuccucgcauucccagaggacgcuccagccggccacagaaggcuccgguggcuuuugcguuugaucuccgcggcgaccuugggacauaguagggcagggcugacgccgagagccccagacaggaaacuggggccuauggaggugaggucccacccaagggcaugcagcucagcaggcccccauugaccuugggcacaccaccucacccgucaaauggggaccauccuggugagagccuacgucacuggaggaacaagaauucagugagacaauaaacaaggagagaaagacccagggccugguacgcauuaaacaauagguguuagccagaaguaacagugaucacgagugugccgggcacugcucuaagcacuuuacacgcaaagccaucugguccucacaccaacgcccucauugcucccaguguacagaaaagucaaggaacugggccaaggucacauagcuacuaacaggacccaaagaggaagagggagaaacucuauggagcaacuacuacgcgccgggggcuuuucacccagucuucgaauuccagugaagugcaaaugaucagcuccggcucaggaggaaaaaccaaggcucagaacaggagggagguucagggucacaaagcaaccacgugggagcgcugggauucaggccagguccguccagcuccauguccaguguacgugccacccccaucucagucacaugccaggacaaccucggucaccaauggcagagcucgugccucagccaucccaggcacagggagcccugccucaguggggcugcaugagcucacucugcugggguguagggggauggcgguggggggggugguucuggcaaugagagcugcaggaagccaugccuggcugcugcccuguggcugguccucaugucaugcugcucucucagcucccuguguacuuucccgugaucgcagcuuccugggggccucuuguaucuagacagagugcccgcuccacaaagugaggggcuucagucacguuggccucucccuccugggucagcuccucugggcuuauaauuuugcacagagaggcugagaucagugggggcagcccaggguuacaagucagaguccucgcugaauauucaagggcuguuuccuuggcuguagagcagggauaauaaacuccauucugccuccaguaucagcgucuuagaagggaaggaaccuggccgggcacgguggcucacgccuuuaaucccagcauuuugggaggccgaggcgggcagaucacaaggucaggagaucaagaccauccuggcuaacacagugaaacccugucucuacuaaaaauacaaaaaauuagccaggcgugguggcgggcgccaauaaucccagcuacucaggaggcuaaggcaggagaaucgcuugaaccugggagguggagguuguagugagccaagaucgcgccacugcacuccagccugggugacagagcaagacuccgucucaaaaaaaaaaaaaaaaaaaaaaagggaaggaaccuugcaaaucaaaagguacaaugcagaaguuucuacggcucuccacugcacucccucuggugaguggaguggacaucuacugucauuuuuggccacccagagucuguuuccccuuccuaacaauaccaccaaguuuccuugggaagugacccucccccuuucagccugguuugggugggacugaucccgccuccagcuccagguggacccugacuggcuccagcuggaagacucugucugcuugcuggguuaugagggugugaagugguggggaagggcacuuuguauagccugaagaggaagcaaccucucagagauggacuagagaaagguagagaccuugagucuuugauagcaucacuugggcuccuagaugcagccaugccugaagccuuccucugaacauccuggcuacaugagccaauuaauuuccccauugugcgucuuggcuuuucuguuacuuggaacacagagucugaccucagaacugcagcucagccaguuuuucucagcgcuuuagauugugagcaaccaaaucaggucauucauauucugccagcuguuucugccagaggaaaaaucuugcaaacaagcuaaagcugacaaguuucaaguaugugguaauguaagaguccaacuuccuacaagucacuuucuacuuggaaucuauaaacuucuagaauuacagaaaguuuuggggcuggacuugucuaauagcccugcaggacucagauccucacuuucugacagguuguuguccauugaaguuuacaacccuuugaccaccagguuccaugcaucuauugugugccagcccugugacaggacuugcagguacaagcucugccuuccaggcccuucaguuugguaaugacugguuauaauucaccuuucuaguagguuuuacacaaaaggccucggagggagaauaccacuacacccauuucagaggagaaaguagagacucagcaaggugaagugacuugcccuaggucccucugcuaaacaggggcagggccaagccaugucuccagaucugccugggcccagugcuacugcuuuuucuccuagucauuggaguggagugggcugaggcuaucauuucuuugagaguuuguuccacucaggagcagucagagugguuuaaaaagcuaaagaaaacgagaaagcuaagugucaugagcuuccugucugccugaaggucuugacuucuucagaagccccaguauuuggcccauccagcuucacucuccuuucuuuuuuuuuugagacagggucuugcucugucauucaggcugaagugcagugacacgaucauagcucacugcagccucaaccucccgagcucaaacgauccucuugccucagcaagagaccaaguagcugggaccaccggcgcacagcaccacguucggcuggugauuuuauuuuuaguagagacaaggucucgcuauguugcccagacucucaaccuccuaagcuccagcaauccuccugccucagccucccaaagugcugggacucccgggugaggccccacacccagccaaacuuuccucuccuauauggcucgcugcuugcaggcuguggccagagaggaaaccagcacugcccugaaauccagaccccaaaugcuuucaugggagaccucgucaccccaagugagcugucccagccuuucucaggcgucugcccuaugucucuaagauccagcugaucuugacuaaacaccuucuaugccuagggcuuucccuauauguuauucaaccaacauucgcuggaacacuguuuauugagcagccacaauaugccaggggcuguucuaggugcugaacauaacagcccaaaucccugucaguguggcaggcagacaacaaggaaguaaguaaaagcaauagaacgccagguggcgguaaguacagcggggaaaaagaaggcagggaggaggacagggagguuugcaguuuuaaauagaaagaucagagaaggucucaccaagaaaucauuucacuguggccuugcaaugaucccacacaggccagaacgugauucccaaaucacagauaaggagggauaggguuucaggauaacucucaaguccaugcaugucaauacaaccagcgcaacuggauucuugcccagggccuccugucucccucgugcccucuccccuaacucuaccaagggguacuagcagcccuuuugcagaggaagaaacugaaaccacaaacccagacccucaagaguacaccagggugagggacagcgguggggggcuagaguucagccccagagcugcccucugggccuaucucuuggcaaagcccacauccacuacccuaggcuucagucugaagcuucagcucuggguuuguugaaacucaauccuccucuucgcugacuccguguccucccagaauccuccucccuuucccagagccccuguggcucucuaucucaggucuuaugagccccaaauuguccaacccaccuuuguucugccuccucaauuaacuucuggcuuaucacuaagcccacauuugcaugaaacuacaaaaggcaucuugcauauggccaagggcggacagucagaauauacauguaggauccaggugugguggcugacacguguaaucccagcacuuugggaggccaaggcaggaggacugcuugagcccaggauuucaagaccagccuggggaacauggcgaaauccugucucuacaaaaauuagccaggcaugguggcacacaccuguaggcccagccacucaggaggcugagacuggaggaucgcuucagcccaggaggucuaggcugcagugauccgagauugcgccacugcacuccagccugggagacuucucacugugcuuucccaucugccuguauuugguaaucucccaagucccagucuaaucuucuucuucuucuucuucuucuucuuuuuuuuuuuuugagacaagaguuuuacucuugucacccaggccagagugaaauggcacgaucucggcucacugcaaacuccaccuccgagguucaggcgauucuccugccucagccucccgaguagccaggauuacaggcgcccacgaccacaccuggcuaauuuuuguauuauuaguagagaugggcgguuucaccauguuggccaggcugaucucgaacuccugaccucagguaauccacccaccucagccucccaaagugcugggauuacaggcgugagccaccgugcccagacccagucuaaucuucugaauaguguggcaugguggaaagaccuuggucuugugggaaguggaccugggguuaaguccuggcuguguagcuuugaaagcaacuuugggguuucagguuccuuauccauaaaacaagguuggucauccucaccuugcaggguuguuuuacagauaaaaugcaguggagagcauccguuaaaaguuaaaauucaacagagaguguauuuggaaagcagagcccggcagauaaucaucaagaaucuaccaaacugaaaggagaugucuguauaguggugaaacaacugucaccagcagaaugacagcugcauucacugugcuccuacacuuugagguagguacucuuaguaucauucacauuuuaugaagaggaaaaaagcacagaaagguuaaguaacuugccugaggucacacagcagaccugcagcagagcugggauucugagcccaaauuguccaacuccaaacuacaagcucuuaacccauauauuaggguaaguaaacgguggcuuuccauguugaaagaacugcuccaugauacauagcguuaagugcugacccaggaagggcuggugggcagccccacuccaaagcuugugcuccccaccaugguaucacaacaaacugaaagggacucuaggaauacucuaacccaacaccuucaucuuuuucuccaagagaagccugagguccagagagguagcaugaccugcccaaagucacacagccaauuaguugaagaaucaggacaggcacccugguguccugacuccagaacccuaugccaucacugagugucaccuugaccaugaggcauggucagggaaggagucuugaggaugugcugaaguguuucagcagaaguggagggaaggaagucuaagcugcuggaacagcccaugccaagguccagaagccgugaacgucuuuccuggagaacagggagcuguaaggugcacgcagagguuuggguggggcagagaaugaggcugcuuucucauauugaauauuugcuuucagcucuuuuauuuuuuacacucucucauucuacuuuaugcugcaaauguuuuuccuuauuucucuuguuuccuuauuucucauguuucugauguuuauuuaaaauauuggucuugggcugggcgcaguagcucacgccuguaaucccagcacuucaggaggcugaggcgggcggaucacaugaggucaggaguucgagaucagccuggccaacauggugaaaccccaucucuacaaaaauacaaaaauuagcagggcaugauggcaggugccuguaaucccagcuacucgggaggcucaggugggagaaucgcuugaaccugggaggcagagguugcagcaagcugagaucacaccauugcacuccagccugggugacaaagcaagacuccauuucaaaaaauaaaaaauuaaaaaaaaaaucuuggucuuuuuauucuaauaccacugacucuggguugucucuaaucaguuuaugguuuuacuuuugaauucauugugcucuggcugguggugggacaggggauuggggaauccacacgcuccuugccccaacagagagagaagacauauggcuccuggguccuccuucucaacaucaaucccaaguaacaacagaacaaaauaccacuaagccuaggcaacaauggggaaacagaaucuccugggagauggaagagaguuuaaacuaguguguguaggguggcggggagggguugcugcagccaggagaaaaggcagggcauggucuuuaggguggagagaauauuacagaaaagaaaacaggguuugaguucuccucuugccucucuguuccaagcccaggcccccauacacacacccacuguccuggaacaacuaaggucagagcugggugugggguuggaguucagccccacagccacccucuggaccugccuccuggcaaagcccacaucugcuacccuagaccucagucuccaacuucagcucugggcuuguugaaacuccauccuccucucugcugacuccguguccucccagaauccuccucccuuucccagagccccuuuggcucucuaucccaggacaugugagccccaaauuguccaacccaccuuuguucugccccucaauuaacuuauggcuuaucacuaagcccacauuuucaugaaacccacaaaaaguaucuugcauaaagcagcccaggaggauggcacaagugucuacugagauaaagucaaagcaugggcugggccauaauuccagcacuuugggagccaaggcaggaggcucgcuugagcccaggaccuugagacagccugggcaacaaagugagacccugucucuuacaaaaaaaucaaaaaauuggccgggcgccguggcucacaccuguaaucccgcacuuugggaggccaaggcggguggaucacuugagaccaggaguucgagaccagccuggccaacauggugaaaccccaucucaucucuacuaaaaauacaaaaauuagccgggugugguggugggugccuguaaucccagcuacucgggaggcugaggcacgagaauugcuugaaccugagagacagagguugagccaagauugcaccacugcacuccagccugggugacagagcaagacucugucuccaaaaaaaaaaaaaaaaaaaaaucaaaaaugaucuggaugugguggugcacgccuguggucccagcuacuuaggagacugaggcaggaggugugcuugaacccaggaugucgaggcuccagugagccauguucaugccacugcucuccagucugggugacagagugagaccaugucucaaaaaaaaaaaaaaaaaaaaauucaaagcuugccagcaaacaauguggaacugcaggaauugggaggggaccgacagucacuacagggggccucuacagucacuccaccaccccuuccuuuccagaccccagucugaagaauucugaccuaggcauauagccccuucuccucacuguuucucccuggggucugaaagagaggcccaauccuguggagugagucacugggggagggagaauggugaugucacaccuagugagaaaccaagugguucugauguccagggauucccguccuggcaaugucgucuccuuggacucauuggaacugggcgacuagggucagccuuagacucuuaccaaagacacagcaucaaacagaauagcugaaaucccccacggaguaagcucacaaguuaaagaacagaguauccaaggagcacaaugacuucaaaagaaacccaaacugauuagagauaccgcuggaaucauccguauuagaucagauuuacugagaauuuaaaauaagcaaaaaucguaauugccuagguuuagugauguuuugcuuuucaguauuugggacugauuugagagggaggauccaggagccauacguuuucccuggcugcuaguuuuaagggcaagaagugcauggcuccccgaaucccaccccacgccacuaccagccauagcacaaugaauucuaaagaaaaaccauuaacaggaccagaugcgguggcucacaccuguaaucccagcacucuaggaagccaaggcggguggauuacuugagcccaagaguuugagaccagccugggcaacacaaugaaacuccaucucuacaaaaaauacaaaaaaaauuagcuggccgugguggugcacaacuauagucccaguuacucaggaggcugaagugggaggaucacuugagcucgggaggucgaggcugcagugagcagagaucacgccacugcacuccagccugggcaacaguggagacccugucucaaaaaaacgaaacaaaaugaagcaaacaaaaagucuccauaaacugugagaaacaugcaaaagaaaugagcaaagauguuagcaaaacagaaagaggaaugguuaaaagaccccaguggaaacacucuaugugaaaaaccaguugaaauaacaaacacauaaguagaauaaauuacagaguguauccagcugcugaacgauggaggagagagcuaaguuauuagcuugaggacgcuuccaggaggaagcagggaaggauuaagaaacagaaaauuggccaggcuugguggcucaugacuggaauuccaacacuuuggaagguccaggaaacauggcaagaaccucaucucuacaaaaaaaauuauuuuuuaauuagccaaguguggugugcaccuguggucccugcuauuugggaggcuggggugggagcguugcuuaaggccagggguugagacugaagugagccauguucaugccacugcacuccagccugggugacaaaguaagacccugucucagaaaaaaaaaaagaaacagaacauugaaagaaaaguuaaaagaacauuaaccccaaucuuacugcauuaauuugagauuaaccauaaaccuaauuguaagucagaaucacaaagcuucuagaagaaaauauaaaaggauaucuucaugacuuugggguaggcaaagaauacugacuccauaauauuuucuuuuuuuuuuuuuugagauggagucucgcucuugucacccaggcuggagugcaguggcauaaucuuggcucacugcaaccuccaccuccuggguucaagcaauucucugccucagccuccugaguagcugggauuacaggcgcccaccaccacacccagcuaauuuuuguacuuuuaguagagacgggguuucgccauguugaccaggcuggucucgaacuccugaccucaggugauccgcccaccucggccucccaaagugcugggauuacauguaugagccacgacgcccggcccugacuccauaauauuuucaugacuuuggguuaggcaaagaauacuaauuccauaaaagaaaaaaaagguaaauuggacuucaucaaaauugaaaaccucuuguuaucaaaacauaccauuaagaaacugaauaggucggccgggagcggaggcucacgucuguaaucccagcauuuugggaggucaagguggguggaucacaaggucaggaguccgagaccagucuggccaauauggugaaaucucaucucuacuaaaaauacaaaaaaaaauuagccaggcaugguggcacaugcccguaaucccagcuacuugggaggcugaggcaggagaauugcuugaauccaggaggcagagguugcggugagcugagaucacaccacugcacuccagccugggugacagagcgagauuccgccucaaaaaaaaaaaaaaaaaaaaaaacugaauaggucaggcauguaaucucaugccugaauaggucacuccuguaaaucucagcaccuugggaggccacggcaggaggaucgcuuaagcccaggaguucgagaccagccugggcaacauaaggaaaccccaucucuacaaaaaauacaaaaauuaccugggugugguguugugcaccugcagucccagcuacuuagggggcugaggugggaggaucacuuuauuuggggagguugaggcuguaugagcagugaucgugccacuacacuccagccugggugacagagcaagacugucucaaaaaaaacaaaaaaacaaaaaaacaaaaaaaaaaaaaacacguacacacaaugaaaacauccuaaagguuuagcaaaaaacagaacacuuacaaauggaauaaaugucgaauugaccaaacuacagaaggaaaaaaagauugagcugggaauuuucuauccagcuaaacagccauucaaauguuaaaggcuggccgggcgugguggucaugccuauaauccuagcacuuugggaggccgagguggacggaucacuucagguugggaguuugagaccagccuagccaacaagguaaaaccuugucccuacugaaaauacaaaaauuagccaggugugguggcaggugccacuaaucccagcuauucaggaagcugaggcaggagaaucgccuaaacccaggaggcagagcuuguggugagccaagaucacaccaccacacuugagccugagcaacagagccaaaacuccaccucaaaaaaaaaaaaaaaaaguuaaaggcuaauaaaaguuacagcaucaagggcucagguuuguacaaaaagacagccccucgcccccuccaaaaaaagaaucaaauaauuuuaaaggaaugauuuaauuaggagcaaauuccacagauuguauucaagauaucugaagacugagcaaauaauuuaguaaaguuuaguuuuucaaaacaaauucaaguucaaagaaaagaacaagaagggccgggcgugguggcucacaccuguaaucccagcacuuuggguggcugaggcaggcagaucaccugaggucgggaguucgagaccagccugaccaacacggagaaaccccgucucuacuaaaaauacaaaauuagcugggugugguggugcaugccuguaaucccagcuacucgggaggcugagacaggagaaucgcuugaacccgggaggcagagguuguggagagcugagaucgcaccauugcacuccagccugggcaacaagagugaaacuccaucucaagaaagaaaagaaaagaaaagaaaagaaaagaacaagaauaacauagaucuguaacucagaauuagacaauuuuuuaaaaaucuagacaauuuucaugugacaucaugggggcugaggggagcaugucagugaaggguguggaaacugaagagaggcaggggagcaagggacaugagaaaaugcuaaucuugucuuuguagggaaaagccacagauaauuuuuuaaagugauaaaacagaaaaagcagaacaaauugaaauaaaaauguaggaugguagaaacaaaauacauaaacacacuuucuuuucaggaacaugcaaacauuuaaauaauucaucaccuaccaggccaaaaaguaagucucacaguucaaauaauaaguuuucacauagaccacauccugugaccaucaauuaagugagaagcuaagcguuuacaaguauaaaucauuaccccuacacuuagaaaugaaaaaaagucccuaaaaauuucaaggaucaaagaaaagucauaguagaaacuuaaaauuacuuagaacugaaugauuaaaaacaccacauaucaaaaauuauauaaugcagcaaaaaagguuaaaaauuaauaaaguaggccgggcgugguagcucacaccuguaaucccagcacuuugggaggccgaggcaggcagaucaccugaggucaggaguuugagaccagccuggccaacauggugaaaccccauuucuacuaaaaauacaaaaauuagccagguauggugguacaugccuguagucccagcuacuccagaggcugaugcaggagaauagcuugaaccugggaggcggagguugcagugagccgagauggcgcuauggcacuccagccugggagacagagacuccaucucaaaaaaaauaaauaaaugaaaucugcugucuccagaaauccuuugcggccauucugcccaaggcuuagcuagguggccucucaugcuuucccucauccucuaccaccuagggcucugugggggagucugcuuacaagaccauuucuguacacacucuuuuuguucguuuguuugagacagaguuuugcucuuguugcccaggcuggagugcaauggugccaucuuggcucacugccaccucugccucccagguucaagcaauucuccugccucagccuccggaguagcugggauuacaggcacgcgccaccaugcccggcuaauuuuuguauuuuuaguagagacgagguuucaccauguuggucaggcuggucucgaacuccugaccucaggugauccacuggccuuggccucccaaagugcugggacuacaggcgugagccgcggagcccagccuacacacacucuuugaaggcaaaauccagggcagauccaucugugauuccagcaccuaacccugggccucacaggcaguugggcuaaugagauguuuguugaaucagugaauguccucccgcacccgucuuuccccuucuugacuggcuuccuccucucuccacccugacaagugccaagacgccagcacccaggugagcacgccaggagaggccgcuccaucaggaauuuccugagcaggggcagccuuuuucuuccuccacucagcuuucuccagguagaugggacaaagcccaagacaagcgcugccuccaucacaggaauagucuggggccuggcccagccaagucuaugggccaugcauuuuuccuguauuuuacccucgguggcuggagcguguggcgggaugaggagguuggcaggcuugccucagugccccaacugggggccuugcccagcugagcuccguuuggccagaggccagcugggaaacacuugauuauucaaaucauguggccgcccaagaggaaagcauccguuuccuccaagagggggaaguggggcaggcaggccagcccagggauuugguuguugaaaagggaaauuucagaacaaaguucucacacaaaccagcacucugagauucacugccccaggaagacucuggaagccucagauagaaacucaggagggucaggcucgaggccagagcccuggagugaggccuggaccaaucccccacuuacguuucugaguuagcagaggccucagccaggcuaauugcucuggccucccccugacccugguccuggagacaccaggacugccccgccaugccccuucgccuguccuucccuucccccaggaaucgcgcaggggauagauaaacuccgcacuucuaagcucagggagcuggagccucggagccucccagcaagugucacacagucuguuccugcuauuugcucaacuccugccuugcucccccuccccagaucuggcuccaaaagaacuagcagguucaagaagaguguacccaucugacaugcagagaauuaucuaguacucauuaagugagaccggacucuggagcaaggcugcccggguuccaauucuggauuaacccauguaugagcuauaggaccuugggugaucccuucccuuccuuugugcuucuauucauuuuuuuuucuuauauuuuuuauuuuuagagaugggaucuugcuauguugcccaggcuggagugcgguagcuauucacaggugcaaugauaucucacugcagccuugaaguccuuggcucaagcaauccuccugccucagucucccaaguagcuaggacacaggcaugugccaccacucccagccugugcuuccauucuuuaccuguaaaagcagagauuugggccgggcgcaguagcucaugccuguaauuccagcacuuugggaggcugaggcgggcagaucaugaggucaggaguuugagaccagccugagcaacauggugaaaccccgucucuacuaaaaauacaaaaauuagccaggugugguggcacgcgccuguaaucccagcuacucaguaggcugaggcaggagaauugcuugaaccugggagguggagguggcagugagccgagaucacgccacugcacuccagccugggcgacagagcgagacuccaugucaaaaaaaaaaaaaaaaaaaaaagcagagauuugaguaucuacccuuuggggagguuagauucaggaaaugacaacucuugcuauuaucagugaacaaauuaagguuucauaaaagagcuaggccuggaucucuggaccagacaaccccauggcagacacauccccccucaccagagccaagcccuggguccaaaucccagcucaaccacccacuagcuccacgagcugcugggugguaaguugcuaccucccugagccuccuucugccccagagcuguugcaggccuccccauguuggagggugguugucccuguuacugcuuguccugggcaguacccggggauuagggggcugacacaugcugggcugccccaggcaggggugaggugacagaucaguuuccuuuccugaauaccggucugggcccagccucagggugugacauaggggaggccccugaggagauggggauacuccccuccgccccacggaucauauagcgccagcaugcacccuggcacaggccugcugccaguggccaaccuggagcagagguaccaggaacuacccagcaggaagcuucacgagucuuuacagaaggaggcaggacagcaagaugccacagccugagugcugguguucacacuccagagcuaucauuuacuagccauuuacuggacaaaugagcuuauuccccauuuuuguuuuuguuuuuuguuuuugagauggagucucgcucugucgcccagucuggaguacagugggacaaucucagcuggcugcaaccuccgccucccggguucaagugauucuccugucucauccuccugaguaccuguaaucuugagggauuacaggcaccugccaccacaucuggcuauaauguuuuguauuuuuaguaaagauaggguuucaucauguuggccaugcuggucucaaacuccugaccucaggugauccacccaccucggccucccaaagugcugggauuacaggcaggggccacugcgcccagcccaaaugagcuuauuucugagccuggcuccccauccgugaguggggacaaugacaauaauaucuaccuccuagggcugauaugaggauuaaaugauuaauguaucugacuugcuugaacagugccugccacucaguuaauaugagcuguuacuguuacaaugauuuaugaccgcugucauuucuucucuaaaguccccccagcaccgaguuuccuccagcagauucggggcucccuccugccagcuucugcucagaucaugauuggcgccuaucccacagauggugaucagaagaccuauugugugcccgacacuggaugaggcauuuuauagucagggacaacaugaccgcuugacucgccuacuacuguucccguuuguucuaagccuaggaucuggggcgugagguguguguuaugggaggaggcugguaggggaggugguucccauauuauguuauuuggaacacacauguccugggagauauuaaaauauuugcacgugacaccaaccaggugaccuaggagacaugaacauaaucucucugagccucaggugcaaggauaaaugaaaaaauacaugugagcugcuuagaacacagccugguucaugauauauuuuaaacaaaccuggccgggugcaguggcucacgccuguaaucccagcacuuugggaggccaaggcgggcggaucaugaagucaggagauggagaccauccuggcuaacauggugaaacccugucucuacuaaaaaauacaacaaaaauuagcugggcgugguggugugugccuguagucccagcuacuggggagguugaggcaggagaauggcgugaacccaggagguggagcuuguagugagccgagauugcgccacugcacuccagccugggcgacagagcgagacuccaucucaaaaaaaaaaaaaaaaauggacauauguauugguuacuccucugaguaccucucacggagucgacacaugaaacugaggcacagaggucaugcaagugaccuuucacuuagggacucucagucucuaagaaauguuaacucgcugcgaguauucauucauucaacaaauauguauuaagugccuacuaugcaccaggaagcaugguacaugcagauucagcaaauuuacagcuaugacuauuauuauuauuaaagaaauuaaggcuguuugggauuggggguacaucugugaacaaaauggacaaagacauuggccagagguaugacacugggcaccucauaccugagugagacuaaaggccugaacugccaacaggaaaacuggacccagagacacuggcuuguccugcugccaaucacuaaccauuuaugagcugguggcauucgugcaaggacaccagugaaggucuggggaggguggccaggcuucgcauugaguggcucaagagucacacccaguggggcaucccucccaggcuuccccaugguaacaaagccaggccagcuguggaaacccuugccgaguggggcagccuuucaugaacucaaaagucauuaaaugggcuguuguaaucccagcacuuugggaggccaaggcaaguggaucaccugaggucaggaguuugagaccagccuggccaacaugaugaaacccugucucuccuaaaaauacaaaaauuagccaggcgugcugucaggcaccuguaaucccagcuacucaggaggccaaggcaggagaaucgcuugaacccgggaggcgcagguugcagugagccgagaucgcgccguuguacuacagccugggcgacagagcagacuccgucucaaaaaaaaaaaagucauuaaacgcuugcugaaagcaggcaucuuauuaggcaugggaauucacgagugacucagauggggcuccuacccuccaggaacugaaacucagagccagaugcuauguggaugaucagauuacaaaggguucaagauauccaaagcaagcucuagaaaaacagccaugaugccaacuggcaacacaaacagggagagguugcugcaggggaggggauggcagguacaaaggcaacgaugagagagacuggagacacagcuggggaaagaccuucagccugggauccugaccugaguuugaggccugguuuuaccaucaauuuuaccucaggcaaguugcuugccuccccaagccucagucucccacuuugcaaaaugaugugaauacuuuauuggguugcuuugaugguucggugaguucaugaauaagaaauggcuuucggccgggcaccguggcucccagcacuuuggaaggcuaaggugggcggaucacaaggucaggagaucgagaacauccuggcuaacacggugaaaccccgugucuacuauaaguacaaaaaauuagccgggcgugguggcacaccccuguagucccagcuacuccagaggcugaggcaggagaaucacuugaaccugggaggcugcagugagccaagaucaagccacugcacuccauccugggcgacagggcgagacuccgucucaaaaaaaaaaaaaaaaaaagagaaaaaagaaauggcuuuaaaaacugaaaaauaugccaggccugguggcucaccgccuguuaaucccaacauuuugggaagcugaggugggaggauugccugagcccaggaguucaagaccagccucaucaacauaagcaagaccucaucucacaaaauaaaaaauaaaaaaaauuagcugggcaugguggcacaagccugcaguuccagcuacucgggaggcugaggcaggagaucacuugagcccaggaagucaaggccgcagucaacuaugaucgugccugaacuccagccugggugacagggcaagaccuugucucaaaaaacaaacaaacaacaacaacaaaaaaaaccugaaaaauagaauaagugccuggaaacugagguuggcaguguuaaagugacuuguccaaggucaauggcugauuaaaacaggauaggguguaucugggugggaugcggggggcagcacaaccccugccucugcugagccaccacuccugcguucccagcacugaccucagguuccccuaggcaauuuguuccagaaggccuagggaacaggugggguaccuaauuccuuggugcaggguuuaccguuuauucgcugugugguccggggcccaccacccucccucccugagccucaaucuucuuuuuguuuucuugaaaugcagucucacucugucacucagguuggagugcaguggcacgaucucugcucacugcaaccuccgccucccggauucaagugauucucaugccucagccucccacauagcuggaauuacaggcauacaccaccacgcccagcuaguuuuuguauucuuaguacagauaggguuucaccauguuggccaggcuguucuugaacuccugaccuuaagugaucugcccgccuuggccucccaaagugcugggauuacaugcgugagcccuugugcccagccucugagcuucaguuuucucccuuuuaaaaagagaugcccuuugcugugcugcgcauguguaaacguggaaggcucugccgaugguaaagcacuuuccacgggcaaagacguaucgcacucaucaaugagaaaugaucaugguaagcugagagaaagacgcagaggccgcgggccccgcacugagccugcgguggaggaaagcaggaggaacuaagcuagacuguaccagggcccaccccaggugugggguaggaaccuuuuaugaggcacagagcugugcccauguucagucccaagggagaggcagguuucugggccucaucacugccuaggcuuaaaguaagagugacgagaaagaggccaguuucagccuuugugagcgaagugcuuuggcgaggcaggggucucccucagcaaggcugggcuacacuacagccccuuucccugugucccacuggaucugagcugaguagcgcuuguugcauuacaaagaaaaagacuugugcaggaaauaggguagaggacaggcucucuagucagaugcaacuugaucuguggcaaaaccaaguggggucuuucagcuucaguguguuagcaucucaacaccugggauggaguuugugggcgggucgguuuugccacacuguagggcccagguggucccacugucacagugaagccaaguucuagcccaagucuggcagagcagucaggcagcuaguuuucaggggagaaaaaaggggugggacgggggacuucaguggccuauuacggagcccucuccccaaaccaaauucauagcugagagcuuggggaugguacaguuacaauuuaaaguaauugucuaaauucuguauuuggguauuaauguuuaaaugguaaucugacaacaguuuauaaagugauguucugaauaccauaaaaaaaagaaagagcucaguuucagguccuccuggaaagaguuaggcuggccccuccccauccuuuguaauaauauccaucguaguaauaagaguuauuuauucgggguuugacagauaugaauucaaaucguagcuccgacacuuaccagcugggcaaacccaggcuaauuacucugagucauucuccucaccugaaaaaugggcugguauaaggauuaaauguguaaauguauacaaagcauuucgcagaguggcuuggugcguaacaagugguccgucagugucgagaacucuuauuacuacuauggauguuauuacaaaggguggagaggggcaggccuaacucuuuccaggaggaccugaaaccagccucuuucucgucacucuuacuuuaagccuagacagugaugaggcccagaaaccugccucucccuugggacugaacacgggcacagcucugugccucauaaaagguuccuaccccacaccuggggugggcccugguacagucuagcuuaguuccuccaaagacaaggaaaagaagaccaaggagcaccgugacacugaacugggugccaccugggccuaucccuucccuacccccacccacacaaugaccaaaucuaaucugguucugggauguccuuuuaucuugugugccaacucuauauuaguugcuaauggcugucuggagcacuguacuuagaaggaaucugggaaggaaagcaagcagugguugacuagugaugucugaugugggugcagggcaggagagaggaaggagacaugcuggcuauucgccauccacaaaucgaaaaauccuaaggccuugccucauucaaauaaaccaugcgugguagggaggguagccagaagcuaagagagggaaagggacuuggcgaaggucacacagcuugaaauggcagggcugggauucaaacccaggccccucuggguuucucaggaugcuuccuucuaggcuugucauuuccuaugagggggugaacaggcuaagaaacacugucugggagaacagacgcuggugccccaccaggugugucuauguucugucuccucccccuggggccucccacccccaugucauuugcaaacacucacugaaaaacaaauguguaccacaaggugcccugagagcucuucuccaaacaugcaaauuugaauccagaugccaaucugauugggcaacccuggauuugagucucaccugcacuuuccaaacuuugagaacauuacucaaucucucugagcuuccguuuccuuguuugcaaaauggaaagaauuaugagcucaauacaauaaggucauucaaagugauuagcucaguuucugacacagaguaagcccuuaaauguucauuacagacuguccccaacuuacacuuaagauuuuuuucuuuacgaugaugcaaaagcuacaguguucaguggaaaccacaccucgaguacccaaccagccauucuguuuuucacauucaauacaguauagccaagaaauugacaugagauagucaacacuuuauuaugaaauaggccucguguuagaugauuugcccaacuauaggcuaauguaacuguucugaacacauuuaggguaagucaggcuaagcuaccauguuugacagguuagguguuauaaccauuuucuacuuaugauauuuuucaacuuacaauuccaggacaaaaaccuuugguaaaucaaggagcaucuguauaaggauuaggucauggggaaaagcaaaaaaacagcauuuucacacacaaaaaaaucacuuaggugauuaagggcuuggacaagcuguugagaggaaaccugcuuaucucugauaucuugauaggcuaacagaccuagaauaugaauuucuauauuggaugguuuuaagauaaauagggaacugacucuucuaggaagauggguuaugucauuugcauuacggagaaagcaguagccuugaauggauggaugggucaccgcagggaacaaacaugucuacuucucacuucccagcugggggaguuuguguuuccguuuccucaucuguaauguggggauaauagcaccugccacccagcgcugcuguaggaccaaauaguaauuacaggcaaggcacugagcaccaugccuaguacgugcauguugggcuuauagucuauggacuuuuaguuaguaguggcauggcagggaccagcggaaugaggcagagaaagaagaggagcuauagaagggcucagaaggaguggaggaggggaaaugggccucagaugagacauuuucucaccagaauggcggcagacgggucaguuaguaacuccuguaugcugagagacagguaagucaagguggagacagguggagacagguggagggggaugagauccuccaaaaggccaggcuggccagaugcaguggcucacaccuguaaucccagcacuuugggaggaugaggugggaggaucacuugagcccaggaguucgaaaccagccugggcaacauugcaagaccucaucucuacaaguaauaaaaaaaauuagcggggcgugguggcgaaugccuguggucccagcuacuugagagguugggguaggaggauugcuugaguccaggaagucaaggcugcacuguagugagccaugaucgugccacugcacuccagccugggcaacagagccacuagacccugucucaaaaaacaacaacaacaaaacaaacaaacaaaacagacaaacaaacaaaaaaacaacaagccugagacacuucagugacagccagcaagaggccugagaacgucagccugagagcuaagugguacccacccuguggcuuuacugaccuaguaaaggugcacuaaagaaggcaagagguugacccaacaaaaagucacuggggccaggugugguggcccaugccuguaaucccagcacuuugcgaggccgaggaggguggaucaccugaggucaggaguucaagaucaaccuggccgacauggcaaaaccaugucucuacuaaaaauacaaaaauuagcugggugugguggcaugugccuguaaucccagcuacaugggaggcugaggcaggagaaucucuggaacccgggaggcggagguuguagugagccgagaucacgccacugcacuccagccuggggaacagagcgauacucagucuaaaaaagggucaccugguagaucuuuuuaaagggugcacuugugggccaggcacaaugguucaugccuauaaucucagcacuuucaggggccaagguggguagacuucuugaacccaggcugagcaacauagcagggccccaucucugcaaaaauaaaauaaaggucacacuucugguuuuuccaguaaaagcaauuugcuucagccaccuaaaaacuuuuuuaaagaacauaaaauauuugcugagcucugcccagcaguuugcagaccuggccagguaaaguucaugcaccugaaugacaaacugagcucuggaaggaugaagaagcaucucugaaacaagcuggaguggaggaggaggggguggcuuagaaagucuggagggucagggccucacuacagggucuccacggccuuauuuccagaaaugaccuuccagccuguccucuccucccuucccugggucaaagcagagaggcauagagaccuaggggaggaguaauccuaaggugucugcccucugagccucagucuccuuaacugcaaaaugcuggagaguaggggguaggugaguaucaaagguaaugugcgaaagugccugguacccaauggugcucacaaaaugccacuucccacacagggcacauuucugaagucgucugcagguguaaggaccaggggaugugagguuaguaucagcaaucgacaaucaaucagucucccuuguccaucucauaaccccuggagcaguugauucguggagaccuagaaucucacaucacagcagcugccuccagagccccccgcauguaaccaucaggcuucacagccuccugugcuacccucuggcucagacauggcgauucuaagaugcuugcugcagccaccaugguaccugccugucaucaccaggcccuggcucccagcaaaggggguggaacagagagcuguggguucagagugcaagaucguguuuccugucugagaagugguuaugcacugaugcacagggcuguuagggagcacagggugaaguggcgcaccaaugcacagggcucuuggggagcaagggguaagguggaagcugucaagggagucucuucccugcaggggcugugcaaucuuuagaaugaaguacccagcgaugccuguccccagcuagacccugggcucaacucgcugagccuugacagguagaugcucuaucacccccaaaccuccagagcccucagacucuuccugaggaccaccgaagcaggaaaaaagcuccuucgccuagcugacauguuuuguagauguugccaggcuauggaagaggggcuaguguccacgugucccauauucucacccugagcccccugagggcuggcccaagccccacacaaucauucaaguggaauuugagccccucuuacauggccucacugcaucuagcccagaaaccgcaagcucagaagguagguagguaaugucagggaggcaggugggcaagugugaggcaguggggcgugguggagacugugguaaaguggauggagcagcugcuaaucagcuccagccacuguggccaggcagggacauagccccauauggccacaucuucugaucuuucaagagaagccagaaauccuuaucuuuauauaaaaugaaauugccugguuuaaaaacaccagcaacuaaauaaaaguuguuuaaucaccgcaaaagucaacaaucccccacccccugcagccuuaggaaggcaguuugugauggaucucccauaacccagcacacagcaggcuauaaauaucugaggaccaguugaauacauuagacccauuccaagucuuagggaagucucaucucuccacuccuacuccucagauauauugguuuacagaugaagaaucugagacucagacaggggaagugacuugcccaaggucacagagguauucaaggacuucagcucagcucuccugagcuuaauaucuuuuuccaccaacccacaucaucugcauccucccuuaaacaaugauuuucaaaaaacagauaugcuaagaauauacuguagaaaugaaacacaccaaauucaggagagugguugccuuuggaaagaucauguagcuuaaggccaggagacugaauucccaguccacucugcccuaagcaauugugugacccugggcaagccucuucuccucucugggccucagucucccuggugcaccaagagcccaguugaccgagccagcuucuaaaggccuuccaacugaaauucuggggaucuaugucuccucucuggccaguacucuguggccucagaugaauacaaaauaguaauaauaauaauaauaauaauaauagagagggcgaguccacaccagccaggaaagaacacuacgacuuuuugugaaaccugacuccugguuacuggaauucagaaagaacgaugguaauacuugagcagcuuaaccaccauccuacaauuaaacaaaagcacaucugguuuaacuucguccucaucuccucccuaacccccuacucucaucucaaauuuuaccccuuaauuugagaagucaaauucaaugcaaacaauugauuucaugccacagugaggcugagaauuuaagcauggaaaacuuuaagcauagaguuuuucugggagcaauuaacgaaguguuggcggggggguugggagcugguacaaggaggcagaaaaauacggagacuauguucuucagacacugagcaucauaucuugauguugggggccuccuaugagcuugacacucagagagguaaagugacuugccucaggucacacagcuggcgauuggaauccaagacaccagcccccaaaccaguguuuucccugcuguguaggcuuuugugaccuaaacguggacuucccucaggcccucaggaucaccugguagggauaaaguuaacugcuuuugaaauugcuccacaggaaauaugaaugucuuaauaacaucaaugcugguucagcccaaaguuggaaaaccauuuaugaucuugcgacccugcaaaguauauaauuuuaacccauauugcagaugagaaaacugaggcuucgaaagggaaggugacuuguccagggucgcauggcagugcugggaaugaaccuucagucuacugccccuaacugcccucugaaagugaggacaucuccagaagaaaaaaaacaaaucuaacauaccacaaagcccagcuccagccugccaaggacgacgacauggugcugggaagccaagucagcauuccuguggccacauggagauuucugagugcugguucucagcccagcuugcucacucucccagcaauguucucucagagcucuggguuuuguauuaaaaagccaagucagacugauuucaaggugagaacucgggcucugcuacuggauccuacucccuggauuaaaaggccucauaugcccagagauggguacagcauggagauugcuagauuuggaauucuagauacgcaggcuccagccccagcuccucagguagcaucugugugccucugggcaacucacuuccccuuuccaagaucauauccagcuugcagggaauguuggguauguaagucaugggacagaacagggcugaguuugguccugagcuaggacacggugaggcacaagaacaggcagagggcaggaagcgcugcagagaugauggcuccagggcugaucucaucauggagcucugcgcucccagcccaggcuguguuuaggauggcgacagaagguggcaucugagugugagcaaagagggcaccaugccaccccacauguguagcccaacaggaugggaagggccugggcagaaguggguaacagguucagaggcaggguaggcacauaacccaacuuccagucuccgcauugcauuuucugcugagaagagagcugaggauagccaggauuuucuuaagcacagguaccagcuuaaacccuucgcaagcauucaucauaucuagaccucaccacugguaggcacuauugaucuccacagcuuaugggaggaggccgaggcacagagagggaacagaacugaucccaggucccacagcaaggcugccuuugcuaaagugagggccaaagguuggccaauccauuuuacaggugauugcgucuuaaucuccuuccuuaugaauagcuugauuucaagucuacacugugaauucugacaguuucaaagccugaaagaauuuuguuaugcaaacauccaauccagaagagggcuuuuggcugauuuacuguggcauucccggcaccuagaacagagcuuggcacacggcggaugcuuaaguauuugcugaaugaagauagcaucuuguucuggccucaguucaguuuuauuccucacaauagucccgaaaggggaauacaccccuuuuuacaaaugggcacauggaccgggaucaucacucagccuagucuucaccaguugggauguugagaagcuguguccaggggccucuucugagggaauucacagguauucaguuaaagaaagaaaaaggugacacaggaacaagaugcauggggccagggagugggauggcuggggcaggacagcguggggacacccacagguggggaggacuaaacaguuggaaagagcaagacuggagaguggaggaagagcgggcugagcccaggaggagccggaagacaaaaccaaggcucagcccccuaucucuuaggcaacacagugggagcaggacgcuagggcugcagaguuuggagucuggauucaaacccuggucccaccacuuacuuaaauugucuaagccucaguuuccccauuuguaaaaugaaaugauguacaugagaugucagagcaggucccucuacgcacgguaggccuucaaaaaacaguugcaguaucuacacugaggcugggacccaaccccugccucccugggcagcugggcccaccugagcggucugacuuuuucccagggcccaaagcccuuccuggcccaagaaucgcccccucuuuugaucucaaggaauuucacccuccacccagaggccuuuguaaaggccccgccuucgaccccauuauguguugaaaaagagucauaaggcacaauggggagugggggaggcuuuccucggccuccugccuuucugcugagaccugcguuuaacccuuucuuaccaagacugggcagggaagcagcccugggaggcccaccucgcaaagccuaaagggggcggcaggcuccuucggcuucgcgggcuccagagcuuugccccacagcugcggugcccacagugggugcccacacuuugacacccacgcggguguccucugucuccucccgccacgccccccauuccaagcgccuccugcccucuccuccucccaaaccaaacugcuuuagaccccaccgggucaggugggacgccugggagggcgccaggccacgaggccuugggguuggcagcccaggucucuagagcuacggcuaaggaggcaccaggaggggcucagucacggggcaccaagggcaggugcccagacagagcgcagggucccaggcagcggcucgggagguaggagacccugggacugcagggcggucccgagcgcgguccccugaguucgccggcuccgcgggcgccacguccaaucuccugucccgcccagagcgcgcgccgggagcuugggaugcgcgggaggacaggggcaggaccaauugcagggcgucccgaaugggcugcugugggcggcguggcgcuggagaccccggcccugccauuaaaguucaaccacggggccagcggaggaugcagaaggggauggaccacguccgcuggggcccuggggaaccagggcgcggggcagcgucgaauccuuaccugcgcagagcacuggcgaggguccguccaggcacaagcgcgugggagcacggagccaggauagcgggcgcggaguggcgggagcgcaacgcggcccgggccaccacccccgccgccuuauaaaggcggccgcggggcccgagugaggcccgggcagcccgcccccucccccg

SEQ ID NO: 14187 - RNA, 9744 nt, Homo sapiens
ggggccaggugaaguuugagggcaacaucucgcuuuauuuuuauuuauuuauuuauuuauuuauuuauuuauuuauauuugagacagagucuuaacacuguugcccaggcuggagugcaauggcgugaucucagcucacugcaagcucugccucuuggauucaugccuuucuccugccucagccucccgaguagcugggacuacaggugcccaccaccacgcccagcuaauuuuuuguacuuuuaguagagacaggguuuuaccguguuagccaggauagucucgaucuccugaccucgugagccgccugccucggccucccaaagugcugggauuacaggcaugagccaccgugccuggccacgucccuauuuuagaaaugagaggagugacugcacauaggaaaaaugccacuuuuagcaauucaaaguggaaaaacuucuuuuauauaaaaauuaucccaacucccaccccuuggcucucaguguugcaucucccacagagguaaaguugugccauuuucccacggcuuuaaacaaagcaaaacaaaaccaccaauccuaauaaccccccuccuugccccgucuccacgcugugcggagagggcucuagccccucagucggacuucuccuucuccuucaugugcaagaagacgaugcugaagaugaagagccccagcaucauggagaaggcgcuggcguaguagggguaggccgaggggaugaagcgcucauacugcgugugcuggaguggccgcacggauaccugcaggaggacagagguggcaggaccuggccacugcagagcccaggcagggcacaugcuagcugaaaacagaagcugucaccugugcuuaccugaguggaagaguacagguguguguagccuagccgguuguaauccacuuuaaacuggaauacaccauacacgucgggcaacuugaacugaacacuguauuugccaccugcggaagaaccaacaagaauaaccgggagggguuucccagagcuuuuccugguugggccucgagagcaagugaggccuggggccguuucuggcagcauccucgugcaggaacuacacucaccuuucuucuucaggaagguccucacaaaaggaucaaugcggacaaacuccagcugaaugucaucgccaucaaaggggacccauuugccauuugagagcugcuggaucacgaugcuauacuccugagauaaaaggccagguuagccagggcuggccaugacuggaggccuuccaccaccugcaggcagagcugcacuuaauucccacccgacgaacauggcaggaaugcccaggaguucagaagaccugcagaugccccugccacccggcccugaucaguaaccagucucucuccucagcaagguuaaucccccaacacagcaucucugccucuucucugaaggccuagauuccuucacacaguauucauggcccaucaaagucuggacccaaaccacccuccugccccgacaugugccaggcacuuucaaguauucaugcuuccauauucgcuuucucuugccuaacaaauucaaccuaaugaccuauuucucuuauuaaguccaacuuccugggcagaguuaaucagugaagccccucccacugcugccccccauagcaaauacacacaccucuucaaaagaagugcuccuauuaggacaucaguuuucacgccaggcucugcaucucaccuggcaugcuuagguguagggauuaacuuauucaucuuuauuuaugcccuuuaggccagcaaagaaguguucaauaagugcuucugagcugagcucagucagcuuggcaaacccuuugggcccucccaccccaaacaucucuuaccacuaggucagugacaguguaggcauuggguggggcugucucgcccacccgaugaugggacacaggccccacacggaggacacccuccuccuugaacacccagcgggagagggccacagcuaguucauaguugccugucugggaauaccugcaggagggaaacaggagcagcuugggcaccagagccaccuuuccaguggugccugaugggcaggaccacucauguccaccaugacaguacccuagcgaaguucugccuguaggccuugggcaccuagggacucaugguuaaagggaacgcaggaaacaaacgaaaagauauggcugguugcuugucaucugcacaacaaauacacaaauuucuaaaaggaacgguggagguuagggaucucuagauaagucacuacuaccuuaaaaaauuggaagugccaauaccagcaauauagcaauaaagcccugaaauaaucugacagcaccugaaacacucagccucugacacuuuuagcuaaaagccuccuucuuccccuucugaguccuccccauauacacacacugcaccacccggauccccggccccuaagccuccuggcagcuaccucugggagccgggcgccgccuucugcacugcugaguugaagaaggagucgcugaagaagucgagggagccgcugaagaugacgcgggcauuguuccuggccuggagcccagcaaugaggaggguguucuuccccaccgcauguggauacugggaacaaaacgaggcugugacccaagcaguuccaaguaagggaaaagcugccacgccucccgaacaagaggacagcaggccagaccaaaacgacccuggcccuaccugaagggggagccugagaccacaccgcuucugcccaugccccaccccaccaacuagucauuuccuucgccucagccaaaugugcuguucugcuucauuuuuauuucgaagccucaagguugugaagcccuuaccugggugauaggcuuguccgggaagaaggaguaagagguggaagagcccgucaggauguccagcaccaaaggguuaucaggaucggccaccauccugcagcaggacgagagcagcccagcacuggccccaggaacugagcccaaggacaugggauccccgagagccaguucuucccaggaaugaauccuuuuuucuuaauugccaaccacuuagcucuugucuugauauaacaauggagucugacuuguuuuuguuuuuguuuuucagacagaccucgcucugccaccugggcuggagugcaguggcacaaccuuggcucacugcaaccuccgccuccuggguucaagcaauucucuugcaucagccucccaaguagcugggacuacaggcacacaccaccauaccugucuaauuuuuguauuuuuagcagagacgggguuucaccauguuggccaggcuggucucaaacgccugaccucgggugaucugcccaccucagccucccaaagugcugggauuacaggugugagccacugcgcucggccaacuuuuuuuuguuuuuuuuuuuuuuuuuuuuuuuuaaagagaggaguucuguguugcccaggcugcucucaaacuccuggccucaagcgauccuccugccuaggccuucccaaagcgcugggauuacagguugagccacuauacucggccuugauauaacaaauuaaucccaucuacguacccuuaaagaauuacaauuuugccuugauuucccaaaaaaauuaagugaccccuucuucccccagguuucugcuguccucucccugcucacucacucacccaacaccucgaaagaggaugggauuuagagaugauuucccaacgaugguuggggccuucagcagguucucagugucagccacgaugagcguaugcugcaaagaguagauggaaagguggguggucaggaaaagguuccccaagccagggagaaccuccucacacccucuuggcuuuuggcuaagcagagcuuugccauaugccccugaaaccuggaaggugacaggccugauuaccuggccaaggucugagaugucauaguugugauggucaaugacagccguuuucuccucgucaaacucaaucccgcacucacugcccagcucucgaagagggucaccugcacagaccgaagagacaccuagcugagcccuuacaggggggccuugggccaaguguccuuggcuuccuugugacucccucucugucagccccagugcccugcagcuucauccagcugggcucagccccagauggaccccuggacagcagugugguauucugccuccaggagucagauucugaacugagaaaacgguucccucacugacuccccagcuaaggcccacccagugaaugcuaauuuggcagcuucuguuuguaaugcucuccaacucccuggagaaguggaaagcaccagaaccucccaggucggacucaccaaugucggagcuggcagcuaccagcacacugccuccgccgucaauaaaggcacugauggucuccacguugauguugccuccaaaaucugaaagcaggcaccagacacagugacccagaggucuccucucccugcuccucugacacuggcagggaggggacaugaagggcagagcagccacgaucacucacagagcagcacccucugggggccacaaugagggagaggcuucccacaccacaucccagaacgggcaaggccccauccucgcagcgugaagacucaaaauuauggcucagaauuagaaacuucuggagguuuggaggaaacagucaaacauccacuaauugcacuggucaaguaagcuguacacauuucaacucacauaggaaauaugcauuuggaaaugccguacugcccauauuucaucucaucaccugcaccuuucacgcuagugaugcugaucacuggagccaguuuccagagccugucaauuccacccugucuaaauggucugaggaagagcacuucugcaucuccagugaugccaucacuugacaauaguacucccuggucuggcauuaauccauuuuucccuauuaauccuacagauucuauccaugacauccacaacagagcuacccaguacacugcuuuuuaaaaagugaucaccaaaagggcucauuaauuuccaacaucuguaacugugagauccuauccuuuucuggucaauuaauuggaucaugugacuacugccauaagcaucuaaaacuagcacuggguggggcuauuugaggcuccagagucuccccaaaguguacucugauauucaaccuaagguaaugaagacagugcucaguaauccauuuauucauuaaaugaguaauucuugugagccgagaagaaaaacaaaguggacaaugugggaggggagcucuugugccaagguuguuuaaggaagaccugcaaguggcaucugaaaagauguaagcgugagccaggcagucuguggggucagaggauucccagcacagugaacaccaggugcaaaguccccgaggggggugggcacggucaccagcaaggggcccaguguggcuuagcuggagagaaaggagugagcagcaggagguaaggccgggugaagugagggcccaggcugcgcagggcucugcaccccacacgagggaccugccguggggagccgcuggacgauucugagcaggggccuggcaggaucucauuccuauuuuugaaggacgauccuggcagcgggguagagacuaggguacgagggugaaaguggccauggugauggguuagaaggccacugugaaaaucuaggcagugaagagugcugagccgaccuuggagcagcaacagagggaggcgcggcaggccuccacgccuucugauggcacagccgcagggccugcugaugcuucgacaggggcauuagaaaagcuccaaggagucuggcugagcaaccggaaggacggacaugccaauuucugagacuggacagagaaguguguccauuagacccucaguagcagguggaaaugacuuuguaaagaucugaauauaagagcccuguuuuuugagggguaaucuucagcagaaaacuaaaagcgccuuaccugacugacuuucaggcauacgcagaagcuccuauauucucuaccucugccucucaugcuacauucaaaaagccaucuaucuacucuccuuuggagaggccaggcagucuuggacauuccaaaagcagccuauuggcacagugcagugguuugcaaucuuggccgauuuugccccucagagcaaugucuggagacauuucuucgccgucacauaacagggaaguggccacuggcauuaaugggcagaggcccgggugcuguuaaacacccuacaguacacaggacagccucacuauaaaauuauccagucugaaacgucaagaaugcaccuguugagaaacucuuguaaagcugacagaacacgggcuuugaaaucgagaccaccuggaguuaaaacuaggcaaaucccuucacccuucugaacccacuuccccaucuauaacagggauccgguuuuucccggguauagaggaugugcugaaaauuucuucccuuguagacaugauugccagugaccugggagccuuccgaugccagagggcaaagaagccacuggggcacagacagggaagccaggccagcacucacucaccugagagggugacagugacaguagucaugggacgagggcagggcccugggagcagacaccaaaccccuaccccgaacccugcccugcagcuuccucccaaggaacgccugaggauuucccacagcagcaccuuccaaaguguggaacccacuccaccagaggcagaaaaggcagcaacgcgaaugcgggaaccgggcuuuaaauaaccuugaaucucagagacagaaaguuacucccuuuccuuauuuuucaagcuuucuccaucaaagagaaugucuuaguuugauacuaguuguuagagcuucuaaugcuugcuaaucuccuuuuucaagagggaaccucagguucaaagccuucggcaggcagcagcaucuggcuagaacuuacggguguuguuuuuauucuauuuauaguuaccuucuacguacaucaagugaugacacuggauuuccauuuucggugguaauucugggcucgcuauuguuucccuuuuaaaauguuguuuuaguuuuuuuucucuuuucuuuuuuuuuuuuuuuuugagacagggucuugcucugucgcuuaggcuggagugcaguuggcaugaucucagcucacugcagccuugaccaccgagggucagcaauccucccaccucagcuuccccaguagcugggacuacaggcaugcaccaccacgcccggcuaauuuuguucauuuuuuuguagagaugaggucucacuauguugcccaggcuagucucaaacuccuggacucaagcaauccuucugccucggccucccaaagugaugggauuacagggauaagcuaucauaccuagccuuuucuuuuuuuuuuuuuuaagcaggucaauuugaagaaaaauauuagguaguuauuagcacaggagauacguaacaugguaaaaaccaugaaggacgugugcaaaugacuaaaguuugggaaacacuguuuuacacucucugucguuucucccaccaacaguauccucucucagcccucucccgagcagucucauucacugcuuuuuuccuucugaccuauacaagcugacagugccuccgcuucaucuuacauccugacacaggguuugguaacucauuucaggucuuuauuuccucaaaaacagacugaaaaaacuccuccagggcagacucccuauccuuaagaucucacccaguccacuguaagguaccuauuucaaaguuucaaacacagcaaaaacuuggcaaacaccaguuacugcaccgaagcccagucaucagaagauuucaacuucuaccaauuuggggugacauccgccuaacuaaucuugccuccaaaaagccaauuccaaaagcacauguugcaagggaguugggagugacacaguaaguaacagaagccuagggaaaguacuugagggauucgguggaacugaaucucgcaugaacuacagagaauaaagaagccaugucccaguuauucaggaggcugaggagggaggaucacuugaaccugggaggucgaggcugcaguaagccaugauagcaccacugcacucagccugggggacaaagcaagacccugucucaaaaaaacaaacaaacaaaaaaggcaccaaugaagaacuuccuaagcuucauuaacugaagggaggaaggcaguccugucuuacccagacagggacaacuugagucuuuuaagaaaaagauaaacugaagcaaauaaagaagagaaugacuaacaugcucaccaaaaaaguauggcaaaagagaaauagcuaaggagcuggggauguucagucuggaggagaaacaaccgaauaagcugugauuaugugaaggcuaugccugcaaacaagauaagcauucuaucuauucucuaaggugcuggggagcauaagaacaaaauaaagcaggagacaauauuucuuaauauaagaacuucuuaacagaauuguucagugguggaguggauugccucguaaaacaagaauacucaaguaucaacuggauaaucuggccaagauauucauucuguuaaacgacuagcccacugcaaggcugcuggacauauuuauccagccucaaaugggaggagggguggggugguagauaauugcuaaggcucuuuuuucagcccgagacuaugaaucuaucugaauucuuaagaucaacugccacaaugcacaaugccucuuuauagcaauccauauuaauaacaggccauuuccucuuuccacccaggcaaacccaacccaggagcuuuccaucuuuuuaucaggcccuuuacagaguaaacucccuucucagcagagcagcagggcccuggguuccacggucugcagcaacacuugacuccacaauccuuagcuguuucuuuuagaaagauguacccuccuagggucaggucagaaaugagcauuuuccuuaucuccgugguagcaccauccaggacuggcaacccauccugugacccaggacaugcccaagaaccagaagaaagcaauccaucaagucccgggucucgaauuccagugcuaggggcgacgcggaacccuuaccuucuaccgaaggggagaaaaugaugagauugucauagaggaauuccccauacuuuaugagagacaggcuggggucaucagcggucuugaaugugagcucaaagccccggucuggacaagaaaaaacagguaguugaggaagacgggacgcgaagggaaaccccugcugcagacaucgcggacccgcacgccaagcggcaggccagacccgggcggccugcuccaggaaagggagagggaaggagaguggucaaugcccucgaugcuguaccaaccccaggcccccacacgcuacccccucggaccccgcucucacccuucaggcuccggaagaaaagcgaaugagucucccgcacguugagguuguccagcagcacuaaggugcgggguccgcuggcgcaaaccgcgccaagcaagggcagcagcaaccaaaagagggcccaagcccgggccgcggugcugggcuccaucuuccuccuccugccgaaggacccagcacgugcacaccggaaguaccccaucuacgguagcccaaucgcggcucgugcccguggagcacuacccggaagugaucgggauacgccgcggcugggcguccagagccgcagcuuuggcgauaaggcgcg

SEQ ID NO: 14188 - RNA, 5275 nt, Homo sapiens
cgucgcuccgcucgcagggaucucuccccgaggcccgcggguccccuccuccccgccuccucccgcccuccuccccgcgccucgccucggcgccgcggccggcauuucuccucgcagcucgcugccuccucuaucccugccucccucuccccccucuguuuuucucccuuccuucccucuccgacccucuuccucucccucccgauccuuucccuccuccucucaucuuuccccugucucuccguucuagcucgucccccaccccaccuuuucuucuuucuccuccucuccuuccucucccccucuccucugucuccuuccaccgucuccccugccucccugucuuucagucccuguuuuucagccccgucucccucucgguuucucucccccacccucccuccggguuuccuccccggugcccucccuccucucucccuccccucccccuccgccccucgcagccccgccgcucgcagcucccagucugccuccccgaaccggcgccgccgcccgcacucgccgcaggaccggcccgcccggcucccggggugcgcccuccucggucccgcgcccuccgggcucgcagggacgucuccucccucccggcucgcggccccgcccggcccggcccccgcccagagccccagcgcgccgaggaugugaguccugcucgccucuggcggagcagcagccacucgcgcgcggagccggagcgcagcgcagcgcagccgcgggcgcucuccgggccgcucgcgcgagugccgcgcucuugcccuagcggcgucccccggccucucgccggcgccaccgccgcagcagcccgcgggccguccccggccggccgcccccggccccagcgccgcugacccuguccgccgcgggcggggacgcgggcggaggaggcgccgcggcggagcccccggacgcgaccaugucggaggugcugcccuacggcgacgagaagcugagccccuacggcgacggcggcgacgugggccagaucuucuccugccgccugcaggacaccaacaacuucuucggcgccgggcagaacaagcggccgcccaagcugggccagaucggccggagcaagcggggugaguucgcggcccccuugucugacacccccuuuuucccgcgccgcggccugaacaaggguugcggaggucucccacccgcuggagcccguucagaccugacggaaucccuucuugcagaauugggggaucccgcacugcggguccggcugaagcgggucgcaggaacgcgucccccuaagccggauccccggcugggucacccugggggcguggcggcuucuagcagcagcugggggucuccacccgcgcggcaaaguuugcuuuuugauuugcgccccccacccccgccuuuugcgcaguguagucacagcugcacucgcuccauaacccuguggggagggggucccagggacccccaggggacggcguggggaccugcguggggaggaucccauuccugcggggaaggcuaggguguucgggucgcacgggcuuuucauuguuacuuggcuugggaggggguuugccaggccugggcgauccgcgcgagagcuggaaaagccccagagaggcggagacgcagagaggcuccgagaggagcuccagagacgcggggacaaugagggggaccgacggcugcagagagagacugagacgcagggauggaggggaggggguacgcgggagaccgaggguggcagagaccgagacaaagcucccgagaggggagcugaagcgggagagacagagccgaggacgcgcguuuggggaggacgcagaagccgccgaaacaauaagggcgaccgacaccuuagacagggagagacagagaccucgaucggcugccggccgucgcgccgagggacgauggagggacugagaaaggcgaggcuaagucgagacgguaagagaggccgagguuacggcaugugucccuggcaggcagcgaagggaggcucugaccucugcggcagcggggagcgcggggcggccgagucagucggccagcggcugggagagggcgcgcaggagggggcgcccgcccaggccaggcccuaacccccacccgcugcgcgucgugggaaccgguuuuggcguccccuccugguuccgcucaucuccgcaccuagccuugcccaccggagcugcgcucgggacuuaccuggggucccgagacccaaagacuuuggcucccucuccuaucccagcuccagacauuucugucuaaauuagugcgccuggugcggggaggacgcgggccagugcgcgcccuggcugcagcaggagcggcuggguuggcgcccucuguuuccuuuucucagaauggagcugggacgcaggcuggaggauagaggguggugggugguucagaggaaagcagggaagggaccccuggcagggacggaggauggagcuguuucaccgcgcagugagcccugcucccucgcccucuccucucccgaccucccacucugggcauaacgggaaaugucagagaccucuggcuaggccccagcgcgcucaccucucuuuuccccccuuuuuuugcaguuguuauugaagaugauaggauugaugacgugcugaaaaauaugaccgacaaggcaccuccuggugucuaacucccccaaagacaaugaguuaagggagagaauaagaacggcgguaacaguuauuggcaaaaagcaugaaaagagaaagcacuuugaaauuuauuacuagcuugcuacccacgaugaaaucaacaaccuguaucugguaucaggccgggagacagaugaggcgagaggaggaggaggaggaggagaaggcucugggcuccucugcaaaaauaaaaauaaaaaaauaaauaaaauuuuaaaaauaauaaaaauucacuauauacacauauaaagaaauaaaaagaagucucaguugcagcuauuugucaaaauuaauauccauuucuuuuuauauacggugaauauugcgcaauuauagaucuggauuuugaaccacuuaaugaagcggcaacaccagguguuuugagguguuggcauucuucgcugauuuggcuguucccaauguuuacauuauuuaaucuugcaaaaaugguucugugcacuuggaugugaaaugcuguccaguuuuauuuuuuuuauguuguuauccuuggauguacaaaaaauucagaaaaugaucucuguagauauucuguuuuauuuuggucaucuuuagaaguuaucaggaauguguuuaaaacaagaagagaacuuuucuaaggaaugauacauagaaaagauuuuauuuuaaaaugaguuguaaagcuuguguuucuuuguugcugcaagcuaucugcccaaguuaaugcaaauggacacauuuuuuaugucagaaaaacacacacacacacacacacacacacacacacacacgaaaaacaaagaaaaaaaugcuugagcuuuuucuaacuuccccuugcagucuguugugugagcagccuguuuauuucucuaauauuaugucaguuuauucucuuuaauggacuguaaaaaaauguaaucacaagagugccaaauaucuugaaaugccaaaaggcauuuuaguuucuuuucucugugcucugaguccacguacaggaaugcuuggagugucuuuucuguuauuuauagggauucucuuaaggcacaccagcugccuguuuugcaugguauuugcaaaaaugccucuugcgugaggaaaucuuuuaccauuuuuuguuugcaacuuuggaccucaagagguuucccuucccuuccccguucccucuuuucuuaauucaauauucuguauguugcaccuugaaccagcacacagggcuauuucuccaauguacaauaaaagaauuguuccugugucucacuccucucuuuucucugcuuuggcuggggggguggggugggggggacaugacuugcuguuugugggcuggcugcagacaggaaggagggaugguggcuuuggucugcgaggcaaaaaggcaauguugggguccccuaugggugggcucagaugagaggaaagauggacuggacuggcaaggccaucccccuaaggugaauuuauuccauuuuggauuugcagguugagcucucacugcaucccugagguuucugccaucucugguggggugaggggagaaagagggauacugugcagggaagcaggcagucuuguuaagagugacuuugcaggcuggcagaguuggaugcgagucccagcuacccgacuuccuaggucuuuagacuugagcaagugccucaauuuccuaaucuguaaagugaggauaacucagccccugccucauaggguuauuaggaggaugaacacagugccagcacaugggaacacucaguaucaggccacucuacgcaccuuucauacuucgccaggggcccccuguccucagaggcggggcugcagaugaguugcauucugucuucaucuucaccuuccggggcucacaggucaagggaugcgcugcuccugggggugcacggccugagaggucucaggcaccugcacuuaucagccuuucucuaaucaucaguuagaagggcuugauaggaagacaaaucuuagccccuuguuaggcuuggggcagucaaaggucguggagcaggccccugggggaggaggguuugggaggaggauuuuggcugaagaaagacugggagaguuuuuuuuuuucuccugggcuauuacacacccagaagugcugggagcuuuuaauguguuugugguaaagcugucagccaggcgucacaacacagcucacagugacaggagccuaagagugacucagacuucaggugagaggcuaggggaggggggcaggcaggaggaagaggggcuccagagggcccagagugggugaugucucaaccuccuucccaggcaguggaggcccaagggcucaggaggucccagcagagagcucuccaugcaagcaguuauuauugggaauggugagcaagcuggggcuggcggggccaacaggagugggaaugccagauugauuuucccaggcaccugacccuccuccagaaccugcucuccucccugcuuacccggggacucccagcaccugggagcugaugggcaccauggagcucagccauccccuggcauucccgcugauaggcugagggggacaaggcaucaaucugccgaggggcagaagccaugugaaaagauucuuucagaagacacga

SEQ ID NO: 14189 - RNA, 32508 nt, Homo sapiens
aaaugaagaaaagcaaaggcagguuaaugggguacagacugaacaguaguuggagaaggggaaggagaauggggaaaugacacgcugguacagcaggcagauuguucuguaggaauuuugaacucaacauucccuaauucugugaucuccuucaggcagaaaaugucauuugacuuguacagcaaccucuacacacacccacuugcccaaccacccuauccugacguaaggugugucaguuuaggcacaggcuaagcauuaaauaagggaagauguucuccaaaugccagagcuucuggagcucagcuaggcugucagccuccuuguucaccuggcgcccgguguaaaugcuucagaaacaguccccugcaggcuggcuacuggcugggucagagggcucgauagcaauuguugaaucucagaucugagcguuuugcagaaagaagccuguuugcacucacaacuuugcaguagcaccugcuuuuagcaaaaucuccaguuacaagccaugaagaccccaacccuagugggcuguggaguuauagaacugagaggguccugagaggucacccagccucugucuccagacagggaauguauaagccauccugggcccagggcuccauuccucuucuuggauagacccaaggacaagagcucauagucgucugggccugggcagcaugcacuucaccacccaucgugcuacaggaggagcucuuuuugccuuugcaacuuaaaugacuuucuguggcucagguuguccucugguaguugagguuaagucagcagcacuggcuuagagaagauacaucuaggaaucuggagauuccucuuccucuuagauaauguaccuuuagguugcauuccaagggccccgaaccaaugcacgaggggugugcucaaggcugggagcuccuggagggcagugggcaucucuuucuuuuuguauccccagugcuuggcacaaagcaagugcucagcaagugucuguggagcaaacaaagagagaaaugacaauagaagauggguaguugcuaaaauaaaaaugagcguuuguaccuauuuuuacaggugucaaagcguucuccaugcacauuauuucgaaauuuauucccaaaauaaauauuucccgaaauguauucacccaauguccucaggguuacagcucugccuuggaucuagacucggaacucaggccacgguguuuuccuucagaaguguggucccugaaagggacuccagcaggggccauuugaguauuugauugcuuaugcaacacugucucacuuguaggcugggcuuccguucuugugaaaaugugaacuauuuagaaaacaggaaccuaccugucuucauggucucuugcugcaaagaauauauuaucuggauuaagguaaugagaaaccugcucugaaauauguggaugaggaccaaagcagaugggcugaauuaaucuguguuugccagcucuacauagagcgcugcaaggaacuuuggaaaccaugccaggcucuuuggggauggcaucauugugagacccaucacugugaacuggcugaagggcuugggugacucagaugaccuaaguuaguuuugugccuaugaugcugaauugcuuuuuguuuuuuaaagcaggaucuuuaaguuucauuucugagagguugacaccuauuaaguacagugcccacugcuaggcaccaagaggcacaacgaugaauuagccacaagcugaucuugcagagccuuaaagccuuguggaagaggccagaugugcacugguucuuuccuacucagcccuucgacccucagcuccuauguuacuuuccagaggccucccccauccucagucugugauuccauaauacccuugaauugauucaucauuccacauucacugagcaacugcccugugccaggcacuguuuuaggcacugggggugcaucagugaagaaaauugacaauugugcuaaucucgugauagauacgauagcuuucuguguaccucucugccucccugcacugggcugggagcuccuggagggcagugcgcacaucuuucuuuuuguauccccagugcuuugcauaaagcaggugcucagcaagugucuguggagcaaauaaagagagaaaugaccacaauagaagauggguaguugcuaaaauaaaaaugagcauuuguaccuauuuuuacaggugucaaagcauucuccaugcacguuauuucauccgacucuucacaacaaccccucacggagcacuuguuuccauuugugggugggaagauggaggcuuggagaaacaaugaccuacccagacgaagagcaugggacacucgauuccaaacccucugcucuuucuacgccacaucggaguguuuuauaaaaugauuugagggagauaaugagcuggagaaacucaagagagggagaggucucuucuggccaaggcuucagggaaaucagggcugaagcugacacggaaagguggccuccugagaaguggugcuggggucggggaagaggaagccugagcaaagauaugagaacaggacagcccuggagagucacagaccauagguguuggaagggaccuugaaaugaccucauccagcccagaaguucuuagcccagcugagccuuagcauucccuggggaguuucuaaaagaguaguucccagaauccagcuccagagacauuaauucaguugaucuggggcagaacuuuuuuaaaaguuccagagucuuuuggauguggagucccccuuuuaaaaauccauuauucuauuuuugcccauuggacagucuuagaauucaaaagccauuugggaggcguuucuggcuacacugaguggggguuacccaucccaaucuguagaaagcguacugucugggauuugcuggugacuuucugcauuuccccuaaugcuugcagccuggccuuugucugccagccacacccccguuuacacacuggucuugcagcuccuuugccugaaugugaagggacagccucuuggguggacugugaauguacaugucaauuucucucuugagcaggugccugugacucacaccuuggacuucuuggaggaugggacugaggacucuagacagguugaugccagaugccuuggcuggcaggccugguggggaaugauaugagcaggguaguguagccugaacaggcaagaccaagugcaagagcauuuucaguaagacccacgaaugucuccucaauggcaguggggacaaacgcucucugcagagugaacugauuuccugugcucccaggcuggccuuugccucaaccugccucucacaccuccuccacacucuuuuuuuuuuuuuaaaguccaaauuaaaaggcauuagaaaacaauggcuugguagcccugguccucagacugaaugcuaacggcucugaccaggcugcugcgaagucaagcaaucagacauccuuccagagacuguuuauuguagauaaaaaggacuaucuccugccacuguugugcuagucaauaucucacuugacuauggacaagugagauaaaaggcuaguauuguucuuaccauauaugcccguuugaaauucacauggcucuucccacuagauuggaaguuccucgagagcagagaccagucugguucacggucauggucaugucccaugucuguugcauguacauauucuguuuguuggcucaacgaaaagauacguauuuaaauaagauuugauucauuaaaaucuugcaugcguuuucaagaccauguucaagaccauacauauuuugagagguguaaugcuucauguaaauaugaauaguaagaacaaagacauuucucucucagcccccagcaguccuacuuuccuuggcuuuaauuggaauagagugucuggauuaugacaacaauguaacugugccuucauguuuucauuuuaguauuaaaaguguguugggaggcaugggaaauguuaauacuuaacaguaaucagcagcauggaaaguuuuugaaguuuaguuuccauuuucaaucaacaaaauuagggaaaauuuuaaaaagcaguaaccacaaaacugaagaugcuacaaugaaguuguuacgugcuuugcuauauaaugcauugaaaaguaaaagcaaaauccauaaaaauuuucauguaauuugaccuaccaauccuauuccuggacauuuguccuaaagaaguaauucaaaagaugcaaaagcuaccuaaaugaagauuucagcauagacuucuauagcaaaaaaaaaaaagaaaaauuggaaacacauagauuuuccuuccauaaagggaaaguaguuuaauaaauuaugguacaucaacauguugaaguauuacucagucuuaaaauaauuaugaaggcuguagauauuuggagaaagaauauuuaacuguguuugcuaagauuacaaauguuaaaaauaugcaugugugccuacuggcaagaaaguaaugugcaacauaaauuuagucauuaagaaugaaaaaaaauauaugcaaaauauuaacaacaguuaucucugaccaaaaggauuauggaugauuuuuauuuuccucuuuaaucuucucuauauuucccaaguuuuccauuuuucaaaaaaagcaugugcuuuuguuuuuggggaagaauauaaugacuucuauaagaaugagccuuuugugccuggaaaaauaauguauaaugaugauguacauuauggguuagcauuuacuucaaugcuacuuuuacaauaaaauuaucacuuuuuaaaaaaauaaauagguucuauacccagaagcuguccacuucucaugacaccuguggggaccacucuggucaucaucugucacuuagauuaugcuaauagcuucuacuuggucuucugucuucugccuuugccuaaucucaacucggcagccaagagcggauuugaagacauccaucgggcaccacuccucugcucagcugccugcaguggcucugcaucugacccagagugacacugugugucuccugcccccaucucugacugccccacccaccuggcuccagccacacccauugcugguccuuccccuaacaggcuggaagugcucucuucugaggaccuuugcacccccucuuccaggagcccucuucccccaccuaucuacagacugacaaccuuguuugcuucugauucuucacuuggguguuccuugaccauccgugucagaccucauccucugccaauucccugccccgcccaugcucuccagauccccacaggcugcucuucuuucuuucuuucuuuccuuucuuuccuuccuuccuucccguuuuuuuuuuuuuuuuuuuuuuuuuuuuuuuugagacggagucucggucuguugcccaggcuggagugcaguggcgcgaucucggcucaaugcaaccuccaccucccagguucaagcgauucuccugccucagccuccugaguagcugagauuacaggcacaugccaccacgcccggcuaauuuuuguauuuuuaguugagaugggguuucaccauguuggucgggcuggucucguguaccucccuccuuggacucccaaagugcugggauuacaggccugagccaccgcgcccggccucuacuuucucuuuuccauggcauguauccucuucuaccauucuacauuaauuauguauauucacuuucugucuccucccguuaguaugugggaggagggaguuuuggccuguucacugaugagccugauaugugccugccaucuaggugcuuaauauauauuuguuggauaaauuuguuacagaugauuugaaucaggugacagccugcugggaacuccauuaagaagaaaaagagcacugggcgcaauggcucgagccuguaauccuagcacuuugggaggcugaggugggcugacugccugagcucaggaguuugagaccacccugaacaacauggugagaccccaucucuacuaaaauacaaaaaauuaacugugcaugguggugcgcagcuguagucccagcuacucgggaggcugagaugggagaaucacuugcacccgggaugcugagguugcagugagccgagauugcgccacugcacuccagccugggugacagagugagacuccaucuaaaaaaaaaaaaaagaagaagaagaaggaaaagaacgagcugaggcccaggccucagcuggggaaauccucuacagaguggccaagaguccagauccagagucuucaggaccugguaugcuuaugucuggucugggcugaugcaggaucagccaggguuguaugcaggugguggggugggggcagcaaguuuccagagaauaugucccagcuggcagggugggcacccccgccauucucccaggguuugugugcagguggcuggccauucuuguuaacaguggcuagagcuagagcagacccaggcugucugcuggaggugcucaccagccagaguggacccaugacaucuacaucuccuaucaaagagaacaaaugucagagagacgcagcucuuagccagucacaaaagggaccaaggccccacugcacagauccccucauauaaacacgaggugagcaugaaaacuaugaaacuaggagcuuuauuaauuaagccccagaaugauggcuuuguuugccuucccaagaagaaaugcauccccagucagcugcuggacuggaauaaauggagggaaggguggcaagaaagggagggaugaaggacaggagauagagauaaacaguguauuuaacuagaacaaggauuucuuauuaaguaaccuuggucagcagucauaucauaccccuagagguagaugauacuuuuaacuuauaucucaacauuaagugaaacagugaccuuaguuuuaucucuuaauuaaaacaaugaauagcuuugauuuucucuguacacuuuguccaaaaacacucgugcauuuccuugaugggaauguuccugcuggucagugucuuuccccugccugccaugugcuuugcugccguggugguuguuugcuuguuuguuuuugcagaaacaauccacguuggcgauauuggucaagcuaaguccaccugggugaaucccaacuugucaaacuauccuuuuuuuucuccuuaagaaaauggauuauauguccagaaucuggccaccucucaugacaucucuggcuaccacccuggcccgaaccaccaucaccucucucuggucaccuucauaccuccagcacucaagucuuccaucuuccaccccagccccucaacacggcagccagagggcgccucugagcaggacagucugaaugaggcuugcucaguuuuacccgugggcauuugucaccacagucguucagucucuugggauaggauuuaaguguguccaaaaauaccuccagagauuugugcuuccgcgucgacuguuaggagggcugcugcuuccuaaacuguuugaacauaaaggcacacagaugaacgucagaaagggcugggagaagcuucccuaaucaggaaaggaaaguggcacgccacccguguagacaaaaaauaaaacaccuaauuuuaguuuuaugaguguuguguguugguaacugagucaccaaaagucuguucuccuuugauugcuaacuccuccgaagcgaccucaggccuucccuguuauauggugggguuugguugguucugguuucuggaugagagucaauaggcucgugaacuuuuaacuuuacugugggguguugccuuaauggacugagaaaacagauguuccugcuuaauucuuggaaugacuucuaaacuaaugcuaaagcaaaauaauauagcugucuucuuuauuccguuuaaaagguagaaaaguagauccucuuaccauguaaaagucucuuuuauccgaacuuauuaugaggauuuuauuuuuaaaacuaaguaaagagaaacaucuuugucccaagaggcaggguggcuuuauuugacauuagaaacccauuuaaaacggcagguaagagcaugaacaaaagcaaaguuuaguuccucgaaugccugcuuuuguaaugcagguggaucuggcucuagucuuuaagguuauuaauuggaaugaaugccccaaggcugcucuuaguuucucugugaagcauuuuauaugggagcucuggggugacucuggguccacagucauguucacaagccaucucuuccgcaggagugcccugccuugaaggcuguuggcuggguccccagauauucucagggcaagaucuguuguguuauaaccaccugccaucuguuggugcaaauuuucuggauucuagaugaugaaucacuuacuucuccugcuguuccuucugcugccaagacuaauuuaccuauuggacuuuaugagggaauauacuagaguaaccuaucaugaagguuuguccuaugcaaaguuccuacuccaucacuagaaaaggugggcaagagcuuccuuagcaucuccagagggugggaugaagagccagcaguaacaaugugggauccucacuuugggguccuuugcagauaaagcuauagccacugacuucaguaagguuugaguugagaguccaaugguggguucauguuuucuugccaacacuuucuuuucaggacacccaugcuugucucaaaguguggcacuggguaagcccucaauggccaucgguuaaaugaauaacugaggucuaugaccccaaacugggcaaggcugacccacccaaagccaccaagaggagugugcuaggccgguugagcccauuuaggacagggggccucagcugcaaugcaacauguggagccaucaggaacucugaauucugauuuaguuuguucuugccaauccccaaaaucagaguacuuggaaugauguuuaggaaaaauucaggugacucuuauccagacaagcuaagugcugugacagaagcugagagcaggagccccgucgcuucugcagugggcaucagaaguguccggggaggaggacuugguucuaacaguggaacaagugcuuucccaaugagaaaacugaagaucaggcuaacacaccccucuguccagucgugugugggagcugaagccuuagguuaaaauacgagaugcacuucuccacugacucaguuucacacaaguugguuuuuaucguaucaucuuuuguccaaaaaaaaaauguuuauuaugaugguuugagucuagcuuuauucacauauccuaaaauauccuaaaauauuucuaugcuuaugccuuccacuuuuucccaaccccaaaauucuaagcucaccagcagcagcaaacccuaagcacagaagauucuaacuccuucaagcuugcuccauuucacucaaguuuucuaaagcuuuccugucuggagaaauuaccaagucccaggugggugggauuuuauucuuaccacagaguaggugugauuuuaugggaggcucuucccccagccuccuagaucagacauagaguuaugugcucaaguccuggugggaagugaaauuccuguacuuuuaggugcugggcucaaauucugucugcuguggucauuaacgggaagagguggccaguugugugggccugccugaggcaccacuggccccagcugaccuuuccaaucaaaggaauggcugaccaaaccaggaugguauuaagaaauucuauaaaacauucagaaauaaccuauucuagaaugaucugggcagugugggaugcaguuaggaccagaccagccuucuucugagcaaauggcaguggugcccaucuccacuaagccucaacgugcgagaaaaaacacucccaaccaugcagcuuaucugagcacaggaugcgcuuguugcugggguagccacauguauaugcuucuggaacuccugauuccugccuucucucuguauacccaggaggcgggagcacacaccagaacucaggacuuugugaugaccaugcuuugggggaacaacaugcacagaaugucugaguguucccuacucugaaggaugauuuggccauaaaagggaucagaugagucauggagucuggcugaacuugcaauagaagagaacauuggcaaacuguccacaucagcacuucgaaguuggaaacacaagaccccauggucuucaaagcagcucaggcuaagacaggcugauguacuucaugccggucaaccagaugcucgggcacauggucucucagcacaggcacagcaaaguaacacgagaccaaggcaccccccuccuccuccagagguucuaagucagaacaggcaccucugucacagcuccaaaggacacaccauguuugaagugggcaacgcacugaaacuggggaauaaaacaauugcuccacccccaaauaagccaaggagguugucaguacaaaccuguuuaaacuuauagguuuguacauuuuaaaaacaaaagauuccauuacugacaaaagcaaaagaaaucagacugcacuggcuuuucucgguuuuggaagaauucagcccacagaguagcucccagaaguuguaaaccuagucagucucuauuaaaaaguagcuacuggguaauccaugcucauggaagcaacuuacuuucaagcuuuaggacuauuuuagaaaugcugauguuuuggggaagaaaacccauucuucccuuagaugccaccucacacaaauaguaaaucccuaagaaacugaccaugcaugguaaagggcuacuuccaaagauggggucaacggccuguuucuucaaaauacucgcaagaaacacaaaugccaguuagauaguuccuacacugugguuauuuaccagacuagaauccucucugggaaguguuuaauccugcaucaaauacagacaggaaagcauuggcuucgagagaaucacaguucacuguaaaggcaagccgguguucgaaaaggaccauuaauucagaaggacccaaaacucuggaaaggagaagucaugaucacugcuguuucaggaacaaccuugguaacuugccaguuacgcuggugguggagagaauggaacagcuggaagggagacuucuuagcgcgcucggcauaggcacagacuucacugcuucagaggacacgcagugcagacgagagucccaagcuucccagcugcaccagguccacauggcacuugaaacaggcugccuaagaggccacaacgcccaagcaugcuccuuugcucagagacccaggaccucagcuggguggcuguggacucagggccacccuuccccaucuuccagugagaugcccagcacagacuugugggggauucugcacucuugcagagauuuggugaggucagaaaaucgccuccugggcaccuccauuguuucaaugcugcagugucgguaggagguuuuguuuuucuguucggccacagcaacaaugguuugcaaaucaucuguuggccggaaauggcguacaaaccuuuggccuguuggugaucuaacagcaagcagcaaccuugguucuugguccgaugguuccuccagauuuccagcccuggaagagcccuguuucuugguucggacgaugaauuuccucuccacggcacaagcucgagcucuggaaucuucuucacuugucuucauggugcccgucucgucuugguaaagagcccggauacugcucaguugcagugagcuggccuuuuuggcaacgguuuccacagccuccuccuccagguucuuucuguugauggaaggaaggacuggauacuuauugagagaagaggaagccccaguggguacuugcugcugcagcucagggaucucaucagaagcucccugguuuggagauuugggugcacaggcuccugguuuuuggcugcuuggcaacucauagggaauggcuggaggcggagaugguauaugaugagcgcacaccuccacgcccugggauuucugcagacucggucuuguccgucccuuggcggacuugggccuuaucaugugcauauuuagugaguuuggcugccaaaugaggcugucaacugcugugcugacaacagugcuacacucagguggugcuauauucacaggggcuucuguggccauugcuucucaagaccccuaaggaagcaggaaaaaaacaggaguccguggguuaaacuuccugggacuccuagauccaagccauucccucccugagugcccagaauaagcacaaauuucuggcaucuaguaaggggcaccagcugcaauuuauucauucaggcaugcauucauuuauuuuaggcacuugcgagagaucagcaaaccgaaguccuugcaauguaaauuauuauagugaggaaagacagggguuaaaacccacaaguaaauagauauuuucaaagaguaacaaccgcuaugaagaaaauaaaaauuauugcaccagagcgugauuaaggugggggacuaauucuuauucuuuuaggaggggggaaguuucugguaaaaaccagaaaaccugcuguguuucaguaaaacuucauuuuuggacucugaaauuugaauuucagauaauuuucaugugucacaaaauacucucuuuugauucuuuuucaaugauuuaaaaaugugaaagcuauucuuaguucaugagccacacaaaauaggugacgggccggauuugggcugugggccaucauuuguuggucccuguccuacagcaacucugggcgcaugcuaauucuacagauguaugagccagaaagguagagugauuucccaauggucacacagccagcugguggcagagcuggagauaggacccaggucuugugacacccgauccuguguccucuguacccauacaagcugcuuccugagcccagcacaucacauucuguaugucugcuagcugcucacauuucuuuuuuucuuuuucuuuuuuucuuuuucuuuuuugagacagagucucacuccaucacucaggcugcaaugcaguggcaccaucucagcucauugcaaucuccgccucccagguucaagcaauucuugugccucagccucccgagcuguucagacuucugucuucccagcuacccgauaggcacccuggggccucuguauuuggaucucccaccaaaagucugugugagugcugguuaaauccaccaggagcaaugaacugaagcauggugggaggcgugaacauuucucugugcagacccggaauugcuaaaccaugacaccuccucuuucauugccaucuugguggccacuucacuaacacuacuaccagcaccuccuccucccaaucuccaguuccaucuuucccuaaacauugcagacaucuuauugggcucccugccucccucugaauccugaccaccacugugacuccugccuucucugcuugaaagcugaccuggccucuccuagccuucuaaagaccuucuggugacuuuccagugauucaugguccccaagaaacagcauauuugggagcaaaggacagaggaccaggugucacaaaguguggguucaauuucagcuucucugccacuggcuagcuaccugaucaaggggcaaucacucuaccuuucuggcacaaaacuuuccucaucuaucaaauuagcuaaaugaucuuagagguauuacuuaaguaccucagaacaucagucuuuuugucuguaacaugaggauaauaacaugaaauaauguagguaaggugggaagcaccaggcuuagugcaugguagaaacuuaauuaaauguuaagcguuuuuuguugucgucguuguuugcuucggguugucuguuuagugcuuccuaugugcuaaguucaaaagccuuccuuguuuugcucuagaacuuuuccccguguguccucggugauucuacuccugguuaaccagcugggugaguccugaaacucaugccugcccuguccacugcacagaaaugcagggagguggacugcaaugagcuaccaccuacgcaguugccucaaaacaugugaaaauaaaaucccgaguugaucacuucucuucuaauuccacauuuuacuuaccucagauucacuuccugcagaaugauuugcacuuccugcaaauucacuccuuucaucacaaaaucuugaacaauguaaucugagccucucaggguuuguauucuaaccucaccauucugcacauguaaccacugcugccuaauuuuaaggaguaucugcuuccucuccacucagaccaggaccaaacgcaacacauuaucccuauaucuuccugauguccugcucaauucaaaaucuuggacaaagcuacccucuuuuaaaggccucuaugucugcugcauuccacucacagccugagucucucuccacucccauuuuccacuucucccucgucuuucacacccagucuggcugcuaguagcucaggagccuucuccuuagcaaacuuuuggcaucaaaaaagacugcccaucuccuuguuaauuucaucuauuuucugaucaacugugaagaauguguuuuucccccuuuagucuccuucucaagucuuucucuggcaauuagcagcucugcacuuucacucaggauggcaggagaaggucauaacuguccaacuguucugccaaagauaagcuccacaggcaaacccacgccccucucggcccacccuccccacuuguggaauggcuauuaauuugccacagcuucuacagaauuaucacaggcuuggcuuccaacacccacacaugccucaggaagguuuaacugucagugaguuugguaacuuagaaaccucuuccuuaacaacuuugaugaggagagucauguguucucacaggcucucugugggauuauuuuuaacaguaaaacuugaguaugugcaugcacuuucuauaccuuuugguuccauauaauuauccauguucagggggugucauauucaagacacccuggucauaagauaacaugacugugagcuaucucagagaaaaaccucaauuaugacuaauuccuaggagcccacucaugguuauuuagagacuaacaccuccuucagguaaaaccauuauauccaaccugcuuucauaacccacugccuccucccgagcacagggaccaucuguuacacggagggaacaccagcucuccccagcacccaucacacagggaugggcggugggggaaacagguguuuggggaucugggccaacugugccuuuauauucacaccucagguccugaacucugcccaccacccucaguccaggauugaggcagcagccaugauucucccugcucaguucacuucaccaccucuaggccuggcagccacucaaccacaaaccgauuugacaagaucuaggcguaggcaucuaucaagcugccaagcugaauaggcgaguggccuguuuacuuaaacacaauagcugcaccccagcggccugcuaggagucaggaagcaaacacugccaacuguuuccaagaaguugccagaagggcaggugcccauuccuuaagauucaccaccaaaucaacuggaaagaaggaaauguggauaggagaagcuaaagcagggcuccugcuuucuaagggugcccaccacccaccacagggucagaccacccuauuucacucacaacccaaaucuaagccuacaguauaugcaguaaaauauaaccaccuacauaccaucugcugguauauaccaagauacauacauuugaauuggucuuuuaaaacuguaucaguuaauccuauccguugccaucccgccccccccaacccacacccccaccaggcuuucaggauaaaaaugcucugaagaaccaacaggagauggugguuggccugagaaugaaaaaacucugguaccauucccaguucuaccccaaacuagggauuagaauacacuguccuaugcagagugccacacugaaccacaagccaccaagugaucaaauguuuggauagagaacuggggaugauuccagcgucagaagggcagggaggugguggggauaacucaauuaaguccaaguuccagcgcccuagaaggcaacaggcuuaagaggcagaggagggaucugggggaggggcgagaaagagcguuuagaaagcgagaauugacuucagagaaagagcacaggacugggggaggggcccucugguucucgucucugcccugccggagacugggacauccuuuucucucccugggucuguguccccgucgcuacaucccagccuggagggcauggcccagcgguugcauaggucccucgguuucugcagagcccgggagucacccuauuuugguaaaggugagcucuggccaggcuugcuuugccucgggagcagacuuuucuccaggcuccucgccugucucccgggguuugcgucccccgggcugggucuggggaggcccucccgggugaugugcuggggucucggggacuggccucccccggccccuuccaggccuggcggaggccaagggcaggccgcgggaucgggcagccgcucucaccuagccguuccgcuccauccgccgccugcgcccgggcucuguccugcugguaaacaacccuggucucccgggcaacgccgcaggguggggggccacgugcuuccggcgugaccggaaccggccugggucggguggggucggguggggucgggugggggccgcugggccaggagggcggaggccgugaacuccaggucgguggauugcgagccuggaguggauugccuggccuggaggcgacagggacccgcggccuccuucucuccuccucuuccuagcgucaccgccucuguuucucucugggggagagugucugggagagggagagcccuggccggggcauggaggagcggggagcagcaccacuagucucaaaauccguuucucaccuugggucaggcccugacccucucagugucccugguuuuaaaaugaggcugugggacugauggauucucggaacccuaaacucugaguggaugcuucuaggguaucugaguugcggggagcagggcccccauccucaguacagcccuuucagcgccaguucccugaccucuuuucacaucagccucccacuccggggccacacugggaaccuuaucaacagcaucugcaccuccuuugauguccccagccacaaucucuuccacuuccagccacuugagucacuuccgcuguaucuguuuuucaccaucuuuggguuuccuguccauugcugucuccgcuuucccccucgauaucaaucugcuucuucccuauccuggcccauuaccucggcauucucaaaaggauccucccugcccgaguccuacucuccuuccaucugaugaaaccugaagccaaaccaguccaccuacacacggguauugaagaagucuuggccagccacacaccuugguguaacagaaacacgaggucucuaaccucaguuagacucucagcccugcacuuccauccccaaccgaccacuggguucucucucccuccuuucuucuuuuucuuccuuuuuuaaggggagacagggucucgccccuucacccaggcuggagugcaguggugcaaucacagcucacugcagccuggaccuccccagcucagccucccuuguagcugggacuacaggcgugcaccaccaugcuuggcuaauuuuuauuauuuuuuguagaaugggguucugccauguugcugaggguggucuugaagucuugggcucaagugauccucccgccucagccucccaaagugcugagauuacagacaugagccaccucgcccagccucuccuuucuucucaauggcuauuucaaaacguuguuuugcuugcgaaaccucccaccucucccucucccaccucccucccuccucccucuuagaagauaccuuuacugcccucuucagagagaaaauagaagccaucauauggaaacuuccucagccuucugccaucagaccugcaaacuugccugccuacacuuccuugcuuuccucccucccuccaguucuaaugucuucugauucucuccaaggugaauugcuccuccaugggucgugaaagaagaucaugucaguggugguguuucugcucgucucagaagggaagucugugacccgugggaguugcuggggagggccuggucugggccaggccucuucuuuggguugcccccucacacacucuggucauccaggaagccucuguggcccucggaauguguaaaagauggugguuuuaggagcugcugguuuugcaacugagugcugacggcuuauuucuuguuaaugauucugucaaaagugucuuagcgaugcucuucagcccuucaucacccacccaaaaaagauuaaaguggauucuucaucagcuauuuuaaaaucaccuaagaauuauacaauccuuuggagaaucaaauuggcuucucaccgugugugugugugugugugugugugugugugcgugugcgcacgcacgcgcgccuuugccagugcacagugaaauggcggucuguuuaaugucagcaguacaugcaguuaacgucagcaguaccugccuuuugcucuccaguguuguguaaugcccagccccagggggaggcaggagaggaggaaaggaaggcgccaguccauugcugugccucugcugccuuugugcccgaccuucuauaaagaggaugucuucaaaggacagaccugauaaugccuggugucuggcacauacccagaguggaucucaguaaacaugggcagaggucauugcccugccagcugaaauguggacucaccuuccuuucuagccaugucccaaucuacucuccagcucucucccugggcugcagccagcuugcuccccagaugggccccagcuuuuucaucuccagugucuuugcccaugccugccccacccugcucucuuccuugaaguuaagccaaaaugacugauccuucaaggcccaucuuaaaagccaccucuuccgugaagcccuuuccugaccacagccuccccacaaaagcucaugugcucucucuggucgccuuugguccaguggaacaugcccaagauggugcugugcacccucccuaggucggcucccuucaucuucacaacgcuccuuaauggaggcaucauagcccuccuuugcuuuagaaaacaguggagccucaggguucccccuggugaaggagcagcagagcaauuuuacaaccugcauccagcaguuuccaaagcccacccuggaccccagagucccacccccaagcuccucaccugcguguucccccauggcccuuaucugugcuguccguugcacuggucguggggacugcaggcauggccucugacgucaaagcuugaguaucaauccuggcuccaccacuugccagcugaagacguuagguaaaugauuuaccuucgcuggaugucaguuuccgcaucucuagaauggugaugauaagcacaggauuguugugcggcugaaaugagguaacacacgugccaagugcuuagugagggcuacuaacucuuguugcaucaucuucacuuacaguguacaucuccuucaguagguuaugagcuccuugaaggcaggaacuugccugucucggaauccccugccuuguccacacaaugcuuacuuugugauacgugcucggcaaugaugaugguggugcugauuccaaggcuagcguuuccacugagcgauccagcaagcugcuaacugguauccuccccaaccauauuuggcuugggguccaaaugaccuccccaggggcuugcugaaggcgggggccccgguuucuuagcggcuuguccccacagaguguuuggccccauuuugaauuagugauuucuagauuucagagucuauagccaguguccugcucugccuguccuuggucucauuagacauguggauugagaucauggauaaccuuuaagcagaaggugaaccagguggauauucuaguagcaaggccaagaggcuggcaguuagucauggcuccugugaucagcuuccuaaggggaucugcaagagggaaguuucuggaugaugaaacuuaacccuugaaguacagacaugggucacuuaaccauggggauacaugcugacaacuucauugcuaggugauuuuuucauugugcaaacauuguggagugugcuuacccaaaccuagauggucuagccugcuacacaccuagguuauaugguauagccuguugcuccuaggccacaaaccuguacagcauguugccguucuaaauacuguaacacaauggcaauuguaacacaauaguaaguauuuguguauccaaacagaucuaaacauagaaaagguacaauuuaaaauaugguauaaaagauaaaaaaaaugguaugccuauauagcgcagcuaccuuauaaucuuaugggaccaccaucguauguguggucugucauuggaccaaaaugucauuauauggugcaugacuguaccacagcuuuuuauuauuuuccccguauuguuggaaaauauccaaaaauguauagccugcuuuccagucuuguuaagcagaacacaucaaacacuguaacucaccuuggcuacuguugaccaaguauuuucaccuucaggagcuuguggaaucuugcuggcauucuguggggggccagaaucauugucuccaccucucuaguggaggaaggugaggcucagauuguuuaaaucugucaggaaguggcagaacaacuccagcccucuucuuugacauaggccccugaguuaguugcucuccacccuugcagucucuugcacaaugcuaccuuuccuuggcaacucgcagucaauaauugugcuccaggugcacuaguuugauguggauggagucagcugccccagcacacagugacccaggcuucuaggcuucguugauuaucgcuuuaaucaccccuugcuuaccuuccuauuaagagaagcugcucugacuccauuccuguccggcugcugggccugagaaaugaagcugagcagcuuguuagaacugcaucuaaaacaagagucuaagaguguugugauaccugcuucgcugcuugggcuguuuuggguuuugccuucucggugguguuuuggauaggcacggaagcaggagagcuuucaaggauuaggauugccagcuauggagucagacgcaccugggguuaagucugggaccucucaguuugcagggcaaaugaccugaccugugccagcuucaauuacccuuacugguaaacuggaaugaaucguauaugccucaucgggaggauucgggaggauucaaggagaauccuaauucacauccugugcuuagccuccuguugguacucaagggguugcaguuauuguuuuuauuucugcaacuugaaguaugauaagacucuuaacacucauucacucauucauucaugccucaaauauuuauuuacugcccaucucuccaugccuaguuuccuuaucugcaaaaugaggguaauaauggcacuuaucuagcuaggggaugugaagauuuagugaguaaauauauguaaagugcucagaaccccugcaaggcauaagugugauauauacguuagccaucaucguggguaguauuaguuugugccaggcacugauaagaaggcacuagggauaaagaggugaacaaaacagaccugaccucuguccuuaaugagcuugcaggcuccauccaucuuauuuucucuauggggaggaaagccaaccaguguuucauuacuguugauaaaagcugaauugauggguccaggaaaggacccagaugguggcgucuagggacccugcaacuuacuggcugcugcccuaggggcuggcgugggaggccaugccaugcuuucuacauucuugccccucaucaagccucgggcccucggguccugugcucuugcuuuagcuucagcacaaucguaggcagccccaaaugacuugucaaauggagagaaccaugccugagucauagcugugaaggucagugcaugaaaaugcccucaaaccuucaaaaugccacacgaacaagaggucuaggcagggagacuggcaaggagaaagagcacuggacuuggagaaagggaccagaguuuaaguccuggcccacuucauagcuguguggauuuuuucagguuacuuccgcucucugagacuuggucuccuccucugucaaaugugaaugugauagaaccugccugguaggguuguagugaggaguaaacaggagcagagcauaaacuuaaggggaauuuaaggccuucucaaauaccaccucuccugggaagauuucugugaccuucccaagagaguucacugcuccuuccucugagcucagaggcauuuauacagucacuggagcagugcuuaucauuccacauggaugcaggcugagcucccuagaaacagacucugaugcaaaaaaaguauguugcugggaggcuccaggagauacagcuguagggaagugagcaagggaagaauggggagagggagaagcugacaugcaagggagaagcugacauagaaagagaagcuaacacacaagggagaagcuggaacagagggagaagcugacacauaauggagaagcuggcacagagggagaagcauacacacaagggagaagcugacauagagggagaagcuaacacacacacagagagaaacugacacacgagggagaagcugacacagagggagaaggugacauacaaggaagggagaagcugacacagagggagaagcugacacacagaagcugacauagcagaagcugacacacaagggagaaguugacacagaaggagaagcuaacacacacacagagaagccaacauagagggagaaagugacacagagggacaagcucacacacacacacacacacacacacacacacacugacauagagggagaagcugacacacaagggagaagcugacacacacagagagaaacugacauagagggagaagcugacacagagggacaagcuaacacacacacacacacagaaacugacacagagggagaagcugacacacacagagaagccagcauagagggagaagcugacacagagggacaagcuaacacacacacacacacacacacagaaacugacauagagggagaagcugacacaaaagggagaagcugacaugcaagggagaagcugacacggagaagcugacacacacacagagaagcugaccuagagagagaagcugacacacaagggagaaguugacacagagguagaagcugacacacacacgcacagagcccaacauaaagggagaagcugauacagaggaacaagcuagcacgcacgugcgcgcgcacacacacacacagaaacugacauagagggagaagcugacacagaagaacaagcuaacacacacacacacacacacacacagagaaacugacauagaggggaaguugacacacagaggcaguugcugaggccacagggagcucuggggcugggaccgccuuucagagcuauccugaaaaaggcaagggauggcccuuuaaacuaucaccccagccagggauuggcuagagacuccuucuccugucuucccugggaggggccauaaccuugggccacgcgguaccugcagcagagagugguucucagugagggacagcgucagcagcagcugguaccccagcccugaagagggggccugccaggacugugugaagcauucgagaacuaauggagaaccaaacagaauugcagcccacauggggcuuuggggcuauauuuggucucuguuuaccuauuuggucucucuagccagcuuggcagcuuccuugggucagaauguucucauuagaagagcucauaguuggugcuuaauaagagucuaucggauuucaugaccaguaaugcacccaggucccuuucuuuguuucucuaaaguguaucaccugcucauucaaaagaacugagccccuuuuucgugggcuaaacuugcacaugauuuuuuuuagacucaaaagagaaaaaggaagcaagccuguagagacagaaccuaauuaaaaaacaucccgcacagcaauugaagugaagguuggcugggaccaggccuggucagggcccgaccucgcagcauccaccagaauguugccaaagggggaagauagcaaagacacccugauuaacucucccagggaucugcagcaggauggucauuuugaaguuuuccuuggaagcuuugccaccagguguaaaucuagcccaagcucugcaccugccaacuucucuaggcucaaccgagcuauuguuucacacuccaaguccugacguuaccagauuuagccugauuuaugaugggggcuauaaagaccacuuguauguaaagaaagccauuggcugaucccuggcagcuccauggcagggcugcaacccacauucuucucuacuguucuaauauggguaucauuacccauacuaaucggaauaugaauucugugucuaccuaugacugcauuugauaguacaaaacaguuuuacuuucauuauuccagcaggucccacaaugggccugugaaguagacagcuaugugaucaugaggaauuuguucacccucucugggucucgguuuacccaacuucaaaaugauaauagaaccucagaaggaguuguaagggucaaaccauguaauaccugugaagcccuuaaaauaaaggcuugaaauuauugacaggaauuucuagucucacucugcaagagaagaaaccaaggugcagagagguaaaguugaugaauaugaugccuggguaucaaggaaggaaggcacugugggacuagaugcaaaccaagcuaggaauuccugugugggauuucuauuaugaacaacauaggugccuuuccaacucgggaacagaggaaauauggacuccucaaaagaaaaaaagaagagaugaagggaugauguugccaaagaaagaaauuuggaaaaaaaaaaaccaaaccaacauuugcacuuucaaaaccauggaacccuucuuauuuuuauauguucagaucuaaaugccagaaagguuaccacauucaaagggaaugagauuugaaaaugauuucuuugaguccucugcugaggucuuuccaaggcacuacaauuagggcuuugcacccaaauacccuugccucauuuuggucauuuuguccuggaacagagguucagcugggagaccccucacacacaggugaaggcguggcuguagaaccucagacccccuggucuccucaggaaugaaggucauugccauccucacccuccuccucuucugcuguaaguagagagcuuggugggucagcaccaagcuucugucuuccuguuuaugucagugggaggggggacucuccagguggcaccaggugagggaagucacaagucccgcagaaaagaaucaggaaaggaacgggcucccaccaacguccucuugcuucuguuucugcuauaaaaugggcugaucccaguguugggaucuuauaaagugucuaggaaaucagagguugccaaccauuugcuagaaagggaguuugacuacuauuuuaccccccucacccucaagagucuuuuuuccuuuggaugcuaguagccuuuauuuaaggccauuuggauucagaacaaaaaugcagacauauauccagcuaauuuaagaaugauuaaugcuuaucagaaagacauuuuuauggugacuuaugggauaauugguaguuauaagucauugcugccgggagauccgauugcuuaccucugcaaagugaagaaagaccuacugggaaacaguuuggggucuacuggagacugauagacucuuuugcuggauucguugaguggagguuuguccagauccauuuuccugucucuuucaauugagucacaauaacuuuugagucccuaagucaaagaugucaaaaacagacuuccuuuccccacagugagugguggaauuuacacuuugcaaggugauagugcaggaggauaccuguacgcagggaugaccgccucugcagccccucagugcggcuccagggacugcuugggcagcagugaccgcccauggguuucuuccgccacacccccguuuagacugaacacgauagugagaucgaaggcaccugagaaaacucccccaaacucuauuucuguuucucuucuucaaguucaugucuuuguuguauuuuuauugcaaauuuacuacaugcuuauaguuaaaaaguaaaauaaaugaguauauagcaacaagguaaagcuccuccucauccuccccagaccccaguuuuuucccuacauccagaugugaccacucuuaagaguuugauauacauccucuauacagcguuuacccacacacauucaaaacaccauaauaggaagggaacacaugcugggccgggcgcgguuguucaugacuauaaucccagcacuuugggaggccgaggcgggcggaucaccugaggucaggaguucgagaccagccuggccagcuggccaagauggugaaaccccgucucuauuaaaaauacaaaaaauuagucaagcauggcagugggcaccuguaaucccagcuacucaggaggcugaggcaggagaauugccugaacccgggaggcggagguugcagugagccgagaucacaccauugcacuccagccuggguaacaacagcgaaacuccgucucaaaaaaaaaaaaaaaagaaggaaagggaacacacgcuuauuaugaaaagacaugagacagcggagacguguauaaaaugaauguugccuguuucuuucucucucuucaaucccaauugccuagagauagugcuaucaaauguaguuuauuuuugagacacauaauuuuguuauuaucccccugucgguggacaugugggugguuuccaauuuuuugauaucacagauaaugcuucaggaaaccauuuuguguaugcauuugugcccacucucauaagcaucuuguagaagcaaaaacagcugaguucauguguacuugucauuuaaaaaaauaauaauugaggauaccuuuccugccucuuaaguauuuuguuucuccugugagauaguaaaggccugaugacaucuggagggacuggcguuucuggcuuugaacuuuugccauucauguugcaucagacccgaggguguucugccuagaacugugguuucuugcuuugagggggaagacuaugguugaugggaaagccuuguucugaaccucauggaaacuggguauucaucuggguuagcaaaaaacuagcuguguuacaggggcaaaucugaaccuauuuuauuccccaggaaagaggcuggugauuccagccaugccccuugcacuucgcuuuggggaucuggugauauuucgaaugcucagcacucuaguaaggggaggggacaucaaggcagcaucaugcucauugcaacuuccuucuuccuuuuuuucucaucggugguggcagcccccacccacagcaguuucuggcaguuucagaggagggucaaacacaucacggggcgaagugccuucuucucauauuacggauauggcugcuacugugggcuuggggauaaagggauccccguggaugacacugacaggugggugcagaggcucuaaggccacuuaucauuuguuuugcauuaaaguucaugcucaaagccagagagaggguguuaggauucuugccuggcaaauaacagaaaacaacucaggcuaauggaaggaagaacugaacgggauuuggaggaugggucuugagaaacccagggucggggccagcuucuugagugugugaccugugaaguuucacagggcccaacacucauaagggucagggccagcuucuugagcgugugaucuguaaaguuucacagggccuggcacucauaagggccuaaacaugguuuacugcucugcugccaccaucuugaaauucuuaauaaagggccucauguuuucauuuugcuuuagucucugcaauuaugccguugguccugcccagagcucuagaagcuguuucauccucauaguaaaagugcugugcuuucagcucuccagcuuuuaggacuauaggcacagcacaacugacucacuaguccuaauuccauauucuaggagagggaauccaaguggcccaguuuggagaaguuguccaucugggugagguugcauggcacaaaccuggcuucaggccuacuccaaaggaugggggugggggagugugaguuccuagaaaaaguagaggugggugucaucuggugaauguacguguggggagguaagaaacgggacaguuugcgugucaauucauuugaagacauaagaaagcaaaauguuccuugccacauuuaaccuaguauggagaaacauguccccacaguggggccuuaaauaucacuccuggagcucgagucuuguggguggggcucauggaaccaugggaggaccucagagccuuggaagggcaacugacgcuuaugaaaugcccuuaugugccaagcacugggacuggcgauuggcauacaaaccuaauuuaauucucgcagggaaugcacgagacagugauaccagcccauuugacaggugaggacagugaguugcuaaaccaccuccuaaaggcaaugcagcuucuaaguggcagaguuaggauugaacgagaauuugccuauuucaaaguuuguccccucuccuugauggucugugccuccccugucaaaguccaaaggcugauuagaaauugaacaucauuagccaaagcugaucaacagcagagcccccacuugcagaugggaauggugagagagggagacugaaacauuuuucuuggccuuucaggccuuagaauccaagcuuaaguuucugccuuccugucccuuguguagugguugaggacauggacugagcccaugcuccagaugguauuucuccuccagugcucucccauccagcccccagccaacucugggugccaugaaugggacuacgucggcuuuuacagacaguugucuccucagagaccguuacagugccugacucacaguaggugcucaguaaaaaguguuaaaugaaugaaugggccuagguuuguguccugggucuaucauucuccagcugccuaaguuugggaaauuggccucuuggaaucucagucccuccccuacaaaagggcagcaaugauuguacuuuauagguuucuaugaguagcuaaugagauagcaacagauacuagagagggcucaggaaaugcuacugguuauuauuauuauuuuuuauuuuauuuauuuuuugggagacggggucuugcucuauuauccaggcugggguggagaggcucaaucagagcucacugcagccuccgucaccugagcucaagcaauccacccacuucagccuccugaguagcugggaccacaggcuggugccaccaugccuggcuuuuuuuuuuuuuuuaaacuuaaaaaacauaggcggucucccuauguugcccaggcuggucucaaacuccuggacugaagcgauccuccugccuuauccucacaaagugcugggauugcaggcaugagccaccacaccuggccuauguuuaauauuauugauaauucaccuccucaccuucaaugccuucuugccuagaggaggaggcaggugagcccuuucuaguccccagauaagguccuccagcagauuccugagggacccacuuccaggcacagccccucaucucccucucccuacgagaagcugaaggaguucagcugccagccuguguugaacagcuaccaguuccacaucgucaauggcgcagugguuugugaguagccuuuucuguauggaaaugucuuuuaaccugggccuuuccuuaacguucaccuccucuuugacccagagaucuuuuagaaaaugaaaugcuuccaagugcuuggaaggagauauuccugagcuuucuccugaugcuccagagcuucucagaguguccgugcucauccugcccuggucucucccacccaugaguguaccuccugaacucucugggggcccagagccuggcagauaguacaugcucaguaaauacuuguucacuugagcuaaucuugaagcuucccuugacaacugcugcuguugagaacauguuuccuuguuucugugauuuuguuaacaaaacggcucagcugucuuccaguuggacaaauauuuauuaagggcgacugcaugccaagcacuaagauaggugcugccagggccacaaaagcaaauaggugggaagggaagggggacucacauguuacugagaccauucaaggagccaugugggcaaguggaucaagugcccuucacauggggcguggcccuggcauccggagcguguucugcggcugguaggguauggguaugugcagggcaauccuggccuagacagcaggcacauuuggaggcacgggacaguagucuuucgugagcaccauccuuuccagcauagccaggguggauccugggguccugggcugggagggugaagagcaacaaauaaagaaguggcuucuuggccgggcgcgguggcucacgcuuguaaucccagcacuuugggaggccgaggcgggcggaucacgaggucaggagaucgagaccauccuggcuaacacggugaaaccccgucucuacuaaaaauacaaaaaaaauuagccgggcgugauggugggcgccuguagucccagcuacucgggaggcugaggcaggagaauggcgugaacccgggaggcggagcuugcagugagccgagauugcgccacugcacucccgccugggccacagagcgagacuccgucucaaaaaaaaaaaaaaaaaaaaagaagaaguggcuucuuauaguguguggcucacuuccugccuggccucgugggguugcaugaaucacuuuccuucccagguguauuuauucagagcugugagugcaccuuggaguuccucuguuuccuccugaggucagggaacuaccaccucucugccacucauccccuauggcgggagauacauccuccaucccguaguggguuccagggcucagaacccuggucuccugagcucccccaacccaccacuucagcucagcacacaccaauacccagaguuaggacugugaggucucccuggcaccagcuguguggguugggggcucggaccccugcaccgggaggaccugccucagcucuuggccugcccugcccacugccaccagcacgugguugacagggaaagaacccccuuuuguuccccacgugagcucaaggagacuuccugaguuggagcucucuggugugguccuucucaggccuaaagcaaagugucuuuucugugacaccuccaaggccauguucaggagaggggaagggaucagggccuggugggagggauggggagaggggacuggagaagguggccuccagggaucgaguuucccauggccucuucccaccugucuuugccacagggguggggacaccuggcuggcccagcccaagccuccacccugggcuccugugggcuggcugcacucgccagggcuggccuaggcucucugcacccagggaagcuucucuauucaaugcucuucacccucccagcccaggaccccaggagaugagggagaguggagcaaagguugaggagcagaggcuggagccccaggcaguggcacugcugggcaguggugggaggugccagccagggcugggaguuggacccgaaaguacguggccugggcuguacuuucuucccacguugccccuucagagcagaagcagccaguugcuccugaagccuugaccagggcuccugaguccagagccuugcucagggcacuagcgugggaggaggcuuccgcaucaguaccagggcaucagcacccgccuccucagcugacccagcccgugaggaccaggccagccccugucauccccacccccaccuugccaagccccugcccccaggagcagggcugagagcgaggugaucuggguucuaauccagagucugcugcugacaugugcugagccccaggcccauugguuuacuugccccaguauugagcgagcauccacuggguacccgcccagugccggugcugugccaggggccaggggcacagaauaaagcagacccagucccugcucuucuggcauucacagucuuguggaaacuccagagcuaaagugcccuuagagauuauccagaucagccccuccuuguagcaaugaagagacugagacccacagaggggaugaguuugauccaagaaacagacaagauuaagaugcaugugucuugaaccuuuucagugcucuggaacauaccgucuggccggaguugucugggcuuugguuuucccauccaugaaauggguacaauaacaacagcuauaguguaugagccucugugauagaugcuguacgcacagcaccuga

SEQ ID NO: 14190 - RNA, 22086 nt, Homo sapiens
guggggucgggugggggccgcugggccaggagggcggaggccgugaacuccaggucgguggauugcgagccuggaguggauugccuggccuggaggcgacagggacccgcggccuccuucucuccuccucuuccuagcgucaccgccucuguuucucucugggggagagugucugggagagggagagcccuggccggggcauggaggagcggggagcagcaccacuagucucaaaauccguuucucaccuugggucaggcccugacccucucagugucccugguuuuaaaaugaggcugugggacugauggauucucggaacccuaaacucugaguggaugcuucuaggguaucugaguugcggggagcagggcccccauccucaguacagcccuuucagcgccaguucccugaccucuuuucacaucagccucccacuccggggccacacugggaaccuuaucaacagcaucugcaccuccuuugauguccccagccacaaucucuuccacuuccagccacuugagucacuuccgcuguaucuguuuuucaccaucuuuggguuuccuguccauugcugucuccgcuuucccccucgauaucaaucugcuucuucccuauccuggcccauuaccucggcauucucaaaaggauccucccugcccgaguccuacucuccuuccaucugaugaaaccugaagccaaaccaguccaccuacacacggguauugaagaagucuuggccagccacacaccuugguguaacagaaacacgaggucucuaaccucaguuagacucucagcccugcacuuccauccccaaccgaccacuggguucucucucccuccuuucuucuuuuucuuccuuuuuuaaggggagacagggucucgccccuucacccaggcuggagugcaguggugcaaucacagcucacugcagccuggaccuccccagcucagccucccuuguagcugggacuacaggcgugcaccaccaugcuuggcuaauuuuuauuauuuuuuguagaaugggguucugccauguugcugaggguggucuugaagucuugggcucaagugauccucccgccucagccucccaaagugcugagauuacagacaugagccaccucgcccagccucuccuuucuucucaauggcuauuucaaaacguuguuuugcuugcgaaaccucccaccucucccucucccaccucccucccuccucccucuuagaagauaccuuuacugcccucuucagagagaaaauagaagccaucauauggaaacuuccucagccuucugccaucagaccugcaaacuugccugccuacacuuccuugcuuuccucccucccuccaguucuaaugucuucugauucucuccaaggugaauugcuccuccaugggucgugaaagaagaucaugucaguggugguguuucugcucgucucagaagggaagucugugacccgugggaguugcuggggagggccuggucugggccaggccucuucuuuggguugcccccucacacacucuggucauccaggaagccucuguggcccucggaauguguaaaagauggugguuuuaggagcugcugguuuugcaacugagugcugacggcuuauuucuuguuaaugauucugucaaaagugucuuagcgaugcucuucagcccuucaucacccacccaaaaaagauuaaaguggauucuucaucagcuauuuuaaaaucaccuaagaauuauacaauccuuuggagaaucaaauuggcuucucaccgugugugugugugugugugugugugugugugcgugugcgcacgcacgcgcgccuuugccagugcacagugaaauggcggucuguuuaaugucagcaguacaugcaguuaacgucagcaguaccugccuuuugcucuccaguguuguguaaugcccagccccagggggaggcaggagaggaggaaaggaaggcgccaguccauugcugugccucugcugccuuugugcccgaccuucuauaaagaggaugucuucaaaggacagaccugauaaugccuggugucuggcacauacccagaguggaucucaguaaacaugggcagaggucauugcccugccagcugaaauguggacucaccuuccuuucuagccaugucccaaucuacucuccagcucucucccugggcugcagccagcuugcuccccagaugggccccagcuuuuucaucuccagugucuuugcccaugccugccccacccugcucucuuccuugaaguuaagccaaaaugacugauccuucaaggcccaucuuaaaagccaccucuuccgugaagcccuuuccugaccacagccuccccacaaaagcucaugugcucucucuggucgccuuugguccaguggaacaugcccaagauggugcugugcacccucccuaggucggcucccuucaucuucacaacgcuccuuaauggaggcaucauagcccuccuuugcuuuagaaaacaguggagccucaggguucccccuggugaaggagcagcagagcaauuuuacaaccugcauccagcaguuuccaaagcccacccuggaccccagagucccacccccaagcuccucaccugcguguucccccauggcccuuaucugugcuguccguugcacuggucguggggacugcaggcauggccucugacgucaaagcuugaguaucaauccuggcuccaccacuugccagcugaagacguuagguaaaugauuuaccuucgcuggaugucaguuuccgcaucucuagaauggugaugauaagcacaggauuguugugcggcugaaaugagguaacacacgugccaagugcuuagugagggcuacuaacucuuguugcaucaucuucacuuacaguguacaucuccuucaguagguuaugagcuccuugaaggcaggaacuugccugucucggaauccccugccuuguccacacaaugcuuacuuugugauacgugcucggcaaugaugaugguggugcugauuccaaggcuagcguuuccacugagcgauccagcaagcugcuaacugguauccuccccaaccauauuuggcuugggguccaaaugaccuccccaggggcuugcugaaggcgggggccccgguuucuuagcggcuuguccccacagaguguuuggccccauuuugaauuagugauuucuagauuucagagucuauagccaguguccugcucugccuguccuuggucucauuagacauguggauugagaucauggauaaccuuuaagcagaaggugaaccagguggauauucuaguagcaaggccaagaggcuggcaguuagucauggcuccugugaucagcuuccuaaggggaucugcaagagggaaguuucuggaugaugaaacuuaacccuugaaguacagacaugggucacuuaaccauggggauacaugcugacaacuucauugcuaggugauuuuuucauugugcaaacauuguggagugugcuuacccaaaccuagauggucuagccugcuacacaccuagguuauaugguauagccuguugcuccuaggccacaaaccuguacagcauguugccguucuaaauacuguaacacaauggcaauuguaacacaauaguaaguauuuguguauccaaacagaucuaaacauagaaaagguacaauuuaaaauaugguauaaaagauaaaaaaaaugguaugccuauauagcgcagcuaccuuauaaucuuaugggaccaccaucguauguguggucugucauuggaccaaaaugucauuauauggugcaugacuguaccacagcuuuuuauuauuuuccccguauuguuggaaaauauccaaaaauguauagccugcuuuccagucuuguuaagcagaacacaucaaacacuguaacucaccuuggcuacuguugaccaaguauuuucaccuucaggagcuuguggaaucuugcuggcauucuguggggggccagaaucauugucuccaccucucuaguggaggaaggugaggcucagauuguuuaaaucugucaggaaguggcagaacaacuccagcccucuucuuugacauaggccccugaguuaguugcucuccacccuugcagucucuugcacaaugcuaccuuuccuuggcaacucgcagucaauaauugugcuccaggugcacuaguuugauguggauggagucagcugccccagcacacagugacccaggcuucuaggcuucguugauuaucgcuuuaaucaccccuugcuuaccuuccuauuaagagaagcugcucugacuccauuccuguccggcugcugggccugagaaaugaagcugagcagcuuguuagaacugcaucuaaaacaagagucuaagaguguugugauaccugcuucgcugcuugggcuguuuuggguuuugccuucucggugguguuuuggauaggcacggaagcaggagagcuuucaaggauuaggauugccagcuauggagucagacgcaccugggguuaagucugggaccucucaguuugcagggcaaaugaccugaccugugccagcuucaauuacccuuacugguaaacuggaaugaaucguauaugccucaucgggaggauucgggaggauucaaggagaauccuaauucacauccugugcuuagccuccuguugguacucaagggguugcaguuauuguuuuuauuucugcaacuugaaguaugauaagacucuuaacacucauucacucauucauucaugccucaaauauuuauuuacugcccaucucuccaugccuaguuuccuuaucugcaaaaugaggguaauaauggcacuuaucuagcuaggggaugugaagauuuagugaguaaauauauguaaagugcucagaaccccugcaaggcauaagugugauauauacguuagccaucaucguggguaguauuaguuugugccaggcacugauaagaaggcacuagggauaaagaggugaacaaaacagaccugaccucuguccuuaaugagcuugcaggcuccauccaucuuauuuucucuauggggaggaaagccaaccaguguuucauuacuguugauaaaagcugaauugauggguccaggaaaggacccagaugguggcgucuagggacccugcaacuuacuggcugcugcccuaggggcuggcgugggaggccaugccaugcuuucuacauucuugccccucaucaagccucgggcccucggguccugugcucuugcuuuagcuucagcacaaucguaggcagccccaaaugacuugucaaauggagagaaccaugccugagucauagcugugaaggucagugcaugaaaaugcccucaaaccuucaaaaugccacacgaacaagaggucuaggcagggagacuggcaaggagaaagagcacuggacuuggagaaagggaccagaguuuaaguccuggcccacuucauagcuguguggauuuuuucagguuacuuccgcucucugagacuuggucuccuccucugucaaaugugaaugugauagaaccugccugguaggguuguagugaggaguaaacaggagcagagcauaaacuuaaggggaauuuaaggccuucucaaauaccaccucuccugggaagauuucugugaccuucccaagagaguucacugcuccuuccucugagcucagaggcauuuauacagucacuggagcagugcuuaucauuccacauggaugcaggcugagcucccuagaaacagacucugaugcaaaaaaaguauguugcugggaggcuccaggagauacagcuguagggaagugagcaagggaagaauggggagagggagaagcugacaugcaagggagaagcugacauagaaagagaagcuaacacacaagggagaagcuggaacagagggagaagcugacacauaauggagaagcuggcacagagggagaagcauacacacaagggagaagcugacauagagggagaagcuaacacacacacagagagaaacugacacacgagggagaagcugacacagagggagaaggugacauacaaggaagggagaagcugacacagagggagaagcugacacacagaagcugacauagcagaagcugacacacaagggagaaguugacacagaaggagaagcuaacacacacacagagaagccaacauagagggagaaagugacacagagggacaagcucacacacacacacacacacacacacacacacacugacauagagggagaagcugacacacaagggagaagcugacacacacagagagaaacugacauagagggagaagcugacacagagggacaagcuaacacacacacacacacagaaacugacacagagggagaagcugacacacacagagaagccagcauagagggagaagcugacacagagggacaagcuaacacacacacacacacacacacagaaacugacauagagggagaagcugacacaaaagggagaagcugacaugcaagggagaagcugacacggagaagcugacacacacacagagaagcugaccuagagagagaagcugacacacaagggagaaguugacacagagguagaagcugacacacacacgcacagagcccaacauaaagggagaagcugauacagaggaacaagcuagcacgcacgugcgcgcgcacacacacacacagaaacugacauagagggagaagcugacacagaagaacaagcuaacacacacacacacacacacacacagagaaacugacauagaggggaaguugacacacagaggcaguugcugaggccacagggagcucuggggcugggaccgccuuucagagcuauccugaaaaaggcaagggauggcccuuuaaacuaucaccccagccagggauuggcuagagacuccuucuccugucuucccugggaggggccauaaccuugggccacgcgguaccugcagcagagagugguucucagugagggacagcgucagcagcagcugguaccccagcccugaagagggggccugccaggacugugugaagcauucgagaacuaauggagaaccaaacagaauugcagcccacauggggcuuuggggcuauauuuggucucuguuuaccuauuuggucucucuagccagcuuggcagcuuccuugggucagaauguucucauuagaagagcucauaguuggugcuuaauaagagucuaucggauuucaugaccaguaaugcacccaggucccuuucuuuguuucucuaaaguguaucaccugcucauucaaaagaacugagccccuuuuucgugggcuaaacuugcacaugauuuuuuuuagacucaaaagagaaaaaggaagcaagccuguagagacagaaccuaauuaaaaaacaucccgcacagcaauugaagugaagguuggcugggaccaggccuggucagggcccgaccucgcagcauccaccagaauguugccaaagggggaagauagcaaagacacccugauuaacucucccagggaucugcagcaggauggucauuuugaaguuuuccuuggaagcuuugccaccagguguaaaucuagcccaagcucugcaccugccaacuucucuaggcucaaccgagcuauuguuucacacuccaaguccugacguuaccagauuuagccugauuuaugaugggggcuauaaagaccacuuguauguaaagaaagccauuggcugaucccuggcagcuccauggcagggcugcaacccacauucuucucuacuguucuaauauggguaucauuacccauacuaaucggaauaugaauucugugucuaccuaugacugcauuugauaguacaaaacaguuuuacuuucauuauuccagcaggucccacaaugggccugugaaguagacagcuaugugaucaugaggaauuuguucacccucucugggucucgguuuacccaacuucaaaaugauaauagaaccucagaaggaguuguaagggucaaaccauguaauaccugugaagcccuuaaaauaaaggcuugaaauuauugacaggaauuucuagucucacucugcaagagaagaaaccaaggugcagagagguaaaguugaugaauaugaugccuggguaucaaggaaggaaggcacugugggacuagaugcaaaccaagcuaggaauuccugugugggauuucuauuaugaacaacauaggugccuuuccaacucgggaacagaggaaauauggacuccucaaaagaaaaaaagaagagaugaagggaugauguugccaaagaaagaaauuuggaaaaaaaaaaaccaaaccaacauuugcacuuucaaaaccauggaacccuucuuauuuuuauauguucagaucuaaaugccagaaagguuaccacauucaaagggaaugagauuugaaaaugauuucuuugaguccucugcugaggucuuuccaaggcacuacaauuagggcuuugcacccaaauacccuugccucauuuuggucauuuuguccuggaacagagguucagcugggagaccccucacacacaggugaaggcguggcuguagaaccucagacccccuggucuccucaggaaugaaggucauugccauccucacccuccuccucuucugcuguaaguagagagcuuggugggucagcaccaagcuucugucuuccuguuuaugucagugggaggggggacucuccagguggcaccaggugagggaagucacaagucccgcagaaaagaaucaggaaaggaacgggcucccaccaacguccucuugcuucuguuucugcuauaaaaugggcugaucccaguguugggaucuuauaaagugucuaggaaaucagagguugccaaccauuugcuagaaagggaguuugacuacuauuuuaccccccucacccucaagagucuuuuuuccuuuggaugcuaguagccuuuauuuaaggccauuuggauucagaacaaaaaugcagacauauauccagcuaauuuaagaaugauuaaugcuuaucagaaagacauuuuuauggugacuuaugggauaauugguaguuauaagucauugcugccgggagauccgauugcuuaccucugcaaagugaagaaagaccuacugggaaacaguuuggggucuacuggagacugauagacucuuuugcuggauucguugaguggagguuuguccagauccauuuuccugucucuuucaauugagucacaauaacuuuugagucccuaagucaaagaugucaaaaacagacuuccuuuccccacagugagugguggaauuuacacuuugcaaggugauagugcaggaggauaccuguacgcagggaugaccgccucugcagccccucagugcggcuccagggacugcuugggcagcagugaccgcccauggguuucuuccgccacacccccguuuagacugaacacgauagugagaucgaaggcaccugagaaaacucccccaaacucuauuucuguuucucuucuucaaguucaugucuuuguuguauuuuuauugcaaauuuacuacaugcuuauaguuaaaaaguaaaauaaaugaguauauagcaacaagguaaagcuccuccucauccuccccagaccccaguuuuuucccuacauccagaugugaccacucuuaagaguuugauauacauccucuauacagcguuuacccacacacauucaaaacaccauaauaggaagggaacacaugcugggccgggcgcgguuguucaugacuauaaucccagcacuuugggaggccgaggcgggcggaucaccugaggucaggaguucgagaccagccuggccagcuggccaagauggugaaaccccgucucuauuaaaaauacaaaaaauuagucaagcauggcagugggcaccuguaaucccagcuacucaggaggcugaggcaggagaauugccugaacccgggaggcggagguugcagugagccgagaucacaccauugcacuccagccuggguaacaacagcgaaacuccgucucaaaaaaaaaaaaaaaagaaggaaagggaacacacgcuuauuaugaaaagacaugagacagcggagacguguauaaaaugaauguugccuguuucuuucucucucuucaaucccaauugccuagagauagugcuaucaaauguaguuuauuuuugagacacauaauuuuguuauuaucccccugucgguggacaugugggugguuuccaauuuuuugauaucacagauaaugcuucaggaaaccauuuuguguaugcauuugugcccacucucauaagcaucuuguagaagcaaaaacagcugaguucauguguacuugucauuuaaaaaaauaauaauugaggauaccuuuccugccucuuaaguauuuuguuucuccugugagauaguaaaggccugaugacaucuggagggacuggcguuucuggcuuugaacuuuugccauucauguugcaucagacccgaggguguucugccuagaacugugguuucuugcuuugagggggaagacuaugguugaugggaaagccuuguucugaaccucauggaaacuggguauucaucuggguuagcaaaaaacuagcuguguuacaggggcaaaucugaaccuauuuuauuccccaggaaagaggcuggugauuccagccaugccccuugcacuucgcuuuggggaucuggugauauuucgaaugcucagcacucuaguaaggggaggggacaucaaggcagcaucaugcucauugcaacuuccuucuuccuuuuuuucucaucggugguggcagcccccacccacagcaguuucuggcaguuucagaggagggucaaacacaucacggggcgaagugccuucuucucauauuacggauauggcugcuacugugggcuuggggauaaagggauccccguggaugacacugacaggugggugcagaggcucuaaggccacuuaucauuuguuuugcauuaaaguucaugcucaaagccagagagaggguguuaggauucuugccuggcaaauaacagaaaacaacucaggcuaauggaaggaagaacugaacgggauuuggaggaugggucuugagaaacccagggucggggccagcuucuugagugugugaccugugaaguuucacagggcccaacacucauaagggucagggccagcuucuugagcgugugaucuguaaaguuucacagggccuggcacucauaagggccuaaacaugguuuacugcucugcugccaccaucuugaaauucuuaauaaagggccucauguuuucauuuugcuuuagucucugcaauuaugccguugguccugcccagagcucuagaagcuguuucauccucauaguaaaagugcugugcuuucagcucuccagcuuuuaggacuauaggcacagcacaacugacucacuaguccuaauuccauauucuaggagagggaauccaaguggcccaguuuggagaaguuguccaucugggugagguugcauggcacaaaccuggcuucaggccuacuccaaaggaugggggugggggagugugaguuccuagaaaaaguagaggugggugucaucuggugaauguacguguggggagguaagaaacgggacaguuugcgugucaauucauuugaagacauaagaaagcaaaauguuccuugccacauuuaaccuaguauggagaaacauguccccacaguggggccuuaaauaucacuccuggagcucgagucuuguggguggggcucauggaaccaugggaggaccucagagccuuggaagggcaacugacgcuuaugaaaugcccuuaugugccaagcacugggacuggcgauuggcauacaaaccuaauuuaauucucgcagggaaugcacgagacagugauaccagcccauuugacaggugaggacagugaguugcuaaaccaccuccuaaaggcaaugcagcuucuaaguggcagaguuaggauugaacgagaauuugccuauuucaaaguuuguccccucuccuugauggucugugccuccccugucaaaguccaaaggcugauuagaaauugaacaucauuagccaaagcugaucaacagcagagcccccacuugcagaugggaauggugagagagggagacugaaacauuuuucuuggccuuucaggccuuagaauccaagcuuaaguuucugccuuccugucccuuguguagugguugaggacauggacugagcccaugcuccagaugguauuucuccuccagugcucucccauccagcccccagccaacucugggugccaugaaugggacuacgucggcuuuuacagacaguugucuccucagagaccguuacagugccugacucacaguaggugcucaguaaaaaguguuaaaugaaugaaugggccuagguuuguguccugggucuaucauucuccagcugccuaaguuugggaaauuggccucuuggaaucucagucccuccccuacaaaagggcagcaaugauuguacuuuauagguuucuaugaguagcuaaugagauagcaacagauacuagagagggcucaggaaaugcuacugguuauuauuauuauuuuuuauuuuauuuauuuuuugggagacggggucuugcucuauuauccaggcugggguggagaggcucaaucagagcucacugcagccuccgucaccugagcucaagcaauccacccacuucagccuccugaguagcugggaccacaggcuggugccaccaugccuggcuuuuuuuuuuuuuuuaaacuuaaaaaacauaggcggucucccuauguugcccaggcuggucucaaacuccuggacugaagcgauccuccugccuuauccucacaaagugcugggauugcaggcaugagccaccacaccuggccuauguuuaauauuauugauaauucaccuccucaccuucaaugccuucuugccuagaggaggaggcaggugagcccuuucuaguccccagauaagguccuccagcagauuccugagggacccacuuccaggcacagccccucaucucccucucccuacgagaagcugaaggaguucagcugccagccuguguugaacagcuaccaguuccacaucgucaauggcgcagugguuugugaguagccuuuucuguauggaaaugucuuuuaaccugggccuuuccuuaacguucaccuccucuuugacccagagaucuuuuagaaaaugaaaugcuuccaagugcuuggaaggagauauuccugagcuuucuccugaugcuccagagcuucucagaguguccgugcucauccugcccuggucucucccacccaugaguguaccuccugaacucucugggggcccagagccuggcagauaguacaugcucaguaaauacuuguucacuugagcuaaucuugaagcuucccuugacaacugcugcuguugagaacauguuuccuuguuucugugauuuuguuaacaaaacggcucagcugucuuccaguuggacaaauauuuauuaagggcgacugcaugccaagcacuaagauaggugcugccagggccacaaaagcaaauaggugggaagggaagggggacucacauguuacugagaccauucaaggagccaugugggcaaguggaucaagugcccuucacauggggcguggcccuggcauccggagcguguucugcggcugguaggguauggguaugugcagggcaauccuggccuagacagcaggcacauuuggaggcacgggacaguagucuuucgugagcaccauccuuuccagcauagccaggguggauccugggguccugggcugggagggugaagagcaacaaauaaagaaguggcuucuuggccgggcgcgguggcucacgcuuguaaucccagcacuuugggaggccgaggcgggcggaucacgaggucaggagaucgagaccauccuggcuaacacggugaaaccccgucucuacuaaaaauacaaaaaaaauuagccgggcgugauggugggcgccuguagucccagcuacucgggaggcugaggcaggagaauggcgugaacccgggaggcggagcuugcagugagccgagauugcgccacugcacucccgccugggccacagagcgagacuccgucucaaaaaaaaaaaaaaaaaaaaagaagaaguggcuucuuauaguguguggcucacuuccugccuggccucgugggguugcaugaaucacuuuccuucccagguguauuuauucagagcugugagugcaccuuggaguuccucuguuuccuccugaggucagggaacuaccaccucucugccacucauccccuauggcgggagauacauccuccaucccguaguggguuccagggcucagaacccuggucuccugagcucccccaacccaccacuucagcucagcacacaccaauacccagaguuaggacugugaggucucccuggcaccagcuguguggguugggggcucggaccccugcaccgggaggaccugccucagcucuuggccugcccugcccacugccaccagcacgugguugacagggaaagaacccccuuuuguuccccacgugagcucaaggagacuuccugaguuggagcucucuggugugguccuucucaggccuaaagcaaagugucuuuucugugacaccuccaaggccauguucaggagaggggaagggaucagggccuggugggagggauggggagaggggacuggagaagguggccuccagggaucgaguuucccauggccucuucccaccugucuuugccacagggguggggacaccuggcuggcccagcccaagccuccacccugggcuccugugggcuggcugcacucgccagggcuggccuaggcucucugcacccagggaagcuucucuauucaaugcucuucacccucccagcccaggaccccaggagaugagggagaguggagcaaagguugaggagcagaggcuggagccccaggcaguggcacugcugggcaguggugggaggugccagccagggcugggaguuggacccgaaaguacguggccugggcuguacuuucuucccacguugccccuucagagcagaagcagccaguugcuccugaagccuugaccagggcuccugaguccagagccuugcucagggcacuagcgugggaggaggcuuccgcaucaguaccagggcaucagcacccgccuccucagcugacccagcccgugaggaccaggccagccccugucauccccacccccaccuugccaagccccugcccccaggagcagggcugagagcgaggugaucuggguucuaauccagagucugcugcugacaugugcugagccccaggcccauugguuuacuugccccaguauugagcgagcauccacuggguacccgcccagugccggugcugugccaggggccaggggcacagaauaaagcagacccagucccugcucuucuggcauucacagucuuguggaaacuccagagcuaaagugcccuuagagauuauccagaucagccccuccuuguagcaaugaagagacugagacccacagaggggaugaguuugauccaagaaacagacaagauuaagaugcaugugucuugaaccuuuucagugcucuggaacauaccgucuggccggaguugucugggcuuugguuuucccauccaugaaauggguacaauaacaacagcuauaguguaugagccucugugauagaugcuguacgcacagcaccugaacucacaugauaaaccacugaggugagcauuaucucccauuaucaaggaggacccuggggcucagagagguuaagcacgauggccaaggccacacagccagggaaagaagaguuggaauucaaaccccgggugcccugucucacacuagcuuccccuguggagggugcuggugugugcaugauuggaggcccucacacaguguaagucucaggaucugcagcaaacuggucagaaugcucugcccuggcccagggaaggaaagaggggcagauggaguuugcuucgcuguaaggccccggagcuuuguguuccugcugagaagccucagagucgggcaacacugggucuaauuccagcuccaccccuuguauuaauagcugggccuuaaucuccucaucuguaaaauggagagaaucgccuguacuucauaaggcugcuggaaggauuagcuaaagcaacccagcuacaguggcuggccuacaguaggugcuucauuaaugcccuuccuuuuagauguggaaauuccucuuuuuguccaaguuuucuuuuccucuuugcuuacggcacugggauuuucuuuauuacuguuucuuugaagaguccgcucuguacuugugcccaucgggcuauggucaguaaccccuuauggaauaaaaccccuuuccuggccaggugugguggcucauaccuguaaucccagcacucugggaggcugaggcgggaggaucacuugagcccaggaguucgagaccagccugggcaacacagugagaccccugucucuacuaaacauacaaacaauuagccagaugugguggugcauaccuguagucccagcuacucagaaggcugagauaggaggaucaccugagcccaggagaugaggccacagugagcugugauugcaccacugcacuccagccugggcaacagagugagacccuaccucaaaaaagaaaagcaacaacagaaaaaccuauuucccuauccuaauugcaccuccauucaaagagcugccccugcaagaguuaaccaacucccuagccucccaugaguucugaaauccugcacccaggccuggucccagguugccuagcaaccgggggcugcucugggaugcaguagguaagcaggggagggagaggaagaaaacaacuuggucuguccacgacucuaaaugucacugagagaucagugcagagaaaggccugucaccagagcccagggcccaauuugccuggugguagggacagcugcccucaggccaccugggaggugguuaucccuccuuugagugggcuuacauaaguacuuggcauuuuugcaagggacuuuaagcucacucagcagugacacccccuccgcccacaugcacauacaugugugguacagggaggacccggugugggaggcagagaugggguuccagccaacugaaacuccaucaucugcaucucccggccucugacugccucccucugccaaagcgggaagaugaaaaugguaacugcuggaauuuguauuuugcaaagacuuuucucauuuacugcugaauauauuccucaucucagccuccacucgcugacacgcuacccacugucucucccagcauucaucucuaccugaaaugaucuuguuuacuucucugugucugugugccucgacucucccccaccgacuagaaagguccgugagagcaaggagcaagccugucuuguuugagggcacugguucucauagagcccacagggaaugaugccccuggacuaagcaguguggggucugcuggcuugcaccugugcccccagcuccuagccaaagaccagacacauguugggaacucaauacuuguuuguuuaaugaguagaugaacaaaagcacucaugaaauaggcagugcacguaucuuuaucaccauuugaaagcugaggaaacaggcuuggagagggaagcaacuugccugacaccccaaagcacagaagcagcauauuuggcccaagaaccuggcuuccugucuccaaggggucagcugcuggcauuggccuguaggccaugugaguguggcaauguagucagcaaagagccuuuacugcauguuggggucagaagaucagcaauaaggaggacaaaauccuugccuggaaggagcuuguguuccaaaaagaacaagagaccacagcauauucauuaauaaagacacauucaaacagggccaagugcucugaagcaccucagacaaagcgacaggcugcaaaaugacagcguuugggggucaggagacagaagggugccugcuuuagguggucgaagaaggccucucuggggagguggcauuuggucugagaccucagggccaaugugcuaggagcagaggagccuuggggaagaauggagaugagguuggacaggaugagacacgugccuucuaugucaauggcaagggagucauuggagcaugugaagcagaggaugcucuacuuuugccccagaaagaucacucuggcuacagugcagagaaagaagagagucaaggaggaaagaagggccucauuaggggacuguugcaaagcacagggaggcacaaccacagccaagaucagcauggugacaauggggaugggaagugucagaugucggcaaugcugugcggguagggucagggccgacaggaccugcugauggguucagcguggggugugaagggaacagaggcugcaccccaggcuccuggccugaguggcuguagauaguggcaccaaauacugagcuugugaagauggggggagagcugaugaugaagacagcaagaguuuggugugagucaccuugaguuugagacacgugucagacauguaagggguaggcagguggacacgugcuuauugaagucuggagcccaagggagaggugugggcugcagcggagaaguugggaguauucagaguucugacacugaccaagaacaccccucagagaauucagagacaaccagggcugaggcgaggggcuuagacuggggccugggacagccacaggcaggaaugcagacuugcugccucuucuuauuuguggagauguaguucaugcagcaagaaagucauuccaaagcccuccuuuccuuucuucaugccucaguuucuccauuagcacauuaaaagaugcaagaucuggaguuaagcuuguuuuuaaaagguggccuccaaagacgguuuuucuuggccuggggcugucucaucauccaggucaugacaggcccgguccaugguugaggaaugccacagaagugacaguccacugcaaaagacugcugcuccagaucaguucuggaaggccuggcaauggggcaggccacugaaguagaacuggaugucagaugcacgcauuagaaaggacaggaagaccaaaugagaaagggagagggggcagggagaaaggaaggagagcuagagacuugaggcaaaggaaacaagagauggaauagaagaagacagaggaccagaagacagugagaccaacagaaagagagagggacgagaaagaagguggcugaggaaggugagaaaaguguuuccagggcgacagcaacuggaccaggcccucuaguuggacagugaggcuggcuggggggccugagcucaaguagcccucguccccugagagagugggggcuaccuggggagcugggcuugaugcaucuggaaggaucuucacagaggcaggagggggagugggagggcagagggcacccaggcgcuagaacagugggaguggcgggagccgcaaaaccggagagccagaggagugaacaucccuggcagauucccugcgggcgagcagggagggcaggaagcucagugguguuggcacaacgugagaaguuccagggaggcgugggaggacggcuucugcaggacgcagacuuugcagagggagaguggcaaacagacugacugcaggcagcucugccggcuccacagggcgcugcuuuuucuccacguggagcuggagugcaucacccugagaacagcagcaagcgcccacagggcaccuucugcgugccaggcacauccggaccacuugucgguagacaccagugacccucaccaccaccccaggaaugggacagugucauguguuucugaaaugacuagguuuuagcaccauuucauagaugaggaagcugaagcuaacuugcccaaggucauaaaccgggcgucugguggccuccccuccucacugccaacccugagagcggacuaggguggaguuaucuggaaagaggaagcuguaccugagagcccuaaacacacaugcgcgcgcgcacacacacacacacgcacaaacacacaaugcacgcacacacaugcgcacgcacauacacacacaugcacacauggacacauaccugcacacacaagcauacacaugcacacaggcacacgcaugcacacacgcgcaugcacacacaugcacacacaugugcaugcacacagugcgacagcucugauuaguagguaaauaaaagguucccaucuaguggugacucggccaaagugcagacacugaaccccaaaggcccauagaggcuucauucaucccuucucuuauucuucauucauggauucuauugagcaucugcucugugcagcaucuguccuggaugcuggggauacugugaugacuuagacaaggucucagccgcacacagcuuaugcuucuuugaggggaggcagacacaagccaggaaaccaauaagagaaguuaaguaaaaagcacagugagugagacaaacggguauggaggacauggccagagagagcuuuaguucagguggucagggagcaccucucugaggaggugaaauuugaccaagccucaaacaguggcagggaucccacugcuugcagauccuggggagaagcauuuuagacaaaaagaacagcaaguccaaaggcccagagacaagacagagcaagaccugugacaugaaacaggcuggugugcccagagcagggaggcugggagaguggagggggagggcgaugaggguggagaagcuggugaggguggcaucccggcaagugugccuggccacggaggccacggaaggauucagcaugucuuucccgaauaggaaaccacacuggggcuguaagccagagagugaacguaacucggguuacaguuugagaaggucccugcuuauuuccuuccgugaaggaggaagagcugcugaugacagagauuugggcaguggccaaagacauagagagaagagggcagaacaugggcuauuuuaaacacagagaagauuagcgggacccgcuggcagaccggacaugaaauguggaaggagcgggggcagcgaggucggcuccuaguuuccugagaaugugggugaaucacgggcucacaggcagagggagcacuaggauaucaaggguucccuugugaacgccucaaguuggagaugccugagacauccaagugagaugucaagcaggcagcuggaaauaggagaugagcucugggaaaaugcucccaucacccuggccugugugcugccugggcgcacccauucagggcccuccacgcagcccacgccccugccuccugauuccuucuaggcuucuccagcacucgugggaugcccagaugugaucagggaagggcuugaggaugcagggaagcuguggcugagagcccuaaacacacacaugcacacgcacacacacauacacaggcacaugcacacacgaccauacacacacacaaaugcacgcagaugcacacaaaugcauaugcacgcacacaaaugcauaugcacacacacacaugcacacauaugcauacacguaucccuuucaguggcuuuccuuucuguccuuaacccuuggccccuuacagugagcucccaguucuccccagccuuagaaccaaacccuggggcugggcugggagcccccagugacccucugugucucuguagguggaugcacccuugguccuggugccagcugccacugcaggcugaaggccugugagugugacaagcaauccgugcacugcuucaaagagagccugcccaccuaugagaaaaacuucaagcaguucuccagccagcccagguguggcagacauaagcccuggugcuagggacaccacagggucccucucaucauccagcauccgcucuaguguugcucuuccaggaagccuu

SEQ ID NO: 14191 - RNA, 1068 nt, Homo sapiens
cuuuguuuuuaaacuagaauuuauugguauacaaaacuccauuucauagauaaaguggcacaucuuugcagcuucuauugcaccaaguaucgaagauuaaaaacacaaaaaaagaaacauuugguuuugaaaacacugcaaauagccaaguacaguacuuugguaaauaaaaaauaaaaugguucagaugaacacaauccguggaaagaaacaaucuagggggaaggaacuauggacaucagacaauggucacaauucucaccaucgagcuccauagauaaggcaagacuugcuaagucuauggaucacgaccccauggaggucuuaaguaucuccagacugaagcuagaacaaguauagugcaauuagaaagagagaaggccccuccuccacggauacauccaccccucuguaaaggagacugacgcaugccaacacuucuacaugggaaaggggagcccccgggugugacgucugacuccuggcccuuuucuucuuuccucugagcuuagugcugguggaggcucuggaagaggcacuggggaggccaagggcccuuccuacuaugaaaaaugaacuguaagagugggaaaaugugugaagccucuuaccaguacugcucgagggaccugccagggaucaaaccgccagcugaggucuguggcugagcucacaugauugucauggauggcuggcagccugccgcaggcugacacgccaaggaugagagccaggccacagagagucuguccggcaaucgccgccagccgcaaggacuggcagugagcagcagcagcucuggaucacggcuaugaccugcuuagaauaaauucccuaugcaaaaguucguaguuuuacagaaauagauucuuuacacugguaccagccccuucucaaguaauucugcaaggaugcuaaacauuuucauggaaccacaaaacaguccuaacgaggacaguaaagagagggacucuacaaagcagcugcuucaaagacauaggucagagccugagguuuuaaaggaauuucaccuugggagagaacuuccaggccaaccacaaggcaccg

SEQ ID NO: 14192 - RNA, 36572 nt, Homo sapiens
ggcuguguucgaguuccugcucugcuaguaaccagcuaaugugaccaacaaauccacuuuaccuucuugggaccucaaucucuccaucuauaaaacagcaaaguuggaaaaggaucauuuccaaugugcuuuuauguucuauaagccuuuuuugcuuuaugccaagucuauucccuuagacgugggggaaagucgaguugacggcaguucaucuccacaucacaaaauaugucuuucugcugcccccucguguggccuguggaacagccuuccacuucccgucaccugguuaguucauuugugccccagggugggguccuggcacaggugcugaugaugcaguuguaaauaaugaguuuacacaggaugacgaugacugcaaauacugugggccauuaggaucucuggcacagacaccaaacaaagacauugcuauggagcuguaaaagauaaaucccacagcucgagguccagcaaguucacugaaugagcaugaggaagaggaguccuccacugccaccccauaaccauauuuuccccauuaagggccaaugaugaaauggaucaagugagggucacauacaaacaauagcuguuguuuuauuguccuugagagaaaugcagaauguucucuuucuuucuuucuuucuuucuuucuuucuuucuuucuuucuuucuuucuuucuuccuuccuuccuuccuuccuuccuuccuuccuuccuuccuuccuuccuuucuuuuuugagacggagucucgcucugucaccuaggcuggagugcaguggcgugaucucagcuuaaugcaaccucugccugccggguucaagcaacucucugccucagccucccaaguagcugagaucacaggcggcagccacuaugcgcagcuaauuuuuguauuuuaguagagauggguuuccaccaucuuggccaggauugucuugaacuccugaccuugugauccaccugcuucagccucccaaagugcugggauuacaggcgugagccacagugccuggccagguuucuagcaauuucuaguggcuaggaaaaggaaugaugaaggauauuaaacccuucacuucacacauaugaauaauuuaguauauguaauauaguuuggucuuauagccauuuaggagaaaguagagagaaugggcaguggugaggaaggaaacaaaaaaaagcccagaaauuaagggaaagaggaggagggaaacuaacacuuacggugccagggacuuugcuggaguugugauaucaauacuucagaacaauccggagaagaagccccaacugcucucauuuuuuccacacaaagaaacuagagcucagaaagauuauggaaaacaaugcuggccacacagcuuguaagaagugggaacuggacucaauucugucugaccacuccaaaaccuguuguuuuauuuuuuauuuugguccacccuaugcuaagugggugagauaaaaggagcacuggaaaugcagaggaagaggaggaaguuggagagggaaagugggacaggcagaggcacacggaggaugacccacggccaucaagaacaggaacugccggcagaaagagacaggggaggcugggcgcgguggcucaugccuguaaucccagcacuuugggaggucaaggcaagcggauccccugaggucaggaguucaagaccaggcuggccaacguggugcaauuccauuucuauuaaaaauacauacaaauuagccaggugugguggcaugugccuguaaucccagcaacuuggggaggcugaggcagaagaaucgcuugagcccaggaggcgaagauuguggugagucgagauugcaccacuguacuccagagugggugacugagcaagacgccaucucaaaaaaaaaaaaaaaaagagagagagagaaaaaggagucagagaauuccacaugugugugcgcguauaugcaaacacacacaugcccucaacaucacuaucacuaucaccaccaucaccaucaccaccaccaccaccaucaccaccaccaccaucaccaccaccaccaccaccaccaccaccaucaccaccaccaccaucuaagcagaagcagaaacacaggguaacugaaagagggaaaaaaagacuuuugcugauaacauucuucccugugcccuguuaggauacugucauggaagguaauugauaugguuaggcucugugaacccacccaaauaucaucuugaauuauaauccccauaauccccacguguugagggagggaccgggugggaggugauuggaucaugggagcagugucucccaugcuguuuucaugauagugagugaguucucacaagaucuaaugguuuuauaagugucugauauuuccuccuuugcacacuugcugucucuugccuaccaucauguaagacgugccucuuucccuuuugccaugauuguaaguuuccugaggccuccucagucaugcagaacugugagccaauuaaaccucuuuucuuuauaaauuacccagucuugggcaguucuuuauaacagugugagaauggacuaauacaguaaucaaaccauguugcauuuucacaacauuaggaacaaauaaggaaaugaaagaccuggccuuggcugggugcaguggcucaugccuguaaucccaguacuuuuggaggccaaggugggaggaucacuugaggccaggaguuugagaucagccuaggcaauacagugggacuccaucucuacaaaaaaugaaaaaauaaaaaaaucaguuggguguggugaugugcaccuguaaucccagccucuugggaagcugaggugggaguauugcuugagcccaggaggucgaggcugcagugagccguaaucacgccacugcacuccagucugggcgucagagcaaaauccugucucuaaaauaaaaucaaauaaggccaagcaugguggcucacaccuguaaucccagcacuuugggaggcugaggcggguggaucacgaggucaggagaucgagaccauccuggcuaacaugaugaaaccccgucucuaauaaaaauacaaaaaauuagcugggcgugguaggaugugccuguagucccagcuauucgggaggcugaggcaggagaaucacuugaaccccagaggcggagguugcagugagccgagaucgugccacugcacuccagccugggcgacagacagagcgagacuccgucucaaaaaacaauaauaauaauaacaauaaauaaaauaaagacugccgaggggaugcuuuuuguucugauucuuugaugucuacauaugucuccugugcccaucgaauauagggaaauauuaugaauucaaauucugguaauccuggccgggcaugguggcucaugccuguaauccuagcacuuugggaggccgaaguggguggaucguuugaggucaggaguucaagaccaaccuggucaacauggugaaacccugucucuacuaaaaauacaaaaaucagccuggcacgguggcacaugccuguaaucccagcuacuugggaggcugaggcaggagaagugcuugagcugggagguggagguugcagugagccaagaucaugccacuguacuucagccugagcaacagagcaagauuccauuucaaaaaacaagaacaaaaacaaaaaaaaccaccaaauucuaguaauucuuaaccugugacaguuugaacauggcugauuugauauuuaauuuugcuuagagaaccuuguccucagaagaagagcaaauuagcaauaaaaucaagauugauuagggggcgauauggugagaagggcaagagagcaaaugcuaagaacucuuaaagacuucagaaaugccuguuucuaggggaaagcuacaugcuuacugcaaauuccuuuuaggugaaaaaguagaucucaagauaacucuauagggcuucaauguaagggaaagaauagauuuuguuagucuagaaaaauaauuuuguuggccaggugugguggcugaugccuauaaucccagcacuuugggaggcugaggugggaggauugcuugaguccaggaguuugagaucagcccgggcaacauagcgagaccuugucucuuuuaaagaaaaaaaaagaaaaguuaauuauuuuauuaauuuugcugggugcaguggcucacgccuguaaucccggcauguugggagacggaggugggcagaccaccugaggucaggagcucaagaucagccuggccaacauggugaaaacccaucucuacuaaaaauacaaaaaauuagcugggcaugguggcgggcgccuauaaucccagcuacuaugggggcugaggcaggagaaucgcuugaacacgggagguggagguugcagugagcugagaucgcaccauugcacuccagccugggcaacaagagcaaaacuuugucucaaaaaaaaaaauaauaauuuuauuaauuguaauaaugcacacaauacaugaacacaauacccucauuuaaaaauacauaugaaauaacgauaaggucacuuucacucuuuccucucuccuuacucugauccauuugcuaugugcccuuccaaaccaucuucuauguuucugaguaugaagauagaggcgagaagauugcuugagucgagguauuggaggcuguagugagccauaguugccccacugcacuccagccugaguaacagagugagagccugucacuaaaaaaggaaaaaaaaaaguacacacauauacuugcagaaaacauguaauucuucuguugugucuuauguuguugaguuuuacauaaagucugcacugaacggaucauucgaucccauacuuuucauuugaccacaugccuaggagagcuaaccaugugaguucaucuagaccgaccucauuucuccaccaccucauucuuuuuuuguuuuuguguuacuuuaaguucugggauacaugugcagaacgugcagguuuguuacauagguauacauguaccacggugguuugcugcaccuaacaacccgucaucuauccaccaccucauucuuuuaugcugcugcguuguauguaauaaauagcuguuccauaauuuaagaagccauuuuccuauugauggauauuuagguuguuucuaguuauuuguuuuuacacaccaccaugccuuaaacauccuucugaggcaggauaaguaagguuagaaggccauguugacuuguccccuugugugacgcuccgcggguuccuuccgcauccuuugcacccacgccuaacucuucugcaagggucccacaggauaccagccgaccagaugguuacaaguuccugguaucugucucagacagcccggaaaagagaacaaaaagcccuaauucuucuuguagcuucuccaaucuccagccaaucagcuucaaaagcccaagaagcuauuagcuacaaaugccugcccugagggagcuagggacuucuccggggucccgcaucggcagcuaggcucaagguuuagcuugcagaccuuuuccucauuuuaaugguuaaacaaaaggccaggcgcagugccucacgcuuaucugagcacauugggaagcugaggcgggagcagccugggcaacauaguaagaccucgucucuauaaaaauuaaacagaaaauuagcgggccgugguggcuugcgccuguagucccagcuacuagggaggcugaagcaggaggauggcuugagccuggggggguggagguugcagugggccgugauggcgccacugcacaccuguuuaggagacagagcaagacccugucucaaaaaaacaaaaaaguaaaaaacacaccccuaggugguuuuauaugcuaaggauacacguuaugcguguuagagcacgucgaugcuaagcgcaugugccaacugcaggucugucuuugcauguuugaccucagcaguauuucaugaauaugcauguacagcucccauaaagggaauuccccguaagguacuaggggcugccucucccuuuuagcagccugcuuugccucucagaguguacuuuugaagcagcuacacugucugggguauauacccugggguucgucaucucgcaccaggaaaauuuagcucacggacacacacgaggaguuuaggagcugagguuuaauaggcagaagagaagagaaagagcaacagcucuuucaggagagagaggugucuccgaguggaaaagaacuguugguagugaugcacuggauuuuauagucuagcuugaggaggcggugucugauuuacauagggcucacagauugguucaaucaggugugacauuuacauagcagggaaggcugguuccccacccuaaucuuauuaugcaaauaaauuauccuuggcaggcuaucuugucugcuccuuacuguacacguggcuggcagagaagaggcgaugaagccgccaucuugaacaugucuagucgguaguucccuguggcauuuacccgugcaagcucccagcuuguuugugucugcagcuccacuuuacaggcuacucuguuagaagaugauuuggggcugcuuuucauuaaaaagaaaagccuuaccgaggacucccaugcccuuacuaucugccuacgcgauuucuucuuaacuccuguaucacuuuugcuuugcaauaaacuucuuugccugcucuuuggaguacuuuggacucacucucaaauucuuuuacguggcuaagucaagaaccugaacgggccaacugccaacacuuggacauaccuucuagugcacgugcauguaauuugcuuuaggacuaucugcgucugagaguguacuuuugaaggagcuacauuguccggaguauauacccugggguucaucgucuugcacgaggaaaauuuagaauacggauacacacgaggaguuuaggaggagauguaauauuucuauuuuuaggauagaucacgagauguagacacuagacauuuaaaauguuaccagauacaggccaggugcagugguucaugccucuaaucccagcacaguaagaggcugaggcacgcggaucaccugagaucaggaguucgagaccagacuggccaacauggugaaaccucgccucuacuaaaaauacaaaaaaaaaaaaaaaaaaauuagcugggcaugguggugugugccuguauucccagcugcucuggaggcugaagcaggagaaucucugacaaucucuucagcccgggaggcagagguugcaguaagccgagaucauaccacggcacuccagccugggcaacagaacaagacuccaucucaaaacaaacaaacaaacaaaaaaacaaaaaaaaccccaaaguuaccagauacaguccaaauugcccuccaaaguggcuagauaaauuuaccucccaacagcagugugcgagaguucucauuuucccauacccuugaugguauguucuugaaaguccuaaagcugcauuucuucacuaaaauucuguuagucacacuuuuuacuaauuuauacugccauccaaugagguuugauuacuauuauuauuauuuuugagacagggucuugcucugucaccuaggcuggagugcaguggcacagucauaccucacugcagccucaaacucccagguucaagugauccuccaacuucagccccucccgaauagcugggacuacaggcaugcaucaccaugcccagcuaauuaaaauuuuuuugcagagauggggaaucucacuuuguugcccaggcagaucuugaacuccugggcucaagcaauacccccacuuuggccucccaaaguccugggauuacaggcaugagccacugugcgggucaaugauucuuuuaauuaacucuagcgaagugggcagagcauucauuuuauuuacaaguacuauacuccuucccuuuggccuuuaaauauaauuuauaggcagcauugauuugcacuuagagacacugucuaacacaggucuccgcugagaagagaaauucgcccauucaaaaucugugugugggcuaaaggcuaagggcuuaugccagaaaagauuuuuuguuuguguuuuuguuuuuguuuugagaaggaguuucacucuuguugcccagacuggagugcaauggcgcaaucucggcucacugcaaccuuugccucccggguucaagcgauucuccugccucagccuccccaguagcugggauuacaggcuggccucgaacuccucaccucaggugauccgcccgccuccaccucccaaaguguugggauuacaagcgugagccacacgcccagccaaaaagauuuuuacaagacgggcaaguguucgcuuuucuaucaauauguuagcagucuguauuuacuuauuugcuggugagaaaccuuucuucccugguuucuaaaguuugaaagucuuugccccugagcucaugagauuuccagagaacugauucaaacaacuucauuaaauagguacuuacuucaugccuggggcuuuacauuuuuauuuaaucuuuacaacucucuuuugcauucuuauugucaucagaaaaaugcaaaucaaaaucacgaugaaauaccaucucaugccaguuagaauggcuuuuguuaaaaagaaaaaauagcagauguugcugaggcuguggggaaaaggggaacauuuuuacacuguuggugggaauguaaauuaguucagccacuguggagagcaguuuggagauuucucaaagaacuaaaaauugaacuaccacucgacccagcaaucucauuacugggucuauacucaaaggaauauauaucguucuaucaaaaagacagaugcacccguauguucacugcagcacuauucacaauagcaaagacauagaaucaacccagguacgcaucaacaguggauuagauaaagaaaaugugguauauauacaccauggaauacuaugcagccauaaaaaagaacaaaaucauguccaggaagaggggagaacagcaacauggauacagcuggaaaccauuauccuaagugaacuaaggcagaaacagaaaaccaaauacugcacguucuuauaagugggagcuaaacauuggauacacauggacacaaagaugggaacaauagacucuggggaauacaagagucgggaggcaguugggggaaaggguugaaaaacuaccuauuguguauuguguacuuugcucacuaccugggugacagauucauuuguacuccaaaccucagccucacgcaauauagaugggguuucaccaucuuggccagcuggccaggcuggucucgaacuccugaccucaggcgauccccuggccucggcuucccaaaguguugggauuacaggcgugggccacugcaccuggccucaguuuuuguuuuuguuuuuuuguuuguuuguuuuuugagauggagucucgcucugucccccaggcuggagugcaguggugcaaucucggcucacugcaagcuccgcuucccggguucaugccauucuccugccucagccucccgaguagcugggacuacaggcgcccgccaccacgcccggcuaauuuuuguauuuuuaguagagacgggguuucacaguguuagccaggauggucuccaucuccugacuuuguggucagcccgccucggccucccaaagugcugggauuacaggugugagccaucacgcccagccuggucugucucaguuuuaaaacggaaaguccugcaucccaagaaaaccucuaguccaggcaaaccuaggugggucgcucuaggauggaauuaggauuuccaguggucuuggacagaagggcgaccucucccuugaguuacgaaggaaggcggagagaugaagggcaggauuaaauaaacaaguaugcgggcuuuggagccagggcaaagcucugccuuuuagcugugugaucuugaaauuauuuaaccacucagauucaguuuccuguaauuuggggauaauuaaacaagaaugagccgugugaaagugccuauccaacuguaguaggcucgcagcaagaguuuaaaucguuuuuauucaucuccgguccuaacuuuugccgcugcucuguguuccacucuucuaucaucuuuaauuucucugcuugacuuguuccugcuuuguucucucuggucccucuccggucgcuccugccacucacguugaguaccauccaccacuagagggcggaauagaacaaaccaagaugggugccccuccagcucucuauggcgucugcucgccgagccccgcaaaagaggcggggauuccaucaugugaccggggugcugggcgccggcgcaggcgcgguugcugcguagucgucgccgggcuccguugcccgcgcuguuuuaccuucccaacgcuugaggcggacgcugggggguccugcgccuuucccuccugccgcuggggacugcaggcuaaggccaugucccgaaagcaggcggcgaagagccggccgggcagcggcagccggaaagccgaggccgagcgcaagcgggacgagcgggcggcgcgccgggcccuggccaaggagcggcggaaucggccggagucuggcggcggcggcggcugcgaggaggaguucgucagcuucgccaaccagcugcaggcccuggggcugaagcugcgggaggugccgggggacgggugaggcgggccgggagcgagggaggcggcgccgggggacgcgccgggcucggccuggcgaccguugcccgcucgcguccauccauccauucauucgggcggcccgggcgccucccgcgagccagccacgcuccgagugcagggcguccagcugcgagugaggcggacaagccccucgccccgagacgcucgcggggaucccaaaggguccuaaucauggcagacgccgcgagcgaaauagaaagugggugcugagaccguauaugggagcagggccacuggauuguggccaggaagggcucucucaaaggugacauuuaagcugaguucugaaggaaugagauggagccaggcauuggaaaaacaguuaucaugacgauaagaccaguugaaggaguuugaguaagccccacuugguagaacgcuuugccuccuuugaguccuugguuuuuggguggugcccccauuuacauuugugaaauuaggucgccuguuuacugagcugaaggcagcuucucuaauucuuccuuccaugggccucaguuucucuguaagcaaaggugcuuccccaagcuuucuugggacuuagacuggauccagguccagcuuucuuuagggaacgcggagggggagaguggggaggaggaagaaaauuagcuucaagaaaggggauauggcuccaggaacauggauggaagaaggaaaagggucaggaagaggggagaacaguuaggauccccauugcaggggcagguaaaaaggggucugguugucagcugugucacuuuggaagagagaguguuaauaacagccuggcuuuuguuuuuuuccuccccguauuugagugcucagauccugcagagggaagacuaaaaugaaauuaaagaccauaaggaauugccuuaguucauuauuauuguuauuuuguagagacggugauuuugcuguguugcccaggcuggucucgaacuccuggcuucaagcgauccuccugccucggccucccaaagugccuagauuacaggcaugagcuaccacccccggccaggaauugccuuagauauuaacugcagaauaagguguuuuaaaaauuuucacauuacauugcagcuuauugauuaagacugugaacugguccuaauuucccuuucccaccguuccuguuuaugcucauugcuucaggcagauuggauuucuuuuugcucacaaagaguucaccacacuuugcugcguugcuguuuuugcuuaagaugcaguuggaacuugauuacauuuauucaccaucaucuggcaaagugcuugguacauggaaggcagucaguacguuuuugcugaaugaaauauaaaaauaauagagggaggucagcuagccuaagcauaagcccaagacacccuuauagaaacagaaauaccaauugaauacaguggaauuggcgugggacauuggggcuuuuccuugcaaaugauuggauugcuugugucugcuauacuggguaugguauucucaaugucagggugcccaggaaacugaaguacucaauagaagguuacuuaugaggaggaauuagcacagggaguuguaaacucuugagggggcuuucauaagguuaugggaaacuuuggggguacuacuucugcucccuauccccacacccccauacacacacagcauacuuuucaaguuaauucagcacaccuuaaguagggugcugggaauauguugaugacuaagauacuuaaggacuucauagccuaagguagaaacacguaacagugggucucagcuuuuuuggucuuaagaucucuuggcauucuuaaaaauuacugagaaaccgaaagaacuuuauauggguuauagcuaugaguauuuacuguauuagaaaguaaaacaaaguuaaaacacaagaauacacacacauuccauuagcuaucagagugaugacuucaugcaucagguagccucuggaaaacuccacugcacuugugagagaaugagaaugaaaaagguacauuacaucuuaguuuugaacucacggauacccugaaagcauaucagagaccuucccacaucuccggucccuugagucacacuuugagaacagaugauacaaauaauuaaaauauaguuugauauauuuuuaguaacagugacugauuauaaugguacuauugagaaggaaaaggcuacuacucuaugaauuggccaggaaguccuucucguucauucgguaaauacucauuggauacacugcuagaugccucucagagggugucaugcucugauugggucaugaaggaccaauaggaguacaccaagagaacggucccaucugagaaggaguauauauagaggcacaaggacacgauguuuuugggagaucuacagguuguuuagggugacggguaguguagggcacaaggguagaaguaacgggcagugaagcuaggcuccagaaaccagcuugacuggagugcucaugucucucuuccaagguuccuguuauucggacaguguuagauaaaaugaucguauuuccucuugugugggcuucauggagcuaaccaccuucuguucacaaguucuucacaugaguuccauuagcuggacugugguucagcccucgucaguauccuaguccuuucgaauguggugaugacagacuuuaucacugcaggggaugguguuuccuguguaugugauggguuggcaggugucaacagauucuucuaccccccucagacggagucuuacucugccacccaggcuggagugcaguggcacaaucuuggcucacugcaaucucugccuccuggguucaaacaauucucuugccucagccuccugaguagcugggauuacaggcaccugcuaccacagccagcuaauuuguuuguauuuuuaguagagaugggguuucaccauguuggccaggcuggucucgaacuccugaccucaugauccauccgccuuggccucccaaagugguggaauuacaggugugagccaccgcgccuggacaacggauucuuuuauuaauguuuauuaaggacucaggugaaauauaaugaaguuaaagacuauuaaaaaauaguugacaucucuagcguucccuguuuucauucagauuugauuacaaucuggaguagccugauacaguaucuaugagcauguucauuguuggcaauaugguaccuguagcauucuggaaccugaggggguuuagggaugaauuaaccaauauccuguaauacagccuuuacauggguugagucagcuuaguguagauuaaucagggagcuacuuagaggguuuuguaaugcuuccuggaccagcuucauauuucacguguugucuggaagguggacccacauaaauuggauucauuuuucaaagcaagaaagaaauaguuuaaccuugauguuuuccuuaaaaacaugauuggcuauagugugaaaagaauguauaacucuauuuauuaggcaguacaauauuaacaucccucugaacuuaucuaguugggucuuacuaaauguaguucugaguuacauuacucauuagcaguguucuaaaauugaaacauugaagaaucacuaauuuuagcuguuuaucuuauuacuaacaaguaguuuauuuuuuaguuuuguuuuuaauauugcaggaucacaguaguagaagggcauucacacaucaucuugucuaauuauugccugugucaccugaacagcagugccaucuuuugugccucacucagugguuuucaguugggugccauacuagaauaucuggggaggaacuuuugaaacaauucagggccugggcucuccccuagaucaacuacaucagaaucuuagaguggggccugguuauugauguuuuuuaaaaaaaaauuuacagaugauucuuauaugcauccauaauugagagugacugauuuagagucuagaugcucaacuaguguuucucaaacuucaguaugcaacauaaccaccuggacugcuagugaaaacaccuggaagggcuacguugcugggccccaaccccagaaugccugauugaguaggccugggugggccccagcauuuucauuucuaacaacugcccaggggaugcugaugcuccuaguccgggaacacacuuugagaaucagugaucuagaucagcgcuguccaggggaaauagaaugugaaccacguaugugauuuaaaauuuuucuaguaacuacauuaaaaagaaacaggugaaacuaauuuuaguauauuuuauuuaagcuauuguaucuaaaauacuauuuugacauacaauucaauauaaaaauuauugaucucucauauuuucuuuuucuuuuucuuuuuuuuuuuuuuuuggagacauuagaguuuguuguuguugcccaggcuggagugcaauggcacgaucuuggcucacuggaaccucugccucccagguucaagcgauucuccugccucggccuccuguguagcugggauuacaggcaugcgccaccauaccuggcuaauuuuguauuuuuaguagagacgggguaucuccguguuggucaggcugguuucaaacugcugaccucaggugauccgccugccuuggcuucccaaagugcugggauuacaggcaugagccaccgcacccggcugaugaucucucauauuuucuuauaugaccgcuucagaaucuaguauuuuacacugauagcacaccucacuguggauuagccacaucagaugcucaguagucacaugcgguuagcaaccacuauuaaacaacacacaucuagacaauugcugugaauugcuaguuauagaaauuggcagaauccugagucuauauagucuaccuccguagagcuaaggugaaauuaccuuuuauuugccaaaaucuaugucucuguggcuuccagguuuucguuuuauuauacagguauaauuuuaauuucacaugacaguuggagguauugaucacgucccccugagccuucuuuaggccaaacaucacuaguaguucuucauauuguauuaaagccacaucauuuaucugaauacgucucucuuaaaauacaguaacuagaaugguacccaguacccuaucuggucugaccccaaauaauaaaaccuuuuccuuuuucugcacauuuacuauuauuacugcagucuagagagcacguuagguuuuuuggugcguguguugcaauauugucuaauaguaaauuauugcgcacucaaaacauuugcgugcucuuuauguaauugguuguuuuugugaacucaaaugcgagaccugccauauaucccuauaacacagugguucucaagcagggaugauuuugcccuccaggggacauuuggcaaugucuagagacaucuuugguugucacaacugauggggagggagguagugaugugcuacugacagcuaauggcagaggccaaguauucuccuaaacuuccuacagugcacaggacagccucccacaacaaaaaaaugauccuggaaugucaauaauguggagauugagaagcccugcuauagguaauggugagagugugaacucaggaaguggcccagaucuccuagaggcccuuugggcagcggugcuuuguucucaugaguuucuugagugcucuuauugggcucaccuaaggaaacccaggucacuggaguguuuguucauuaccuuguaauccugucagaaaaggaagugauuugucuauuuuggcuuguuuugggugagcucaaagaaaguuugguaaguaaugaaaagcauauuaaaaaauguaacaauuaaaacucuuaaauauuauuuuuaauucugcugccuagggguaacuauggcuaucauuuugguguugacauucgagcgagagccacguuauuuggacuuggauccugggccuaccacuuacuaguuuugugaccuugggcagguuuccccugagggaugguaauaggaccuaucucagaguugugagacacaacauguuuaauacauauaaaguguuuaggacagucccuggcacauuguaagaacuauuuaagugguuguuucuguguguuuucuuggcauacguuuguguguguuucugugucuguguauguguauaguguacagaugaacuugguugaguucauguggcauauacaguucuacaccuacuuuuuuggagaacauuugcucauguuauuaaaaguuccuagcaaacauguaacuguagaauaccaugaauuuugguacauuaaauguaaaauaacuacauaaauuugugauaaaucacaucucuuaaacuaaauucaagaauaggcuagugguggcagaugcugauuaagaaaaguuugagggaaaagcuugacauuuaaauuguuuuaucgauuaacuuacuuuucuccaugguugaaaaaagacugccauugucagauuuuagcaagacaccucagucuagccuacagaacucuauauuccacuccuucuagaaucuugucuuagauuguuggaaagcuucuugguuuuuaauuuauagaagcugucuuaauucuccccuccccugcaaaaaaaaaaaaaguauauauucuuauacauuagaagagauuccagccuuucuauagcuuucuguugaaaauucacuuuucugaguugaaaaacaaaacccccuuuuuuccuacacauuuagacaugaaaucuuucugaaagugaugaguuuauacuuuggaauuacaguaucauaguuuuucauuuggaagaguaaacaguuggguguaaaacuggacaacuguuuggcuucagaauuguuuauuucuguaguuuuaaggauaccagauuguguuugucuuguuugagucucuguguaucuaagccucuguguuugugauaguucggaauuuagaagccuuugagggguuugaaaguaaagauaacucuuacaguuuauuaccaguauuuuaauuuuagagaaacaaaaugugguguuuaaaguuuucauuuggcaggaauaacaauggcauuguugcucccugggugcuaagugaggaggcaaggaggaagugucuuuccauaguacaacuguuuguuguccaagugcuuuccuucucaugacuuucuccacuauguucuuaggacucaaacagaguauuguucaguuguuaguauuggcagcuugacaaauugcuauuuuuuggguacuauuuguuaaaugaaugauuacuuagcuggguagcuguaguggaacuuguuuuagaaaagaggcuguagauaggacaugauuuuggaagaggaucuguaaaucauagcccuuaggcauggaauggccuauaaggucuggaccuuguaguaaggugguuaguguaucaccggcuccacuuguugaagcagcugaggcccagggaaguuugaugacucuccugagucagccagcugguacauggggaauagaauccuuguuugcugccucucaagaagguaauaugguugaauaugcccucaugcugucccccguggucuuggaagaauccuggacuauuagaguugagucuuuaccucugugugcacaaaauauuuccauggaugaucuggcaugaagcaucauuguuuuagacgaacuaaguucauuuuugaaaggucuugacucguguuguuguuuugacagcaauugcuuguucagagcucuuggugaucaauuggagggacacucacgaaaucaucucaagcacagacaggagacaguggacuacaugauaaagcagcgggaagauuuugaacccuuuguagaagaugacauuccuuuugagaagcaugguagguucacugugggacauuguguccuucaggaguaaugcauuggguaauuaaguccacuggcauccuccccccucccagccaaggguuugguuauauaaaucacgacauucauuuauucaagaaauauuuguuugccuacuugguuaucggcaguaugcuagguaguuggggaucaguagguuuagcuguauaugcccuuaauaaacaugaugguauuaauugaccugaaaagcgauucaugacuucuuacucuguggggugggaaaagcaggcuauaacauagcuuguauagguugauccuauuuuuaaaagguauacagacacaguaggaaaagucuggaaagauacuaacauuuuguuuguuaauucuuagcuucacuuauuuuucagaaauuacucauucucuuuaaacuucuauagaagggagauaauaauagcaucuaucucacaggguuuuuggugaagauuaaauuagauaacaaaauuaaaauaagcccuuaguaagcguuagccaucuggggaugaugggacuaugguauuuuaaauuaucuuuuauagacuuuuucugacuuuuagaugaucauguauuacuuuuaaaauuagaaaaaccaauaaaaucauguuaauuucucacccaaaccccaaacacaaucuguuuucuuugaggcaagucaguuagugauuuuaauugguuccuauuuaauaggcauagaucuuauagaaaaugcauaugaacuuguaaacuuuaauuucaacaaauauuuacugaggaucuacugugcuugcugcugauaugucuuacaaauggcauuuucaucacagggcuuauagucuuuucugucuguuaucaggaaagagaauugauccuuuguuuuagagagcuaagucuggaggccaugccaagaauggauggggagagagacugauaaaggagacuaguuagaaggucuccacacuggccagaugagaguagaggaggucuccaucaagguagcuacugaggauaaugaguaaggcccaaaccaagccacacuuuggcaguauaauugacaggacacauuggaggugaggaggggagagggaggagacaagagugauucugaaguuucugcuuagggaauggguaauuggcuguaccguuagcaagagagagggcagcaggagggggacauuugggagaaaagguaucagugaucccaaaguguuucccauuccuuacuaggaaagaacuuacucaguaggcaccagacacagagcaacaaaacuuccaaugggugguuuguaccaaucacugaguucagauggucccucuuccugggauuacuuuuuggcuagcagauaugcauaguuuacuggauagucagcaguuuacaaauuaaauguuuguauaugggacaaauuuuguaguuuagugcuguacgaaaugaauugugucauuaauccaaugaaaacaucauuuuggaugaaacggguuuuuaguuugugaugugaaacuccacuuugaacacugucagugaagaucacaugguggauuuugggguguuacaggauagggaacucaaaucuucgguugccaaugugauagucacuugagaugaacaguggaaagguguuuucuugaaaugucacuaugcaugccuguugcuuggagcugcuuaagaauuugagcaucacagaaguaagaagucacuuugacggccagagcagaaaugaaaagaaaccuggaagucugcacauucucuuugugugucaguugaaggcuuggcuuguuacauuggugagucuugagucauaguuaccuguuuuuaaugucagugugcugccuaccuuguuguacugugagauucucaagggcagggacugugugucuuuguuuugcgguguggcagugcccggcaucugguagacauucauaaagugaauaaaugaaugguucacuauacuauuaaggaccuggucacccuugcaucuggcuguaucuuuaggauuauucuuuucuuuuagacuguggcuucagagaaucagcaacaucuuucccccaacuguacaaguauccaggucagaaccugaguauucuuaaugcuuaucuuccucccuucucuuacccguucauuacauguuaucacucuaccucagcaguuuuucuuucacugcuacuaccccguaaaaucagaccucuguggccauuugcuuagauuuccuccauacuguucgguaucauugucucuugauuuccucagucuguuuucuacauaacagccagagggggaucuaaauguguuuuuccucuguauaaaagcuguugaugacucaucuauugaccucaggauagagcccagacuuuuuaguucuucaugaucugggauuuucucauuucucuguccucaucucuugccauuccccccaacauuuucucacuuccuccaccucuccaucucagcauucucaguuccugccauauuagaguucucucucucucucgugucugucucuccucuucuuagaacaucauccauuucuccugucuuaacucuuccuuguccuuuggguauuagcuuaguugucucaguugagaagcuccucugauacaccuuaccucccgcuccucaauuccacguuggcuuauguucaccaccuggaguuagccaaacugcaggguucgagaacacaguccuugcaugacuucccucaacuuuugguaccaucuacaaguuggggucucccagaaccucccuuagguuccauaauaugguaguaggacucacagaacucacugaaagcugucaugcuaacaguuacgguuuguuacggggaaaggaugcagaucaauacuacuagccaaaggaagagaugcauaggacagucuggaaagguuccagacacgaagcuucuguuguccucagggcauauucuccucauagcaucugugugugacaguacacauagaauauugucaccuggggaagcucacccuaacuuugguguccagagguuuuuguuuuguuuuguuuugcuuauugauuuacugcaugucuaagugguugaacucagucuccccucucacccuaucaccaccacaaaggucugaugccagaugugguggagaggcccgucaugaauaacagacacucucaucaccuuugggaauuccagagguuuagaagugaccucccaggagcccaggauaaaggccagaccucucuuugggcaaggccaaauucuuacugcacaugcccuuccugaaguacuugugcaucauuagugccuaucuuguuugccccucacugguugugaacuccgcgagggcaaauugauggaguggcugagagccaggaccuuggcauugggcugcguaggugaaaccucagcuccacuguguaccagcucuuugaccuuggcacaguuuucagcuauucugcaucugaguuuccucauguauaaaaugguuuguauaauaguacuugucuaugagaugugauuagaucagugcuugacacauaacaaccauucacuaaugcaagcugcuaagauuacuguguuuauuguuauguuucuagugccuuuuauugaguuaguauauuggaaguaaucaguaaacauuuauugcagaagaaauaaauggaucuuugcuuuaugaaugacuaguguucuucugaguagcagucuuguauuguucaacuagcuaaauuccuagacucugacaaaguuaauggacuucucagauauauaucguuguuucuuauuauuuggaacucaguaaauaccaaagcauguuugcauuuagauuuuuccacuauaaagacgucauuuuucuuuccuauuuccaugcaguggccaguuuggcaaagccugguacuuuugcuggcaaugaugcaauuguagccuuugcaagaaaucaucaguugaauguagugauucaucaacuuaaugccccuuuguggcagguaggucaccuauuuaaacauuuaucuuaagcucuuauuucuaagucagcuuugggaauauccgaagaugaggggcuugaccugugaacauugaauuaugcggaguaacuuggucuacgagccuaaccaaagacaaaaaucuugugauggcucagaaguaaucccugugcuauguacaaauggaguccggaguauaauuuagaaaucuuuuaaaaugcuauaaauauucaacagucagcuaauugggcagguuggggacagagaaccuaguguggaaacacaggcugucacccccuaaagucagagugcugccuguugcuuuguaccucagcuccuaaagacugagcaugugguuucuguuaauuccccacccacucugcccugcuccaccacucaccgcuuucucacuuuuucuaauuaaaaaguuaaaauacaguacuuguagaaaaguuagaaaauugaaaaagcucguaaagagaaaaaaauuuuauuaaaaauuauauuuaaaauuuuauucaaucacccagagagagguuauugcuguuaauguuuuagugaguauuccugucauucacacacacuuggcuauaaaaacauugauacauaacuggaaaggaacauaucacaauguuuuuacacacuuuuaaaacacauacacacauguauccauauccacauauauacggacacuucuguguuauuagcauaaagguaacagugcccuuuuuuucauaugacaccugcauauauuccuuuguaaauugcucagucauagccuuugcugauuaaaaauagguuuauagggauauaauuuacauguagcaaacuucauccuuuuccaaguauacaguucuauguguuuugacaaacacagucauguaaccaccacuacuaucaacacagacuagucuacucucgaaaaaguuacuuccaggcucuuuguacuuuguaaucacuggcccccucccccaauacccagccucuuguagcccauucucugauuuguccuuauaguuuugccuuuccagaaugucauauuaaagaaugcagccuuuugucccuggcacaguguccuuuuaacaaaacuaugcuacaacaaaguaagauagugcagggauggugagaaauuuuaccuuauggggauagaaggagcaggagugaaacaguaucugcuuguguucuuuggggcaguguugcggauguccugacaucaggguaccagauagagcuaucauauuuuccaugggguucuguuuuccaagggcgauguuugagcaaaaauacugguuaccccuuuguucuauuuuuugucuuuaaacuuacacuguuuugcagaaguuaacaaaaucauuugaauacacagcauaaugacccucaccuugaaggggaauacucacuaccaacucaguaaucagcuugccuuuuccuccauugaugacuuuuuucccaaaguuucuuaguuaccuagguaguuguggaagacauuucugcauagguaaauuuuuuuuugaauuuauuucuguaguguucucuuucauaaauuccugagcauugaaaguacaucuuuuuaaaauaaauuuacuaauauuuccauuggaucccccuaugucuuccuaccccagugaagcaucuuauaaaauuuaagaacugaaacugcauugguugcuacuuucaugguuaugggcucuuucauuaauaaagaguaggcuuauacucacaccauggagauauugaaaccuacauuuuuuuucugguuauaauuggaauaugugcuccugugaacaaucuagauguauguaacauagaaugugaaaguccucuguaaucugcccgugaaagucacaguuaacaauuuggugaauauucuuccaguuagguuuucuauucauaauauauauauauauuauuauuauuagguauguaagugcuuuagggauuaugucaaagauucuaauaaacuguuuacuuucccauugcucuuccugggagacaaauggugcucucuauuuuguaugugucuaaaccagacucucugcacuugagaucugcguauucuacuggaaaagcuuccacgcuacugacaucuagacuugugugcuuccuguuuguuccaugguuuuugcuuugucuuuagaccauggauacuguuuaaaguaagggcaguaucuuacuaugugugauuuucaguaaaaagaaugugcugauguuuuggaguuuaaacaaaggaaccauuacugggcuuucuaagggacaaaguuagaaugagaguuucuuuggacguggcgaguuuuauuugggguacgcccagaccuuagggcuucuguacugcacaacucuagggagccccauucuugugcugugugucagggguguaguucacauagaauaccuuguggguggcgccugcaggguugagcgcuacaggccguacuacuuuauguaauuuuguuuugaagcugacguagguaggagauuuggguuuguuguugauguuucucauuuaggugguuaauagaaaaugcuauuuucguuuuaacgaaagggguggauuuaccuugaagcuaaugaaacaucaggccacucauuuguaggacucccuuucuaggucuugggagaaguucuaccaguuuuauauuuauaauuuugcauuuuuuuuuuccucaaagagagccuucaaauaguuagggcuucaagcucaacaaaucuggaucugccccugggccuuccccuuggaaggggcuugugcauuagaggggcucagagguaauacagccucugaagcuuaagcuuauuuaacuucaucgcaagucugccccugguuuuugaauuucuuacaugauuuauuuccauggaguuacauauuaaauaagcauacggaagcauacacgcauaggaaggagguaguuuggaaauugcuugugacauaucccagguguguucccaauuagugucucauagaccugcugacugggcuuccucagcaguccagguggguguuucucuccagaaguugauaguguucagauccucacuggcauggccccuucuuuugucuacagauucgugguacagagaaaagcagcgugagggaguuacacaucgcauaucgguauggagagcacuacgacaguguucggaggaucaaugacaacucagaggcaccugcacaucuccagacggaugugagugaggccucggauuucucccguauuccccgcccuacaggaaacagauugagagcuguauaucuggcgcuaaaaaccaguaauguuuuuguagaaaguuggcauugagaaucugugggccugauuuuaaaaauauuuuuuauuucuuaguuuaggugagagugauagauaaaauugcuuauuauuauuuugcuuuuucugauaguugauaguuacaauuguauguguauaagauacauggaauuuuaaaauuauuuuuauguuuuaaaauuaauccacaccuuuuuuuuuuuuuuaauuggagauggaguuucgcucuuguugcccaggcuggagugcaguggugcgaucucggcucacccaaccuccgccucccggguucaagcgauucuccugccucagccucccuaguagcugggauuacaggcaugugccaccaugcccggcuaauuuuguauuuuuaguagagaugggguuucuccauguuggucaugcuggucucaagcuccugaccucaggugaucugcccaccuuggccucccaaacugcugggauuacaggggugagccaccgcaccuggccuaacucaugcuucuuaucugaaaucugaaaacuauaguaaagguaaagaagaaaauaaaaagcauguaaagucaacucagcuaccugaauguaaauuuuguuacuguuuugguagauuuccauuaauuuaaugcauuaaaacaugguugacauuuuauuuauauagcuuuguuuccuguuuuuaaaaauuaacaucauuggccgggcgugguggcucacaccuguaaucccagcacuuugggaggccgaggcgggcggaucaccugaggucgggaguucaagaccagccugaccaacacagagaaacuccaucucuacuaaaaauacaaaauuagccgggugugguggcgcaugccuguaaucccagcuacucgggaggcugaggcaggagaaucacuuguaccugggagguggagguugcagugagucgacauagcaccauugcacuccagccugggcaacaagagcaaaacuccaucucaaaaaaaaaaaaaaaauuagcauuauugcauaaaccuuuuuuuccuguuuuuacacaugauccaaaaccauuguuuuuuaaacaauuuuauuuauuuuuugagauaaggucucgcucuguugcucaggcuggagugcaguggcaccaucacggcucacagcaggcuugucuacguggacuccagcgaucuucccaccuuggccucaugaguaacuaggacuacaggugugcgccaccaugcuuuguuaauuuuuuaauuuuuugcagagaugaaguuuugcuauguugcccaggcugcccuccagcuccugggcucaagugauccuccugccuuggccuuccaacauguugggauuacaggugugagccauggugccuggcaauuuuaauucuugaauaggucauauuuguccauggauuagaauucaaaauauguaaugggauauauagucaaagucacucuccuacccuuguacuucagccacacuguuuucccuggaugcaaucagugguauuaguauaucauaaaaucuccugugguuuacauaccaagcaaauauauauauagaugugcacauauuccacuuuugccauuuuuacucuccccaccacuaguuguagcauccuacacauacuacacaucccacacauacauccugcacugugcuuuuuaaauuuaacaugucuugggauuuaauucaugguaguacauaaggaacuuccuguauccuuuuuaaaggcugcguaguguucuguucuguagaugcauuauaauauuuuugaccagucacuuacugauggacuuuuaggugguuucuaacccuuugcuauuauaagcaaugugcaguaccuuuuauguaccucauuucacucauguaucugugggacacauuccuagaagguccuugccacaucagaggauguugauaagugaauugucaaauuacguucuaacaagauuucaccgguuuaaacucccaccugcaauauguggcucuuuuccugcacggugcacuucgucaacauaguguuaccaaauuuuuaaauccuuuucauuguuaggggaaaaauuguuuacuuaaccuaguuuuaauuugcauuucucuuauuuaugcaucuuuuccuguguuuaagacauauuucuauuuuuuguaaaugguauucauuuucuuucuccauuuuuuuccuauuaaguugucuuaaugauuuuggggagcuuuuuauguauuagggaaauuagccucugucugugauaugaguugcaaauaguuuuucgcacucugucauuugucuuuuuguucuuucuccuguggucuuugcuaugaaagaauuuuagauuuuuacauaguuaaauuuguuacgauuuucuuauaugcccuuuggauuuugggucauaacugggaaagucuuucccacucugagguuaaaaagaauucucccauaguuuagaauaguacuuucauaguuucacuuuauuuauuuauuuauuuuuugagacugggucucacucugucgcccaggcuggagugcagugcuaugaucauguuucacugcagccucaaccucccaggcucaagcgauccuccugaguagcugggaccacagcuguguaccacuaugccuggcuaauuuuuuauuuuuuguagagacagggucucacuuuguugcccgggcuggucucgaacuccuggacucaagcaacccuccugccucgaccacccaaaguguugagauuacagauguaagcuacugcacccagcucauaguuugacuuaaaaaaaaaauuaaaucuuggcuucaucugaaauuuauauugaaauaaggguaggaggcuauggauccaacuuuauauuucccuugugauuaccuaguuguacccaaaccauugauuaauuauacaucuuuucuccacugauuuaaaaugccacuuucuuuccauauacuaaauucccauauguauuugggucuauuccuagacauuugguucugguccacugaucucccuguucacauguugaugccucauuguuuuaguugguauauuuuaaaaucugguaggauuuuucacucauaauuaauuuucuuuuuauaaguuuccuuauauguugucuuuuuuaaaaaaaacaaaaugaauguuagaaucaaugugucuaguucaaaggaaauccuauugagguuuuuuuuuuuguuuuuuuuuuuuuuuuuuugagacagagucuugcucuguugcccuguugcccaggcuggagugcaguggugcaaccucugccucccggguucaagcgauucuccugccucagccucccgaguagcugggauuacaggcgcucgccacuacccuuggcuaauguuuguauuuuuaguagagacgggguuucaccguguuggccaggcuggucuugaacuccugaccucaagugaucugcuuaacuuggucucccaaagugcugggguuacaggcgugagccaccgugcccggcccuauugaguuuuuuaaaauuggaaucucauuaaauuaauagaguaauuuaaggaaaagcugacaucuuuuugauguugagucuuuuauuauuuaauugacuuugugauccacaggaacauuuucuucauauagaucuugcccacuuuuuguugaguuuauucuuaggagguguuuuguguuuuuugugucuauuguaaagagaucuuuuauguuuucuaguugguuaucauuugucugugagagcuguuaauaacaagauguuaauuacauagguaucccacagaaccccucuuuuuuuaaaaguuaaggcaaaauucacauaacauaaaauuaaucauuuaaaaauauauaguccagugguacucaguacaucugcaguguuuguuguacaaccacuucuucugucuagucccaaaauauuuucaucaccccaaaagaaaaccucauauccauuaagcagugacucccaauucccccucuccccuagcagucaccaaucugcccuucuucucuaugaauuugccuauucuggacauuuuauguaaauggaauuauaugugacuuuuucuuuguggcuucuuucccucaguauaauguuuuugagagucauucaugguguagcauguaucaguacuucauucuuuuuuauggcugaauaauauuccauuguuuggagagaugauuuuuugugcacccauucaucuguuaaugagcauuuagguuguucccaccuuuuggcuauugagaauagugcugcugugaguauauguguacaguauuuuuacaaauaccuauuuucagucuuuuuggauauaccucggaguggaauugcugggucauaugauaaaccuaaauuuaacauuuugaggaacugccaaacgguuuuccacagcagcugcacuguuuuacuugccaccgguaauguaugaaggcucugcuuucucuucauccucucugacaaauguuuuuuucuuaaauggucauccuaguuaguaucuuaaaguuuuuuuucgagacggagucuugcucugucgcccaggcuggagugcagcggcacgaucguggcucacuggcaagcuccgccucccggguucacgccauucuucugccucagccucccgaguagcugggacuacagggacccaccgccacgcccagcuaaauuuuuguguuuuuaguggagacaggguuucaucguguuagccaggauggucucgaucuccugaccucgugauccacccaccucggccucccaaagugcugggauuacaggcaugagccaccacgcccggccaguaucuuaaaguuuugaauugcauuuucuuaauagcuaaugacauugaacaucuuuucaugugguuuucggccauuuguauaucuuuggaaaaaugucuauucaagucuuuugccuauuuuuuaauuggguucugccuuuuugaguuguaagaguuuuuuaauauauucuagaugcuagauucuuacccagguauaugauuugcuguaauuuuuuugguuugcaguaguuuuuuguugauucucuuguuucaguuacagaauuauaucaucuacaaagacagauuacuuuuuucuuuuuaauuuuauacuuaaaauuuauuuuggcuaaauacuuuggcuguuaccuccaaaauauuguuaaguaauaauggggggagugauuauuguguuucuuccuuuagugggaaugaagacaucauucuguggauuuacagugguuauuuaaccauauccauacuauaaagccuuugggugguuuccaguuauucaccacuauaaguaacacuguuagcacuuuuaccugaaucuuuucucuuuuuuuuuuuuuuuuuuuuuuuuugagacaaggucuagcucuguuguccaggcuggaaugcaguggugugaucucggcucacugcaaccuccaccuccugggcucaagccauccucccagcucagccuccugaauagcugggacuacaggugcaugccaccauguccaaauaauucuuuuguauuuuuuuuguagagacgggaugucacuuuguugcccaggcugguuuugaacuccugaggucaagugacccacccccaucagccucccaaagugcugggauuacaggugugagccacugcaccaggcccauaaaucuuuucucuauuugauauuauuuccuuuggcuaaauuucaaaacugugaaacuaccggcucaaagacuccuguaacuuugucaaauucuuaggguuuaauuuuauaauagaauguuuuguauuaacauucugaggaauauacuguacauugcuggaguccacuauauguuuacauucaaaaaauagaacugucuuugcccauuuaccuaucucccugcaucaaugggaagcagaagaagaaggugguugagcaucuacagagggaugauuuuagcuuuucugauuuaaggcccagguuguaaaggucucauggaucccaagugaacuguuguuuguggcuuuaggauuuggauugacaaguuucccuggguguggugguauguaccugagguuagaugagucaugcucauccgugacuguccagcugggacgggagcuucaguaccucuaagcgugcugaugaucaaauaaggcuugggaaccagagggaaguuguauguagguuucuucaagaccagcaccguuuuugugcaaaaguucaccaggugcgaguauagaggaucguuuucuguuaagcucacggcucugaaaaucagcugaggugacugugugcugucagaggcagcagucauuugccaguguuggcauuuagacaugggagugcgaaugccuuucuuacugagcaguuauucugucuuuugggccuuucuuuucaauuccucuguugugacucaaaguacaaugaguggauaaaauggagccuagucauugcuguucucuuaagguuguuucuagaagguuuuccccuauauauaugaauuuuuccagauuagagugucuuguguuaaagauucugaacauaguuugauucucaacauaguucccugauuauuacuuguuuccuuuaguuucagaugcuucaucaagaugaaucaaauaaaagagaaaagaucaagacaaagggaauggacucugaagacgaccugagagaugaaguagaggaugcuguccagaaaguuuguaaugcaacuggauguucaguuaguauuucugucuugcaggaaugauuuagaagcaagcauugcugugccuagcuuacuucuuaguuucguagcaccucucuagcauaucagcaccuugugggccaaaauaggcccaugagauuuguaguuugauuaguguauguggcuuaaugagagcuguuuauuaauuucccuguuguuugcuagacuucacccaguacugcucaaaggucuuaggaaguauguggauuuaauuuuuccugacuaguguuuacaguaguacaaaugcaguuuuauagagggaauucauuuauaaguguacauuagacgguuauuucaagggaccaaccuuauuggaaaucgacauuuuucuaaauggaaaagguccugaaaccuuguguuaauucucacuauuacaucuuuauguuuaugauuauugaaguagagcuaggcagaaaaauauacccagaguuuugaagugguuuuuuuguuuguuuguuucuuggauaggauuuuaauuuaauaguccagaaccuggaagcugaaaauuauaauauugaaucugcaauaauugccgugcuucggaugaaccaagggaagagaaauaguaaguccaugacuaauauuuauagaucuucaaaaugguuguguugguaauuuuccaaauauuuauuuuuuaaccaagucacaggugguaacuguucugucauucauuuaggaguuguuuauugagcacguucuguacguagacauuuuuuacuagguccugucucugcuucagggggaguauaguucagggguagaggguggauaguggagacagauaaacuggugcgauaguacauaaugggguugggaguacagggugcugggggacgcaucagggaagaauuagccuguuuagaaauaagauggccuuagaagaccaaaaugauaaccaaaauaaaauggagagagaaauaccuuguuuuucugguggaaauauuuagauuuguauuagcuugugauaauuuugauuuuuuuuuuuuaauuugaaccaaguauaauuuugugacucagaggaaagaaaagagauguaacggcugggugugguggcucacaccuguaaucccagcacuuugggaggcugaggcagguggaucacgaggucaggaguuugagaccagccugacgaacauggugaaaccccgucucuacuaaaaauacaaaaauuagcugggugugguggcgggugccuguaaucccagcuacucaggaggcugaggcaggagaauugcuugaaccugggagguggugguuacagugagcuaagaucgcaccauugcacuccagccugggcaacagagcgagacucccucucaaaaaaaagagaaaaggauguaacaucuuauuaauuucucaagucauuuauuuaaaaugauaucaauaaauacugauugccagauguuacgugucagauacuguuucuggcaucauagugcuccaugugaugagguauuuuauuauccacuauguauuggcuguacuuuuagaaaucuguaaguaacuuggucuuugugacuuuaaacagcacccuccagugaucugugcuguucaguauaguguguaccugccacaugagcaaugagacuggagagcuacguuuuaaauguuguuuaauuuuaauuuaaauguaaauggccacauauagcugguggcuaauacauuggacagcacagcuuuagagccuguuucuuuucuggguuuugggugcaaaugaaagauuuucccauaaaaauucauguuaagacauaauuuaucuaaaaagcacucugcugguuggaagcugaucaaaaggcuggucaguggguuauuuuagaauuuaucuuccaacuuuuaccaacuuuuucuuccuauguuucccacugucuugacauucgaauuugucucaaggaaacuuacuucccuuaugacugaaguagggacccagguaauuuuggaaucauuaauacagucaucacccuguguaacucucagguucucaguuuuaaugaaaugucuuucuuuggaagaugcagaagagaaucuugagcccaguggucgagugcugaagcaguguggcccuuugugggaggaggguggcaguggugccagaaucuuuggaaaucagggcuuaaaugaaggcaggaccgaaaacaauaaggcacaggccagcccuagugaagaaaacaaagcaaauaaaaaccagcucgcaaagguauguaagaugggguugaaugggcagguggugggcagguguaauucuguggcaguggugguagcuugagauuaauuuuauuuguauuuuccuucugauuuauaaaaguaguguggaaaaucuggggaaugcauaaagcuacaucaagaagcagaaugaccucacuuauccuguuugguguaugccgugacaguuggaaggaaauacacccugaaauuguccucaguguacaaaugaaaagccuccuuuucccaccuaacauuacuguacaugugggcucuucccauguuuauccauguuuuuuauaaaugccaugaucugcaaugaacaccuuuguguauaaaucuuugguuuuugcauuauuuucuugaauaaagucccagaagaggaaugaacagguuaaaggucauggauacaugaaucuuuuaaaggcuuuugguaaauugucacgugcuucccagaaagguacaucucccucccugcccuucacucccacaaguaguaugugacaucuuccauuuuacugaauuuggaaucauuuuaaagauuuucaccaagaaguucugagcucaaaaugccacaguguaaaaagccacagcagaggcagagaugcaauaagcuucugaggauuuugucagaauuaccuggggcauuaaauuauguggggaaaaauguucucugacacguuuguuuguuaccaacucuugcuggaugagggcugguuucuuuaagagaagaauggaauugauuuuguuugcuaguucagcaaggaaauauaaauuuaaaugcaaauuugagcagcaguggacaguaaaucaucuuuggcgucuuagauugguuuucccuguuccugcugaaaagcaaucugugcccuuugccaccaucucccuucuagcagguggcagcuugagucccccgugcuuccuacucaccaccauggccuucucucucaggucacaaacaaacagaggcgagaacagcaguggauggagaagaagaagcggcaggaggagaggcaccgccacaaagcccuggagagcagagguagccacagggacaauaacagaagcgaagcagaggcgaacacgcaggucaccuuggugaagaccuucgccgcucucaacaucugacucuuuggccucuugggaguuguaagaagcggcuggaaaaggauugcugugugcuagacuuuccagugaggccguccuuuuauaaaacgcaacacaaccaacgaagcccacacaugagcucacacacugaguuaguuucguucaagcugccucuuuuuuuguucgaaguuuuauuagugauauguugguguuuuaugaaaaugcagugaggccauucauauucuguaauacaaaauuaaaauacugaguuuuaggggcagauaguuaggucaggaaaaaccuuuuaagugguggcuuuauuugcccugaaaaucagacuucagugacccuaggaucuuuccuuaacauuuggggugaguuuugcuguaauuguucaugaguaguuuagaauaauuguuagaaauucagaaugacaaguuuccuuaguuucucuuucauucucaaacagauauauaggguagcuuauaaaugaucuccaacucaggaauaugcuuugauuuacuucuaauccaaguuacucagaaaauaauucaggaauuguuuucccaaaguuacgugaggguuguggccugcagucaggauggaaauuaaccgcauuucucuccuuccugauucugauguuauuucagaugggaugcaggugcuguuaguucauuugcacucaagccauaugauaaaugcagcugacuguuaauuaggccuggccuuguugggaaguugauagugguguuggguuuuugguauuuguuuccugacaguggggagauggcauguuacugcuugugauacaguucuggaauucugauaguguguagagcagggucuauaguuguaacaggagacgaacuccugggguuuugccuaagaggagucuaaagaauuauguuuuuauaggagaagccuggaagaauaagguuuuuc

SEQ ID NO: 14193 - RNA, 900 nt, Homo sapiens
ugcgaggcggggcggggcgcggcgcugcgcggcgcggcugccgggaguccccggcacggguugcgggccggggcggaaaggucuccuggcugucugagguccaguccccgacucugggccugcagcagcgaguggcggcgagggaaccgcaccccacaguccccgcgggcggggaugcggaaggcaccgcggcugggaggggaccggcccuccgcgccccaccccgugcacgcgcucacuccugcggcgcacccggaacugccgccgagcgcggaccggcccggcccagcccaacccagcccaacccagcacugggggagcgcgccgggagcggggcaggagcccagcgcugccgcucgcuacggcaggaucuggagcgccgcgcugcaccugagcccgggcacgaauugaggagccucgggcugacgccauuuauucagcaccuacuaugugccaggccuuguuuaggcaccggaagauaacagauaagacauaaagaucccugccgguauagcugcagacagaauaucugugaggaugacacagguagagauuagaaaauuaaguucaacaggucggccgcgguggcucacgccuguaaucccagcacuuuggaaggccgaggcgggccaaggucaagagaucgagaccauccuggccaacauggugaaaccccguuucuacuaaaaauacaaaaauuagcugggcguggugguucgcuccuauagucccagcuacucgggaggcugaggcaggagaaucguuugaacccgggggcagagguugcagugagccaagaucgcgccacugcaccccagccuggcgacagagcaagacucugucucaaaagaaaaaaaauuaaguucaacaaaugcuagcuguuaugaguacuguugaaug

SEQ ID NO: 14194 - RNA, 22275 nt, Homo sapiens
ggggaggagcgcggaggcaguugggggcggggacaacaggcgcggccccagcggcgccuccaggcccggucagcccagcgcgcggcgugggggcggggccugcgguucccgcgggggcgguggcgcgcggucagcugacccggcgggccuugacccagaagcugggcccuggcggcggaucuggacguggugagccggaccgggggcagguggcaaacuucacggcugggggucggggcuccugggcuucccugccacauccuuccagcccucuccuccggccgcuggacugucccggcuccugcgcccuccuuguggcgcgauaucgugggacgaggcuccgggccgggacuggguggcccucgggaauccgcagccaguggccccccaccucaaaggcgaccagcgcggccucucgagcuggccuggccaggaguugcccugccccggccgaccggccccuuggcaucugauggcuucguuuuucccgggccggccgggcgaggggcccucgcggcgcuggccccagcagcuguccuaucauuaucccuccaaacaggcggcccgcgccgggcugagucaccaggagggagcuguggccgaggacgccgaggccuggagugggugguagccccgagcugggacgcuccucccuccacaaucuccccaggucugcagggaccgagggccuacacugccuccucccacgccgugcuuaggguagguuuccaaacguguaaauggagagucugagucuggaagugugaggggucccgggccugggucacaggucaugucuaaucaacgcuuacugaaggcgccugugugcccggacgcuggaggggcuacaaugagaacaaauaauagucauuuugggcuguugguguugagugccagugccaggcacccuuguaaucgcuuggccuggauugucucauuuaacucugcagucagccuaggugguggguauugcauuauuccccuacuuuucagaugagaacuacgaagcucaaucacuugaguuccagacugguaggcaucgggcaggucuguuccagagugcuuuucuccucaacccugggcuguucgagcucacagcuuucuccccuuccuuucuccuuuccuuccucuucucucucuuccacccuuucuccuuucucacccguuuccucucuucuucacucuguccuucucucuaccucucucuuucucucacugucucucaacauuugcugaaccucuagguguguuuacaccuggagaauaagaaaugcacaacccaggguggggagaguacguuucaaagacaguggucgcagaggacggugguagcguucuucagguguguggacaaggggagaggaggagguggaagguccuguccagccagcucucauggggcaucuuugaaagggcaauuuagaagugagucuucuuaucucaugaccaggcccuugaaggggagcaggacacuucuaggggaagagauggcacgugcagaagccuggagaccugaaaugacugaagacgugggucaggaggcaggagauaagguugggagggcaguucuuggaguaacuugaggccuagccucagguaauuuggacuucauccuguagacaaagguggacacaugauuggcugugaucaugugcccgaagcacccugacucagcuugggaucagggagaggaguuuggguguggcaggagaugucaucuccagcccaaccuuucucaaagugcacuagauggagcagaaucgcuggagggcuucuuaaacccagaaucucuaagccccagcccaggugcacugacuccaaauuuugaacaugcacccuccaagggugauuccaggguaccgcuucugggguccuucccaucccugcaggugaggucaagcuccauugcaaccuuggacauccauuugcucagagcuguuugaacaggaugugggcccaugccuggcuucuaggugacaggaacuacgcaggauggcccucagagccaggccuuucuguucagggaucaggugugucucagagugucccgagcuccacauugcacauggguccuguccaaggucagggggacacccacccaguauccuggauccauaaaccaagguaccuuccucaagacaacuccccaacacgcacgcauacuggggugcauccauuucauuuccuccuuaaccuagggaaagggggaagugagagagaggccgcaggggccauaaaccaagguaccuuccucgagacaaccccccaacacacacaugcugagauguguccauuucauuuccucccuaaccuggggaaagggggaaaugagagggagaguccccaaggugguugagaugcuggacucucauccugaaaacagucgcugccauguguugucaggcacagggcugagagcuuuaugugcauuuagucagggcagcugccccaaggagugagugucguuagccccauuuuauggacaggcucaggcagguuaauucacuuccagggcugcucagccucaccugucaaaugagcacaguauacccaaccuugcuggggaguggugaggauggcaguggaugagcugcagccuuguguucagacucugcaagggggugugggggugcaccccaguuggcagugguggcugagaacaugaggacuugauuugaaaugccuuuggccuugcaaacguguaguucucaccuggacuauaugguuuuuuuuuuguuuguuuguguuuuguuuuguuuuugagagucuugcucugucacccaguuggagugcaauggcgcgaucucagcucacugcaaccucugccuccuggguucaagugauucuccugccucagccuccugaguagcugggauuacaggcacgcacccaccacgccuggcuaauuuuuguauuuuugauagagaugguguuucaccauguuggccaggcuguucuccagcuccugagcucaagugauccaacugccuuggccucccaaagugcugggauuacaggugugaaccacugcgcccggccacaccuggacuauauguuaauuuggaguggccuuucaggggccggagauggagcaucaggugaaggcuuccaacaucaucugugcugauggucccccaggugggccacgaagacacagggaagaggcuuucagccucccugccugugccaggcccuggagguaguccagugagcugggcugacagugaccuggggcacccuuaccuuuagguccagggucucugcccacagcgagucacauuagggcugagggucuacggcuuccugagaggaggugcugacucacuuccuuucccucccggugcucccuggucucuguguccucagcaguuccguggggccagccagggacuagcuggggagcccaggccuccugacacaagugggaaugaaggcagcuagagacagcccccaccuggaugaggaaauccccucugagcacagggaaaaaagaggaagcccacuuucuggcugugcagucaugccagaccacagaggcuucucugucucucucucucccucccucucucccucucucucucucgagccacagaagucuucugcuucgcuggugacagauggaccugaggcgggugguguggcagguggcuaugagcagggguguaggucugagucuuggguuugacucuguaguuuccuggcuggguggcgcuggcacaucacuuccgcacucuggcucaggcuccuuguggauaucagugguccccacuucauaguugcugggaagaugcaacaugagugcaugcaggaugcuuggcucaccgguccgagcuguggugaugaucacugauggagauggcccagccgagccucacuuucccucccuccucuaaggugucacgcaggcaaugacugcucuacucacuguccagggugcccggguagcgggagaggccugcccugcccaccccugcgaucagccauauucuggcuuugucauugugacgguggggagguggcuguggacucccugcuguuaggcaucccccccacacucugugagcuccugggagaauacaggcugcaucgucccaaacuugaguccuugucauucaugcaaccccggggaucccuugcuccucuucuccacuugccucaucuguguggggcaacucuuuaugguuuguguguguguguguguguguguguguguguguguguguguuuucuuuuaagacaggguucagcucugucgcccaggcuggagugcaguggcaugaucauggcuugcucugcaaccuccacuuccugggcucaagcgauucuuccaccucagccuccugaguagcuagcugggacuacaagcgugugccaccacaccuggcuaauuuuugaauuuuucauggagacagcguugcccagccuguucucgaacuccugggcucaaguaaucuuucccaccucagccuccuagagugcuggcacagugcccagcccuuauuuuguuguuguuuugacacagggucuugcucugucauccaggcuggagugcauuggugugaucauggcucucuauagccuguaccuccugggcucaagugauccucccaccucagccuccugaguagcuuggaccagaggugcacaccaccauguuuggcuaauuuuuguauuucuuuucuuuucuuuuucuuucuuucuuucuuucuuuuuuuuuuuagagggagucuugcucugucaccucuuuuuuuuuuuuuuuuuuuuuuugagauggggucuuguuauguugcccaggcugccaggcuggucucagucucuugggcucaagcuguccucccgccuuggccucccaaauuguggggauuaccggcaugagccaucauucguggcuacaaccugcuuuaaauuagaugaacuugaugggccuggccucagcagauccuuagagaguaauuuacaauaauaacaagaaauuaggaauacccuaaguguucaagagucauaggaaaagguaacaucgagggcucaguucaacacacuguguaugaacucacugaacccacacaacagcuguaugugggaggcagcacugugaugaccccauuuacagaugagagggcucaggcacagaaaggcugagucuuugcccaaagucuagcaugaaugggugaugaagcagggauuugaacacacccgucccuucugcagauccagcacgcugccugcaugugucuguaguuggcguguguuugcugugaucugugcaccugggagcugauuggguccuggugggugaagauuaugucuuugcccuucucuggcucagggccaggagccccgugaaaaggcugggaugagcuuaguuugggaugaccaugaauaggaccuggaccucccagugcugaaagccuccucccuuccucccuguagaacccuugcuggccucagaacaccagcgcccucccuccggugcagcccugccuggccgggggccccuccuccacagccauggucuggaagaaacugggcucccgcaacuucuccagcugccccaguggcuccauccaguggauaugggauguguugggugaaugugcccaggacggcugggacgaggccagcgugggccugggcuugaucuccauucucugcuuugcugcaucuaccuucccgugaguagugucuugguggcaggaccagggcagggcugugggguugaggcaguggcuccagcuacugcucagcgagggguugucuggugggccacgggccucuccagacuagaggcugggguguguucccucgacagggaccugcacugauugcuaccgcaggucagaccuagugcugggcagugcugauacagagaucaucaccuuugcaacaguuuauugagugcccaccauauaccuggcuugcuucuaagcacuugccauauuucuaccucauuuaauccucacaacaaccuugugaaacagggacaguuaccauccaucuauuuuauagaugagggauccaaaacccagagaaguuaagcaauuugcuuuaggucacacagcuggucagagauggggcgggagagugggagggcugggaugcgucaaacacaaccucuguccuccagacuuugacagucucgugguggagacagcagcagugaacacaacauuguguggccgcugccaugaucagggagugaggacaugcugcacaggggucaagagcaucuugaccugggcgugucaccucacugcucugagccucaguuuccuugcuugugucauggaaauauuguuaccuaacuagaugguugcugugaggauggcaugaggguguguagggagagcugcccacucagggccuucacacaauguuugcacaagccugaaagcugucaguggugacacugcuaguauuucauuacaugaagcacagaagagggacacccaccugaucugcagaggcggaagaagauuacagucaggaaggaccuggaggccaggcacaauggcucacgccuguaaucccagcacuuugggaggccgaggcaggaggaucacuugaggucgggaguuugagaccagccuggccaacacagugagacccccaucucuaccaaaaaaaaaaaaaaaauuaaaauuaaaaacaaaaaagaagggaguuggagguguuggccucuaggcuaaaagccaaggauaggacagcauugggggugagagccaggggcugaguguggaagagcaguucaggcagaggaagcagcagauguacagagaaggggcagcugcguuuauauaguggacagagugugugggggucagggaagggagaggugaggucacaggagucaucaaaggcccuguggccuaagcggcaugcucugcucuuaagaaaugugcucuuuauccuaagggauaaagacaaggguuugaucaggggcuugacauuguuuuaacagcuuuauugggagagaauucgcauuucaugcaauuaacccauucaguguacagucauugguuuuaguauagccagaguuguguaacugucaccacaacuaauuuuaggacauuuucguuagcccaaauggaaacccaugcccaucagcagucauucuucauuucucccggaaccucucagucccugccagccacuagucuacuuucugucucuguugauuugccuuuucuggacauuucaugauucauauaaauggaaucacacaggaccuguugugauuggcuucuuucacuuaacauaaugucuucaagauucauccaugucauagcauguaucagaucaguacuucaguccuuuuuguggccgaauacuguuuuacucuguguauagcacauuugguuauccauucauccauugauggacauuggguuguuucuacuuuguagccauuaugauuaauguugcugugcacauucauguuuuuuuuuuuuuuuugccuggugcaguggcucacaccuguaaugcuagcacuuugggaggcuaaggcgggcagaucgccugagggcaggaguucaagaccggccuggccaacauggugaaacuccaucucuacuaaaaauacaaaaauuagcggggugugguggcgcgugccuguggucccagcuacucgggaggcugaggcaggggaauugcuugagcccaccaggcagaggcugcagugagccaggauugcacuacugcacuccagccugggggacaagagagagucuccgucucuuuucuuuuugagacaaggucucacucuggucccccaggcuggagugcgguggugcaaucuuggcucacugcagccucugccuggcgugcucaagagauuccccugccucagccucccgaguagcugggaauacaggcaugcgccaccaugccuggcuaauuuauguauauauuuuugguagagcuggggcuucaccauguugcccaggcuggucuugaacuccugagcucaagugauccuccucccucagcauuccaaagugcugggauuauagguaugagccauggugcccgaccuucagguaugaguuuuuguggggaaauauguuuuuauuucucuugaguauauaccuaggaguagaauuucuggguccuauguuaacucuaaguuuagccuuuugaggauuugucagacuguuuuucaaagcagcugcaucauuuuacuuucccaccaaaagcauaugaaggcuccaguuucuccaaauccuccucaacacugguggccugucuuuuuuuuuuuuuuuuuuuuuuugacagucucgcucugucgcccaggcuggagagcgguggugcgaucucggcucacugcaagcucugccuuccggguucacgccauucuccugccucagccucccgaguagcugggacuacaggcaccugccaccacgccuggcuaauuuuuuguauuuuuuuaguagagacgggguuucaccguguuagccaggauggucucgauuuccugaccuugugauccgcccgccuuggccucccaaagugcugggauuacaggcgugagccaccgcaccuggccucacuucuuuuuuuuugagacguagucuugcucuguugcccaggcuggagugcagcagugcaaucuuggcucacuguaaccucugccucccggguucaagcgauucuccugccucagccuccugaggagcugggacuacaggcgccucccaccacacucagcuaauuuuuguauuuuuaguagagacaggguuacaccauguuggccaggcuggucucaaacuccugaucucaggugaucugccugccucagccucccaaagugcugagauuacaacugugaaccacccugcucggccgucuuuucacuuucuugaugguguccuuugaagcauaaaaauuuuaaauuuugaugauguccaguuuauuuuuucucuuuuguuucuugugguuuuggugucauaucuaagaaaccacugccaaaugcagauaacaaagauuuauccuuaucucuucuuuuuuuuuuuuuuuuuuuuuugagacacggucauacucugucccccaggcuggagugcaguagugugaucacauagcucauugcaaccuugaccuucugcgcucaagcaguccucccaccucagccucuugaguaacugggaccacagacgugcaccacuaaaccuugcuaauugaaauuuuuuuuuuugguagagacaaggucucacuguauuguccaggcuggucucaaacuccuagauuuaagcaauccuccugucucagccuccaaaguguugggguucaagcaugagccauugugcccagcaucucuuguucuaaguguuacaaagauguaacucuuacauuuagguguuugauccauuuuguaaaugaugugaaguaggaguccaaccucauuuuuuuuuuuuuucuugagacacagucuugcucuguuguucaggcuggagugcaguggugcgaucucagcucacugcaacauccuccucuugggcugaagugauucuccuaccucagccuccugaguagcugggauuacaagcaugugccaccaugccuggcaaauuuuugcauuuuuaguaaagaugggguuucaccauguuggcuaggcuggucucgaacucgugaccucagguggucuaccugccucagccuccaaaagugcugggauuacaggcaugagccaccacacauguggauauccacuugucccagcgccagguguuggaaagacuguccuuccccauugauuucucugggcacccuaucagaggcuugauguuuuuacugaguuaccuuguuccaggugccuguuggguguggugcaaguaagcuaaacagacacuguccuugccuuuggagagcuuccauucugguacccuugaaaagauaaucugggagugacggggaggaaggagcagagugacagagagagaguggaggcagggaggccaccuuggaggcuguggaagccuucagcaagcaucagugguggggggauuggagaggcccucaccagacagacuggacggguguaggugacugauggggccgggggcgggaggcucccuguccaggggugagagcuuccucaggacuauccgaguugcuggcugaggaucccccuuucugccugggcugguugauuaaccagggaggggauuggaggccugggagagagcccuaagugauggagagaggguggcugccccccuggucuucccuaggacucagucucuccugagugggacagaaucacuuuccugcaauugaugaagacaagucgagucauagcaucuuaggaggagcuuuacuguaagggauaaaccuugauuaagggccuucucagugcugggccuaugcuagucacucccccuguccucaggaaacuugagggaaucugggagggacggggaugucaaguguuucaaaggaggaaggagaagaugccagcggagcucgugucggggaggcccagaggaggaaccgacauuuccugagacgggaaagaugacuccgaggucucugggccugaggaggggugagcgggacaucugagaccagagcugggaggaagagagccauccuggggcggcgagccuggggccuugcaaggauccccucacagaaugggggccuuuauccaagagcacuggaaggcucuggcaguuuuuggugacacugggguuuuaguuuuuuauuuguuauuaaagacaauuuuuuuuuuuuuugagacaaggucucacugugucauccagucugaagugcaguggugcauucauaacucacugcagccucaaccucuugggcucaagugauccucccaccucagccucuugaguagcugggaccacagguccccacuccacacuuggcuaauuuuuuuuuuugguagagacagggucuugcuguguugcccaggcuggucuugaacuuguaggcucaagugauucucuugccucagccuccugaagugcugggauuacaggugugagcuaccacacccagccuccaaaguguugggauuauaggcauaagccacugcuucuggcugagauggggguuuuagaaagauuucugaaagggaggaugaaagauuucugaaaggagggaggcuuguuaggaggcugagggaggcagguggaaggacucgcugugggaagaaugccgguuucuuaguuucuggcuuggauaauggaugggaugagcugccauuuaguuaguuaguuucuuuguuucuuuuuauuuucuuuuuugagacagggucuugcucuguugcccaggcuggagugcaguggugugaucucggcuuacugcaaccuccaccuccuggcuucaagcaauucucaucccucagccuccugaacagcugggauuacaggcgugcgccaccaugccuggcugauuuuuguauuuuugguagagaugggguuucaccauguuggccaggcuggucucgaacuucuggccucaagugauccacccuccucaaccucccaaaguguugggauugcaggugugagccaaccgugucuggccaccauuuaguuucuuucugucugucuguuuuccuucaugcaugcaggugguuaaagagaaacuggaacaguaaauggcaguauguauaaugguuaagagcaagaccggaggcucagguagggguugaauccgagugguauggcacggcuuccuccaggcccagugaggaggucaucgugguagacuggacagcacaggugucuugaggacagaaugagucaacacacaugcagagggcucagaacugcccugggccuuagugccaccgccagcuuuggccucguacccacaccuggccagaaguccuaagagggucccagcaccaaggaccuuugggaaaacaaccaggggaccaaaagccuacuaccuugauaguggagcuccaggcgccucagccccgcccuucucuguugcccucuaaagagaacugggcugggguucugccugucuuggcuacagcugcuccuggagacccggcgugcccaggccuucggcccgcacgucccuuucccagcacuguucuuguugcaaugcccuucccugcauccacaggagaaaggauccaggguucuaugcagcgguugucagggcccaacacaaaacuucaggacccuacauaagccccagauccccacuggagaccccagggugugguagaggagaaucugaguaaggcugcggcuuucccuggagagaugcacagccguagaguccucggcuuagaagggauuccccaggggacuccuccaaagggccgagaaggcuucugaggaucccgcccguggggaggaugggccgccaggccacuuccucuccaucgccgccucgauccccauggucgucuccucugggcgguguccccuauaaggcggcauccccuguaagguggccugagcaugcaucccuuccucuuccucuuccacagccaguucaucaaagccuacaagacgggcaacauggaccaggcgcugucccugugguuccuccugggcuggauuggcggagacuccugcaaccucaucggcuccuuccuugcugaccagcugccccugcaggugggccgguacccgggcaagguggcgcuaccccuaacccugcuucacccugcaggguugccugaggagaugccaggcucuuuggcccgccuggucuccagaacccugacccgucauuccaucuugugggagggccccauccuucugucugccgaacugugacugugggcaggucacugcucuucucugggccucaguuuccccaucugcaauaugagcaugucuaacaggaagguuucggggucuuccaccuccagggugcuggagugcuggcgaagcuuucagagggugggccccucgaggagaaagggaguuuuuccgugggaggcccagaugccauccugcuccugugggcaggcagagcuggggcucccaaucaggaaggcauugucuucccaugugggaccagaaaguucugacugcccuggugucaggccaaaccagagccaucacuucaccgcggagucccacuuuguccugacugcuagcgcugaccaccagcucauuggccccuccugggcuagauccuuuccugggucuuucgcccaccuguucugucauucugccaggugggaacugggaguucuuccuugccagauaaggaaacagaagcucagagaggagaagugacuugguccgggucacccagcugggauaugacagagggcugccggggcguggucucagauccugggacugcgccaaccccugggcccccugcaucucuuacagaccuacacggcuguguauuaugucuuggcagaccuggugaugcugacgcuguacuuuuacuacaaguucaggacgcgccccucucugugugaguauggggaccgcucucugucagaugcucuaccagcagcagggggcaguugugggggggggcgccuggagugugggaggaagcggguuucccauggcugggugauaacccaaaccucggaaagccuuccccgggccuuaucuaagagccugagccuuaacuggccaagauagaggcuugagggcagugagcgcguccuggcccagaccacaggccgguuccucucgcccaggggcucauucagcagacacagcuccagcuccuccucuguguccggcccugggcuuggagcuggggaaacgagggcaagucacacaggcugccucugccccagccuucaggaggagcaggagacaaggucagcuugaggcuauacagacacggggagggaccuggggaggaaguugucucaucagcguuccugcuucguguaacccccuccugaccucccugcccucagcguuucaccuuuauaacucuaggagaaggguacuguuguuguacccauucgacagaugaagaaugaaagcucagagagguuaggucacuugcccaaggucacacagccccugaggggcaaggccaggacuuagcacccucccccgacaaccgcugccacucagccaucuaaccucagcuucccccugccuugugugcagugucugcccccaucaacuccgugcuguuguuccucauggggauggcgugcgccacaccgcugcugagugcugcugggcccguggcugccccuagggaagccuuccgggggcgggcgcuccuguccguggagucgggcagcaaggugaggcgugggcguggcggucgaagggauggaggcuggcucauccccagggcucuccccugcacagccucaugggugcuaaauggggugggggaucaccucuggcuccuacgagacaccaagugcccccuucugccccacagcccuucacccggcaggaagucauuggcuucgucaucggcuccaucuccagcguguuguaccugcuuucccggcugccucagauccgcaccaacgugagccuccagcaggggcuggguggggccgaguagaggagagcuggccuggccacccgggcccucugggcuaaggaguagcacagcauaggagccuugguucagaaagucuggucuacucccgcuguuggcuugggcaaguuaauccaaucuccgagccuccauuucugcuucuggaaaaugggcguggcguggccugccagccaggcuacaagaggcccaugugugucuugggggagugggaggucaggggaaggugaggggcugagcuuggaggccugaggggagaggagaagcuggggagucggggaggggaggcuugcugggcagcuagagccugugugggguggaaugcagggugguguggggccacaggccuggcacagccacggucucccguggaccugggcaggggccugggggggcuugucugugggugggaggaggcucuucugugugucgggcccauaucccugggcacccagggaaagauuggcucagagcaggugcacugugguggggcagguggacauguggacaguuacaauccagagugacaagaggccuguucgaggucucugaccugaccuccuccugccccaguuccuccggaaguccacccaggggaucuccuacucucuguucgcgcuggugaugcuggggaacacgcuguaugggcugagcgugcugcucaaaaaccccgaggagggccagagcgagggcagcuaccugcugcaccaccugcccuggcuugugggcagccugggcgugcugcugcucgacaccaucguauccuucagggcguguggggcagguggcggggugugggcaaggaagcuucugccugcacacagcgucagcacucauccgucucuuccucccuucauccauccguccauccauccaucccucccucccucccucccucccuccaucuguucacccagucgugcacaccuccugugugccaggcacccagcuggacccuggagccgugagugagcaagaacagccaugagugccccagaagcuuacagcccagcggggcgcagagaggacacaacgcuaucaucaaagaauuacuucauugcaguggcaccaagugcugcagagaaaaacaacaagagcgucuagccagggaccguccugguuagaggggcagcaaaggccccuauaagucucauugaaccugugacuugacagaguaggagaagucaggcgaaggcaggagaggaauguucuaggcugugcagacgagagcuggaguguggagagacacaugacuuggucagacaaaccuggguucaaauccuggcuccuccccugcuuccuagcugugugacgcagggcacacagucaaccucucugugcugccgugucuucaccucaguuaacagccacugucucgucaggauguuguguaagaugagguaucuggaaacacuccccacaggaccccguuuucagugagggcucagaaaguguuugcugaauggcuguaaagagcguuaccugggucucauuucggagcaaguaaacauggccuuuguuuuaauauuuguuaagucccugccgggcgcagggaggggugaaaguuuaggcucuugugccccaaaacggcccagccaccuggaagccuccaggacgccacagcugagagcaagcgaagauccugggccagggucaagggaggcugcccacgggaaggagaagucagugcuaggcuuggagacagauggagcuuggcuagggcuugaggagccgggcagaaguucugaguggagggcacagcuaagguagcggcugggagguuauggcuggcccuucccaccugcagcgugggggugggagggaggggagagggaggcagcucccaggagucgaaggcccccaggggcagguccaacccagucucugcucagcuuggccuuaacggcggcacccccagaucuccauccaguuccugguguacaggcgcagcaccgccgccucggagcuugagccccuccuccccagcugaccagaaccaggcugagcgcaggaggacaggcaccaccggaugccacaccaggcaggaggagguguggacagugaugguacggcggcccugcaucagccugcggguggccucuggauccuccguggaccgaaccguccccccaggaacacaccuucagguagaccccgaagccucaaggccggggcuggagcggagaccccagggccucucaggagacagugaggcugccccuccuaccaccuaccucauucugccuacucaccccaggggccacagccacagccugcuggacucaggacuguccugucaacuccagacaacugaauaaacaggccggguacaguggcucgcaccuguaauccuagcacuuugggaggccgaagcggguggaccacuugacguccguaguucgagaccagccuggccaacauggugaaaccccaucucuacuaaaaauacaaaaauuagccaggugugguggcacacaucuguagucccagcuacuugggaggcugaggcaggagaacuguuugaaccugggagacagagguugcggugaaccgagaucgugccacuguacuccagccugggugacagagugagacuccgucucaaaaaaauaaaaaagauaaccgaggaaacgguaccuccccaugagaccugcuucuguugcuccuuccccaaggugcugagggaucggggcugcuuuggggaccagcgguggauguggauggggauucaggacgagcugagcagaggggaccgcaucugccugcagcccuggcccagccuccuggggccucugguuucuuuagccugcuucuccgggcccuuuccugacaggccccacaccuuacuguggggacauagcagggagagugacuccccacggggagccugccccucgguguucaggaagaagcagaaugguuaagguucuguuggaucuggguucuccaucgcaguuccucagugccuagcuuaucucaucugugaaauggacaguacugucauuuccuguguccuuucaaggauuacauaagaugcugacauuauggaguuuagccccagaucuggcgcauaguaagggcucaauaaagguuaguuuugaggacuuuuaguuggagaagaggagcaaccagaucuuggagaucagggagagccuccuggaggaggugauaggucagaaggaugagcgggagauaucacagggaaagagggaggauugaaggcaggaggaagaaguggcggguacaggagcaaggugggagaguggagaggagggcagagcugagcuccgagugcuuccuggacccgcaaacucaguguuguccagacccuguuuuauuuuuaaaauuuuuuagcccaggccggaguacaguggugcgaucauagcucacugcagccucgaacuccuagcuuccagggauccucccacucagccucccgaggagcugggacuacagaugagcaccaccaugccuggcuccagacccuguucugauuccacuuuccugggggucaugacccucaggugccuggagcacagagacgccagcuccccaccuuguuggccugaucucaccccacacacccaacccuagcuguggaaaaccagaaccagggacuugggguaucuggugggguagucuuggggagagacgcugcgucccagagugggccuugccuuuaggaucucccuucccagccccggagaagggaaacggugccauggccauucuggugccgcagauccuuugugagcacagcccuccacucagccuuugcugugucagacaccggggcuguggugaaccagcuccaaggcccugccuuccaggagaggagaugguuaccaugaccagaagguagaaaugucaggaaaugagcagaugagaccagccccaggagggucaaucagggaggacuucucagaggaguggccuuugagcuggaucuugaaggcagaggggagggcaguucaggaaaagggaggggcagguacagaggccuggaggugggugucucgggugcuuccaagguggggcugcuuacaaggagccuugaaagccacaccaaugccaaggacaagguccuggggcacacccagcagcagcccagcagcaggugaugggguuuggucgggugaagagccuuuugcuagagagaggaggcaaggcacaccucugagacccaggugggcagagagggccagucuccccugcccugucccccuaggggacacccacggagcccaggaugccaucuggcaugcagcuguuaguugcacacuugccaugugcgggcugcgccgccugccaucagugcacgagaucuccccgucuucacagccagcucugagaugggggaguuuuuauuuuuuuuugacacagagucuugcucugccgcccaagcuggagugcaauggugcgaucucagcucacugcaaccuccgccucccggguucgagcgauucuccugccucaaccucccaaguagcugggauuacaggcgccugccgccacgcucagcuaauuuuuguauuuuuaguagagacgggguuucaccauguuggccaggcuggucucgaacuccuuaccucaggugaucugcuugccucagccucucaaagugcugggauuacaggugugccaccgcgcccggccaagaugggaguauuuuuauggccauuuuacagaugggagaacagucucagcacaauugagcagcuugcccagcuaggagcagcagcaacacgagacccuccagcuuugggagccaccccacaccuggccaacgcuggcggcccguguccccuuccuccauccuugcugggggcccauggcuuguggcaguucagcuucacccucaggaguggcccgaacccugcuggacccaggcucccuucucaccauccugaauagcgacuuugcugagccucuggcccugccgagauuucaggauaaguuacccccaggcccgaagccccagcuugcccuggccugugccugccucaggugccagcuagaugucucgcuccaccugggucugggaccuggcuccacaccaguuaccugggaccaguaggugcccuuccagccugaagaucugggggcacaguauagccacaugagccccaagugugguccugaacuggggccggguggggaagagugagaugggauaacauagccccugcuuggaggcccuucucugauggggugacauaaucccuuccuccugggaaacaccagcuuuuggggugauagcacuuucaggcaggagcuaugguuccuuccucaggaggccuccaaucugauggggaagacauggccccucccccuggggagugcccugugugauggaggcgauacagccccuaccuucagagagcaccuggccugcagcucauccaaaccugagucuccucucccuuggaggccucauuccagcgccccaaggaggauucaaacuguuggggcuggaagaacuugguggccugggucccuggagcccuguugaaggagcuggugacauucugaugcuggaggcaggugacggggagcacagacuuuguguccugcacacugagcuccaagugugccccagccacugagccuugugacuugagcagauguccgaagccguuucuucaucccaugagaccaacaacacugucugccucagaacauagccgugaucaagaugagcacggaggcucgugucccagcaccuggcacacaguaagugccugguaaauaaacaauggcuauauuugcuugucaucagggggcuuaccaaugccuggaaccucccccagguuccucacaaagagaagggccaaggccgggugcagugguucacgccuguauucccagcauuuugggaggcugaggcaggaggaucacuugagccaaggaguucaagaccaacuugggcaacauagcaagaccccaucucuacaaaaauuuaaaaaauuacaauaaaggcgaaucucaucgaugggauucugccauacugauggggccguguuugcugauggugggcaaacauguuaccaaguuaaacgccuccacagguggcuucccuuucucccuggcuuacaccuccugcuccuuccugcaggucaugggauggcaggaugcuugucuccagguguggccugaagggaaaaguguggacaguuuggugugaucaaggaaauggaaccacgcuuaccaguugcccuuguccaggaagggcuggcucccuuaggacgcccacauggagcaugagguugggccaggcacccccagagguccccgccuuggcagguucuguuuuaccuguugaacgagacacuguauggggaagugacaugcgcagugccuggcccagugcugugcacacacgcugcuucgcuuccucagguuccggggaugggaugggacagaaaagcugguugcuuagcugguggcguucuccagcaaagcagaagggaugguccuggcagcccugugccgagcacuggaccccgcgcccucccuggcucucucagccccaaggucccauuaguuaucaaaccugguuuuuuguuuuuguuuugagacagagucacuccgucacccaggcuggagugcagugguacgaucuuggcuuacugcagccuccaccuccugggcucaagugauccucccacuugagugccaccacgcccagcuaguuuuuguauuuuugguagagaugggguuucgccauguugcccagcaggcuguucucaaacuccuaagcucaagugauccucccaccucagccucccaaauuugcugggauuccaggguuuugaagccacagccaagacgacauggccuuccauuccugaagccgaggaaggggagaaagccacaaccuucaccacucuccacccuuucugucugugugacuuggcuuucaucggagcugaaugacgggaccccagaggugccgggugacagccaggugcagagccucaacuaccccagaugguaaagcuuuaaacugauccacuggccaggugaggcgacucaugccuggaaucccaacacuuugggaggcugaggcagguggauugcguaagcugaguucaagaccagccugggcaacgugguggugugcaccuguagaccuagcuaccugggagguuaaggugggaggauugcuugggcccuggaggucaaggcugcagugagucaagacagcaccacugcacuccagccugggugacagagaccuugucucaaacaaaacaaaacaaaacaaaacaaaacaaaacaaaacacaggaaaaccuggaucugcuuagcauuggcccuagggcagggaguggguuaccuuccaccguggauuaacucaguucaacugauaacuacuccuccaggcccccagccugggacagcccuggggacacagucacccaguagcagcacugugcccagcacagguaagcacucaauaaugacgacgguuacuaaguacuccacccccaccaaacaguaggcagagacugucucuccuguuggccaucauaaccccaguacucaguaggcgcugaauguuuggugaaugaguaagugaagggaaagcugaggcaccaacccucagggagcccucagucugguggauguaaccaacaaccacagaacuacagaacuguauacuuuagauacaugaauugugugguaugugaauuauaucucaaagccauuugaaaaaauaccaaaugugccauuaagauuuggaugggaaguuauggguaaugagaauauaaugacaucuugcaacauu

SEQ ID NO: 14195 - RNA, 8318 nt, Homo sapiens
aacgcgcaggcgccgcugcuaugcugagugccgcgucucgcguagucucccgcgccgccguccacugcgcgcuucgcucuccgccgcccgaggcccgcgcgcucgccaugucccggccaccgccaccgcgggucgccucggugcugggcaccauggagauggggcgccgcauggacgcgcccgccagcgccgcggccgugcgcgccuuucuggagcgcggccacaccgaacuggacacggccuucauguacagcgacggccaguccgagaccauccugggcggccuggggcucgggcugggcgguggcgacugcagagguaacaguagcugcagauccuccccaugcaucguguagagcugagccuguccccagccgugcaccaccccgcucgggcccggccgcgggcagcaccgacggauucgucccucgcuccccaccccagguccaccccgcagcucugggaaccccgggacaacuagacagugcuuugcccugacuccuuucccccacucuccuucccuugggaguugcagcgcgagagucuccccccagccuggucugacccaucgcuucccaccuccauugaugcccccgccuccaaaccugccaggugcccacaaccgguccccacccaggcucucccccuuuucucuaccccuucguuaccaucaucacgcaugcacacccugggcacccuuuucucauccuggccuuuucuuaaccacuagaauuugaccugugcagcuggcaguaccucugccucucucagggagaacuguggcgaugccguaaggcuggcugggagaguaggaguguuagggagugcggacgggucaggguguagggacuuucuauccacucuaugccaggcuuugacuuggggccauaggagggaaagugauuccagcccuccacagggaguucagagucuaaugaggaagauugaaguaaugauugcuggagagcccagaagagagaguacuuuagggagcugcaggccggggagaggcacuagggaaggcucagcaaaugcuggauggagcucagccuuaaaggcucaaugguagguuggaggagaacaagagaaaggaacauuagagucugugcaaagacuugguuuggaaaugcaaugugcgugaugugugaaaggaaggccacugggcagguggggcuugaguggaggauggaggggacugucccucgugagccuggugcccuugauagcccuugggagggugccuggcacucagugagggcccagggaacgugggcuguuacccuuaccaugcuucacccacuggacuauccugaggcuguugcuccccaccccugaggagagguucucucuggguccuccugagucauagcgcuuggggggucggggggaaaagagggcaaaugugaaucucaggcccacgcuguuucuaguucaccuggcugcauguuguuguuuuuguuauuauuauuauuugagacggaaucuugcucugucacccaggguggagugcaauggcacgaucucagcucacugcaaccucugccucagccucccaaguaacugggauuacaggugcacacggccacgcccagcuaauuuuuguauuuuuaguagagaugggguuucaccauauuggccaggcuggucuucaacuccugaccucaagugaucugcccaccucagccucccaaagugcugggauuauagguguaagccaccacgcccggccacguuacauacuauuaauaaugaagauuuuguuccugaguugguuuuucuucucuaacccuuccccgcuuccgucuuuggggccaggagcucacugaaccaaaguccucaggccaggccugaggcacaguucaugccaagaaugccuggggcguuguggggaaauggagaaaaucuggaugagaaacuguggaacuuguucugucccauaucccaacugaucucgugacacccuucugagcuacugagcugacuuugcuaaguaugaaaagugcagaauccaucccccaaccaauccagacagcugggguucuuuuuuuuuguuuuguuuuuuguuuuuugacacagagucucacucugucgcccaggcuggagugcaguagcacaaucuggacucacugcaaccucugccucccagguucaagugauucuccugccucagccuccuaaguagcugggguuacaggcacgugccaccacgccuggcuaauuuuuguauuuuuaguagagacagaguuucaccauguuggccaaggcuggucucgaacuccugaccucaggugauccacccacuucagccuccgaaagugcugggauuacaggcgugagcuaccuuuccuggcccagcugggguucuuuuuuaauuuuuauuuuuguagagggagggucuugcuacauuguccaggauuaucucaaacucuugggcucaaguaauucucccuacucagccucccaaaguacucccaaacuagguuuacagacuugagccacuacaucuggaccaacagcugggguucuuuauaggggaaagaauagugcagaauuaacucauuuccaagcugcucggaugcagaacacuguugucauagcgaugugucccuacaguguuuggauauaugcucaugcuucugugagucaggaaggggaggggagaauuauaauuacauucugcucaguuugccuucuaagcucucaaguugaucucuaccacugggccacauuuauguggcugcuucgcuuuccuaaacucuuccaggccugcccccuugacuucuuucucuauacugcagccaagugugaacacaggugaccgguucacacccugacaaaaucuggaaugaucaaguucagauucagugggaugguauuuaagaacuuuugggaugaggucugucccugucucuuguccuacgucccacugcuccuugcucuagaauuuaugcucuuauaacuuagacuugaagguuuggagccucacauaguguuuuuuugccucuuugacuuugcauggguucccaugcucuggaguguacuuccugcucuuccuuguuggcugggacucugggagugauccccuagagaaagccuucccuggagucuccaaguuggcuucaugcaucucaucugggcuccuuggcaucgugugccuuucccuccugugcuuaccauauuguaccaucauccucuagggcuccaggagggcagagauccauuguguucaguucaucucugcauacucagucucuagugcaaggccuggcacagccagcagguuggugacuaaugauaguuauucuaauaggugaacauugagaacucacauauaugacauuauuuaauccccaggaccucccaaugaggacaguuugauuauuaucaccccauuuuacagaucauacaauugaggccaagagaauauuaguaauuuagccaggguuacaugguuagcaaauggcucuaauaggucacuuaaccauuccauucucucuccaagugaaaauugccaccaaggccaacccuugggauggaaaaucacuaaagccugacaguguccggucccagcuggagacgucauugaagaggcugcaguguccccaaguggaccucuucuaccuacacgcaccugaccacggcaccccgguggaagagacgcugcaugccugccagcggcugcaccaggaggugagggggcccuccgagcuccaaaggugggcuccugcuccuuucuuuauccugauccuacucaugagagcagaggcaccagggcagucccaggguggggcagggaauagccccauucccuggggccccacccuggccuccccuuccuggucugggcuacacugcguucugacuggagccucacccaugcagggcaaguucguggagcuuggccucuccaacuaugcuagcugggaaguggccgagaucuguacccucugcaagagcaauggcuggauccugcccacuguguaccaggugagggccggggcugcagaggccaaggucuccaggacuccugcuaauccugggcucucuuugccccccugacugcccccugugccgucugcauagcagccacuccccugcugaaagccugcagauggcucccauguacccucaggaugccauucaagcuccucagccuggccacugggcaucugcuuccuuccugccuaucugugcaccuuggacccuuccuuccccaccuccuuucauacuucagccuggaacacauuuccccugcccuccucccugggagaagcacucaggccuuacauagaggucuccuccucuggaagccuuucuagacagccccauaggagucuccagucuccaaaucucaucuucauacauucagcgaguacuuuccagcuccuuguuugauuguagaaccuaacuuuauuguaauuaacugccuuccuugucuauuuuuuuaaacuugaguaaacaucuccuggaagcagggauuuugugauaccuacuugugguuguaaccaguguccagcauggaguucauacagcagauauuuguggaaagauaccauuccacuucaauuuucuguccuugggcccaacaccuucccuccauccccuacuaacaguagugauguuagaauauugcugaaguccugggccgguguugcuuuagagguuugaaaguggaaggcaacaguuccuucucuugacauguccacccuguccccggggucccucucccugcagggcauguacaacgccaccacccggcagguggaaacggagcucuuccccugccucaggcacuuuggacugagguucuaugccuacaacccucuggcugguacguggagcauuccugacccugucucagccuauuccugacccacagaugcccagcccagaauuuaugaagcagggaggguuugacaagaggcugggcuguguucuucagccccuccugggucccugccccuccccuagaccagagcccugagggauguggcagcuucuggggcacucuggggccaggggcugauugcugccuucccgcagggggccugcugacuggcaaguacaaguaugaggacaaggacgggaaacagccugugggccgcuucuuugggaauagcugggcugagaccuacaggaaucggugagccgggggugggcuuggugaggauggcugggguggggucaaaucuauguggaaugaaguccugggcuguuccugagguaagaccuuccuuugcuguuugcaucuccuccccugcauugcuucaggaauucccaagcccucuguggguuuucuuguugucuugagaccucugggggggaaaugaggaucccuggauguuggggucuugaagucauagcucguuccugagcaaucaccugcugggaagcaaaaagcgagcccaggaugggccaggcaugguggcucacaccuguaaucccagcacuuugggacaccgaagugggaggguuacuugagcucaugaguucaagaccagccugggcaacauggucucuacaaaaaaaaaaugcaaaaaaguggucaggugugguggugcacaccugucuguagcccagcuacuuggaaggcugaggcaggaggauuacuugagucuaagagguugaggcugcagugagccauaaugaugccacugcacuccaguguaggcaacagaguaagaccauguaucaaaaagcaaaaagagagcccaggagggaauccugccccaucugagcagccuucgugucccuagggaagucccuaggcuacugaguccucaggaguaaagauccauugaggucucugcugaggggcccagcauccugggugguucugaugcccagcaaagugggagaccuaugacuagagaggacacccgccccucagggcugcagggugugggguggggcagugguccuggauggcuauuugguugcggcucccagugugacccccaugguacugaccccugugcuaacauccccucugcacagcuucuggaaggagcaccacuucgaggccauugcguugguggagaaggcccugcaggccgcauauggcgccagcgcccccagugugaccucggcugcccuccgguggauguaccaccacucacagcugcagguaaccagcgacccugggugcucagcuucuucccuuccagggggaccagcgucaccuuuaggugaagcccaaagcauuugauuucugaauuccucugaaauuuuucuuucuuccaauucucauaagcacucuucccacuggucuuugaugguaucugaguggaggcuuuguagugagggauuuucauuacagggauuuucuuauuccuuaggcuuucugaaguaugauuaucccaguguuauugaugaggaaaccgagguucacccagcuauuaaaguggcagacauuuuaacacagguuuaacuaagacccacccaucucacccuuuugguuucucucucuugaugccucaugucuuccugguuaaaacuuauuuccugaucaguggcagugacccacaccuguaauccagcacuuugggaggccgagaugggaggauugcuugaucucaagcauuugagucuagccugggcaagaaaaugggacccuaucucuacaacaaaucaaaaacauuagccagguugugauggcuugcuccuacguucccagcuacucuggaggcugggaugggaagauggcuugagccugggaggucaaggcugcagugagcugagauuacaccacugcaccuuagccugggugacaaagcaagacccugucuaaaaaaaacaagcaaacaacaaugaaaauaacagcaacaaacuuaucuccagcuucagccuuccauguugcauagugucuggcauauauccgguagauguucaguacgugggagcuguguuuuacauaaguuuucucauuccaaugcugaaaacagagaaaaagauugaaugucaugccugcaucgacagcacauauacuaaaauuggaaugauacagagaagauuaguauggccccugcgcaaggaugacacgcaaauuugugaaguguuccauauuuuuccgcugccaccaccacaccgcacuaccucccacccccuuuuguguacaaaacacaaggaaaaauauuuuuguuugaaaaaaaaaaagaucgaaugucaaaacaagcuuaauaacguagccugcuuuuuaauuuuuuugagacagagucucacucuguuacccaggcgguagaacagcagcacacucauagcucacugcaaccucaaccuccugggcucaagugauccuucugccucagccucccuaguagcugggacaaggcaugcaccaucaccccuggcuaauuuuguuuuguuguuuuuuguagagacagagucucucucuguugcccaggcuggucuugaacacuuuggcucaaguguucuucccaccuugaccucccaaagugcugggauugcaggcaugagccucugugcccagccaacuuagccauuuuuacacagcugcugggggcagaacugggcugugaauguaguucuguguggaagcgucgugcggcaguaggggaaaggaugcggguuucaagucacguggguacagcuauccaaggcaccuuaaguccuuucuggacauacaagauauaaauauaaacagagaccccagaucucagcagggagguggcugggacggcugugaguggagucgcugugcagcagaagaggguugaagucuggccgucucccuugcagggugcccacggggacgcggucauccugggcauguccagccuggagcagcuggagcagaacuuggcagcaacagaggaagggccccuggagccggcugucguggaugccuuuaaucaagccuggcauuugguugcucacgaaugucccaacuacuuccgcuaggcccaucauggcucaggcugcccaaggcuuuucugucaccucuuuuguucucucacacugaccagucuuggccuuaagcugacuuagaaggguuuuucugaauugucuagauccaugcauuauuuuucuagcuuccugccuugcucccuauucacuuuacacugugaaagguggggggugagucccacuugagcgcuuccuguugaauaaagcaggcacuugaccuggcuguagccuaggucuugagugaaccccaaaaacuugcuuucucugcuguuaacacuuuguuucccauccuaccuggggacugagaaagggcagaaccaugggcuggagucuucagagggcagagguaguaggagggucacagaagcacacugcccucccagggucuccuc

SEQ ID NO: 14196 - RNA, 6811 nt, Homo sapiens
aucuuuauuacaguaggaugaugguccugggccaccagccuaaaccuugcagccuuaggaaagaccugugucaacagggcuugccucccucucuagacaggggcucagccaccuccagggcaucccugcugcauuuucccugcuggaggauggggcagagggacaaugggagaggagggcaugaccccaccccaggcuauagcagcuccuuggccacaaagauccuuuugccaguagcagaagggaggaaaacagcaaccaccaggguuaccaccacuugugggauggccaggaccccauuauguccucuuaaaguugugcucaaagcaauuaauaaauuaaaaugagccuucagcagcaaagcugucaaucacacaggagaagcugagcagaaagcaaagcaaagaggaauuuauagcuucucuggcugaggccuaggccccucccucuaggagcagcugucagcacggacuacauaggggccuccaaaguacugagaggagccaucuagacuauucccccucauaugugucuaucaugcauuaaauuuuagagggaccccaauccaaaugcaauaacccuagaagggacaacaccuuuagaaggcacuagagcauuuuggcaguugaaaacaugagagcccccaggggugggggggggcguucaaaaggaaugcugguguauguauccaauucugucccaucagccuggcccacccccagcuagaguugggaaaggcgcugcuggucagaugcagggaggaggagcuugacuagccaccgaaaugcagacauggcuggccgggccccuuagugcacacugcggggauggguaggaccagaucccuugggcuuugugaagggggaacagacgccccuucaggcuuagauguggugugguuccuggaggcagggagguggguggcagcggccccuccucugcuuaguggccacuccagagggccucuccagggcuacagguguauggcugugacaucuguaggagugcuggucuggcugggcccuuggcugcuggagccccggggggcuuugggcgcugggcuggagcuggucugagaggcuucccugaggcucucccugagugcagcuucgaucugcuccugacaggcccgcaggcaguccugggaacaugggagaagagugaggagcaaacacuccccccauagcaucuggcagcaggugcaggggaaggacagcucccaacacauggggaagucuggggagguuaggccacagcccggccccaggaaucgcucuuuaguucucagaaacuagcaagaggauguggcaagggagugugagagcagcccugcaucugacaccaaaccccccacccccacuccagcacaccacuuggcaagaaaagaaccccuagggccagugcccuucaccccacccaagauacuugcucuuccccagaccaaggcaggagauaaaaagccacaaagccccaagguugugaaaccaggacuugggaccagguugggguuggagguuucccucuacuggaggcucagggcauagcacuacuuuaugaauggagaggcugcugcccagcuacccagcacucaccacuucagugccagugaucccugccagcagcucugugagcucauccccggacauggagcaggcacccaggccuugcacugcagccccaaugcugcccguggcgaucauggauggcggguacauggcaaagguauaaucuuggagaggaggaaagggaaccaugagagaaggaaaccugaaggauaacggccagcauggacuuccgacuccuuggaaagugccaggcagcaugaguagagcagaggacaugcuggaaaacuccagcaguggguggggcaagauaucagcaagggaggaagacaggaaagaguaucuuuccuagagaucagaaccaacugccaguuuccauaggucccgggaauagacaagacacucccuaguaugggaacacaacuagggccaagagacugggguucuguucccaaccuguucacugugagaccuugggcaagucacuucucucuauacccucaguguccccacuacaaacuggaggggucugagaucccauauagcugauuauaaccugcuuuucugcauugagacugggggcucagaggggguauaauuuucacaaaggaauuuugacaguauaaaccagaaucuucaguuaccucucacccuuauaagucuucugauuuuuccaauuuggcaaaaaugugcauagggcucuuaccuguagcacagagggccaaaaaggucugggcaugcuuuuugaccaaggccugucggucacggggcagagagagccggugcagaaugaaggccaggaaaucaugugcaaucacagcagccaggucccacuugagcuucccuaggaccagcaccucccaguccugaaaaagcggggaaaggguggggucaguggcuggagaagugaagaggagggagcaaagcagaagucucaaagucucaggcagggaagcccaucaaacuuuuaaagcccaagaccccaguucuguuucugauuuuaaggccgggcaccauggaguucaaggcagggaagaggaggaggcaugugcuuugagcacuuacugaucauuuacuaggugccaggacaacaugcuuuacauggauuaucccuuuuaauccugucugguuauguuuaaggggccaauaauccaggccuucuccugacuucauucagggcucugaggauuucuccagccagggcugaaagacggaagcagcagauaccacagcaucaccaugaacugggcucucuucugggaugaagcagaaagacucucucaaccccaaggauuugugaaaggggagaucaccacuagcuuccccugcaacucugcaucccagccaaguccacacuucuugaaucaacagaagggaguaugacuccuccaaugacagccacagagccuuuucucagguuccucaaaggggagauugcccaacccaagccacauccccuugguaggauaucagggauggguccugagguauagcaccccaccccacccccuuuagcuggaacccguagugccccaugccacuugacuuucaggaggauagguagaggccaagccagacaggauggcuccaaaugauuccagagggaucaagcccuauccucaccuacccaagccuaccugccaguacuaggucucgggagaaggcugggagcuccaccccaguccacucgucauggguucccagaccuggccccauuucugaguugcacacaugaggauuucuucauuguuuuaucucaggaaggaacuuguggguuugacuccuuauugaggcagaaauggcaaccccacccaaccucuuccaggccccagccacagcugucucucucuuggccccagcuuaggugucagccucucaaaucaaccccuacccucacagagccccagagaaaauagccuggccuggagccagaagugagacagauaaauuacaacgcuaccccuagugcaugucccaggagccaacuccuaacucagcaguaaacagaagggacucagcuucuaaggaagcaucuggaaggcaacugggagugggacucucccuauggggaggcaagggguuguguuugagggaaaguggccaccuuuccccauauccaggcaaccagagaaucccaguguuaacugguggagaacacaccccugggagugcuuagcuucaguagguggcagcggccaucacauuccugacuuuuaaggcaaccuggucuagcuagaagacccagguucuacacucaucugcucagugcgaugcugaggcaggaccuugcccuccuuccuugggccucagccuccucugcugcacacggauuuggaccaacuggaguucucagaggucccuuccaaccuugaccuucuaggaagucuuuugggcacuccacccccagcucaggcagagggaagaguacuuuuugccuguacugaaaaacccucauacgugggcacacaaaccaccuccaucuuuucacaaaaaggaaguuccccuucuaccuuccagccccaaccccuccaaaaacaucuugcucucuggcccuggaaacuagcuccaccuucagacuugccaaaaacuaccagauucaucacaaagagcuguggcgccuccuggauucccaacucuggccuccuacucccaucucugagcuacuuggcaggaagaggaauccuguuccucgacucacagcagucgggggccccaguacccuggcuucccugccagccaaucacagcagccugcuugcugcccuccucccugggagauggggcccagagacuccucucagggucagcagaagacuuggcccgccacagagcaagguggaggaaggugccagcucacccacccucucccccagccucccuaggagacaaucugcauguccuaaauaaccucuuccagauccagcagcucccccgccuccuccccaggcuccuucugaggcgggacagaaccggugacuuuccugcccggccugagcccagcccaaguuuccagcaagaggcccagggagccacuucccaaaccacaggagugacagcagcuccccacaggguuaugaaagaccuuggucagagagggcgggccaggggagggggcaccauuaucacaucggaagcagaugcagcucaccucccugucugucccucagcuugggccuugggcuaaggggggaagagggagcuguuuccaccaggcccaaagcagcugcuccaguuccucagaaugaggacgaggaaggauuaggaagaagcuguuucuuccgggauauaagaggaagcaaagaaggugggaugaaauacaucagcccuuccuuaaagcaaucagggccuggcuuuaauuggcucugggaggcuuuucuaucacaaaguccacaugaggauaaagacucaaccaaggcaaaacccccucccccacaugaagcacauuccacuccccuacuccagugggggugugcaggcaugcccuucugcugccaauaaauaacucaugguggcugcguaaacccagaggcaaaguacuagugaguguagacaugcaauuugacuuguugcuaucugggggaaagaccaggaaggaguggcauccccuggaggucaggaggaggggguuuaaugccugccugcagcucaagccugggcgggagugauacuaaccaucacaccacaaugccccaucguuuguuccaccccaauuccuuucccaaagguccugauccccuugcuuccucuccagggggcagaaagccucugauaucucaagcuuuccuuuuccuggaaaguggggagacaauacgugucggggguggggggaguuacacacgcacccgcaacuggcggggagagacagcguggucgguguagaugcacaguuuuucgauggucaggggcguggucucgcgcagcuuggaggccagcagcaugcagaccgcacccaggagcugcaacugcgccuuucggguggggacgcaagacagguagcgauccagguaguucauggccagggggaagacuuccuccucacagcgcugcuccucacauaccugggggagggcgcacagucacugcugggucuggagcguggggaacacagcagcgggggggugggagcgcugaagugaggugggauagggagcaaaaacggcagagaggguaagcuacuuagagagacaaggaccaauaaaggaggaggaugcgcccuccccaaggugacgccccccacuuccucugcgcggccuccuccccucuccccuugacgggggagugguaaagccaaggagcccuugcucacggaggauuccaaacggagacuccccucccccacagcgaggggaagugggacgcaagggucacccaugguagccagagagcugggaccucacccccaucaccgccaccacugcacacacccgaggggaagggaggaggcuccugccgcugccuccugcacuuuucauuucccugucggccggaacagggcgcgcgccacccccaucgccuuccccgccagaaccccgcgaaagacacaggaaccggcucccgggcgggggcggccgagcccaggguuuuccaggcgcgcucuccggagaaggccgggaggcggagggaagcgggagacgcugugagaagccgaaggggagagaguguccuuggucccguuugcucggcccgaagagaggcacaguuagggugccaagugacuggcagucacugucgggaggagccgauuagggcucgggaaagcaagggaggcagcuggcgugggugcccuagugaaaggccaggccccgggagucuuagccucggagcauccugcagauugcuguggggaccgggaugucccgacagggcggccccgguguguccagacccgggagcggugggggagggggacgcguccgggcgguaccuccagcauccaguaagccagcaucuuccgcaugugcggcuugaucucccgcugcacgcacuggaaguaggaggcgcgggguacguagcgcuccuccaggcggagcaggcucugcaggacacgcuggucccccagcagccgcggguccggcccggcccggggcgcgugccgggugccuucgcaacacagcagcuccauacucgggcagcgaacaggcagggcgggagugcgggcucgcgagucccaaggcaggcgacgggccggagagcgcggggcgcgggucuggcgcuggcgcuggcacugcgcggcggauccccagcccgccc

SEQ ID NO: 14197 - RNA, 7791 nt, Homo sapiens
cgcgccgcgggcuccgccuccgcgggaccacagagcugggauagcgcgcgaggcccucggucggacgggacgcucgggauucagggacugccucggcacacgggaaguugcccuacaggcgcgggagaaagcgcaggcggcggcuuggcagggagaggcaggcugcagugcacauugggucaggcacacgcgaggggcagcccccgagggccgucccagagucccccgcgccgccgggguccuaacggggugcaccgucuuccgccgcacguggauucagcgcgaugcccaaauccaagcgcgacaagaaaggugggcgaagggggagucgggacccuggggggagcuccgugggcuggcuacccagccugcggugagggcuucggggcggcgggggcgcagauuggaacgccaggacauccucgagguguuccgcugccucgcugcgagcuggaaugggggcuucggggcuguaaaaccgccagagguggcugacgcccggucgggucuggggagcggagacucguuuugccuaguuucaggugcucuugcaaggccaacugggucgggaggcagcuccugaacaccgcccccggcuaugccugcugccguuucggcccacuuuucccaacuucggcccuuucucaucuuccugcgcucccgccacccuggcugccuuucccuucuuucagcacagguuuguucccgugucuggcguugugugucugcgguuguuucugccuggcaugcuuacaucuucguaugguuugcgccuucuuaguugucaguuaauaggaucccucugagacagggucucgcucuguugcccaggcuggagugcaguggcgcgaucguaacacugcaggccggaugcgguggcucacgccuguaaucccagcacucugggaggccgaggcgggcgaaucaucugaggucgggaguucccgaccagccuggccaauauggugaaaccccuuuucuacuaaaaauacuaaaaauuagaugggcaugguggcaggugccuguaaucccagcuacuugggagacugaggcgggagaaucgcuugaauccgggaggcggagguugcaaugagccgagaucgcuccacuguacugcagccugggcacgacagagcgagacuccgucucaaaaauaaauaaauaaaauaagucacugcagccuugaccuccuuggcuuaagcgauccucccaccucaaccucccgaguagcugagacuacaggcgcacgccaccacacccagcuagguuuuuuuuguuuauuuuuuauagagaagacucaguguguugccaagcuggucucgaacaccugggcuccaaccacccucccugagugcugggauuacaggcgugagccacuacacccgacuugcgcaccucuuaagagaccguuuuugaccaccuuugcugugguggccucucucuuaacccggcucccuggaauauucaaaaauauuuaggggucuggcacuuucuaggcguuagaggauacagcagucacaaggaaagccuauuucuuaucgagccuaacguuuuaggagaaacauauuccgcaaaaugcuaaaaaucagauugaaaauggggugaagagauguugauauuuuguauaguguggucgggaaaggucucacugaugaagugacaaaugagcagaaaauaaagaaaggaagcgagcaaccuguggaauugagcagcuguggaauuaucugggagaaugcuguuccaaguagagggaaccugaagugaaaaggcucugaaaugggagcagauaugacguguuugggacaagaggccagugaggcuggagcagaaggagccaaauagaguuuggggagggaguuaggcagagagggcaggacuuccucggccuuggcaaggcauuggcuuuccugcccaggugaagugaguagcagaggacccaugugauuuaccuuuacuuaugaagggucacucugguugccuuggugagaauaguuggggaagacagggcagagggcaggaauggaagcagugagaccagcauuaauccaagacagggugaugcuggcuugagccaaagguauaacaguggaaaugaugggaaguggcccgcuauauuucguuugcccuccucugcuccacuuaccauugacugaugucauugucuuugucugugugguaccuaguuaagaggggcugagugcgggcagguuaaagaagagaggccugggucccuuugugaaggcgcccggggcuuugcaguuggaguucuguuaaguguuucuggaacgauuugauucuguggaggggccugggucaggucuggcaaaugccaaacucuguggguagagggcaaauugggccccagccauuuuuacaguagagguacauguuccuccccagagagguguugcugcgucuuuggguccaaauugcaauacuggggugcagauacauaccaggagauucaguccccagccucaugguugcacagcauaggccagcuagaguggccucugcaucauggucaagagcagcaaggggccaggcaugguggcucacaccuaugauuccaacacuuugggagacugagguaggcagaucucuugagcccaggaguucgagaccaaccugggcaacauggcaaaagccaucucugcaaaaaauacaaaacucaccugggcaugguggugcauuucuguggucccagccaaaauuagcaggccaugguggugugugccuguaguccugugugggaggauugccugagccuaggagcucaaaguugcagugagcccagaucgugccauugcaguccagccugggugacagagugagaccccaugucaaaaaaaaaacaaaaaacaggggccugccucagccagcaggugaggucugccacugagagcacuucuagcagcaggaacagccuccacccccacacugcaaucaaguuuuuugggucagccuuaggagcuaagaaaggccuaguuugucuaaauagcaggaguuauauccagggaucuucaggcccaggaaugcuaaugaguaggcauuccaugggcccugggaauggcuuugugugccagaaaugauggccacaaaggccuugcugccuuuuuucagaauggcugcauccagcugagugcucucugccaaaggggagaagaaaauaagucuccagugcauuuagauuggucucucaucaucucucuccuuuuuguuuuuauuagucuccuuaaccaaaacugccaagaaaggcuuggaauugaaacaaaaccugauagaagagguaagagguuguucuuuucuagagcuugcaauuguuugguuuauaaagguagguauaggacuguuggccagggauaggacuguuggccaggggaacauacuaguggggaaaaaaaaaaaaucuccaagcugccaauccaggccuuuuuccuccagcagcagcaccagcaaaaacuuccauagugaugauuuccagcuuugacuagcucguacucugugcccuguccugcacuguguuucuuaugcguuguuccacuccauccucauaacaucccugugauguggguacuaggugaugauguugcuguuuugcauuuggggucacugaagcuuacagagauuuguuagccugccuaaugucaaaaaacaggaggccaggaauggugggccacgccuguaaucccagcacuuugggaggccaagugggucagacagcuugagucugggagcucaagagcagccugggcaacaugacaaaaccucaucucuacaaaaagaaaagaaaaaaaaacuagcuggacguggugguacgcagccugggcaacagagugagacccugucuuuaaaaaaaaaaaaaaagagcugggagauuuaccagguguaggugacugcaccaacccacugucuguacagcuucugaccugccaaccugggcugcaggcugggugaaacagucuccuccugcacaaugacuccacuccuagaggcugccucaugguggcuuuggccagcaccacgugcagagcaguaccgaucagcugccuccccuuauaacagagaggcuccauguguuuccauguagcaggacccuuccuaaugugggugaauguuucuagguuaacagcugaugaucaguuccacuguuggucauaaauaagugagagaccuggaaaaggccgugggguguagauccauggcucagccuccccugugguuagggauccuaauuucaguaauggagguaggagacaaccaaauuagaggccuccaguucuuccaguuuccauaguugucaggggcccagagcagauucauucucaucugaggccagaguagugcccguuguaugcugcugcuugaacucagagccucgugaauugucccacagcuucggaaauguguggacaccuacaaguaccuuuucaucuucucuguggccaacaugaggaacagcaagcugaaggacauccggaacgccuggaagcacagccggugagcgggcagggggaggaaggcccuucugaguggggacccggccaggcugcucucagucaaagcacaggagcaauuucugacccuuuaggugccugggucaugccgcugacaccuuaauaaggacaaagugcuaccugccacugaagagcacuuccuuuucacuguuaaagcuggucuugggcagggugcggugguucacgccuguaauccuggcacuuugggaggcugaggcagggggaucaccugaagucaggaguuugagaccagccuggccaacauggcgaaaccccuucucuacugaaaauacaaaaauuagccgggcaugguggcaggcaccuauaaucccagcuacucaggaggcugaagcagaagaaucacuugaacccaugaggcagaggcugcaaugagcugagauugcaccaucgcacuccagccugggugacagagugaaacuccaccucaaaaagcagauuuugcacugagcuccuaggggcaggacuuggcaguugcucaggagauguuugagaggugggccuuuccggagaaguggcccuuuaacccuggacugugggccauuuaggagcaucacaccaguuuuagaaugucaguagggacacugcgacacagacagugaccugggagcaggaugcaggagccacauggcaaguuucuguccuggggcagguggcucuggugguggucucuugccgcaccagcucugguucaggcuguuaacaugccucccgcauacauccagauagagaacugguacaugaugcucgugaugggcugggagacaaaauguugccaugucaggagucugugggugggaacauaaugaaagggaccccaacguggggacaguguggccaggcagcauggagaagugggugccacuggcucagccugggccugagcucacuggggaccggagcuacuuugcauguugcugagggauggggagggcagggcucuuccuucacagaaugcucuuucucuugcuugguaggauguucuuuggcaaaaacaaggugaugaugguggccuugggucggagcccaucugaugaauacaaagacaaccugcaccagguaagucucuggcccucacgggguggagcuaaggcaaagccgcccucucucccacuacucccaugugacagccucccccagccauuggcaggccggaggcucagggagagcagggccuggcuuaaagcucuggguucucccuucaccuccggacccaaggaauagcagcuuccugccucccacuccuuccugcuaugacaaccaaaaacgucuuuaaauguugccaaauguacccggugagcaaaaacgugccuaguagagaaccacugcucuaaugugaccaagcuguccucacuccugauuuguaggucagcaaaagguugaggggugaggugggucuccuguucaccaaccgcacaaaggaggaggugaaugaguaaguacugcugaggaacggagggaaagaggcgggugagaggggauuucagggagggaaugaugcaggaacuucguuccauauguggcaucaaguuggaacugcuccuggaagccugucacugagcuaguggccugggaccacagcccucucuguccucuccagcauggugcucugggcuggcugcuggccagcagccaaggucugugaugggggaaggcccagggccacgggacacuugggggagccugacucaugggcugguggcguggccaggagcaucuccuccuaccacuucucuuuucccuuaggugguucacgaaauacacagaaauggacuacgcccgagcugguaacaaagcagcuuucacugugagccuggauccagggccccuggagcaguucccccacuccauggagccacagcucaggcagcugggccugcccaccgcccucaagagagguaugggcagcccuggagccaaaaggucacagccuagaguccaagagcacgggccugcaagcucaucccuuucuagcugagcaaguuauuucuacaagcuuccauuuucucaugagaaaauggggcuaagagugcaugccucacagugggggugaaagcagacaguaacuuacagccaaaaugcagcccuugaggcccaucaggggccuugcgcuuguuuaaaaaaaaaaaaagucaaaaaauuagacagccaugguggugugugccugugguccuagcuacaugggaggcugaggcaagaggaucacuagagcccaggaggucgaggcugcggcaaaucaaagggaccucagggagacagccacugcccaguguguguuggagccguggggagggcagguggcugacuggauuccucccaacaugaccagggcagagagggcucugcaggccucugggccagagguaacugagagccacccucuucugcagguguggugacucugcugucugacuacgaggugugcaaggagggcgaugugcugaccccagagcaggcucgcguccuggugagucuggcgccuugcgggcuguugcgggcgggguugcuggcuuuccucugccugcugaaaaugccccccugcacuuugaauaccuucauuccuccugauucuuuguucccuuugucucuugcagaagcuuuuuggguaugagauggcugaauucaaggugaccaucaaauacaugugggauucacagucgggaagguuccagcagaugggagacgacuugccagagagcgcaucugaguccacagaagagucagacucagaagaugaugacugaaagggacucgggacugaaggucuccuggaagcuucugggucucacuggaccaucaggacugcugccgccccucuggagagagcagcuuuuuauuugucuguagacagggaacaugaugggcacugaccuccuguaaagaauaaaacugugggccgggcgcgguggcucacgccuggaaucccagcacuuugggaagccgaggugggcagaucauaaggucgggagauuaagaccauccuggcuaacacggugaaaccccgucucuacuaaaaauagaaaaaaaaacuaguugggcauaguggcaugugccuguagucccagcuacucaggaggcugaggcaggagaaucacuugaacccgggagguggagguugccgugaguugagauuggaccacugcucuccagccugggcaacagaguaaaacucugucccaaaaaaaaaaaaagaauacaaccuugcaggaugucucuccuggagacagcaagagggagaggagggagagggcucuuu

SEQ ID NO: 14198 - RNA, 4109 nt, Homo sapiens
uuuuaauuguacaagcaauacauaaauacauucugcauuuuaaaagaguuaaacuccuuuuggauaaggcgaauguccccuuuggcuuacuaccccugucuuuccugaggacagccuugaagcuguguaccugcugggcagcugccccuuucuguccccuguaugggucccuggagccugccuucuguucagucaugcccucuggugucacccccacaggcgggagaccuuugacuuugacgacgacugugacagccugacgugggaagagaaugaagacacgcugcugcucugggaggauuucaccaacugcaauccgaccaucgaccugcagggcgagguaagcccagcgccuggcuucccaaaggccaggacuaggggucugggggacaccgccuuucaauggucccucaucccuguuauuuuucuacagcccccaccacacagcuaaacuguccccuuugggccaggcgcaguggcucaugccuguaaucccagcacuuugggaggccgaggugggcggaucaccugagguugggaguucgagaccagccuggccaauauggcgaaaucucaucucuacuaaaaauauaaaaauuagccaggccugguggugggcaccuguaaucccagcuauucgggaggcugaggcaggagaaucgcuugaauucaggaggcagagguuguagugagccgagaucauaccucugcacuccagccugggugacagagcgagacuccgucucaagaauaaauaaauaaauaaauaaauaaauaaauaaauaaauaaauaaaauaaacugucccguuuguucuauuuccccagcaagaggaaaacuugggcaacuugauccaugagaccgaauccuucuucaagacgagagacaaggaguaccaggaaacgauaggucagaucgaggugagggcucgggacguggagcccacucgugaggcucuccugagguccacaugguugagauccuggcgaucaaacacccaugugucaugggcaggggcugguagaguggggcaggcgcaggaucgggagucaggaggccucggggcgaguaaugucuuucuuagggccucaguuuccuaaucugucaaauggggguggugauccuugccugccucagagaauuagaaagaauauauguagcugagaugaucccauaauaaccacagagcugacauucgagugauagugagugacacaaggugcugaguaugcccgguauccuuaccugugcccuaugcaguaggcaccgugcaccccuuuuacagaggaggagaugaggcuggaaaggaccaagugacuugcccaaggccuugcggccaggaagcagcauugaaguauaauucucucuggcuccagaggcugugcaugugaucacuucuauaaacgauagucauugcuauuaugcaggagaaagggaagcccagcuccuucccuagaggaaguaucacuugauagaggacaagagucagaaacaugaaaaagccuucaggauuuuuguaaucaggucuggauaaaggaacccaaagauguugaguucucagaaccggguggggugcaucagagccaggcugcugcugggguugcuaagcaaccauuccccuuuggccagaaggaguucuaggggaaguggacccaugugcagagagcagagggugagggagguugauguccggaggcaggguccugauggcaugguguccaaugguggccuugauggcaccaucccugaggaauccaggaggagagguugccgaggcuucugucacgaggaugacuugcccucacccuuauuccucauugguuccucccagcucgagcuggccacagccaaaagugacaugaaccgacaccugcacgaguacauggagaugugcagcaugaagcgaggccuggacgugcagauggagaccugccgccggcucaucaaaggcuccgcagacagguacccgcccauccucccaggggauucagcuauggcauccuuggaggggaauucccaaggcugcaacucggccaugugucaugcucccaaccugucucucuguccguccaucuguccguccguccguccauccauccauccauccauccauccagugacuauuagcacaccuaugugccagaugccuuacauaucuaaccucaugcaagucccaccaccacccugcccuuuguugauucaauagauacuugccaaaggccugcucugugcaagacgguggggccaguaaguauagccccugcccucaaggagcuuaagccccauuuucugcugaaauggggagcagagguggacagggcaugcucccauuugcucacaggaagugauuucccuuccuuucccaucuguuagucuguucucauggugcuauaaagaauugccugaggcugggcgugguggcucacaccuguaaucccagcacuuugggaggcugaggugggaggauugcuugagcccaggaguucacagcuagcuugggcaacauagcaagaccccgucucaaaaaaaaagaaaugccugagacuggguaauuuauaaaggaaagagguuucguugacucaccguuccacauggcugaggaggccucaggaaacuuauagucauggcagaaggcaccucuucacagggcggcaggggagagaaugagugccuagcaaaggggaaacccccccuuauaaaaccaucagaucucgugagaacuaacucccuaucacaagaacaggaugggggaaaccgcccccacgauucaauuaucucuaacuggucccucucaugacacguggggauuaugggagcuacaauuccagaugcaauuugggugggaacacagccaaaccauagcauccucuuccaacccagggccuguccccaggagacugacaagugucaggcauggcacauaaagcagagccccugccuucaaagacacacagccuuaucgggggacagccacgcugagaaugagcuaauaugaggagaaugccugccacacagcacaaauacguugucacuguuuuccucguuuugcugcauuacuguacgagagggagggacagcucugugggggccagaucugugugcagggccguagccuugccuuucagaccuuuaacuccucaaacccccagaacccagugugguuaucuccauuauccagacagaagagcagacgcucaggcagguuaaacgguuugcccaaguucccccacccccagcucauccgagauagaaucagaacugcaccccagugauguuaaccauaucccgcauggccuccuuuugagcucugagucauucagguuuuacuuagcaccuacuauaugcccagacauggguuaggugcuuggagaguaacagccaaacuugauccacgguccagcucccaaggggcuuucuuccuagagaagccaacacagccagaccaaguaggggcuggugcaggggguuaccucgugagcuuaaaggaucuuaaggauagcugagugaggcaggagcucaggaccaggccccucugagaguagaucuuauagaaguggcagcucagccuucccacuccuugacccuucagaggcccagggcugcucucugaauuuccccacucucuugugcuucucaggaauucaccgucccccagcuccguggccagcagcgacucaggaaguacagaugagauccaggaugaguucgagcgcgaggcggauguggagcccauggucagcugaugacugaggcccugcgagccugguggucuuggugauggggcccugccaccucuccucauggggccaggaaggccccucggagugggguucgaagccacaccacacagacuuucucugcccucccuucucuggaggcccugagggacugcugcuuccuuccuuccuuccacaccaccaacgggugccccgucuccaucccccacccacccaaggaauggugcugucaauuucuauuguucuccacauuacaaaugcagacuucugugcggacuuugcaguguuaacugugccuucucccuuaagcugagccacuuugagcuccaaagaauuauuccuagcagguguuuuuauacagaacucuaagcug

SEQ ID NO: 14199 - RNA, 1424 nt, Homo sapiens
gauuuguuuuaaaauuuucaucaauuaacaguguaaggagaagaauaugacaagcacucccagcaugccaggcccuguuguaagugcacugguauguguucauucauucaggcuucaguucucagcaaaagucaaauauuggaucacuugguucuucaacagcacaggaaaagcaaaucaaacucauuuccuguguccucacagcuccacccuccccuccagugucuccauucuaugaaaaucuaggauucuucccaguggaaaggcaaaaccaggaaaggaaagcuaagcagaggcuguaaacucguguggggcguggagaaugugcacaggacuugcucagcaaaccucagucaucagaauuaaggggcccgccagaagcuuggagcaggaaauuuaggaaaauaaaaggccauccuguuucuuccagcagggagaaaacauauggcucucauuaccuagagagguggcaagccucagaauagagacacgcucaagagugauggaggcaaauucagagaccagagagcucaaaucaauuugcugauaaaggaagaucugggggcagugggggagagcauucaugggcuccagccuccaucuggcuugaauucaaaucaugccaccuacucacucuauguagcaaagauucaguuagagaggguaaaaugcucagugcagugccuccuacuguaaaucuuuauacauauuggcaccuccccagaugcuguaauccacaagacaggugucauagcacccauguaucagauggagaaaccgaagcucaaagaagccaaaggaccucauccaacaucacaugcuagucaggugcagagccaagacuagagcccagggcucuugacuccuggugcagacuguuuccacuaaccucauucauacaggugauacuccuugagcaccuaccaagugaccaggcuucccuccuugccugggagggaaaagaaacaaguuauacugcagcaugacauggacagguaugugcucccagagacagaugcagcccuggagagguggagaugaauuaugucuuuggagggcugggcagucaagguagccugccugguggagguggcaucugaauguagagccuauagagcuuaacauuauaggcacaagcauggaggcagggaccaaaaccucuagcauccguguacccacucccaauccaagccucaguuuagggcauggcauacuucuguugaagguggauggcccacagcccuggcuccagauucagcagaagcugcagugcccagcgcuugcauggccuuaccuagugaaggcaugcaggucacggggcaugcagcauccgcccucgcugugccuggcuuuucaaaaacacaauuacucacccuucagagaugccgucgguguugguaaacuccagccgcuaaacugcauua

SEQ ID NO: 14200 - RNA, 2494 nt, Homo sapiens
ggguguaagaaggcuguuuauuuccuuacgugcuuucaacguuccccuucaacccucuuuacucuaugaauaucaagucaugcaaagccuguucuuuggagacagagaagugaagccugucugaaaucgcaggcucuaauuuagggaagucuccaguuuauucguucaucccuucaucccuccagguagagaacuaacaccugcagaaaaccuuggcagggccuuggcugcagccuagagaugccaucccuggcucacacucugcugggggggacaggugucaugugacccgcacccuugucuggagcuauucaagagugaggaagggacagugggcauggcaaguagaggugagagcaggugcaaaggccuggggguggcccaucugacucccaucaggcgcucagugaagggucaggaagaggggaggcaggaggaggaggcugagggcaaucagggaccuaugccaagucuggggugcccugcaauggagcuugagcuauauccaaggggaacagucaagaaauuuuaaacacaaaagcaucaucauucgauuuuaggaagcucuggaccccucccuagagaugucugauaagcaucucagacuuaacauggccaaagcaaagcucugcauuucuucccuaaaccuaccccucccuuagucuucuccaccucagcgaacggcaucaccauccaccaguuuccgaagcgaaaaaucuagggcgucucuccuaucacaucucaucccuugccccugcccacuccccgcaucucuuccaucgaauccguucuaaaagacaagcccugaauccacugcuucuuccccauuccugggccuccaagccagcugaagccucuaucacuacuucaagucagcacccuccugaucacacucucugcuuccacucuuguccccucagcccccaaauccaguauccaccaagcagccagagugaccuuuugaaaucagaacagucuuaucauuccucaguuuugccugauacuuaacaauaaaacccgggaggcaccacccggucuggcacugccccuuucuggccucgcccacuccacuaccucccaccacaccagccucauuuggguucuguaaacaggagccagcccacaccuccagauccacgaugugcaggcccuuguguugggugcugcugggauuucaaagaugagcagcaugaacccugaggagcgagcauauggaccagcagugaagaugcugcuuugccaaggugccucuagagacagaaagauccaagagcaacuccugccuccaccucuuccucugucaccucccccauucuccauaucugugucuauaaaaugggauggugauaauagcacugaccucguggagggccaugacagcaaccaugcaaccaagcaugccuggaacaguccagauggcgcuuguuaucugagggugacuguuaagagcaacccuuguucagccucaaaagugccugauuuggacgacaaaugacacuuuugccaaugcagcauucuggaagcgcuuugcaaaugucguuucucaggauggugcucuacuucucugugcacauagaccaugggacagauucaagggcagcgcuccaugcauugcccccggucgggagauuucuuaagcuacaacucugggcaaugguagaaagagggacggagcccuagccugccagaugaaaagagcugacuuuggaauucaccucccucucccuuuccagcauggaccaugggccuugaucccaccuagguguugggcugugaugggcaggacaggaaucacgguuuaagggguuguugcaggugaugcugggugggccuuucucugugucugaaagcucgugaaggaaaggcaacccagucacccaggaguggacucaaugccggaacaauggaucccuugcacaaguccagcugcauugcugaccuauguggccuuuccaaacugugccauacguagagccuguugcuucaucuuucagcaaauaguuauugagagcccucugugucucaggccuggugcuggaugcugccacagaggccccugcccugguggaauaaaggaaacugguaauugcacauugaucuucuaugcagacaucuuacugacacuuaucagugcuaauagauuuuuuuuauuuugaucuuuugcauuaugaugugaaaauauuaucugcaaauaauaauaauaauaauacuucuccucucaaugccugagagacagcauuuuuaagguagaaaaauguauauccuggaaccagaucacuuggauucaaauuccagcauugccacuuagaagcugugugacuuuuaacaaguuacuuaaccucucugugcuccaguuuccucaucucauguaaugaacuuaggacagugccugacgcuauauaaauauugguagggcuauacuuauugaacugauuauaauuucuugccuuauuccauugucuaaaauuuccagaaugcuuguaaaaaaggguuu

SEQ ID NO: 14201 - RNA, 6279 nt, Homo sapiens
gugacuugaucuuuuguaaaaacuuguuuuuaauuuuguauaaaauaaaggugguccaugcccacgggggcuguaggaaauccaagcagaccagcugggguggggggauguagccuaccucgggggacugucuguccucaaaacgggcugagaaggcccgucaggggcccaggucccacagagaggccugggauacucccccaacccgaggggcagacugggcaguggggagcccccauugugccccagagguggccacaggcugaaggaggggccugaggcaccgcagccugcaacccccagggcugcaguccacuaacuuuuuacagaauaaaaggaacauggggauggggaaaaaagcaccaggucaggcagggcccgagggccccagaucccaggagggccaggacucaggaugccagcaccacccuagcagcucccacagcuccuggcacaggaggccgccacggauuggcacaggccgcugcuggccaucacgccacauuuggagaacuugucccgacagaggucagcuauugggggcaggaaggaggcagggucaggguggagcugggugaugggaaccgcugccccucccccaacucuggugaugggaguguuuugaggaugaaaaguagcaaggaggggagcucaggguguccuggaagugggccugguggauaauauguguugaauaaacaucagguggguggcuagguggccagauaaugaugcggguguggggacaggggaggucuuggggagguggccuuccuaccucggaggagcuccucaugggcacacacuguacgaacacagaucuccuuguuaaugacguacacacggcggaggcugcggggacagggcacgggaggucucagccccacuuccacccaaucccacugggauagcccagacagaaccuggcacgggagcccggacagaaccuggcacgggagcccggacagaaccuggcacuggagcccaggaguggaggaggucccuggcccaggcucaaccacagaacugagcucaacuuaaggacucacuaucuuuccuccaacucccaccuuggcgggccagagcuguccccugugcccucuagccccccaugcuccggaauccucccgacagcugcccaucugugcucaccuguagaagcagaccucguugagacacuguuugcaaggccuguguauggaguagaggcgggugcacggguacuguuccucacggcagucuggugacagguggggucagacuaggagcccagaguggggggcggcccccagccucacccaccugaggcuggcucacagggccuaguccccccuguaccuucaggccccgugcagacacccauaccuacacaugcccacauagacccacgcagcauugucagacuucccagggcuguaauauucacguaucaauucacaaccgcacuuacuauagaagccuaaguucaaacagaaauuugcacccacccaugcaucgccacaaaagcccauaccaacucccgagcagacgugcccacgcucacagaagcccacauaggagcgcucacaccaacccacacgagagugagcacacggauucuccugcacacacacaccuuguucuuucaagcucucagcuagggcagccggagggcaccgcucagccagccugcacucccuggcccuuccucgccuccacaugugcaccacucagucucucuggcuggcaggaagcccccagcacacucccugccccucccaguaucugugaggucaggggccuuccuaggcugccaauuuagccuccagccaggcacacuggggacaggugggaccuccuggagcugccuggggggccuggugaugccagccuacggcagucauacugcccacacugccaagagcccacaugggcaagggccaaagaccuccagcccaccagcaccacccccuacuccaccccaacuucagggcgugccuccauuuuuccagcugucaagaaagcccuuaccaagaggcccaggcucugugggcuccagcucugcauuuccugguucugguguggagacagagguaggcagacaucacugggaggggucuccucagggcaaggggagucaccucucccagcccuggcagacccccacucccaggguugacaggguggggaggggugaggcaggagcugagacgggugggagcagggucuggggccuaccugggguuggggcugggaugacuuccuguuggacuugcugcugggacuggaacuggaacuguuccucggagggccgaggagucaccucugcagccaggggaggauaagggggucugcucccucuaccccucccagggggucuccccaccccagcugccggcccguccuauccuaccccuagcccguuaccuugauaaucauaguagucuggguugucugcaaacaaagaugaaaguggaauuggugggaguaaggcuaaucccccagccccuggggcaaacaaguucccuccugagccagggaccaacccccagaguucccaucagcguguccagugcggucccuggcugagccaggcacaucugagcagccaggccucggugacccggcaaggcccuuaccgaucuggucgcuauaguggguguacuggacguggucagggaacggcggcagcggguccaggucauacuggcccugagccagcaagccugcuguggggaggcaaagcauguaggguaccccaucgggaggggcaacgggggcccgaggcgcuucuggagaguggaggcgggggucacaaggucaggcccauaagagccuaggaccccacaagcagauuccuagaggauccagacucuucuucgaugguaaagacccuuccccacccuggucaugggucaccucccugaccuuacccugccccuuccuguugcuggccuccuggcugcuccuaggacuccacaugcuccugccucccucagagccuuugcaccugacacucccugggccugugaggccugcucagcuccuucaggucuucccuggaauuucagcugugccaagaugccgccccaccuccagcccaccagcccuccugcugauuucuguccagcacucagcacaugcuggaguuucucaugucugcuuguuuccuauuugucucccuucccuggacuggcagcaugaugaggagcaacgaugugucugccugguucaucgcugaauccccagggccuagcccagcacuuggcacgugguagggacucaacacaucgcugcugaaugaaugaauguuggcccugcuaggacuuuugugguccucauugauucucuucauuuggccaguagggacccccacaaggucaggacuguauagagcagaagggcccugaauggaucuagaacucaagcauccggacucccugccuugggugccccugcaccugcacaucggcucccagagaggccuugugccuugugcccacggaguccuugugccugggacgugcccuccagaacccugccugccugcugcuguggaaggcugggggaagggccaggagcugccuccagaugcugccaggguuggcugguccagucugugguccaagcaggcagaaggcccugggagcuggggagcugaguucuggucauaagucgugacaaaggcucacuaugaauucccccuacuaacccuacuccucagccccacauaagaggagcuacccccugccccaggagccacuuaccaggcaggaauagcaggaagagguaggcagcucucauggcaacaaagaggcaggccgggguggugucagagaggacagcuggggaaagaccggugggagagcucuacccagggccacacccaggacagcagagcucaccuuugauccccugauuucgcccuggagaagguggcacccagaauagaagccaggcaugggagggcuggaguggagggacaucccagucccugcuggcccacccagguguucaggucacaagggacaaggccuccaacccagcuccagggcugauccugacaagcaaaccccguguaguggguguacuugauguggucagggaagggcggacccugcccugcucacuaaggggacauuccuaaugugcucccagcccaggccauucuguccucacccacacccgugcucagcccucuggcccaguggcucccuggguguccaaggcacugacugcgugaaucacugaacccaggcccauccuugggaccccagcccuggccagccggcaucaccgccuggacucagcagcuucugccaagccaccaccugcucccaauuagccccugggcccuaagcauccugcucagcaggaaaccacauacacaugggccugcccggcccccagagcggccaggccgggcagggcucccagcucccagaagacuccucuccugccaggccuccaggccucgcaagaccuggcugugugcaucacaggcucacgagacccgggcuauuugcagcagcaggaagcacgagagugaagccugagggggcuccucuggaucccagaaaggcagcacugaaggggccgugacaucacccaggcuggggguucugcacccccugacacuguaggcaagugugugugucauuuggagggagagggcaugggguccguggcuuucaucaggcuccugacauucaagagcccagccuccaguccuggcuacacggugggacuugggggagccuccgguuccccacauccagccccagcucaguggagggccaccucagguccgucagccuucuguagggagggcugcgagggcgggguccauccaggagggccccucccggcugcaacccaggaaguccuuucagagagcuagcuggaaaccccaacuuuggucuauuuuccccacugggaguccagggagaggggagggaaaggggagaaagcaggaggucuuucccuccuuccucucaauccugaggccuccugacccccuggcuccucucaugcauuaggcaccucacuaagguggagugggagccgggagacgaagcucaggaccaagcugccccagaggcgagggauagcuggcuccccacaccccauucugaaaacccuugaccuccucaugggagggggaugaaaagacccagagagccuuccuugcccuucuccccauccgucaggucggucggagcccccgcugcucagcagaaggcgcugaauuggggcaagagggguugcaagguguugggggaugccugucgguacccugcggggagucuuccuccccuaggacuggcccccgaacccaggcuuauugggggaaggaggcccacgggcuagcggggaggcaggaaagagagaagucaguguggaguucaugaacuccucccacgggaccacaucuccgagcucuucuagacgaagggguuuuggggcgugcgggaggccaggaccugccugggaggcugccccacccccaccucuggccucuuccacagcugcggccucccccacccccgacuccccugcguccugggaggugggggacagggggccccgacgcucgcucagacaucagacggagggagggcucugccggcuccagagccgggcucagggggaggggucccggcgggagaaacccagauguugcagcgccgcacagcugggaacaaucagccgcggaaacuugcuccgcgcgcccucgcgcucccgucucugaucucucuuugucucucugcgucucugucucggccauucccaccggaccccccccccccaccccacccgccacauuccaaccuccccgggagaacaaaagaugucccaucccccgacgaccucaccucuggcuccccccaaacucgggcuccccgcccuucccaauucgcguucucucugcagagcaaccccaaacuuuccaggugcccccuuggccuccgcucugaaggcgcgggguucaggaaccuccgcggcugccccaggaucgaggacccagagagccuggcacccucgcccccgcgccgggggacccgccgacgccccugaccgccccccggggcccccaagcgccaggcccgcgccuaccuguccgggucacuccgccgcccgcuccgaguccgcccgccggagccgccccuuggcccgcuccgagucccccuccgggcccccgacggggcuggcgcccgcccuccagccccggagccgcuggguccuaacgcgagcugcccgcaugggccgccacgccgugcccucgggguuccaucuccu

SEQ ID NO: 14202 - RNA, 19384 nt, Homo sapiens
cguccgucggacagaggaacgguggaagucgccggaaguucggugggcuccaggcgucgcgauggaggagagcggguacgagucggugcucugugucaagccugacguccacgucuaccgcaucccuccgcgggcuaccaaccguggcuacaggugacuacccaccgccagaccaggcuagcuccaauuuaacccuuucuccgccacccggacacacccacugcgggaaccgaggacagcccuggccaguuuuggggcgagggggagcuaaugcugcugcuucuuccaguuccaggcccgagcagggagguggauccagaguuucgcccgucucaguucgacgcacgggacuccuggcggcggggagggcguuaaagccguaucuagcgcuuagggaccccggugggcugccggguacccuaaacuuggucggggguggugaugucacagacgcuucucuuucagcgcuaaccgguggccuugaagggauccucgaaaagccuuaagcggggaggugcccuaucacagacggaaauccccgagaggaggggagggagcccagagccggcugaaaggaccggucccggggagcuuuaaggugacggucgaagcccagggaccccuuccuacccagaucccuucgcacgaauuucacccuugaucacagccuggagcaguugggaggaccccuucuauauuucucuggucucuaccugagacgaauaaacacacacgcuuguaaacauacugaguaucucugcaaaggaacacaggaaacugcccuaggggaggggaaccgcccuuggaaggaaacuuccuuucccuuuugugcuguuugcguuuuacuacucuuuguaugcguuaucuaucaaaacgacgaaaaauauuaaaagaaaaaagauacacuucauacagacaaccuggccuauggcuauuuugugccacugaguggugguggggagugcucguauuugcgggggccuggguggcucuugaaggcgaugguuguccaaguuuuucggaaauacaggauuggucugcaccccaagaaugauggaacguccacauuuccucuuguuacuuuccaguuguguuaccgugggcucauagcugaucuuauggugaaaagaugcguuagugaacauuacauucaugacauauuuuaaaauaguauaaaaacaaaaacaacaauaaccaaaauacauuuguuuucugucaucaaacugugguuggaccaucaaaccauugauggucgucuagccccaucuccuguugggucuuuuuuuuuuuuuuuugagacagaguuucccucuuguuguccaggcuagagugcaauggugcgaucucggcucacugcaaccuccgccucccggauucaagcgauucuccugccucagccucccgaguagcugggauuacagccauacaccaccacacccgacuaauuuuguguuuuuaguagagaugagauuucuccauguuggucaggcuggucucgaacucccuaccucaggugguccacucgccucggccucccaaagugcugggauuacaggcaggauccaccgcgcccggcccccuauugggucuuuaguaggauggauuugguuccucuuggugccccagagagcgagguuaugaauugucagggcuggcugguuuagcuuagaggaaacuaccagugccugcacuuaagucuuggagcucuccuuagccugaaucucaggccugguaagaggaacaggaacugagucugcugauuugugaauugagaaucugcauuugugcagcccucaagacagccgcguccaggguucuugagaacuggcauagggacuucuaagaaaagccuccuggaaacaccugcgguucuugcuauuuggggauuuaacugaccuuuucuuagaacuaaaaugugaaguuaaugcuuuaaaagagucaaaacagcuggcugugguggcucacgccuguaaucccaacacuuugggaagccucgguggaaggaucccuugagcccaagacuucaggaccagccugggcaacauagacccuaucucuauaauuuuuuuuaauuggccugguguguugguacacaccuguagucccagcuacucaggaggcugaggugggaggaucucuugagcucaggagguugaggcuucagugagccguaguugcgccacugcacuucagcccgggugacagagugagaccccgucucaaacaaauuagagccaaaagaggcauugcuguagguucaugguuuccuggguuucuuccuaaggacccauucacuuuucucacauguacuguuguucuccuuuucucuucuggugauuguuccaugcugucuuuuucuuucaagauagucucacuggucucaaauggucgcucugacugcugcagucaagcagugucagaaacagaaucaggccccugcagcugcugcuucuauagaaaggaaacuggaaggaaguccuacguggaggaggacacuguggucuagagagggggucaccaagugacaacccaguguguuuuuguaugguucacaccuaagaauaguuuuuacauuuuuuaaaugguuuggaaaauuuuuaaaggagaguauuucauacugggaacauuacaugaauuucagauuucagugucuacacuuugauugaaauacagcugugcucaguagaaaauaguuaagauaccuaaagcaucaccacgugcauguucuauacugauuuuacccuacagcagccgagcugccuuguugugacaggcuguguggccuguagagccaaagauauuuacugucugacucuuuacagaaaauguuugccaacucuugggcuagaauaagcagcccuuuccauucccagcauuggggucacacagcaggagccucuggcagagauucagugguguuuguccccuuagggcugcggaguggcagcuggaccagccaucauggaguggccggcugaggaucacugcaaagggacagauggccuacaucaagcuggaggacaggacgucagguaaccggaagggaggcugcaucaagcugaggggccgcaccccacuuuaugaagggagagguggccuggucuggccaggcugcucaggggucaugggaaccuguccugaaaaaucagagacguguguguaccuuuaagcuguaccauucccccaccuuaguuguagaaaguaccgucuccagguguaaaaaugaguauuucaugucaaacacuaguuccuuuuaggaguccucaggaaaaugugggggccaaggagaggagaccgcagcuugguccugguaggaaguaggaagcccuggaaguggccuugaagacaggcgggugaggaugcacagcccucugccgcugggcucugcuuccuacugaggaauuguuuaucaaugcagcgguaacucccagagcugaccacacccauuaaccgaagaagcuggaaacuguccuacucagcucuuucuguagugagaggacgagcugagcuggguuguguuggggucagcuggcagagaucgucuugggggaaacuucacaaguccugggccaccugugccucugggugagcuguggagggcagugcaccuggaaucccccagccgagaccccuaguggggucggacacagugucugcucagucaggugccacaacauucggucauuuauuuuuucuaauauguagagauuuuccuuuguagagcagaagagaaagugcaaaaguuuagagagagaacuggcugccucuucucagaacuauguucugccugagcugcuggauguggggugagccacaugaccucuggggccuuggccuccuccuuguugaaauggggaucauauuaguuccuccuucauaagauuguuggagaauaggaagugagcagauauuucuguaaugcuuuacggacugcgaggcaacccaaagcauugauguguucuucgggaacuuggguacuggcggcagaggaguuuggagaggcagcugccauggccagaccagagacuuuaagcuggagaauugcugggacaccccagguagugucauaagagaaugguaacaccucguucucugaggaauuugguaacugcgacuuuauuuuaaaaaaucauuuguuuuuagauggagucuugcucugucacccaggcuggagugcaguggcacgaucucagcucaccacaaccucugccucacagguucaagcaauucucugccucagccucucggguagcugggauuacaggcgcccccccaccacgcccagcuaauuuuuuuuguacuuuuaguagagacgggguuucaccauauuggccaggcuguucuugaacuccugaccucgugauccgcccaccucggccucccaaaguguugggauuacaggugugagccacugugcccagccagcugugacuuuaacaugacucccuaacguaacaggcacugccuagggcugagccuccccugugggacccaccccaaggugcucuuagcucaaggucaugccugggucauguuagacucuuacuuucccaugagguaaugagcauaucacucuaggccaggcuuucucagcuucagcacuguugacaccuggggccagaugagucuuuguuuuggagagcuguggagcccagugaggacauuucacagcauucuuggccuaugucuagcagaugccaguagcaccccccaaguugugacaaucaaaauuaucucuagacauugccagauguccucuuggggacaggggagcaaaaucaccccugauugagaacuacugcuguaggcugaaggaaucuuggugagguuggaacacaaggcagauaaauugacaagaaaccacagacucuagggcuguugguuuugaaucaguucagccuugauuacaaaauuaccucuugccugggcaugguagcucaugccuguaauccuagcacuuuaggaggccaagacagguggaucgcuugagcccaggaauuccagagcagccugggcaauauggcaaaacccugucucuaauaaaaauacaaaaauuagccaggcgugguggugcacaccugugaucccagcuacuugggaggcugaggcacaagaaucacuugaaccgaggagguagagauugcagugagccgagauugcgccacugcacuccagccugggugacagagcaagacugucucaaaaagaaaagaaaacaaaaaaaaggccgggcacgguggcucaccgccuguaaucccagcacuuugggaggccagugcaggcagaucaccugaggucgggaguuugagaccagccugaccaacacggagaaaccuugccucuacuaaaaauacaaaauuagccgggcgugguggugcaugccuguaaacccggcuauucgggagguugaggcaggagaaucgcuugaaccugggagguggaggucgcagugagccgagaucgugccguugcacuucagccugggcaacaagagugaaacuccgucuuggaaaaaacaaaaaacaaaguuaucucuaaaccacaggauucaguagaagauauaugguuaaauacuuaaagcaccagccagguguggugacucacgcuuauaaucccagggcuuugggaggccaaggugggaggaucacuuaagaccaggaguuagagaccagccugggcaacauaucaagacccuaucucuaacaaaaauugagugggcaugguggcaugugccuguauucccagcuacgugagaggcugaagcgggaagauuacuugagcccaggaguucgaggcugcagugagcuauggugcacugcacacugcacuucaaucugggcaacagagcaugacccuguuucuuucuuuuuuuuuuuucuugucauguuggcuggaguggaguggcacaaucucagcucacugcagccuccaacuccuggggucagggauccuccugccucagccucccagggagcuggaacuaaaugugcaugccaccaugccuggcuuauuuuuggauuuuuuguagagaccagguuucaccaucuugcucaugcuagucucaaauuccugggcugggcugggugcaguggcucacgccuguaaucccagcacuuugggaggcugaggcaggcagaucaccugaggucaggcauucaagaccagccuggccaacauggugaaacacugucucuacuaaaaauacaaaaauuaguggggcgugguggugcaugccuguaaucccagcuacuugggaggcugaggcaggagaaucacuugaaccugggaggcggagguugcagugagccgagauugcgccgcugcacuccagccugggugacagagggagacuccaucucaggaaaaaaaaaaaaaaaagguauaaaucaaauuccugggcucaagcaacgcaccccacuucagccucccaaagugcugggaccauacccacuccaugacccuguuucuaaaaaacaaaacaaaaaauacuaaaagcaacaacagacgucagcacaugggaaaaacugaugccagucauaaaugcuuguggaaauuuuauguugugccgcacugucgagugcuguaguugacaaggugauguguuucacaagggcuuuuaaagcuagucacgcuugcccugucucagauugaauuaaaucagccugcuucagauucccuauggguaugaaaacuuccucccuucuuuccucggggcucacuggccccucuuauaguccugccucagguacuagccucuucagcaggugugauuaccuaggccaggguucaccuguucuaggacacucaggguucagguaauauaaguggguaaagcagauggaauggaugggcuagcagcuccaacuuauucucaggugggcuuggaggcucagcauuaauaaagcuuaauuuuaagagaggccaggcagaauaccaaacugugagcuaaauuugaccuguaagcucucugacuuaagccuuuccuugauuauauuuucugugucuucccuuuagcaagaauggauucgauuugaaucccacaguaagguuugccgaucugucucagcugguuagagaugccuugcgggcaaaaggcccaguagugugguagaaaaccuuggcuggaagggggcucagggcucagcgcucagccuaaccugugcuuucaggggagcucuuugcucaggccccgguggaucaguuuccuggcacagcuguggagagugugacggauuccagcagguacuucgugauccgcaucgaagauggaaaugguaggcauggguccuggugcuuccuccucuugggaaagguuuucucugccuuuggaagguggguugaucauguguuguuccccagggcgacgggcguuuauuggaauuggcuucggggaccgaggugaugccuuugacuucaauguugcauugcaggaccauuucaagugagugggucugggagacacacgcucaugccccucccuucuuucccuggacagaaugaucucccagguuaggauacccaaguguuugugugugauuugucuggcagcagagacucaggagaacccaggacaagccaccucucuucucugccaauguucaucucugcuguaaagccuucucuuuuaccugaggcucaucucuaccaucccagccuucgggccugccaccugucuccccuuaccaguccccugagcagccagaguccucaucaggcuccuguggccuuucugggccugcuccuccauguaaucaauggcgcuuggauucccagggcacccagcagaugcccugauguccuuuucugaagcuaagagacagggcaggaaguccuccuccaccaucugcagggcucgaacucaggcugccagugagugggcugugcccggccacucacaugggcgccucuggcucuucccuuaccggugcugcuggguggugugguauggagggugggggacuuuuguguugcccucuacuuuuggguaucugucuuguccccccgucugccuucugaguguuugaggguguguagagaccgcaucuuaguucucaugucauauacuguagagggaagggcaggcucucacguguccuagagauaguguuaggacccucuacguaagugaucucgcugcauucguagccaucuugaaaaccuauagaauugugggcauauuuugcugaugaggaaaccaaugugcaugccgcuacuuaagugucagauugggauuugaauucaggccucacucccaagccugcacucuuuccagcaccccgucucacuacgaggcucagccuggacugauagcaggcaguagugaagugagccagugauugcagggcagcuggucucuuccuuccucaccuuuuuccucauguucucuccccaggugggugaaacagcagugugaauuugcaaaacaagcccagaacccagaccaaggcccuaaacuggaccugggcuucaaggagggccagaccaucaagcucaacaucgcagugaguucuacccuugcuuggcuguggugacgugauacuuguggccacccagccccagagcccauugcucuucuuacaguucagcuccuucaguucagcagauguuuagugagcaucugccuugugccagguccugcaucggggugaacaagagaccucuguucucauggagcucagaguugagcugagacaggcagguaaaaaugugauaacaacauggcaggaaagguuccaugacuaagggaugcccugggugccgugggcuccuagaggaagggugugcagcccauaguugugggaaccaaggaaggcuuccuggaagaagggaccuguaggcaagggaagagugaucaaagagugguucacacagaggaacagcaggugcaaagccucugaacugagaaggagcaucagucauuugcugccagaggugguguuucuguccuagcuauuagagugcaucaggagggaccugugugcucaucccaggcugugucuugaauaaggaagauuugggagaguucuggcaggagggcguugaggugggcgcugggaguccugggcagcuugugcugaugguguuguccuggcuccugugucuucguucugagcugcucugccucuggcuucccucccgucagcuccuguucauaggaacagguugggcugggcugggcugggcuggguugccuaaaguuggccuuuaccuggcugcaaggguggagaggggagaugaggucagagucaugauugcggggacccaaggaccaaguggauugguuuuuguuuuugcuaggaauacuguguugagauggauuuguuuuuucaagaagcuuuguaacucuaaaauaaugcuuuuccucuuuacuuacucuuucuccucuuuucugcuucgugcuggugaugauuugggauccuugaaguuggccagcuggcccuuaagagagaaaugcaaguccaauccaguggacugguugggaugugauucuuucucucgcuuggaggaaacuaacauuuaaugagcaucagcugagggccagguagugguuuuuuuuuguuuuguuuuguuuuuuguuuuguuuuguuguuuuuuuuuuuuaggcauuucucaugugaauuaaacauccucucccuuuccuccaugagaugaggaaauggaggcuuagggaggguuggggacuugcccagggucacagagcuagaaauaacuggcacagcugugcucacacugaggucuuugaggucuuuugacuucagggcuggacuuacgauuuuauuaagcugcugcuuuccuuacaaguagggaacacauuaucuucaucuguguaacuugugcugcuuucuggcucaugcuuggugcucaguuuuuuuuuuaaagcauuuucuugaaguauaaugugcauguaaaaaaguguacaaaucauaaaugcagaacucugugaaauuuaaaaaaucuaaucuauaggcugggagugguggcucacgccuguaaucccagcacuuugggaggcugaggugggcggaucaccugaggucgggaguccgagaccagccugaccaacauggacaaacccugucucuacuaaaaauacaaaauuagccgggcauggugguccauggcuguaaucccagcuacuccgggggcugaggcaggagaauuggcuugaaccugggagguggagguugcagugagcugagaucgagccauucauugcacuccagccuggacaacaagagcgaaacucuggcucaaaaaacaaaacaaaacaaaacacccaauuuauaaacuugcaccuugcucaagaugcaaaagauugucagcacucuggaaacaccucuccuggccccucccaguaacugcccugaguaaccccauccugacuucacauacccuagauuuuguuuguucuuaacuuucaugaauugaaucauacaccuaaucuugauuuggaaugauuucuuucuuuuacucaauguaauuuuugugagagucauccaugguguugcguguaguuuguucauucucauuguuguggcauguaccauugugagaauucacccgauuuauuuauguuuuacugaugauggacauuuggguaguuuccaguuuggggcgauuacaaauaaugcugcuguagauguuugaguucauguuuuuggugcauauauguaugauuucuguugguuuauaucuaggaguggaacugcggagucauaaguuuaaguuccuauguugagcuuuauaauccuuucaaauaauuuuucaaaguaguuuuaccaguuuacacuuaagccagcagcgcgugaaugguuacuucauaucguagucaauacuugauaaucuacauuuuagccauucuggugagcguguaaugguauaucauuauagcuuugaucugcauuucccugaugaaugaagugggggugcuggguuuuaaaauggaccuuauuugugagagauucagaaugaugaugcacuaaguauagcucauagcaauggaggugcuagguaggaccaucuuuugguuacacagauguugggggucuggggucaccuuggcccuccuugugggguuuucugguagcauugggacuccagcagaacgggcugauuugcauuccucuucccucuuuagaacaugaagaagaaggaaggagcagcugggaauccccgaguccggccugccagcacaggagggcugagccugcuucccccucccccaggggggaaaaccuccacccugaucccucccccuggggagcaguuggcuguggggggaucccucguccagccagcaguugcucccaguucagguuagugcucagugggugacugcugcaucaguaccugccggcuccucuucucccuggcagccaggccccaugguuucccccccguuacacacauggauuggucauguaguaccuguccgugucaaagaaggcgggcacccaaagcucauucugcacacgcuggguaaggggcuccuccuacuuggccuuuagggcgucugcccuccccugagaggccagggcugcgacuuguuaguuacugugaaaucaucaacaugucgguuccugguucccagugucugcucaguggguauugagugaguggguaauggagacacagucucugcucacguguagugagagagaugagucacagcacagagaccaaauguguagggccuagacccaccaucagcugcugugaucuggagagguuucaugaaagaggugacauugaucuggaccuugaaggaaggagauagagugggagugguuggcauuccaggcagagagaagaacacgaaugaggcccagacuuuuagacaccugguguauuuagggagauggguacagcauaaggugugccaaggugaguggugggaaaugagauuucguuuggagugagcaccucgggugugggaaucugagagcauuugcccuggcaguuugugcugaggagcccuuaggagacccugggauuccggaagcgagugucuagugucagcuucugaccacgcuggggugccagcccuuuuccucuaccuccccgcgcgccccccccgcccgccgccccgcccagcccagcuugaugcuccuggccuuccccaggcugggcgauugucaccagcgugccuucugcacacagcucuccccagcuugcaggcaggaagccuuccugcuuuacugauuccuaagccuccccaacauuggcugcccuaucuggaggucaagcuucagacuucaguccuguggggagaguggcaggaggggcagucagagagccccggcccgguaccaggaacuguucuuuaagugcuauuucucagaguggggucauaggaccacuugcuuuggcaucgcugggggaugggggcaagaaucugcauucuugugucuuuuuuuuuuuuuugaaauggaguuuuuuugcucuuguugccuaggcugcaguguaauggugugaucucggcucacugcaaccucugccuccuggguucaagugauucuccugccucagccuccugaguagcugggauuacaggcaugugccuccacacccagcuaauuuuguaauuuuaguagagacaggguuucuccauguuggucaggcuggucuugaacucccaaccucaggugauccgcccgccucagccucccaaagugcuaggacuacaggcgugagcuacugcacccggcccuuauguuuguucuuguuuguguguugacuaaagucugagagcuacuaccuuaggccuuccuaagcaaccaagguugcugauggauauuuauuuauuuaagauggagucuugcucugucacccaggcuggagagcaguggcauguucucggcucaccgcaaccuccaccuccuggguucaagugauucuucugcuucagccuccugaguagcugagauuacaggcacgcaccaccacgcccagcuaaguuuuguauuuuuaguagagacaggguuucacuguguuggccaggauggucucgaucuccugaccucgugaucugcccgccucagccucccaaagugcugggauuacaggcaugagccaccgugccuggccuugcugaugcauuuuuaacagcauuuuaauuuuaauauggugcacuugcugugugccagguagaguucuaggcacugguacguauagcauccaguuucagcucucaagggcuuguuuucuggugucugagacaggcaguuagcaugucaacaaacaaaauggugucagauaauaagucaugaauaucaacauuuaugaagcacuuacuauaugaacaauaugguuggguucaaauuucagcuuacuagcuuugugauauuuauuuauuuauuuuuauuuuuuauuuuugagauggaguuuuuugcucuuguugcccaggcuggagugugauggcgcaaucucggcuuaccacaaccucugcuuccuggguucaagcgacucuccugccucagccucccaaguagcugggauuacaggcaugcgccaccucacguggcuaauuuuguauuuuuaguggagacgggguuucuccauguuggucaggcuggucuugaacuccugaccucaggugauccucccgccuugaccucccaaagugcugggauuacaggcaugagccaccgcaccucgccuacuuauuuauuuuuaagaaggagucucacucuguugcccaggcuggagugcaguggcaugaucucagcuuacugcaaccuccgcuuccuggguucaagcaauucuccugccucagccucccaaguagcuggcauuacaggcaugcaccaccauaccuggcuaauuuuuguaauuuuaguagagacagagguuucaccacguuggccaggcuggucucgaacuccugaccucaggugauccaccugcuucagccacccaaagugcugggauuacaggcugagccacugugcccagcccaguuuugugaucuuuagaaaaucacuucuccaugccucauuuuucucaucuguaggauaggggaaguaaugauacuuaaaauauaaguuucuugugaggaucaaauaagcugauuuauguauagcacuuagaacaauuuuuggaacauucuaagugcucacugaauguuagaucucauuuuauuaauaucguuauugccacuauaugcuggaccuguucuaagcauucuguggauauuuaaucuucacaccaguccuauggaguaguuccuguuauuuucagcauuuuagagguaagagaauggaaacugaaaugaccugcacagucacguggcucaucccaaucugucuuucccuaggggcuggggugagguucacagaagauaaugugccuugagcacuuggugaacuguaaaacucuaaaccauugagggcccuaguuuuaucuguucuccuggcccagagcagauuagaaauagcaacuuagugccaagguggaggguggcaaacacaggcccuucagaagggcaguuggcagcacugggggaggugccugaaaagcacaaaagcaggcauugcagccccauggcgucgccuaccuugguggagagauaggauugagcuucugugugagcucuuuggaaugcucuuccugaccccuaaccaguuuggggccugggacuuggcacguggcuggcacguaguguucucagccaguucauccagacaugguagugcaggcuugauaugaagaugaucuugcgguuuugguggacauucuccguucaagaagcuaagacggguuauaguaaauuuuaaauagauuucaacauaaaugguugauaacaaagucagcuucagguaugcauguuagaugacgugagacuaaccacccaucccgcgggcaccccucguuccaccuuguauguggcuuucugcguuuucuccagagcgcacaagggcuggugagaagaugcuggaaguguggcaacucaggguguuugguugcccaaaagcaugucugguguggcuuucccagcuaccuggugucaugagacugaucacugagucucaugauuuggucauugaaacaaccagaaaggucucugacuucucuguccccucuucucuuccuacgggucggacucgggaacaucaauaggaggugcuccuguacccuggccacagcccaauccugccacugcugacaucuggggagacuuuaccaaaucuacaggguaaggagggccauguucugcggaggggcuggggccagggccguugcucuacaaaccugguauuguuccacaugccugccuucugguguuaggauuaggaguaacaguuuuaauuuggauguuuucuuuucuuuuuuuuuuuuuuuugagagggaguuuugcucuuguugcccaggcuggagugcaauggcaugaucuuggcucgcugcaaccucugccucccagguucaagcuauucuccugccucagccuccugaguagcugggauuacaggcaccugccaccacgccuggcuaauuuuuuauauuuuuaguagagaugggguuuuaccauguucgucaggguugucuugaacuccugaccucaggcgauccaccugccucguccucccaaaguacugggauuacaggcaugagccaccgcgccuggccugauuuggauguuuucaagcuagccagaggacagagccccagcgugccugcuuuggguggcacacgucuuuccguggagguuuugcugcuuuccagugcuauauagccuggggcaacccuuugcaaaucugggccuuuaaaccgccuucccaagugcuuuggcuuguccccaguaccuccuucuucuauaccccaucccccaccuuccccaaaauaguggacugagaguucagacccaggcuccagccucagcccauccucauagaacgccugaggcuagguggcuugucuucucugauuccauaagaucucaagacuuuacuuggggccagggugaaaagauacuaaauuccuacugcacuauuauuuacauggacagauucuaggacaggggucagcacacauuuucuuuuucuuuucauguuuugagacagggucucucucugucacccaggcuggagugcaguggcacuaucacggcuuacugcaaccacauucucccauguugcuggcucuacaggugcacaucaccaugccagcuauuuuuuguauuuuuucauagauacgggguuuugccauguugcgcaggcuggccuugaacuccugggcucaagcgaucugccugccucggccucccagagugcugggauuauaggcacgagccagugugcccagccacauuuucuguaaaggacuagauagcaaauaguuuagacuauucaggccguguggucuucguucuagcuacucaguucugcucuuguugcacaaaagcagccacagacaauauguaaauaaaucagcauggcugugugccaguaaaauuuuauuuacaaaaauagaggcaugggcugggcgcgguggcucaugccuguaaucccagcacuuugggauucccaggcaggcggaucaccugaggucaggaguucaagaccagccuggccaacauggucaaaccccaucucuacuaaauacacaaaaauuaguugggcguggugggguggugccuguaaucccagcuacuugggaggcugaggcacgagaauugcuugaacccgggagauugcagucagcugacaucaugccacucuaguccagccugggucacaagagcaagacuccaucucaaaaaacaaauaaacaaacaaaaaaaacagaggcgugaaaugaggacuguaacccuuuuccuguuugcccugagaaaacuugccaguggcacuucagacugcagcguugacccugagauaacuuugccacaaaauguauugcuuuuauauuauuuuugcaucgcucuaguauaucagcuuuggaacaaaagacauucuauuuauagcauucuguuuuuaauagugguauuuccauuuacaaaauauaguaauucuguuuuuuuuuuuuuuuuuuuuuugagacaagguuucacucugguugccuaggcuggagugcaguggcgugaugucggcucacugcauccuugaccuuccaggcucaggugauuaucccuuagccuccugaguagcugggacuacaggcaauugccaccacacccggcuaauuuuuuguauuuuuaguagaggcgggguuuugcuauguugcccaggcuggucuggaacuccuggaauccagcaguccgccuaccucagccucccagagugcugggauuacaggcgugaacuaccaugccuggcccaaaauauaguaauuauugauuacugaaaaagucaaauccuagaaaacgcagcauucuuacaugugauguuaacaucguucuugaacaguuuuuagccuaagauucauuugaggagucugauuuuuccaaaauaguucugauuauucagaugauucugaaauaacuccaagaacaguuuuuauauuuuauuuucacguugaaaaucagucagauuugcuucagccucaaagagcauguuuauguaaaauuaaaugagggcuggcagugagcuauauuuuuucuacaugggaaagggguuaagacucuucggccaggcauguuggcucacgccuguaaucccagcacuuugggaggccaaagcaggcagaucacuugaggccaggaguucgagaccagccugggcaacauggcaaaacccugugucuacuaaaagaaauacaaaaauuaaccggucauguaguuccagcuacuagggaggcugagguaggaggaucgcuugagcucaagagguugaggcuauaguuggccuugagugugccacugcauuccagccugggcgacagugagacccugucucaaaaaaaaaacaaaacaaaaaacaaaaccacaaacaaaaaacuuugguaaauacaguuacauuaacuauuuaaaaaaaaaaaaccaucgagggccagauuuggucucugugccagaguuugcugacugcugcucuagaacauuuaggaacuggcuucuuagagcuuuuucuguccagagagaaaccaacuuuuaucugcuuuguauuuucaaagaucugaacucccccacccuucccugucuucucuuuacagaucaacuuccagccagacccagccaggcacaggcuggguccaguucugaccugagcacgguuuuuccucaugugacuucugggaaggcgcucccucaucugggccaaaggaaggaggacgaagcccuccucagcuggccuguguuuggggcaugaaucucuccucuccuccuugucuggcucuguugacaaaccgggcauguuuggcaguaaauuggcaccgugucacacuguuuccugggauucaaguaugcaaccagaacacaggagaagaaaagcuccaggaucccuguccccaucuguccucuugaugugagagagacucugagacuucuuccaucgcaaugaccuguauuaaacacaagccccccaagcaaaagaagagguugaguuugcugccaggauucagaucagcccuucccagggucugcaggugucacaugaucacaguucagcgggaggcuuuccguacccacacuggcuguagccacuucaguccaucugcccuccagaggagggguuucuuccugauuuuuagcagguuuagaggcugcagcuugagcuacaaucaggagggaaauuggaaggauuagcagcuuuuaaaaauguuuaaauauuuugcuuugcuaaugugcugauccgcacuaacucaucuuugcaaaaggaacugcucccucggcgugccccagcuggggccucugaagggauuccucacugugggcagcugcccugagcuucaggcagcaguguuuaucucuggccaguugucugguuuccauguauucuaggccagguaggcaacacagagccaaggcgggugcuggaagccagacggaacaguguuggggcaggaagguggaugcuguugucauggagcugugggaguuggcacucugucugcugguggcccucucggcucacauguucacagugcagcuccuggcagacuuggguuuucucuuuggugguuucuaaagugccuuaucugcaaacaacuucuuuucuccuucaggaacugugaauggcuagaagaaggagcucaguaaacuagaaguccaggguugcuugguuuacugguuuauaagaaaucugaaagcaccucugacauuccuuuuauuaacucaccucucaguugaaagauuucuucuuugaaaggucaagaccgugaacugaaaaaaguguuggccuuuuugcgggaccagauuuuuaagauaaaauaaauauuuuuacuucugucauuguau

SEQ ID NO: 14203 - RNA, 834 nt, Homo sapiens
gaagccacaaguagauucauaucuccgguccaccacuuacaagauaugugaccauggacauugauuuacacuuuuugagucuguuuucccuuuuuuaaaauuaggagaauaauacuaucuuauaauuggugugaggauuuaaagagauaaugcauguaaagcgcuuaacacagugccuggcacacaguaagagcugaacacaugauguuacuguuauauuuggaagagaaaccaaggcagggguacaaugaggacaacucugagcgccgaaguacuguaagguggaacuuuuggauagcuaggcgcaugcgucugucuaugggcgcucuccuagcgaggacgcugcgcaugcgccggaaguugcagccgggaagccugcgaggucgguuccgcccgacucuaacauggcggcgcccuuugucugcucuggagugccguccccggccuucucgcggccgugaugcaccucccucugcggugggguccgggacauggcaggugagugucaacaaucgcccggggccggggaagucccgggagccggggcggaggcggcggaggauggggcgcggugggacgccggugacgguugugugggggaggggagggaaguggaaugggacgccaaccggggcugaggggacaccgcugggcgggagauugugggguggcggggcggggggcgucgccgggcgugcuggcggggagugggcggccaggcgaccgcccgggcgagggggcgcgugucaccucccgggcuggaugacaccccagcugguagcaucuccgcccccgccgcacggcugucaccgccccuugaccccgcgcgcuguc

SEQ ID NO: 14204 - RNA, 2922 nt, Homo sapiens
ggggaagcaguggcgaaauuggaugcuuuuugcugaguuucucagagaaguuucuggaaagauggagccaaagggacgcugggggguggggagcgccaggaagcaagcguuugaaagaaagcgaaaaaacccaagcgcaccgcgacaccuccaaccuucaagccacggcccaagcagagcccaaggccacugagacccucacgccagagaaaaagcacagggaccgcggcagccgcuccucccucugccacugcucagcccccgagacuccccagcacggggagagggcaggggguagccaugagaaaccuagagcgcucacuggacuuuugcgagguggaaggaaagccgaaacccgcccuuuggagccgccugugcgcacgggccccgucgagugggcucaguacguuaggacucagcguggccgccaaagcauugguugggggcgucuuucacuaauuuuuccuagguuuucucuucuaucgggcucugugguccuuucaccacccaucuucacuuugguggccugacgcuaacgcugcgaguuggggaaaccguaguaaccccgggccugaggggcgucccgggcggcggugcuccguuucuuccagcgguugccccuuuaagaaaaagccccccggagaggggcccguguggcugaguaaagguggcgugcgcccgcacaaaggcgccgcguuguuggcgggcuccggacccuguugccccugggcggggcggcgugggaagaccggggcgccugggcggggagaacgacguuggcgcuagcggggcagggcagggggagggagucacgggauuuagcaggugcuucuccgcgaccgagcgacugccauuuuguggugcggccgccgccauuucgcgcggccgaggggcggggugugggcggagcggcgggcgcgcccgggcugucccucggggcggcgggcuaacgcggccgcuuuguucuucgcuucucggcucgaggccccagucucgaccgccgaccgccucggaaccgggcugcauccgagcugccacgcggcgugugaaccuugaagcgcggccggggaauccgcaaggcgccgacucucuuccuccuugcaagcccuucgaaagugagauuucucaccccacccuugcaggguggagagaacacguuucaaaaaggggaugccuagaacucagccgugggaagugccugucuaaagccuugugcuggugccaguagcaaacccgugcgcgugcucggcuuugagcgaucauggagcucugcaaauagcucaacugcagagcgugccccuuagagcuccugugcugcugggaggccucauaaaggugccaaaaccagguguccccagcgguuggccucuuuaaaaagaaaaaaaaaaaaaggcggagugggauguccuugacgugcugaaagacggaguagaaugagacguugguuuucauuggcuggccauuaagcacgcacugcgcaacuguuuuccagauacggguuuauagcccauuauuuauaucggagccauaaacuugaacaauagauuggaauaucuuauuuuugccuguugagaauaucucccauuuaacuucuuuugaaaguucagaugaguauauaaauaauacauugacccaguagaaucuauugugugcguuccagcgucauuucaaagagcuauuguuuuucugauuucaaaagaaauauuuaaaugugagucuuuguguuuuaauguuaaccuugugguucgaaaucaacaaagccaggaaauucaagagaacugcugcuaaauuugucuucuuccuuugcuuucguacaagguuuuuuuguuuaauuuuuuuuaaguuuuucuucacagcgugaguacauagaagagccagcccuuuauauucuuacuauguauaauuauagggaguuauuucaguaacaggagguaaagcucauaaugauaggaugaaaagguaaaagaacaucuguugaaggaaucgaucaggauuugauggcuuccagaugaaagaaauaucugagaagaggcuuuuggauuccaaauaauuuaguuucauuaugaccaaaagcacugcauagagcuuuaaauuuuuauaccguaucuuuugacaucaacuauccuuuuuuuuuuuuuuuuuuuaagacaaggucucuguuuuuugcaguaacgaaaucacagcucacugcagccucgaccucccuggacucagguuauccucccaccucagccuccugaauagcugagaauaggcgcgaaucaccacgcugggcuuuuuuuuuuuuuuuuuuuuuuuuuuuugaaggaggcucgcucugucacccaggcuugagugcaguggaucuuggcucacugcaacuuccgccucggggaguagcugggacuacaggcacgccucagcacgcccggcgaauuuuuguauuuuuaguagagaugggguuucaccauguuggccagcauggucuccaucuccugaccaagugauccguccgccucgaccucccaaagugcugggauuucaggcauaagccaccgugccuggcgcugggcuaaguuaaccuuuuguagugacgguuucaccauguugccccggcuggucuugagcgucuaggcucaagagauccucucaaaguguugagcuuacaggcgugagucaccgcgccuggccuauccuuccuuuuggcggugagagcuuacagaauuuuuuuuuaaaugcuguguuuuuuuucuuuuuugucugcacaaugaaaaugaaauaguguaaaacuauuaguuuuaguggaaauuuggaaucuguuacaguagccugauaacucagguaaauuauuauggcucuaauuagcugggcaguuuagauucgaagaaugauugcccagcacuugaacagacuagaagggucuguuuaaacacuccuaauucc

SEQ ID NO: 14205 - RNA, 2029 nt, Homo sapiens
cacucuacccaguucucuacccagaaugguuuugcucagucugcaaggagccacgucccccaggggacccagcccaggccagccugaggcacauaucccaggaccugccagaagagcuguguggccucagaaaagccucuuuccugcucucuguguuugugauuauucuuuguuguuguuguuuuguuucugagacagagucuugcucugucacccaggcuggagugcaguggcacgaaucucggcucacugcaaccuccgccucccagguucaagcaguucuccugccucagccuccucaguagcuaggauuacaggcacccaccaccaugcccagcuaauuuuuguauuuuuaguagagacaggguuucgccaucuuggccaggcuggucuugaacuccugaccuuaggugaucugcccaccuuagccuccgaacguauugggauuacaggcgugagccaccacgccuggccucuguguguucgugauucuaagcacagguugagaaagacaucgucuuuauuguucauggagaagggaagggagaccaguaaagggggagcccuccugaggaugcacccccaccccugcccaggaaggcaggucugagaggcugcaucauugcccaccccaagaaaaagaggguucaaccagggguccccagguguccccucuccagaggcucccauccccaaauccugccuucccuucucggggcucccagggccugugcugagcucugggcaggaggccagcucugccacucugccuccaggcaucgcccuggggucaaggccucggagaucaggcuagugggcuugagacagacuccagauccucccugaggcaggucaagagggggccgaacucugggacuggggugccgagggcaggggcuggcuugguguugacacuggaggccucugggauggaaaauccugaggaaaagcguugagaaugacaccacccauucacccaucccccugcgggccuugggccuccagugacccgggcacuuccucccccuugggccucuggguuguugcuggagagggcuguggacaggguggggggugcuagugaccuggaggacagcccuggccuggugaaagagggugggagaggugauuccagcucccucugccccugacccccaagggaagucacccuggcucugucuuuuuuuuuuuuggagauggagucucacucuguugcccagacuggagugcaguggcaagaucuuggcucacugcaaccucuaccuccuggguucaagugauucucaggucucagccuccugaguauuugggauuacaggugugagagaccgugcccagcuggcucuucuuaaacuugagccucuugaggcuccugggcuguuugaagcaggguucauugucugggggacacaugggaugggggugcccaccuguaucuggcagaggucaagcagggugcggacgcccacgagacaccagagcucgcccaguagggagacaaggaugcccagcagguccagccagcgacccacagucagcagcagcacgaagaggccgcccaugcgcaccagcaccgucugcaccuggcucugcaggccggggugcugccgcugcuccucugugggaugcgggugccugucaccguccgaccacacaccccggacuggaccucccugcucccugacccacccuccacaggaugagccuuccccucccgugcagcccuccucccaucacauccuccugguccccaucccugcuccgaguaucugcagggcaccaggugcucugccuccaggacucacugcccagcccacaggccuccaacugguccaggccagagccccacagccucgcagccucgcaguggcaggagucggucugacuccuuucuuuuccgcacacccgccucuagucccucaguuagcccuggcaacuccuucugccaagcacauucccagcugaacaccucucgccacucccauggacccaccugggcccaaaccaccuuccucuuuccaagaagccu

SEQ ID NO: 14206 - RNA, 1112 nt, Homo sapiens
auggggcauuggggcugaaggugaggaggguguguuuuggggguggggaggaacaccagggaccucaaauguaggacugggccuugagggugaggcacugaggaggggaggcuguggagggccagggggcccagggagggucuagggcuggggacuggagucuaggcugacccggugggggugcuggguccuccaggcugcgaaagccagggggccugggucugcacauugaggggguggcugggcuaaggaaggggaggaagauaaguggggcuugcaggcuaagagggucuuggggucccuggccagaguuaguggggugcacuggggucuccaaggaggggucuguggacuaaagagggccggcgggagggggcccagggucugugggugucucgagucucugaggagggccggggucucagggucugugggggucucuggccuguggggucggagucuccagaguccuuggggccugugggagucucugggguuuuguggggggauccugugggcugaggagggcuguggggagggucucagggucucuggggagggccagugccucggggucuuugggggucucugaggagggcugggggcccagggucuguggggguccccagcaggugggguuggggucuccggagucccuggagucugagggugucucugaggucccaggggggagucuauggccugagggcugagggggagggucuccagggucucugaggagggccggugucccgggcaggcggggucggggucuccggaguuccuggggucugagggugucucuggggucccugagggaaucugugggcugacgaggccugggggagggucuccgaggagggccggggucccagggucugugggggucucuggcaggcggggucgggguguccggagucccuggggucugagggugucucuggggucccugaaggaaucugugggcugaggagggcuuggggagggucucugaggagccccgagguccccggcaggcggggucgaggucucuggcgucccuggggucugagggugucucuggggugccggggagagucugugacuugaggagggcugggggcgggucucgg

SEQ ID NO: 14207 - RNA, 20969 nt, Homo sapiens
cucgcuuccccgccccccggcaagccccgcuccucacccaagccgcgggggaggagcccucuucuuucccgcccggccccggcccccagcaggaccccucccgcucagcugcuacagugggcacgaagaggggcauggcuuucggccgcgcuccccagccucgcggggggcagacgacggcgggcggggcgcgcagaguacacucgacccccggcggccgggagcgaucacgcgcacgccgcgcgggcccgggggcgggggcggggcgcgcgguccccgccagggcccaagucccaccuucgggggcggugccuggcccggggagugucaggaagaggaagagcgcggccggcggcgcugcgcugagagcaggggcccggccaaggcgagugccgcgcgggccaccauggccacggacgagcuggccaccaagcugagccggcggcugcagauggagggcgagggcggcggcgagaccccggagcagcccgggcugaacggggcagcggcggcggcggcgggggcacccgacgaggcggccgaggcgcugggcagcgcggacugcgagcugagcgccaagcugcugcggcgcgcagaccucaaccagggcaucggcgagccccagucgcccagccgccgcgucuucaaccccuacaccgaguucaaggaguucuccaggaagcagaucaaggacauggagaagauguucaagcaguaagugcccgcgcgacccggccccccgcccgccccgcgacccggucucgggccccgaaccccccgauccccggaucccgcuccgccccgggagccugccgucagccaagcuuccccgaacccagacgcaccgggguuggggacccggcggccccuuccagaucgagacccggcaucucaccgcgcacguuagucugggggacccccggccccuggcacgcggcggagacucguauuugugcugccuccgguacaccauagacgcguccacagagugggggaccccaggcuuccuuccagauaaucgccaggccccgcgagccccacccccaccaccacacgugugggucccgggcccuccgcgcuguuaguggggcuucuccaccaccccacaccgcacacaccgaggcugaggacccagcggccuuccuuccccgaucccagcuacucgcguuccccacccccaccccaacacacgcuggccaaagauacccaccccagugccccucgacaccacaugccaaccacauucccucccuuaaggucuuuucguuuccucugcgaucucaggucucccucaagguggguucugggcagggauccccccaacuuccucuccaguuacuuagcgucuaccagcaaacugggggcaaagacuugcccuuuccauccccacccacucauuagccaggacccaaauccuucacucacaaguggucuccuuaggaagggaccccucggccccuguugccccucugguguaaaccucacuccagucgucccugugggccgaguccccuccggguuuggaaggccucccucccgcuccugcccgccccacccccgugcacccagcagcuugcagucaccgcuccccugcuucugucgcaaggccccccaucucuccuccccacuccguauauccccuucccuccccacagggaccccccaugucccacacccacccuggucaaaaggggccccuuccuaugugacuugcccuguuacccccaccccuacccuuuauuccaucagauccacacugugugcccucaccaggguggaugggcacccccaggcgugugggcucaucccccuguccccccacaaaaacaaucuuaaugucucuguggaggggcuagggagagagggcccagcucccuccggcccaucccugggucccacucuguugggucuaagaugcacagccacucucucccagccaugugugugcccaggggauggggaaggugccagugccccucccuuugguagcuuuccccaccuccuguucccugucccccugccccuggcuccuggagagggaacagccucguuccacgaucugggugcuggucuggagugguucuggaaggggauagaacuggccugaggcugagucuugggggugagccaggaggucuagccccaccuggcacaggcagcccagggcugagggagggaugcggcaaggccggcucccgcuuggcugggcaggaggugggggcagaccaggggugucagccucagccacaugcagcugucagugccccaacaucaagccggaagcccaggaaggggcguuuugcaacugcacuguuugagaaaggcucugacccuacucaccacagcuugcagcagcuucugcauuuggccccaaggcagggggaaggauuucugguucccaguugcggguggcugaggagucccauacuuucccaagguccuucugggggaaaaucaaguccuugacccccggccccucugaaccucuuugagaaagucccagggcccagaaccucuucaagaaagucccagggcgcccacguccuuggcuccacgguguuugguuggaguucuucuaaaguuucuucccagcagaagacuggcgagauugggagagcaggauuuccaggauuccuggaagaguaacgugaaugcuccugggugggcagacgcagggguggguauggaucacugucugucacugcccccaucgggcagugcagagcugauucagacaccacggagaucccugugcugauagugcugaggcgcucaccaggucccucaaacagcccugugacacagagcucuucgucaccuuugugcagacaaaggguguuaaauaacucgccaagaccacacagcuagaaaaugauagagccaggacugaaacccaggucugugacuccaaaucccgggcucuuccccuuccggguuucccaucacagacaucuacuuucauguuggaaaaccuucuccaacacccgcuuccguguucguggcggauuguccauucauguccccaaccccagcccccgucucuccuuucccccagagccugccuucuccugggcuuccacagcuucccugccacuggccaccaaaacaaagauggagcuguucugggagaacccagacacuucaaaugagcgggacuugggaggcugcagugugguuggaaguggcaugcagcugagggaacagucuggaagcuucauuugcgcagcaaacucacuuuuuuuuacauaggcuguuucuggucuaguuugaugagagguacucugagggcgacugaggggagcuggaccccuccaagcuaccccuuggcaccugcacuucuugccaggguucuaggagggcugauggggcaggcaggggccaggaagcuggaccucuagggaagcaagugcugccugccagggcccgggugaggguggaaagcugcagauuguguauucaaggaaacaacgcuucacugugccaaccgagcccaaccccgccgccaacagacgggcucucguggaagacaaacccccguucugcuuccgcuguccgaguggggcugcagccuccuggguccaagcaggguccuaggaucaaagccagggcaucagagccagggcucuggggagagcagagggcagagaggaggggagccugcccuccugggaagccagucacuagagcaggaggcaggagaccaugaggucagcaggagaaugggagccagccuuuccuugggggccaggagcgaggaaccugggcuuccauccuagucugcuuguccucccugggccucagucuacccaccuguaaaaggggcaggcuaucccucaugacccccaaagguccuucagcccugaccugcguaugucugagggguccugagcccuucuggauauuggaacugccuuccagggccuucugguccaccccuccguguugauucagcagguacuuccugaggcuggagaucgagggggaagagaggggaugggggaagauagacagacugucagccaucacuggucucacaccuagagucauucagguuccuccugagagagaccugaaggguugacuccaaccccucuccccauuugacagaagagggaaccaagacccagaaagauguggcggugacuugcucgggguuacggagagguucucagugaggcugaaaccuuguaugaugaggagaguggucccggugucucaggguggggcuccgaggacaugacacacuuagaguucugggccagugccaggcacaaggaggcucugcgucucccuggcccucgcagccaggacucuccauccccgucuccgugcggccucaggcuacguccagcaucucugaucccccagcugcucccucccucucuuugcuccuccagggcuggcucuggaacccuccugucagagaggcaaagagaauggcccuggagagccucgggagugcccaccccugggcugacaacagccuagcgggggcucuggaggguuuuguaaguugagaccugcuggaaagguaggcagccguguaauucugaaccugccguggaaucugaggacgaugcccuagaucccugucucccgccuagcacagccuugcaggcccuguccccacugucauccccagccacuucaucucaggacaccuuacgucagagaggcaggcuuuccuuuccuucuggccagcucuucccugcacaagcucuggaagccucccgcccucuucuccacaccuccaccuccaggggacacaccucucccaggagcccuuccuggacgcagucagcagggccucuggagucugcagcccuggguuugaauacagcugugggcuguggagcccuucugagcuucuguuccucacgcuggaacagcggggacagggggacccacguuacaggguuguuguauggcgcuuagcccagugcuuggcacagagcaagucguuacuaaaugacugucaccgccauccccagcucagcauacacccucuccugggccccucauagggcccuggcaguggucauugcggcuggcucagaggcagcuccacagugcccacuggcugccuccacuuaaccaccagcggagcuuccaggucugccagguugucgacaacccuuugcuuugggcccuagugacaggacgcaggguuagagcccuccuucucuccugcugaacagccacucugauugacagcuacauauggcuuugauaaauaacaaaaagggagaaaugaauucauuaucaccuaguuucagggaaggcagguggcacaaaaaaggggagagcaaacaacagcucuggagggugcacaauggggauucccgucugccaccacccagcuggguugcuccaggcaagggacucagcaucucugagccucaguuuccccuggggcucaagaaccuaccugguaaaguucugaggauuagguauaaaaacacccugagucuuugugacgagcccaucauggugucugggcuguuugcaugauagaugauguuuuugaaaaauacaagguucucguaugugaucauucuuccaacagauauuaaguuuuugcgcuacaagauccagagaauuaaaugaaucaaguuccugcccucaagaggcuuauagccuuauauagaacaaacauguauagagguuuggggauagagaggauugcacccacaaggcuagcaauggaagguuuuuuucuuuauuucugccaugauuaccgaaagcucucaugaaugacaccaugcugauguucucuuuguagccagcccccugccucugugcccccuccuuguuaaacagagccacuaguucuagccauuccuggaggagccuaugcauauuauuuagagaacugaauugaauucucacaccagcacaaugagauugauacugucuuuguuuuccuuuuuuuuuuuuuuuugagauggagucucgcucugccaccaaggcugaaguacaguggcaugaucuuggcucacugcagccuucgucuccuggguucaagugauucuccugcuucagccucccaaguagcugggacuacaagcacacaccaccaugccuggcuaauuuuuguauuuuugaguagagacgggauuucaccauguuggccaggcuggucucgaacuucugaccucaagugaucugcccgccucagccucccaaagugcugggauuacagacgagagccaccgcucccagccugauacuaucauuuuuauccccauuugacagaugagaagacugaggcucaaggcgauugucacuugucuaagauuauauuaaguggcagugacaggauuagaaccagauccuccugcaaggagccccuggaggccaagugaagccguguuuguggcuggggcuugggggagccuccgagagccuuagagagguggagaggugggguccuucaccugcagcuuagggucaguggguggggagaaugcccugcaccccuggggaggaaggauuuccuggccucgguccuuacuccguuccucccacuuccacuaugcaucagccucugagucaccucuccuuccccacacccccggcccaggacuuuugguuccucuuugguccacccuuccugccuucuccggcuuccucgcucuccuccaugcuaccuggguccaaggccugguggcuuggacuggcuuccacugugagagucuaggcuccaggacagcaggccuugcugccucaggggaugucagaggucguuuccucaaggccagcccugccggcagaggcagagucacuuugcagccucagcagggaagguccccacacccuggagcagcugaguuccccugacugccgggcaaccuucuccuuggcugacuucugcuuuucaaggacaacagagaggcaggggucagugccagaaagguguggccagaugggagccgggccgcccagggaguccugagccacagacacuucaaaccagaugcuuugccucccguucaguccuuucuuauccugcaacauuauccucgcccauuucacaguuaaggaggcuggacuuucagaaggguuaugugacuuguccaaagucacauagccagugaggggcagaauaggauuugaaccugggccuccccggcuccaaguccucugaacccuuacaguggcccaaacaccagcagcuucaccgcccgggaguauguuagaaaugcagaugcucagauuccaccccagauuuaccagacuguaaucugcaauuuuuuuuuuuaagagacagagucuugcucugucacucagaccaagugcagugguacgaucauagcucacugcagccucaacuuccugggcuuaagugauccucccaccucagccuccugaguagcugggacuacaggcacaugccaccacauccagcuaauuuuuuuuuauuuuuguagagauggggucucauuauguugcucagacuggucucaaacuccuggccccaagccacccucccaccucauccucccaaagugcagggauuacaggcaugagccaccacgcccagcccauaauccgcacuguaaccagcuucaccaggugugcacacugacguuuaagaagcgcuaagccucggcucaggcccccgcacagccgucuccccaccacuuccugagguugaccuaagguuauccuuaggugggugacuuugucugagcuguaagaggauaagauguauggaguaaagauuaaguuacguuauaaacacuggguuauguuaauauuaggcauucaauaaauauucuuuauaaucacuaucauaacaauaaugacuaugaagagcaagaagcgaaaggggguggcuggcagggagugccgugggugcggugugagguuguugaacuccagguuaggaugccuuugagcccugacagccccccagcaaauugcuuggggucucccucuuuauccuccgugggggagccccaagcgccacacuuaugugcucucuaucucuccgucucucucucucucucuuucucccccaaccccauaccccacuuagcugaacuagggcaagagaucaagugugagauucccagauaggacuagaggaaguggugagcgcugggcuuucccuauaugagucaggcagucuggggguggggacaugcaggaacuggggaagccaggggggccugagggcuccugagcccauacccaacacccacccuguccaauugucuguucuccugggaccugcacgcccagagcggccaucaguaaagccugggaugggagucaggagagacagaauuggggucccugugcucccaccuucccgugugcaguuuuugcaaugacucugcuuccuucugccaucagacugugcagugcagcuugggggcaccugcacgaggagcaacuuucuuucuuuuucuuuuuuuuuuuuuuuuuuuuuuuuuugagacagagucuugcucugucacccaggcuggagugcaguggcacaaucuuggcucacugcagccuccgccucccggguucaaacaauucuucugccucagccucccuaguagcugggauuacaggcaugcaccaccacacccaguuaauuuuuguauucuuaguagagacaggguuucaccauguuggccaagcuggucucaaacuccuggccucaagugaucugcccgccucggccucccaaagugcugagauuacaggcgugagccacugcaccuggucgaggagcaacuuuuuuuuuuuuuuuuuuuuuuuugagauggagucucgcucugucacccaggcuggagugcaguggcgcgaucucggcucacugcaagcuccgccuccuggguucacgccauucuccugccucagccucccgaguagcugggacuacaggcgcccaccaucacgcccggcuaauuuuuuguauuuuuaguagagacgggguuucaccguguuagccaggauggucucaaucuccugaccuugugauccgcccgccuuggccucccaaagugcugggauuacaggcgggagccacggcacccggccgcaacuuucuaauaguuccaaagccaagauaggcccccccuuaaguaagcaaugagcuuccuguccucagagguauucaaggcacuaaacaacgaacugcaucaggaaucugauuuucaggaacgacugaauaagauggccucuaauaucccucccaaccccgaaguucucugcuguguccugauaggcaucagggcauagcauagucguuaagagugcauguguuugaucaggccugguucagagcccagcgacacccuugucaccuaugaccugggcuaagucgcuuccccucugagccucagucuccuugucgguucauguucaugccgcuucauaggcuucuugugagaaucugaugcaaaacaccuggcaucgugccuggcacauagcaagugcucagcagaguagccaggaaugaugauagauuaugacguggggcucaccugggugcaaggcugggacaucugcacugugcaugguugacgccuccacugccuaccccugugacucccuaguuaucagaacuggggagaggggcaggggcagggaagcaaccagcuggggaccaugcucaccccaaagggaaagggucguccuugggggguaacuggcugcuccgcuuucgagagggggauggauggggauuuuguccccagcauccagggugcagcuagcugcugagcccucccugacgagaacuauucaaggggaggcagauaggaaugcgggcacggugccaggccccgcagccucccuccggugcuggagaaaagugcugagcucccaggcugggcgcuuucugccaguacugccgaauggcauuggccuucccaaacaggcaccaagcugggcucucaguccagccuccacuggcccugcaagcuugagaaugugggacccuccaugggaccaggaaaaagagaggggccagggaggagaaaaacuuccagcuguuggaauccugcagucugcuggcugugugacccugggccagucacugcccacugugggccccaguuucccuacauaauguaaaacggguagaccaggcuaucuggguggaucuugcgggcugaucucucuuuuucuggauccucuaagccagcugcaaccucaguuccagcucagggagaagggcuggugggugagaggcccucuagcccaggagaugccuguuuccagccaucguggaaccucguucucuccugugcugccaguugucccacacacacauuggcaccaugagaguagccccuuccucacuuuucuccaaccccgagggaagguuccucgcucccugaggcuccucucucccuguucaagggcucuguccagcggucuucugucuuccuaccucccagagaugcuggggcuuugcgucgggccuaguaggggaaaagugggccuuuagaggagaggucaugcuggagggauccccugggucaucauguccaccccugccuccaggccaagccaccacaagcccugccucccaacccuguaccaccagucaggacuggagccuguggcagaagccaguguguuuuuuaucauuauuucuaauaucaucacccuuuuuauauuguauaugugaaguauaugaugugcauaugugacacacacaaacuucucaauauaacaacuacuauuacgaugaugaugaaauuaacagguuugaaggacucacuaugugccaggcauuuuauaucugucagcucauuuucauuuucuuuuuuguguuuguuugucuuuuaaacaaggucucacucuguugcccaggcugaagagcaguggcucgaucagggcucacugcagccucaaccucccgggcuaaagugauccucccaccacagccucccuaguagcugggaccagaggcauacaccaccacgcccagcuaauuauuuauuuauuuauuuauuuauuuuuugagacagugucucacuuugucacccaggcuggagugcaguggcaugaucucagcucacugcaaccuccaucuccuggguucaagcaauucuccugacucagcuuccugaguagcuggaauuacaggugcgugccaccaugccuggcuaauuucuacacuuuuaguagagacggaguuuuaccauguuggucaggcuggucucgaacuccugaccucgugauccgccugccucagccucccaaaaugcugggauuacaggcaugagccaccgcaccuggcccuuuauuuuuuuauagagauguggucucccuaucuugcccaagcuggucugaaacuccugggcucaagugauccucagccucccaaagugcuggcauuauagacaugagccaccacguccagccucauuuacucuuuaauaaucuuaaagguagauguuaggaauaauaauaacugguuuuuaguaucauaguaggcauguaugaagugcuuccuguggaccaggcucugugccaagagucugcuuguaucgucucuuuuaauccuugccuccauccugagaugaguucuuugaucuccaugauguagaugaggaaauugaggucugugggguuaggugacuugaccaggucacucugccagcagguggcagagcugggguuuggacccaggucagucucagcggaguugauguaaccacaaacccucaaggccaucuucaaucagguugacccuggaaccuggcugauccccugcacuagaccacaucagagcccagggcacagggcagauggccacucuccaggagucucuugggaauggccuccuccacggcuaccucugggggcuucaccgcccaccccagcaccuggccucucgcagcccccgucaccuccucuuggugauggacucuuuggcaccgcagccagccccuguauugucccccugggggccagagccugcccuggauggagcccagccccaguaauugauuggccuuugauugauagaggcggccguucaaaucaugguuugagccacagcccagccaggccugggagcugccaaagacagagggauccacagcccacguuuccauccaaguuuggacacuuuaucugcacuuccucugaaacugagcugccccuggcugcagaagaaacccaugcacuugagcaauaaauaaagcuggggcucagggagagacacgugggacccaggggcuggggcgugaaccccugaccugcugguuaugggaccuguggccucaccaacagcccuccugaccuaauccggaccuggaggauugcugagcacagggauuguaaagagaaagugcuggugcguugggaguuuagugacggugauucaaucuuguuuuagcgguggugacugccauuuaugcagcuagcucugugcgcugggagcugugcugagugcuugacagggaugggcucagucguuccucacaguggcccaugagagaggccccauugcagcaggguucucagccucagcuccacuggcacuuggggccaggucauuccauuuuuuuuuuuuuuuuuuuuuuuuugagacagagucuugcuuugucgcccaggcuggagugcaguggugccaucucagcucauugcaaccuccaccuccuguguuuaagugauucuccugccucagccucccaaguagcagggauuacaggugccugccaccaugcccagcuaauuuguguauuuuuaauagagacaggguuucaccauguuggccaggauggucuugaucuccugaccucaugaucugccugccucagccucccaaagcgcugggauuauaggcgugagccaccgugcccagcuggccaggucauucuuugcgguggggccacccuaugcgcuauaggagcuucccuggccuccacccaccagaugccacuggcaucccccccaccuccgccgccccagguaugacaaccaaaaacaccucuagacauugccagaugucuccuggggggcacaugcaccccagcuuaagagaugcugcauuuuggccaggugcgguggcucacaccuguaaucucagcacuuugggaggccgaggcggacggaucaugaggucaggagaucgaaaccauccuggcuaacacggugaaaccccaucucuacuaaaaauacaaaaaauuagccgagcgugguggcgggcaccuguagucgcagcuacucaggaggcugaggcaggagaauggagugaacccaggaggcagagcuugcagugagccaagauugcgccacugcacuccagccugggcgacagagcgagacuccgucucaaaaaaauaaaaauaaaaagagaugcugcauuuuguggcugaggagcccaggcaauuuggcuucagagccugacugucaucgcugaccuugggagcccagggucagaaagcggcagggcuuugcuuuccuggggggcacugaggaggggaguccucgugacuuggcucaggaaagacugagucccucaccaggugcuccugcacagccccacggucauguggcgcccgcccagcccucuaccaggcagcaaacagggaccagagauggcaggaggcgccuccgcugugccccccagaaccccuccagcuccagguggaggcuggaccacagcagcuuuggccugccugacccucugagucccacaccuucuacugucacagagguggccacugcccacaggggcugcuggcccauccaccuccaccccaacccucauccaucaguggggcagaagccgcaggacccuguguucccuccagggcucccaagacccaucuuugcugugucacuuucaaccacugacucacuggcucgugaacuauuuauaccccucgcacaaaugcuccccuugugcuccaggcagccgucuguguucugcagcagccccaggacacguuggggaggggcuggguacagagcaaaugugcaaguuuaugagcccagcagaucaagucuggaagcccagcuccuuccuuacugcugugugacugugggugggucacuuaaccucucugagccuuggucauaaaauaagguuauuaggaaaauuaaguaaaguaagcaguucccagcauaaagacagaucucaguacaugguugcuauuagguguucaaaguacaccuaacuagagaaggcgaaaggagcuggggagcccguaagaaggugcagaaaugagacauauucaugcagaagcucaagcgcccgggacauaggguucuggaacacauccaccuguguugcgcugcugucaccagcacugucacccagccaguucaaggccugggggacugcacaagccuucuuuaggugcagaaaaacccauuuuggcugggcaaaguggugcacgccuguaauuccagcacucugggaggcugauguaggaggauugcuugagcccaggaguuugagaccagccugggcaacauauugacaccccgucucuacaaaaaaaauacaaaacuuggccagucaugguggcaugcaccugcagucccagcuacuugggaggcugaggcgggaggaucgcuugagcccaggagguagaggcugcaguaagcugugaucgcgccuggguaacagagcaacaccccgucucaaaaagaaaaaaaaaaaaaagaaaaacccauguuaccaacucugggaucacucuccccagcccccaucuugucuuccuccuacgcuguucccagagaccaguagggcagguguuugguugauaagagagcccagcugggcaaacagcgccucgcccucuuucaccaggcugugugcuccaggaaccaguggugccuucccagccaggcaacaggcagaaaggccaccuagacucuuacuacacagaagccagucaagagggacuugcccccaaccccaccccugucucugccagguuguuagugguagaaaaaaagagaaccugagagugcagggcagaggggaggcaucucuaucgcccgaugcuuguucccggcuuccccaccaccccgccaaucuccgccacucccugcaggcacugcaccacacgucccugaacacacccaggcugccuccugccaccuggcccugccuccugcccccguccugcucugugcccucgacaaaggcagaggcccugccuuagauaccccuucauuuauucacgucuuauuucuucauuacacauuuuugagcaccuacugugugcuuuuuaaccuccuucccaguaccuagggcaagcuggggggcaugaaauagaccccccaguacagagggugcugaguaagaagagucauuuaucacauggaaagaggccgccuuccacacccacgucacauccccuauuccagugcuucucagcggagaaugcuuuuauccugcuggggacauucgacaaugucugggagacauuuuuagcugucacaacucaggagggaugcuacuauaaacaucccacaaugcacaggacagccccuacggcaaggauuuguucuguccagauuguuuaaggucugagguugagaaaccaugcccuugccugcaagguucugccaucuagggugggggugagauguccuccaagugcccauggagaugccaguaagccagcuggucauggagguggugagugagugcucagcucagagccugauccacccugccgugguauugagaauuccuucucggccaggcacgguggcucaugccuguaauccccauacuuugggaggccgagguggguggaucacuugaggucaggaguucaagaccagccuggccagcauggugaaacacugucucuacuaaaaacacaaaaauuagcugggugugguggugcaugccuguagucccagcuacucaagaggcugaggcaggagaaucacuugaacccgggaggcggaggcugcagcgagccgagauugagccacugcacucgagccugggcaacggagcgagacuccaucucaaaaaaaaaaaacccagagaauuccuucucacugucugugccaucacauucagcacacggagccugucauuucagcuuccuugugccucaggcuuguccaaaaguuagcgcuauucgacaugcaggaggcugccaggcccuguggugaguuccccgucaucagagguaaccaagcaggagcugagccacauauggguccucugccuggacugaggucccuuccaacagugacgggauuuuaugguugguaggagaugcccucugaucccccagucuccuugcacucaagccugcggccucucugacugagccagugccaagauguccucucuuuuugcaucugcagguaugaugccgggcgggacggcuucaucgaccugauggagcuaaaacucaugauggagaaacuuggggccccucagacccaccugggccugaaaaacaugaucaaggagguggaugaggacuuugacagcaagcugagcuuccgggagguaagcccggcccccagccccacuccccuaccaggggcuucaccugaggaccugguggcccgggagagaccaacccccacccuuugucaaugaaugaaugacauugccauugaacagcagcugugagcagcugcugcuuggcugagugaggcuucagagggccuguuacagcaggcaccagggaggguucugagauccucucggggaggaagaggagggagggacagcccuuccuucacauagggagcauauauugagcgauuucuguauacuugacccugugcaggcucugggguagagaaaggcccugugcucgaagguuccuggaaguguagagggggagacaccacagaaggaaaucagggcugugaugcagaggaagagggccacggcacugggugacuucacgcccaggaucucacuccgagacaggagcuaggggcaagccgguuucgcagggaaggaaauggaggcccaagccagacagcgaugauacuggaccccaggaaguacagggauggaccccaggaagcacaggguuagguguggggacucgaggcccaacuggggcccaggaggucuggcaggaagcaugaaggaugcagggaaggagagagguggcaggggcaggugggggagugcgaguggcugggcgggaggugugggcagugcaggguaacagcuuagaguucgagagcaggguuccaucccucugacacguucaggcgcugagacuuggggugucuuuuacugucauggaggcucccucauucugucaugacaccuguaggacucaauacauggaacgcagaguagguucacugggcaacagcgggagacagagguaagagguaggcugaggccgugucgucgggagcuggugugggcgggucagggcugcaguaggccagcauccuggguggcagaugagucauaucuccucccauuguacaguugggcagaggcccagugaaggggcucacgggagcagcaaggggcgagacccagcucacugccccccaguccuucucugcaggggaggccugaggcuggggccugggugcggccagggacuccggcuccccuccuucccucccuuccugacaccgcgcgccucccuccccgcugcaguuccuccugaucuuccgcaaggcggcggccggggagcuucaggaggacagcgggcugugcgugcuggcccgccucucugagaucgacgucuccagugagggugucaagggggccaagagcuucuuugaggccaaggugaggagcccaaggggugcccugacccacgcuccaggacaaggggacccuggguuggugcgaaguuaauagguccccuucccgucccugcugaggcugcagacagagaugggagcugacucccugccaggcugggccaggcccacacgcucugucuucugucuucucccacuccuggcugagauccuuggcagccgccaagggggugggugagggggguguacucuugaaaaggggacagggauuaccuugaggugcccuggcccuggcacacagagcugcuaacacagaggacugggccuuaggagggcaggcccagaaacacagcacuggcucuccaggguccccgguagacaccaaucccaccagccccagccuaggaggaagccugcgggcucagagaccaccugcaugcaugacacccuccccuuucagcagguucucagauggaggagacaccugugaucuaguggcuccuggguccugcccacccggggccccagcucucccgccuuguuucucucuuuccuugcuaagaacauuccuuccagagacugccucccaccacccucugggcuucggagcauugguggaacuuuucaggguucaucaguggaacugggugugccgcugggcuccccggacaggaagcagaggaucaggauggcagcagcuugagcgacucccuucgagcgcccuugcuuugcagcagccacagaauauagguucucuauuucaauccucucaacaacucccuaagaucagaguuauugggugccagguucuaagugaggaaacugaggcucaggaaggugaaugaagugccugacccagggccagagcuggugaggucaagcuguuuguguugcugggcaggacucagcagaagccugagccagaagggaccccaggaaaagcagucauaaggccgggcgcaguggcucacaccugucaucccagcacuuugggaggcugaggcggguggaucaccugaggucaggaguucgagaucagcuaacauggccaacauggugaaaccccaucucuacuaaaaacaccaaaauuagccgggcaugguggagggcacccauaaucccagcuacucaagaggcugaggcaggagaauugcuugaaccuggaaggcagagguugcagugagccaagauugcgccaucgcacuccagccugggcgacagagcgagacuuugucucagaaaaauuaaagaaaaaagaaaaagcagcuguagcacagagaacccccaacauacaccauccagcccugacccccucacccccaugcccccgcagguccaggccaucaacguguccagccgcuucgaggaggagaucaaggcagagcaggaggaaaggaagaagcaggcggaggagaugaagcagcggaaagcggccuucaaggagcugcaguccaccuuuaaguagcgggggcugcagccgaccgcccugcuccggccccaguguggugggcgaggguggcgcaugggaggccgagccugaauccuugccugugucugacgggaccacuacuaaaaaccuaaaaauaucugugaauggagcaaguucaggggucuuauggagguggcccggccccuccccgcucccuuccacucugcacgaggccgccacaccggcgcuggcucccugcccggcccggcccucccuggcaaucccugggcucucuugcaccccuaacugcccccugccugcuccggcacugccccaggcccagcuccuggcccuaggucccucccagccccaugugccugccgccugcccuccacacaucccuguccccccaacccgggaaccccugcccuccuccagcaggccgcaccgccccuggggcccccugccagccccuucccaggcugggagacggcagaagagauagaaucagggcugcccccacagagugggacccaaggggcuaauuggaggcacgaggggaccccuccccagggccuuuuccuccucugcgucuuccaucuacugaaaugggagaggggguggggagcuucuguucuggugaagggacccgggcaggcccccagcaccccaugcugacuuggagaaccccagaucucuggggcccagccaggcagggugugggggcagcugugccaaucuaccucacaggcccacccccugccgggcaugccgugggaucaugggcagggaaggcucugggggucggagacaccgcugcuuagcacccccagccagaacacccugagggucucggggcucuggagagaguggggcgggaggaagaauuggcaccuuccuagggaaggagacgagcgcuucgccuugauucuccgagaagccuccgagaagugcuuuaaguguguuugcaugcgccaggcggugggcagcgggggccuguccagcccucucccgccauccuuccccaagugacguccacugccuugucaccagcgaccugccugucaugcccacccccugaggaagcauggggacccuaacacccuggugcccugcaccagacaggccguggucaggcccaggccaccggccggguucugccacagcuucccacgugcuugcugacaugcgugugccuguguguggugucuguugcugugucgugaaacugugaccaucacucaguccaaacaagugaguggcccucgaggccacaguuaugcaacuuucagugugugucauaacgacgucacugcuuuuuaaacucgauaacucuuuauuuuaguaaaaugcccaggaguccuggaagcuacgcggacuugcagagguuuuauuuuuuggccuuagaaucugcagaaauuaggaggcaccgagcccagcgcagcagccucggacccggauugcguuugccuuagcggauauguuuauacagaugaauauaaaauguuuuuuucuuugggcuuuuugcuucuuuuuucccccccuucucaccuucccuucuccccgaccccaccccccaaaaaagcuacuucuucauuccgugguacgauuauuuuuuuuaacuaaaggaagauaaaauucuauauucuuauguguguaugguucuugauggugagugggcagggaaaugacaaggucaccuggguguggggacaguggugucagagccugggagggaaggggaccugcccuaguggaggagguugguguuuuaugcccagaugcugucaccaggcaugagucuaggugcuuugugccuauuaacucauuuaaauccuugcaacca

SEQ ID NO: 14208 - RNA, 1373 nt, Homo sapiens
uaaaaaagaaaaacuacauaugauuuuguccaaauuuguccucucagcugugaaagggacuaugcauauuauuugccuuuuucucugcauacagaauaacaagacaauacauccgugaauuaaaagacagcagacaccugaccauucaguguccuuggcaagguucuaguacgugugcacugagaacugugggcaaucauguugagcuuucuucuuuugcuaagacuucucccuugagaagaaacagaauuaaagaauccacagaacagccccucccuugcugcugcuuuuguacuuuuuacuucaucguguuuuauacuugcccaugccauauucuaauuacccacuuccugauagauuucuaacacaagaugcuugagggcagaggucucauuuuauccuccuugaugucuaccccagggcagaugcugccgggcacgugaugagugugcaugccuucauuuuacaguuucagacccagcaccugcugccuggcacagggaauacgguggugagcacaaucgaugcagccucuggaagaacuugagaggccaucuagcucaacacugucuuuuaguaaaugagaaacaggcccagcgagggaaagugcccacagucacagcuggaaccaaacccaaucucaggaucuucccuuccauggccagcuagcuagaacgcaacuugggaaauggcagccugucuguaacccagcucuguugugcccagaggcuggguaugaagacaguaaaagcagaggggagugacaugguggcagcagaaaauuccaggaguagagacgucuagggcacggguggggguagagccaaacuaugacuggcguguuccuauaucagaagugcaugcugggaacuugugacaucuuguaguccauguugcaggaugccaagccccugaccacccugugccgugggcacugggcaccacugagccacagcacaaguugcugguguggguccagugcacggacuuuggucuccauguugaaaaugaaaaagaauaauucuugccuccuggguuugcauaauuaaaacugcagaacagaauuugccuaucaacgugagccccaugaaagugcacagaaaacucuuaagauaugauucauuauugccccgauaaaucauccgaguccccugcuucccacuugcagcuacauuucaugcuguaaagugcagguacagcuagugacgacucacagagucacaucccaguuccuuggcaagauccacugacuggcauuuguuuacagacuuauccuccccccuugugucuuacacgcuggccuggaaaguucuucuaaugcaccucuggacucuuugcuggggccugggcugcccagagcacacacgcuuuuc

SEQ ID NO: 14209 - RNA, 886 nt, Homo sapiens
ugcugauuuacguuccuaacacguaccuaggugaugcugcugccacugcuccaggggcuacacuuugagaacucaaggauucucaaaugauaguaugcaucagaguuaccuggggagcaggugaaagccccggauaccaugaacucauccccucugauucugauucaguagaucuggggaggggccugggcaucccuacuuugaacaggccuuccaaaugagcccgauucauaccaagaauuugagaaucauugcccuuaagaguccaauaagugguauaggccagugcauguggauuugaaucucuuguuaaaacacagaugcugauucaguaggucugggcucaaggccugagauucugcauuucugguuaguucucaggugaccccugugcagcugguccaggugccacacuuugaacagcaagggauaguccaguguuucucgacaaggggugacuuaccuucugaggaacauuugacaaugucugaaaacauuuuuaguaaucacggcuggaggguggggaaaauucuacuggcauccgguggguggaggccauagaugaugucaaacaucccacagugcacaggaaaaacaaaagauucaaucccagaauuggaauagugcugagguugagagguccugugguagaaaaaggcauugagaaguugccuaaucacagauguugagccaggguggucagugaaggcuuccuggaggaggggguacuuaaaugagggcuguuguccaauauuugguuuaucuagggucucccuucuccacagcgcaugcugcuaucuaauauauauuuaacuuacaugucuuacuuacagcauuuccccugcuagaaugcaaacuucagaaggguuagaacaucugguugguu

SEQ ID NO: 14210 - RNA, 125124 nt, Homo sapiens
ccucacaaucgcucuucacacuuuuauuguuaauucucuucacauggcagauacagagcugucgucuugaagaccaccacugaccaggaaaugccacuuuuacaaaaucauccccccuuuucaugauuggaacaguuuuccugaccgucugggagcguugaagggugaccagcacauuugcacaugcaaaaaaggagugaccccaaggccucaaccacacuucccagagcucaccaugggcugcaggugacuugccagguuugggguucgugagcuuuccuugcugcugcgguggggaggcccucaagaacugagaggccgggguaugcuucaugaguguuaacauuuacgggacaaaagcgcaucauuaggauaaggaacagccacagcacuucaugcuugugaggguuagcuguaggagcgggugaaaggauuccaguuuaugaaaauuuaaagcaaacaacgguuuuuagcugggugggaaacaggaaaacugugaugucggccaaugaccaccauuuuucugcccaugugaggguccgcaugagacccuucuccuagauccuuaucagaucccauacugcagccgauugacugacucauuaaauaacacaaguuauaaaacuuuaaaaauggagcauuuacagucagggacauaaauacgugcuuuuaaaagugucuacauacauauuuacagaguugcaagaucaaccguaguagcccugaaaaaaaaaaucccuuuaucgugugacaaaccgugcucaucagagcucccuccuuccgcucuggguuugauagcucacucuugaaauuggagcugagaaaacagcgcccaaguggucucagacauccuugccuggggucugccccaaaggcacaaaacccaagaaccucacugaacuggguccaaacgccaagcucagcucacccguuucuccgagacauggacugaccguccuccagagagcaggagucagccccguccgccccuggcaggauggccuccgaaaucucuucuucuucccccugugcuuuuuaaucuucccauuuuuuuuucauuucccaauuuguuuuuuuccuauugcagcuaauuugagaagcucagacacuaaagauguucauggucccaccaaguguggcaaugaagggcgcaggagaucccuccccuccauacaccguccccauucccugcccuucccaagggaggagauagaucuguaaguggggacaaagucuuucucccaggugcaccugaucugagguucucugcaaagacucaagagcaauggacugaugagaauuucaagucuggaaaugccucaagagccagaaacucagacaccuuaggcaaggaaggggguuuuccaugugcuggggccgaggggcauguucaggcucggcuccaacgugucaauaugcuguugauucccagagauguugccgggagagggaagguggggagagaggggugguacugaaggggaacucggccuccuccugaaggccuuccuaaggcugaccccugggucaaaccaaaguccccauaauggcaaaagacaacucaagaagcaaaaagcagggucaaggagcucuugaaaaauugcauaguaggagaggccccaccccaacaggaaggcugggcugcagaacacggucccaagagcugcauccaaguaucaucccaaaggacagcguggagucggcccccuuccugccgccccggggaucgggacccucguuugaagaccacucacgcgcccgcacgagaacacgugaacacacacgcacgcacacaugcacgcgcgcacaugcacucccuuucucucgcagccucacacaacugggauaggucgguacucccugcagggcagacugccagucccuuuggcuucacugauuccaggucacuucaggugcugaggagaaaaagaaaauaaaaauaauaacaguaagcacacauucagugccgaccauggugguccaugcguuauugcacuuaauuuuguaacuaaacuguuuauugaaacauaccauacauagagcaaaaagcacagcuugaugaauguucacagugaauacaccugcagagcuggcacccagaugaagaaucagaaugugacagccgcccaucagccccugacccgugaccccuuuaaggauacaugaacccucccgcccucgggaagaaccacuguccucaccucuaacagcauagacugauuucacccauuuuuuaaguuaaauaaauagggucaaucaguaaucuccuccugcgucuggcuuuuuccaccgaguguuugugagagccacccauucuguaugugugguugauguuuucaaccuuguuguuauguagugugcuauuauagaaagacaccaccucggccaggcgcgguggcucacgacuguaaucccagcacuuugggaggccgaggcgagcagaucaccaggucaggagauugagaccauccuggcuacggugaaacccugucucuacuaaaaauacaaaaaauuagccaggcaugguggcaggugccuguagucccagcuacucaggaggcuaaggcaggagaauggcgugaaccugggaggcggagcuugcagugaucccagaucgcgccacugcacuccagccugggagacagagcgagacucugucucaaaaaaaaaaaaagaaagaaaaagaaauacaccaccucuauccaucuauuccucugcugauccacaacugggaacuuccaguuuggugccaugugagucaugcugcuagaacauucucauaugugucuagaggacacguauggugcaaauacguaugcauuugugcugagcggaaaugcugggucguaggauguccauagauaacacaucagcauucucauagguauuuccuggugcacguggguacauaucugcugaguguguccccugcagugggacugcuggguccugagguacccacauguucagcaucagucaacacugccaaacaguuuuccaaagugauuguacuccugcuuaauuuccuuuggauguucacaacaacccucauggcaggcaacacagauccccauucuauaugaaagaaauggaggcucagagaggagaaauaacuuuuacaagccugcagaugaugagcagcagaggugagacuugaacccaggucaggcucacucacuccagcaucugugugcucuuccagucgggaggggauggcuguucccgcaugcuuccuccgcagaaaccacauucacagugcuuaguccagagcugagcacaugggugaauccuuaauaauguucacugcaggcugggcgcgguggcucacgccuguaaucacagcacuuugggaggcugaggugggcagaucacuugaggucaggaguucgagaccagccuggccaacaugaugaaacccagucucuacuaaaaauacaaaaauacaaaaauacauuagugauggugggugccuguaaucccagcuacucaggaggcuaaggaggagaaucccuugaaccugggagacagagguugcagcgaccugagauugcgccacugcacuccagccugggcgacagagugaaacccugucucaaaauaaauaaauaaauaaauaaauaaauaaauaaauaaauaaauaaauguucacugcauuggguugaauugggcugggccaaguucagggauacaguucucuugcccaguggaccuggucaccauuacuauuacuaaaaauaacuacugcuauuauuauuacuaccacuaauaauguaauauuucaauaauaauaauaauaauaccaguuguuuauggaaggcuuauugcauaccaggcacuuugcuaaggguuuuucauucacuaaccuaugcaaucuucucaacaaacccaugagagagguauuauuauuauuaacccauuucgcagaugcgugaauugaaacacagaggcgugaaguagccacugaagggauagcuccagacacugugcaccuaaccacuacgcauguucauuucaauucccugaaaugucugauggggcuggaaagggcuguuugcgggggagugggaugucuucaagagaggaggcaucccuucccagaggacgccugcuuaugcagcagacuggccugugugcccgugcccaugagccagggcagggggaagaaaaggaagcagaggcggggccggcuauggaguggcuguauucccuuggccuggcguggccagcaagugugggucuccccugggucacgugggauccauuaaaggagccaucuugccagucccccaccgagagggcagcccucuggggaggccacagcagcaggagcugggggcuggaccugagguggaggggagcucucauacaagggagaugggccgggaugggcgaccucuacaccccccacucccaggaccccaggagggagcgcaugucagaaauccugcccacagagggcccugaggccgcuggucuuagccaaaggagcagcaacagcugagagaaggaucacaaugguggccaaacaggugagaggcugucccuucccugggccucccgcugaaccccugggguaggaaagacacggggugaagacaggaugugcaaaggaagccucccuauagacuaggcagcacagcacuuuucugcacuuaaaagugaacagaaaccucugggcuuugugugagucacaguaaagagggugccacagaggcuggugaaaggcagggcuugccagaaaccaagcaccucuguguucauucucgcugcauucaaacuguccgggagacgggugacgaagccuugaauccggaaugggcaagagcaggcuaagcagccaaagccauggguccuucgagaaggccauccuuuuuucugaacaaaacccacaugcacacacaguuuugcaaggaggcacggcccaauuagaagucgaagauccgucccgggaaucagaagaccagaguguugaugccaguucugccacacgccccuccgugucaguuuccgucucuguaaaaugagggcuuugaccugcacacaccuuccugaacuaaaauacuuugcuguggcauuuucauaaaucuggagcuauguuaaacagugcuauggacugaacugugucucccuaaaacccuuaugcugaagcccuaaccccucccugugaugguauuuggagguggggccuuugggaggugauuaggcuuagaugagaucacgaagcagggcucacgaugagaugaguggacuucuaagaagagacaccagagagcuugcucucccccaggcccccgccacgugaggacacagcaaugagguggccgucugcaagccaggaagugggcccucaccagaaccuggcuaugguggcacccugaucugguacuugcagccucaagaaccaucaggaaauaaauuucuguucaauauuuaagccacacagucagugguauuuugugauagcagccugagcuaacuaaggcaaacaguauaaagagauuuuuuuaaaaaauuauuuuaaaaauaauauaaguagcacaugcuugguguaaguaccaauuuaaaaaauggaaaaaaagcuacagaagauuuuaaggagcaaguuacacgaaacugcugaguuuggagccuucguuguuggugagcaaacagagaucacaagaugcagaggcaaaugacguuaggccucucuucauuugaucgcuucgcuugggaaacuguauguuuuuaaagaaggaaaaagaaggccaucaccuaggacagugcuuggugcuggggcagagccuaaauucauaaggcuuggcaaaugcuacauacauuucaucuucgucauggccaagccugcaguggccaacagaaauggcccagucuguuuaggaagccagcccagcugcaccuggcucucccuccggcugcagagaacaccugcucugggguggaagcaagucccgggugcccaucaacacagaagguucacguagcagccuuggccgcaaggaggaugcuggacacaaaugguucccagagucggaauuguucauccuggcauggccucucacuuuccagaagacccuagccacguccuaugucucuucucuuggggccucaauuuuuccaucuguaaaaugggagguaccucucccagggccucccagcucuguacuaucuuacaguccauuucaacauuguuccaugagacuccagcucagggucaagucuccagguuccccucucagggagcagccggccccagagagacagguucaauuccagcagcagaccacagacucucugggcaagaguggauuuuauuuuugcuccccuccccaaaccccagaggaauaaagccaagccagaaacuccaacugcuuaagaaagagagaaguaaacagccgggagcgguggcucacgccuguaaucccagcacuuugggaggcagaggcaggcagaucaugaggucaggagaucaagaccauccuggccaacauggugaaaccccgucucuacuaaaauacaaaaaaaaaaaaaauuagccaggaguaguggcgggugccuguagucccagcuacucaggaggcugaggcaggggaaucgcuugaaccugggagguggaggaugcagugagucaagaucgcgccacugcacuccagccuggcgacagagcgagacucugucucaaaaaaaaaaaaaaaaaaggaaagagagaagugaggucuugggguuggagggcaggcagaaggaagaaagggucuucucuuccuggcauaauacaaaagaccucagaguuucagaauucagcccauucuugccuugaacuacacucucauuccaaacgacucugguugguguuuuaaccacugccucguguuaagcacacauucccaaaccuacgcgugucccagaaccagggggccaucugcuaaugcagguucccuggucacacccaccaggaugggccugugccaucaauacccacccaccaauacaagcagggcuguggggggugguggccaguccccucccucccauuaaccccguauucaacaucuguccugugccaaccacuuccaugcugggcaucucauaggggugaugugacuucccacagagauguaaacucaggauuugcucacugcaagcuccaccuccugcauucacgccauucuccugucucagccuccugaguaguugcgacuacaggcgcccaccaccaugcccggcuaauuuuuuuguauuuuuaguagagacagggcuucaguguguuagccaggauggucucgaucuccugaucucgugauccaccugccucggccucccaaagugcugggauuacaggugugagcgaccgcgcccggcugaacucgggauuuuuuaaugggguuuggcccuauucguacuauaguccaguaaaugggauuugagccuuuuuggccauuuuguacauuuggaacuggacucugaggucuguauuuauaaaagcauccuagaucuucugauguaugagguccucugaucacuuugagaugcuggccuuggggacacaaugaaugcaguuguguggugucaccaacagggagggccaagccugcucgugggucaccagcagaauccagguacuccaaaaaugaaaagucugguuuccauguuuuuauccaacagaaaucuuagaguaauuccagguuuuuaccaucagaaaaccuaggaagaggcuguuuuaguccaaaauaaaucugaguuuuauauuuuauggauuaggacagauuacauaucccuugucugaaaugcuugagacccgaaauuuuuugauuuuggauuuuuuuuggauuuuggaauauuugcacuacauacuugcugggucagcaucccuaauccaaaaaucugaaaccugaaacgcuccaaugagcauuuccuucgaguguauuuccuuugaauguccucacucagguucagauuuuggggcauuucagauuuuggauuuuuggauuaggguuacuccaccuguauuauuuugacuuucaaaaacauugugagaauaggaacucggucaucuuuucugggcuuaaugccucugaggcaauuaagaacugaguauaauuacuauuuuuaucauuauuacuccaauaaugacuuaccuagugcuuacuaugugacagacacucuucuaggugcuucgcacauuugacacucguaauugucacaaucacccuauaaaguagguccuauuguagugcccacuguacacauguggaaacugaggcucagaaagacuaaguaacuugcuugaaguucguagccagcaaguggcagagcugggaugugaaacaagugguccggagucugcacucagcuaagugcccuccuggagggaggcccugcaccgugccugguacacacaagcaaucacacccacugcuuucucuccuucccuccccacccaagacccaagcccacacccccuugacccacccaaacagugccagaagcuguuccauccugccucguaccugucagggagcagccagagugucuacucuuugaagaauggucccuggaacugggcugcagcuggagcuuugaccuuccuauacugccuggugauguacggggccgcugguggagagcaucgggacgccaagcggaggcuguagcugugcaggaagaggaacaacacacauugucacaggagcccagcccggugcccuagacauugcugggggggcuuccuuagugcuggucaccacuucccaggccaggauaggauugcacuuccuggacaccuugaggccaggugccuggcaucagcuaauaggacaugagcuuuaaccaccaaugugcacuucuccaugucccauccaccaauucucuccccucggaggcgaucgcagaagcacgggcaagaggaguguccauugggcugguucugagacaccaugaugggcagugccgucuggugacccccaguggacaugcaggugagccagaaugacuccgauugcaucagaacagcggcugugcccuucucugauuccauuuccccaccugccucccugcucuccccuccugccaggccccaacacccauaaggaaaaaagcaucuggggagguuacuauuaucaaaguacaaacacaccugcacaugggcuggguuguggggaauggaggcagcuccauugcccuuaaccccacacuccacaucuauccugugccaagcacuuccaugcugaguaucucacaggggugacguggcuucccaaagaggugaaucuaggaauuucgggggcaugguuuuguacuauuuguacagaaaagcacccccaaccaccgcccccaguaaaugggauuugauuuuuucagaagggcuuuuaaaaaauuuauuuaaaagauagauaacucacaccauuaguccucuccuuucgucacucagcuaacucguacuucucuuucauagcccagcugggaugcuaccuccuccaggaagcuuuccuucuuuaacuccugggugggguguuccuccaacaggccccuuagguguccccaucccaccugaauuaaaagcccagaauaaggugucugccuuucucaugagcucugagaucccaaggucaggaucuuuguccuguucauuguugcauccccagcuuggcacaauaaaaauaaacauccggccaggugcgguggcucaugccuguaaucccagcacuuugggaggcugaggcggguggaucaccugaggucaggaguucaagaccagccuggcgaacauggugaaacccugucucuacuaaaaauacaaaaaaaaaauuguccaggcguggugguggaugccuguaaucacagcuacucaggaggcugaggcaggagaaucgcuugaacccgggaggcagagguugcagugagccgagauuguuccauuguacaccagccugggcaacagagcaagacuccaucucaaauaaauaaauaaacaaacaaacaaacauccacugaguaagagugauacauacaggcucacugcauguccagaacugugcuagguauuuuccauacacaaacaaucuaacucuucacaaaaccuacccagguggauacuguuauuaucccuaauuuacagaugaggaaacugaggcacaaagagccugucaccugucuaccucucuagauggaagaauggaaagugagggaggccucuggacaaggcggcccaggucagaggaggugggaggccaggcagguaggaaagcaggagggacaaacacgcccggaacccuaccugcuccagguguuugcagagccagcucugccugcgggaacaggaggcgggaauggaguccagcucaaagcuggcacaugguagagcucacaugagugguucucaaucaggguacacacuugguaauguguggagacaucguuggcuuucauaccugagggaagggugcugcuaccggcaucuggaagguaaggccaggggugcugccaaaccuccuacagugcccaggacaggcccccgcaacaaagguuuaaccagccccaaaugcugacagugucaauguuggcaagggagcccucaaucaauauuaaaauaagcaaaugcaucaacagacaagcaaauguagaaggugcuggagaaaagccuuagacaagacuaagagaccugcuguugucacgagugagccucccccaagggccuggcucucugucaaggucagggcugccccuguuugaauuccuccccugcgcugugcagccaaggcccacggucagcucagucuacucgccugugcaagaguuaaggaggaaacggaggacccaugcuucauacaacugugcuccugacgggccaccaaggcagcuaguggccacccccgccaaccccauucuagcuggcuggugccccaggagacccaaccugggaggagacagccagcugggaggcugcuggagacauggacuccuguguccuguugggcaauaagaaacagagcuggcaaagagcagguccccucccuacgaugucccccuucccagggaaaugucuacagugguguagcaagaccagcagaagcuuuggagacagacaagcccugcaucaucaguauccagcuucucccuuucucugcuguuaaguauccaaaagccagaucaaucacacaaaaauaacaccccgaccucccaggccucucuagccagccagugugucuccgcucccuuuagcaucucuuccgccugggcuccugcggaugcagcaaccauagcgucuccaccagggggcgcgccuccuccccggcucagggcguccaucuggguggaacgaguaggucgggggcaaaaccccugaaggcagaggccccucugcuaccccucauccacugccuggccuaauggaggaccacggcagccaacaugaacauggccuccaugacucccaaggacuuucucaguuuucucucugaacccucccagcagcccaggagguaggaagaacaagugcuuuuauaccccuuucacggaugagaaaacugaggcucagacggauauggagacuuucccaggcgagcagagcccugggcuuucagcuccuuaggccaccauuuugaagaaacaccaggucacuaauuggguguuuccuguuaggacggggacaggaugucgugggggacuguccuuccugaucaagaagugcuucacugucaaagaacucaugagagcacagugcccccaaccccgagauguuaaauaccgaggaccaaggcuccggaauugggugcuucuccagggcacaguagcaguuagcgcagagccucaugauucuugguucccacccacuagcugugugaccucagugagucauggaccugucugaguuccagguugaucuucugcaaaucgggaagaccaguuugggguuacaguaaugauuaacuuuggagaaaggucuccgugcagggcauccuggcacuccaguagguaucagcacagugucgugacugcagcaguugcgguugguggacucauauggagaagucaucaccccaggaggaugcaguauggccgcuggagaccuggggguggccucuaauaauccucauucucauugacuguauggcccaggguaagccacucccugucgcucggccucggagccucgguuucccccucuguaaaauggagacagucccugccagccugccaacagagagcagggcuggaagcauuuuggugaccaggauugagagcacuuugcuuucugggaagaauccagcacaugugagaugcuccuagugggugugaccccaggaagcaucggagcaggaggugagccaggguccugacugguccuuaaagacugaaugucagguaagacuucugugucaacacuucggucagacuuuuggcucaaacuccugggcagggcuccagacccgcacacccacugccugccgggccccuccacuuggaugucuaaugagcaucucacuuuaacacggcaaagugggacaugcuagggucccaccuugcucccgccccuaccaggcuccagccacacuggacucuugucacucuucucaggaaauggcacugccaaacguguuguuguuacaacuaaagcccaauagcccuuuucuuccucuucuauucauuuugcugcuucggauuggccauagaccuagaaaccacacacauuugaagcaggcacaccaucgagcagugugcugugaucauggggccugugagaccccccgcugugcuuacccuaaagcugauccaucuccgggucccuuaauucugccuccagguccacacaccucucuccacucccauugccaccacccagcacaaccuguggcaucaacaccuuccacggggacuguggcaauugccacugcacuguccccacuucgacgcugcacccucccccccaccaccaauccauucuccacuaagcaacaagagaggccuuuauaaggaccaccggacaugaccacgacacuggaccacaucacugcccagugcaaaaguggcccaagccuucccacacagagugcugugcaccugcuugcgacccucccaguccccucacgcacucuguguucacccugugcacuugucucucagccaggccaagcucuucuuaccugguugcucccugccuggcuuuccccugcccugcccuccucugcccacagcucccucccaccuugugggucucagcuuaagugucuccugaaagaggccuucucugaccuccccaccuuaguggcaaccccagcccuguucccauagccuuuggaguucccuucugucuuccuucugucuuucugugacuuucugggccuuuugcucacagcuuuucccacagcaaucaccuugccugucgaguugcuuacuccuucaacacuagaagaggaugucuuugagggcagggacugagucuugcugacaguggaauccccuguguccccaggcacaggaccugguacaggaaauauuggguggguggguggaggcagccaugagggaugccccugguuugcagguggaggaaacauggucucaggaccacacacccuccccaggcccggccccuguccagggauggcagagcccagagucucuggcacaaggacagccugugcgcucccagcacugccuccaguuacaaggggaugccccaucagccagcagggggcgagcacagugucacaggaugcuuccuguggguuauggugauggcauggucacugugcaaguaagcguuaacgagccauugccucacuuauccagaggccccuuaaccuucacaauccagagaacagccuagaacguuguagaaagucugagccauccacaaccagugcccacugaucuguaaacucuuuuuuuuucuuuugagacagagucucacucugucgcucaggcuggagugcagucgugcuuucuuggcucacugcaaucuccaccucccagguucaagcgauucucccgccucagccuccugaguaccugggacuacaggcaccugccaccaugcccggcuaauuuuuguauuuuuaguagagacgggguuucaccauguuggccaggcuggucucaacuccucaccucaggugauccacccaccucggccucccaaagugcugggauuauaagcaugagccaccacgccuggcccagaucuguaaacucugacagaagcucacugcaugcaggcacuaaaauucaugccugggccugcagccugucccuaaggagcacaaagucacacagaacucaagcuuucagccaggugcgguggcucacgccuguaaucccagugcuuugggaggccgaggcgggcggaucacgaggucaagagaucgagaccauccuugcuaacacagugaaaccccgucucuacuaaaaauacaaaaaauuagccgggugugguggcgggcgccuguagucccagcuacuugggaggcugaggcaggagaauggugugaaccccagaggcagagcuuucagugagccgagaucgugccacugcacuccagccugggugacagagugagacuccaucucaaaacaaaaaaaaaagaaaagaaaaaagaacucaagcuuucacguucagugcacgcuguucuuacuguacacacaauucaaacgaauacggccgauggcuuacaaguccacagccaaucagaagcagcaaaaugaauagaagaggaagaaaagagcuguuagauugaggcaaauacagagucuguagcagacagcagacacuucccuggaagcgggaaaggagggcaaguucaaggguagggaaauacuaugugccaggccauguaugugccaugaugucccggguuccaugcaugcuuaauuucguccuuggggaaccugagaggucgacaaacuugagagagguuaacuguuauagauggaaccuuuguguccccugcaccccauucauaugcugaagcccuaacccccaaugugauuguauuuagaggugggaccuucaggaagugacuggguuuaaugaggucaugaggaugggacauucaugacgggauuagugcuugugccuuguaagaagaugcgugugcucgaaaaaggucaugugaggacacagacagaagguggcagucugugaaccaggaagagagccucgaccagaaccaaaccaugcugguacccuaaucuugaacuuccagucuccagaacugugaaaaaaaaauuucugucauuuaagccgccuaguccaugguauucuguuauggcagcccaaauuuuguuaagacaacuugcccagagucaugcuuggugagauuaggaucugaacacggggucuggaccacagccugucaucucugcaggugacucccucccuaggcgaugcauccguggcuuuggcguccacggccagccucacacagaugacucaccggcacccacgcccagcccacaucuggccuuugaacuccauucacgcacugacgugacaucucuuggacaucuagaaggccccuuaaaucaguuccugaacuuaaauuaugaccccaccucacgccugccacuccacccugcuccuguucuuggugaacagcacugcauuugugcccugaaagccagagaccugagacucaacacggucccuccgucacucucuccugcuacacgucaccugccacuggcuccaucgaguccgccuuccuuccucuucuaccacugucggggaccaccucucgccuggaguccugcaaggcgccuuccucacuggacuucucacuuccacacuggcuccccucccaucuguuccacagaagugugacggucuucccaaaaggcaaaacggaccacgacacgccccugcugcaaccugucaaaaccccauggcucccaggacgcaguccaaguuccuugauacaucaaguccagccugcacugcccucccagcccaucucuccccuucuguucuuguuuacuccagcuaaucuggguagaccccauuucccaguggccuguagccucggcuccucacuagauucacccagagaggccugggcugcaugccaggacaugacaucaggaucucuggggcaggauugggcaaugguauuuuuaagcucuucagugauuccaacaugcagcuggguugagaaccacugcucuggagaugcuucuguggucgcccucuugaggcaacauggcccuggucagguucccacaccggcccccacacgggcaguuucucaugcaucugcgacugucugauaaaggcaggucuccccagggggccguaaggucucugauggcagagcgugguugaguuuuguucaucauuguauucuuaguaccuaacugugcgugagugaauaauagacccucaacauguaaggaaggaagaaaugagcaauucaagacucugugauauucccacugcacagcuguucucagacaccaagaaaucuguucagugcaggggagggaaaauggacuuacuaugcuccccaagaugcuccuccauaaaaucccggcaaaaugaaugagauacguaguccucaauccuagacaucaagaaaggguugaacaaguucagcaucaacuguuuuuuuuuuuuuuuuuuuugagacagagucucacucugucgcccaggcuggagugcaguggugcgaucuccacucacugcaagcuccaccucccguguucacgccauucuccugccucagcccgccaccacgcccggcuaauuuuuuguauuuuuaguagagaugggguuucaccauguuagccaggauggucucgaucuccugaccucgugauccgcccgccucggccucccaaaguguggggauuacaggcgugagccaccgcgcccggcccagcaucaacuguuuuuagaaagcaggggaguguagcauuaccuugguaagauuuucauacacagugguugaacauuuuaaacauaguagcaggguugggaggaaccugcugugugccccacacaggcuuugcccagaagugucuggccucuggcaaagugugcucuacugccuacucuaggagggaaauuucuggacauuuuacuuagaacaaaaacuaauggacuuugaaagcacagggggaugucauacaccauccaaucuguauggacggggaaggauugggcagagggcagaccucaaacaccugguccacucccggcucauaggaaggcucagaaauggugccucagagcaucgucuccuggggauccuaauuucuuacuugucagaauuccuugcuagucugaagacaaugcaagggcauuaucuauacaauagaacgucuaauagaacaugucuagaaauagaacaucugcucuguuccuggccucaaggaugcauucauucuuucauucagucauucagauuuccaguggcccauucuugccucagggacucggcacaggcuguuccuggaacacucuucccccagguggucuuguggcucacucccaggcccccuuucaaguuucuguucaaaugucucauucccagugagccucgcuuaaccacuuuauuugaaaucacaaaucccccugauacuccccaucucgacucccuuuuacuuucugaguugugcuuauccccaucaacagagcugcguuuacugguuauuguuuacugucugucuagcaggcuccaugagggggcgcauuggaggcugguuugucacggaggcaccuccagcaccccagccgcuggcuggcauacaguagcagucaucuacuauuugucaggugaacggugugucuauucugugccaggugcuuugccaacaggaguuuuagugaauaaaacaagucaaguucucuacauauagcauaguuuuacaugucacuuaguguagccuagagaggaaagauacucauuucagaaggaguuugaugcccguacgaggccaagacucaggccuccuggcucccaaaugaccacauucuuauucagcccccagugguuuuggauaagggagaaauccagacacacugaaauauacaagagaaaaugaaacugaagaaacaggagugaaggucagaguggaggagaagacagggaaaggugacaugggaaacggcagugugugggcuacgaccugggguggggggaucaaucgguccggauacuacgccuugugcguuccaggaaguggggacaggaagugcaaaggcccugaggugagacccaccaggaaugucugaggugaugugggcagaggggagggucucauaggccuucaagugaggugucagucaguuguccuucugggcagaggaauaucaugacccaaaguggcugcugugcugggcacagaccguggguugacagggaaggaacuggggacaccagcaaggaggugacugccaccauccagggagaugaugguggccuggaccucaggucagcugaggaggcugagcugagagaagcuguggauuccgggugaguuuggggaucugcugaugagcuggauguggggauggaggaagagguuggagucuagcugguagcuggacuccaagcaggaccguuuccauucaucccacauagggaggacagcaggagagggaggcuucauggagagacaguuucauuuuggaaagauuaaauuugaaucuagacacccaagggagaugucaggugggcggcugaauggagauucugaugaggguggaaacccgggauuggucagcauccaggugguauuuaacgcaugugacuggaugagaucaccaagggggagcggagacggagcgaggggacagagcccagggauggaggcgggaugcgggggacagagcccagggauggaggcgggaugcgggggagcagcugguaaugugcagagacugggagagggcgguguccagguggagaguauuucaaggaagagaaggauuaacagcguccacugccgcagaugggccaagggagaugggacuggaaaccaaccacugcauugagcauccugggggcugcugauaaccuugguuugauggcuccucaagaagagccaaaacccugaaagugaguucaagagagaaggggagaagagacacuggaggcaggaacccagaggacgcuucaagaaggguggagggaaaggaguuugggagggaaggagcugccggcuuucagaggacaugggcucuccagggcuccaggguccccacguggccacggugcucuuccaagcucccugccagaccgccaugggcauccugggcugggaucucugccugcccuggucccuccuugcaccuuuuucucacagucuucaggagggaucuccugggacagccauacagaaagcugguuaggccacaucgcuggccgcagaagucuuacacaacucucuaaauucucagagugcaauucauuugaagucagugucugauauucugcacuuuugcugaagguaggggaaaggcagaggguggggagauggugcaaagguaagacaagccugugaugaugcugauauucccugggggcugggugagggcccacaggugggagcugugggagccaucggcccucagccaccuccaggaacagucgacauccacugcaggacccaccuuccccaagugggaaggcccacgugcuucaggaagccccugcccauucaaaugaagcccccagccugggggaagggcugagaagacagagaagaaagaagcagggcaggaacccaaaggaggaugggguggggauuccagagcccagagcuggaauccuagcuccauuacggacuugcuguguagccgcuggaaaaugccucuaccucgcugagccauagaagucuugccuguaaaaugaggaugucaggcaagggggaaaaaaacaucaucgcaucauccacugagcacuuucuauacaccaggagcuacuuuggguaguuuuugggagcuccucaaauucccagcaguccuguaaggcugggccugugaugguccugguuuuacagaggaggguucugaggcucagagaaauaaagaagcuggacacucaaguucccucggccaaguagagaagcagccaagauuugaauccaggaccauuugacaccaaagcccaugccccacucccugacacaguccccauaguagugaggauugaagaguuguuuccaauaucccaaagccaggugggggugagccuuugcccauagagcagcugcauugaccacucaagacucuggcagucuguuuugggcuggacccaccuuugcucagagggcacuggaacagagaaucucaaacucggguguucacugcaauccccuggggauacuaaaccgauccugaugccugcuuucuaucccaacaaguucugauuucguugguuucagguacagcccaggcauugggaauuuuaaaaggugucuuugcaggccacuggucuagauccuuguacucaaaaugugguccccagaccagcggcaucauuuccccccccggagcuuguugguaaugcagacucucagcucccacccacuccaagucagaauuugcaguuuaagaagaucccugggagaggcaucugcaugcagacgccgcaagagcauggggcugggggacaccuuuagcggcgucucaagugugggcagcaugcuaggcugcaguggccagcaggggcccguucugaagccuggagaggagcugcugcuugaugaaguucuguagacagucuccaaaugagggggccgaaggggagagaaugaacguaggccuuggggggcagggguaaagguuugacaccaccagcccaaggagucgcugcggugccuucaggugagacagagcccuugaguacagccgguggggacaguggggacaacacaguugaccaugaggaauuaguacacacuggcccaugcgcugucuucaugucauccucccuuuagucccagcagaugggcuguuauacccuuuuuauggcagaggggacagcaacacagagagguuaaguaacucguguacuuaagaggugugaauagaaggacaaagggagggaagauucacacccagaucugauuucagggcugaagucggccucagcagacacauuuuucuuccaucucaucagcccugagggaggccaugggcccacugcugagcccccaauguggccuccacgcucccaaaagaucaaucacgccccugcuuuguggagcuucuaagccagguucugagguccucagaggccaugaauuccccaaaccuguuuggguugaacucuaaauacccagcaugugagaagcucguaacacaugacccaguugauagggaggcuggcccggccuggccugcagugaccucggcccggagaaccugcccgcggggaaagcccccggcuguggcugccucuuuugcugccaagacccgagaagugcaggggaccccagaggccacagggaucagcccuucccuuacagacgaggaaaccgaggagagcgagcaaggcacucgcucacagucauacuccagguuguucuugggagcagugaggagacaggacuaggcucacugcuuauuuggggacauugaugaugggaagaaggguaguugaagcccccgaggacucgcugagggcacucagaucucuguaacuggcucuacccaccuggcucccccacuggacugggagcaccaggagagcacgguuggagucuauucacuucucacccaucgaaccugccacggggccuagcaaaggcuggugcucagagaacguuuccugaacaaauggauggcaaagccaggcuccuggugcgguucaacccugaaaugugccuguccaugcugcucaagaaccaaauccucccagcguggcuuccuauacgguuucucucauugccaaggucccgcccaaaccaggggacaagguccccauuuuuacgacaguucugugaaccuaacccuacagcccucaggccuccccagcccaccuuccccacuccauucagcacagggguucaagucuggagaaugucaccucggcuggaaacaccgucacugcccgugacacgaccagcccgggugagagaagcccagcaggguggaggagcgguuccuccagcuucacagcuuccucccuccucugccuucacaccucccaucacacgcuccccugcagccaccugguucuaggcugccccaaauccugucccuucuuuccucuccuguggagcugaaacauauugcuuucuucaaaaggcaacuucuaagaguaggagggaagccaaaaagaaaacacgaacacaaagugugugaagacugaugaacauauaaaaagcagauucccaacuugggaagcaagagaugauggucccuuaugagauccagcagaagagcccuuuuuagaugguaagauucuguaaggacacuaaagcuucauuauugccacuguuccaucuuuuaaagaugaucuaggucaaagaagucaaagggauuacauaaaccccaaggaccaagaaaagaagagcucaccccgugugugguuuggaguugcugggacugagagucucagaagccucauguggcaucugcccuggacccagaauuucuagaacaugaugccugaugcccacacuggacgacccggaaccgguccagggaugcuaacaaugagaggcagcugcucccuguggcgcccucugcuccugccucgaugcucaagaagccugugggagcuugggguucuuugcuacccaagaggucaaaaccagcuugucuugggaggccugggugugccuggcugacagggcgucccagaugcagggcuggcacugucaugggaaaggcacgcucacuuggugccugaacggguguuguucaacacggggaugacgcugcccaaaggccaagggcaccauggccuguggagcuggaggucucauccucagaaugugcccaggguccgggguugaauaguaaagucugcucuugugccuucuaccuuucugcucgugauccccaaaguccucaaacaggcuguaagguggccaggacgggacagcucaaucuaccuuacacacgaggagccuacggaggccugcaggugucagaugacucugauccuggcugucuggccccacccugggcugcucagaccuucccaggauccugcacuccauuuaguuugagaacugcucaaacagacacccagcccagccaggcacuauuuggggagaccacagaaugacggccagguggcgcauguggaaugaaaacucucccaguguuucuuccauguuaccagcauuucccgaaaccagguucaguggaacugguucccgcagacgcuguauuuguccucauaaucauuugcauaauugcagcuaacauuuccugcuuacuguguuccaagcacugugcuaaguguuuguuauggaauaaugaauuuaaucuucccaagaacuuuaggagacgggcacuagugcauuuuacagaugaggaacuaaggcacagagaaguuaggcaacuugcccaagaacacacagcuggcaggcggcagaacugggauggaagcccgagccauuuaccuccagugcacaggcuugugaaaccaaacgggcgugucucugcacaauuucugagccuuucaugugcugacaggcaguguaaauuccuaagaagaggagacagguugucaucuaccccaaacauauuucccuuaguuaucugauagccacugaccgcucacucugccaguuacuguggguuacagugcugagccaagcaaacauacgcugugaacgcacaaggggaauucugcaagggauggcuuugucaaagccuaucccuacuuaguuccaggagaguggccuccugcacagaagggcccuggccugaacccuccccuugcccccuccauaggaugucacuucaguccucgcucacgucgaugccccugccugcagugcccuccccaccacggccuccucuccagccccagggggcacuacuggaacacuagguacguggaggcuuuugacccaucugguuugaccuggugcuccuggagaggcagagagcaugagguuuagagucugacaguccuaacuccaccaccagcagccugagcgggucaccugcccccucaguacaguuuccuuuaugaaacgggccuaacgccaacuucguauagcuggggaagcauucccaacucugccugcauggugccuggaacagagcaggagcucaauggaguucaauccagagaggcucuuaugagaggagaccccccccaacccuccuucagugagagccggcccagcagcuggucacucaaagcagggagucaguauggguacauuuaagcauuucuuaauuagaaauagagggauguguguguguucaucaaccuuuuugauggagaaaaacacacaaacaugcugccugaccgcauuuuaaauucaugaccccaaaacuccggugggcucccagcgcauaugccuccuggcagcccuucucuguucccuggugccguucccuugauuacccacauggcugcugcucaccgucuccccucuuccuccacaucuccccauccucacccaccuccaaugauuucgcucccuauggcacacaaugaugguggaacaagacuuccacaguuugcgcccugccucccuucccagcugucuucuucuuuguaaggcgggaugcccccuccugagccccacuccucccaugggugccaggccccaucuucuuucauguaaucaaggcacuccccauuuccacuccagaagucucuauucccgcaucuguguuuuauuucucucccuagcauuuaucaucugacaugccaucuauuuacuuacuuuccugucuccaccaacuagaacauaaauuccguggaguaggacauugugacaguuuuguucccugcuauauccccuggcaccuaaaacagugccaggcauguaacagcaggcguaggccccgcauuuaugaaugaaugaaugaaugaaugaauggccaagaucugcacugccuuucuggacuaaaucacacccacauuacaucaucuguuaacuuccaguuuuuguuaaaagugcagagagaaacuaagacacuuauaaggggaaucugaguacaaaauccuccuaugccuuuaccaucucugcccuggucccggcacauuuuuaauuuucucacccacaccuuguuggacugcaauuuuuaagcgaauuacuaugugccuuucuaaguauucaacuuguuuuucauaaauagcucuaugcuagucauuggcuuguauaauauuuaauuagauugugcaagugugauaauaaauacaagcggcauaaacagguuugggaacaaaugcaacugaccuuuggcaugcauuuaacuuggcugcugggaauggaagcacacggacucucccuaugagcaguggucaggauuuccagaggcaaugaagaacaugcauuaauauuggugggucgcucaaacuaaagucagcuggguuucaacuguauguuuuauccacaguuggcguuccagcaaaaaaguucagaaggauuucugguccuauuccacuuuccaaggccuugugcuuugcaaaauguucucacuuuuuuuuuuuuuuugagauggaguuucgcucuuguugcccaggcuggagugcaauggcgcgaucucagcucauggcagccuccgccucccggguucaagcgauucuccugucucagucuccugaguagcugggauuacagacgcccgucacuaugcccagcuaauuuuugguauuuuuaguagagaaggaguuucaccauguuggccaggcuggucucgaacuccugaccucaggugauccaccugccuuggccucccaaagugcuaggauuacaggcgugagccaccgcgcccggccucacaauucuuaauucucuguucuuccuuaggcaauggugaacaugccggacuuagugacgaaguaaguggcggagaccucuguguuugccuggagugcuuguguuuguuacccuuugauccagcugacuaagucacauuacccagcagcucugacucaccacggugaaggagaaaucuccaaggcaagcgauacuguguugcagauccgguuuuuggaacagcuuuguuaacacagcccauucaaaugcacauggcaccaugaaacccaucaguguuuaaacccuaagaagaugauucauuauuuugagcaaaagucagaaaaugugcaaggaaagucauccauugcuauguauuuugggaggcucuacuagggaaggaucgauccccccauucccaccccuuaagagaugucaggugucaggagaugaaauucaagcuugguacuacagaaagggugacccuauuuucagguccaaaaauaggggaaaaagaaccuagaaaucugaaggaauaguugaauaguucuacccccaugauguucaguuauagucaaagacagccuguaaggacucgaaucuuugguguguguaccaguguagacugggaggggagacuauaauuccaccaguaccuuugaauuaauacacugugcuguaguggguugcuagcaguuuuauacuggucucuauggguuacugauuggcuuucauuaugcauucuuaaccuuaaggacuauccccagaggcaguaacacuaauuuuaauuagcuaucaccagccuuuucuuucggcuugauuuuaauggaucauuuaccuaugaacggacauucuuuguucaaucaccagcaguuaauugccccaacauucacauuuuaaaccaagagggucaugaguuagggucacauaaguaggucacugaggcggagcgguagcuuuggcucuauuauccuugaggauuucuuuuucuuuuucuuccacaaauacugaguuccuaccacaugcucaggccuacggugggugcaggugaacacacacaugcagggcgcuguguuggcgaacccccaauucccucuuaccuacgacacucagaaauguccccagcuccugagcugccccugacucaucuaucaccggguuguuauaagaauuaaggaaaaacauaauugaaaguguucugagaguugaaauguugcuguaaguauaucaaagagaugguaaacaagcaaaggaaaagaauuuaaaaucaaaaucagaagaaauuaagugaugagaugagugauaccaugucauuaaaaaaaguaauaauacuuuaaaagcccucugaagucuggguaagacucaugugacaagcugauaaaaaugaagauuucaaagucccaccccagagauuaugguuuaguaggucugaaacuuuuaaucacccaggugauuuuuuaauguaggugguccacugagcaaacauccuggggagaugauccaaacuagggccccaucacacacccaggaacacagacaggaaauggcauuuaaagcuguaauuaacaacgcaaaccaaaccgcaaaaugcucuuaccucgccaugugccacacacaacucggaacaacacuuuaauaaaacaccugcuguuagcuggcacucacgagcugugucuguaauuuuuaaaaaugcuuucaaaggauauaaaccuaucauuaauuacaauguugaaauaaucuggcacggcauauauuucaacuacaauaucugacaccaguucauugaggccuaucaaacaguuggcuccuacgugaagguaaaguuaacacagauuuguuuucacuaaacucacucguaaaauuaaaucacaggagccuaacauaagaaugaagacaguaagaguauaaaacucacaccuguaaacauaaacauuggccauuagagaaauuccaaaacaauuccagaguaacauccugaauccauaagagaaauccauuucaugggcaggucaucaaucucugcuaaagguagugaacuaccaguacuuccauggguuuguaaggaccagcucucuaaaacuaucaagauuaaaccacuuggcaccaaauagauuauuuauucuaaacauaaauuaaaggacauaggaugguaaagagaaggaaacucuuguuucagaacuaaggaacuucaccuggcaacaaauauuugcugagaaaggaauugauugcacuuuuacccaaacuuuuguuucguucccuccacaaaucauuucuuuaacucguguuuugggagcuuaaaagaaaaaaagcaguccauuauacgguguguuauacuuaauacucuccuaucuaggucacuugucccagcaacaucacuuaccagcacagaaccaagagccaaagucuauuguguuuugguuuuuggcuuucuuggagacagggucucacucugcuggccaggcaggaacacaguggugcaaucauagcucacugcggccuuggcuuccugggcuuaaacaauccucccaccucagccuccugaguagcugggacuacaggugugugccacuguaccuggcuuuuuuauuucuuguagagauggggucucacuauguugcccaggcuggucuugaacuccugaguucaaaugauccucccgccucagccucccaaagugcugggauuacaggugugagccaccgcaucuggucaagaccuacuguuaaugagugagcaaaccauguccacaaauccauguucuggaauuaaugcacuuugcuuacaagggagguccuugggagaucucucagggccaaccaucucuuuguuuacauaugauauuaacaggaccacaaucuagcuucccagcccacaauuaacagaagcauaucugaaggaugccaggaaguacagacaauauccaugagugacagauggaaaaggagaucuugaggaguacgcucuucucaaaagucacaucucaagcuucuggauccucuaguguggggucaggaucuccuauaugccagaaucaucuuuucuacaacaaaguauuaauugaugguuaccuugaacccucaaagaagggugaaauugaguccaguguaguuuuaaaaagcagaaaaguagcagacacaaugacaucacaggcagcaaauaccuggcacuccagaaccacucgccuuccugcauacaaggcagacaugggucacuuagccagcccucuuucccugagugugaacccagcuucagaauccaguucuaugcagcacccugggcaacugcucccccuacacaaauggaaaccugcuggucaacccuggcuuggaaagacuucugugaaaauagaagggggagaaguugacccuagagaguagguucauccauccucugggcuguucaguaucuagaucugcuccuucucuaacaaagcuggagggaugaggcuccaaccuugguaaaaacgaggccuggccgaaaccucagacaugcugguuucccaagaagauacaaaauggguucaucccaggaagaacaaagacauccauucacccgcaacacaguuuucagcuccuucaaaucugcuggugcuucuuguccagcagacaaggugcuuacaagucacauucuuugcugcuuaaaggccaugccacuagaaggcggcacaggggcgugaccaggggcucccuucuaccuccucacgccuagauccacagacgagagguagcacaaacucaugauuaagagaugagacagacugccuggacuugacuccuggcuccaccuccuaccaucugugacuucaggcaaauugcuugacuucccugugccucgguuuccccauuuguaaaaugggagaacaugaaauuauucauagggcucuuuugaagauuaaaugagguaauacauggaaagcccuuuauuuacaucguggccagcaagcauuaucggugaucauccuuacauuauuauuguuucagcaaagcgagguuauuugguuuucaugguuugacagagcuaaugaaaugcuuucuucuuaacuuaccuuuuaaaaauugacauugaaauucaaaaccaaaagaaauagaaaguuacagggagggggugauagaauaagaaugaaucaucuuuuuucucacuuugaauuggaaaaugauuucuugucuuacagcucacuucucuuuaguucugaugggugggagcaucugcuauaagaaggaagcagcucugguccacagaggaacagcucuggccuggcaaagacacagcaaagguccuuggugccacugguagccaaaccaggaguuacaggccacuugagagcuuucucucugggcagaggcaggagauaaugagggaauguucuggcuacuacaacucacgcugucaugaaaucuuauacauggcaugccaggcucaacuuuucaucagauucaaacugagauuagagaggacaucagucagucauaauagugaugcugacagcagcugacguugacagcacucacuggggugaacagcaucugugguccuuccaggcugcucuaaaguugucuucguggcaauucuuuguggucagauugauuacugcccuuccacagaaaggaaaacgggcucggagagguugaguaacuugcauagauuacgcuuacagaacuacacaugauaaagccagaauucaaauauuuuauucaacaaauauuuauugagcagcuacuacaugccaggcuccauucuauuaauagaugcugggaacgcagcagugaagaaaucaaaguuccugccuggguagaacucucaucuaagaagggggagacauagaguaaacaaacauaaugaguccauaacagaauguacagaaggcuuaagggucuugaacaguaaagcacagcaaguagagggaugagggaccaggcagugugacagaucgauggucaggaaaggcuucuuggaggaggugccagcugaucagccuuccagguccagagccaaugcccguaccuacauuccgcugccugucaugaaaacaguagaaccucaaccccggcuagugcuggccugcaccucaccaucucuucuguggaaugcaaguggccuucaggaaauucugaacuuggaauuuccauuucuauguaaucauggcagaccaggcugaacugaagcucugucucaacuugcauugcucccaugaggggcccuggucucagacugagaaaggcuccagggaucccaggagaaucaaugucuggagcuccccagguaccaagcuuguccgaccugcagcccacaagcugcaugcagcccaacacaaauucauagacuuucuuaaaacacuaacuuuuuuuuuugcgauaucuuucuuuuguuuuagcucaucagcuuucauguuacuauauuuuaugugugaccuaagacaguucuuccaacgugggccagggaagccaaaagauuggacaucccugcucuaugcucuccaugagccgggacucaauugcuccgcacuuaccuagauagaaaagaauacaucauucuagaagccuuuaggaguguuuuaaaaauucugacaaagcucuagccucaccaaaggauagaaccacccacucaugaaauuaauagaaacuuauguuucucaguucccacaaagggcuuuuuucucuuucagggcuuuugaaaagugagucguuucugcaacagccucguccccaaguucuuuagugaucaccaucauccaaguuccccacaugcugccccuuuccacccggggccggcuacuaagaccuggcaauuuccuuagcggugccucccuaggucuguuuuugugaggacuugagcaccugacgcggauuaagcguccacugucaucaccagcgccaccacagccaucagccauuggauccucacugggaacacaugcugccuucuguaacgcgcacggcauguggcagguggggggcacagagcuccccuacaggccaggaagcuggucacucugugggcagcaugcccugccacucaguaacuaacagcacccagguaaggaacaccuagaugggaaggcauucaaugcccauguucuucccaugauccuacacacacucucugcaguaaaacugcucucuggccaucagcaucucauuugggggacacaacaguuauguacaugcaagucucucuaaaacccaagggcacagugauuaggugguuucaaauuguaguugagcuuggcucuggaaccagauggcuggguuuggggucuccacuuguagccaugggacauaauucaagugauguugccucucuccgacucgguuaaucuaucuguaaaugagaauaccaucuccgucagaugugggagagcucaaaauguaaagcacucagaaaggugccccacgcgcuggaaaggccagugacacuccaggcgcauccucaacucccuccauggugguuagcuacaccccgaggguccucuaagagucccaggacaaaguccuucagaucuacagccugacacuuugaugauucagauuggcuguugaaagauguuuucugaauggcuggcugacugaaucacaacaggagaaugugccugaauucacaaguccaauaauagccuggaaauagaagccaucugaaaauguucuaaacucuagcuggguuggcaaggauuggaugcgauuauaaaaagcaagugagaagagaauguuaccgcaaggaaaauugaauccaugaguuuuaaauaacuucauuccaauaaaaaaaauuaaaguauauuuugggccaaugauuaaaugcuacgacaaauucaacugcuguacacugaaauuguuuuuaaguuaaaaaauuaaaauacccauaacugucuccuaaggccuaaaugcccuuuuguuaacuuaccugugccacaaauuccagguuuuuuaaagugaguccuauuuuaaauguacauuuagauuuaaugcuaagacucaguagauguaggauuccagauuguaucauaggcuccuguuuaaacaugaauaaggaaauauucuuagcuuaaauauguucugaaucagaacacaaaccugggcuuuaaaauucaccuguagcuuucugugguugcugaaaugacacuccaguucuuucuccccucacugaguaacucagguggcaccuaugaaaggguguucagaaacauggcuuguucuguugacuuccugccaugguuuauuagcuggacaugggaaggcacauuuaggcaccagucuuccguaaaauguuuauggucuccagaauguccaccugaauuucuauuuuaaaaaagaguugaaaagaaauccagcugacauaaggaaggcagaaaugcaggcaugugcaaauccuauuacccgcaacaggucgacaaguuuauuuuaauaaaaguauuucuggguaccuuuuaaugacucacaauuaaaugcaauuuuugcaacugcaaguaauuuaauguagagugaugaugguuuccucaauucuuaaucuagaaaacuaaaugaaaccuacacacccccuccagguucuaauccuauacuuuaaaaauaagguaucggcagaacguaaauaccuguuuguuuugcauguaacaaacacacuauuugcugaagucgggaggcagccuagaccaacuuucuuuuuggguuaaugcccagcagcucaagguucuccgccgguaucugaggagaugcuugaggaucccagggccuuuagaaucaucuccaaaaucaaaggguauuacuauaaugagcuuggcuucuguuaaacagucacguugccguugaugaaccacauggcucuauaaaagccagcuugauugaccugaacuaauuggucugugauggggguagaaguuuauuccacagugagagggaaacuaaaagcaaauggguccaggagcaacuccugacuaauaaaggcucgcugcaccaggaagauuuccuuacccacaaaugacuguuccacuuguucacuaaugcuuggaaaagcuuuuauggagaagguacugcguccuguuuucuauauuuagaagaaauaaaaucccuuaaaaaaaaaaaacccuaccuauaaaaacgauggacugcacaguguagcuuggaguucaaaucccaacuugccaccuuagaguugugugcccuuggaacaaaaucacuuuccccaaaucuguuucuccaucgguaaaugacaccaaccucaggcugucauugccaagacuuguagaugcucagcagaguacccagcaaacagcaggcauuggaaagccagacugaauccacccuaaagcuucucagaucauuuccaccaccacucagaggaagcggcacaagggcagaagggggggagggaggaagugacaugacccuguguagguggcagcaaggaucgggccuaggggccugggacugcagcacagagauccauggcaccaaggagcaguuucgcacuuuuuucccuacaugccacccacucaaaccucaaaccguauucaacuucuauuuugacauuagauguucugucuaaaaucuuaacggucacgucaucauucccaccaaucuggaccuuuauuuuucuuaucccauaauacuguguauucaagguucugcuugugaggcaaacccuucaggaaaggucaagccaccagaagggcaaggcccaagggggcuugggccuuggaaucaacauaagccagagagaaacuacacauuaggcccgugguuccuucacccucaaggcccaccaccuccucuuuccaccaaguggacacggcucaggauuggcuucagaauaacccugaugccccaacgccagaugcacggccccgccagccuuagaaagaacgggaaaacaauagugcccacuuugcaggauaauuauaaggaugccaugcagcacugcgaggccuaaagcacacacaauccucuagcaauugagagcuacacucaucuguuauucuucccauauuaaauucagaaauucuccugugcccugaauuuaccuggggucuuuaaaguacauauuacccaggcaggucccagcccuaaauggacucauuguagggccuuggaacuagugguuuugacaagcuccccaggugaaguguggaacccacgguguugaagggcagggcuuguggcuccccguuuuguuaagucuagcagaauggcccauccacaccugcaaggcccucgaacauacgcucaacagcagugcuucaccagaaccuucacugaggcugccugaagcggcagcugcaggaguggugccaucaggcaggaaagaggccaugagagcugggccuguaaaggcugacggggaacgauaaaccauuuucuguaacuaucagccuggucuuugaaacacuuuaaauguggccuuuauauccuagucaacccuuuucucauccgccugugcucuaauccacuuucaagguaaauugcccuuuaugauuuuuuuuauggauucaagucaauauauucaaagcgagguucaauaucaaaucaaaacccacaugaauaaaauaucaaaugcauuaagugagcuauaauuuuaguagagucauuuuaagcuaaguauuaaaagccggcagucaucuagauuacuggcauucagauauuaagcuagaagcaucuccuuguccaccuagccucuggggaacugugacagcgaggagguuuggaauaugaaguauaaaguggggaaaaaagccacuaugaaaauacaagccccacggaagucaggauuuuuguccauuuuguucagagauguauccuaagcaccuacaacacagccaggcauacauuaaguacucaauacauuaagcugguuuuguaaaauuaucuugcuagaaaguacuuguaacaacgaggacaagacagccagccuagcaaggcauuuaccagaaacacugugaaauguuucaaugguaacagggauggaaggcucuaauuagcuuuugauuuuuuaaaaacguuuaacucuaucaaagaagagccaaagcaacccaaacagggcagcuucucccuuggugagauggaugugaugugguuccuuggugacuccuccaguaaacaucugagucccugucauguuccaggcagagccagggacacuguggagaccgagccaucaucccacucuuucaguccagugcuugugucugacagcaucuugauccaggagaaaagaucuccuccuagagggcgcacucagaaaccagccagucuacuccccacuuuuugcagacugggaacuaugauccagaauguaaaggaacuugcccaaggcuaaaacacagaagacgcagccauggagggcgcuuguuggaggcccguuuacugaaggcacagggaagggaugaacggccagcagauggguuaggauggaaauccaguucucauccaagaccgugcucuuucucacaacacucaacuccucacagggcacugcuguguguugaagccucauuuguuuaaaacuacuaauaucgaagaccaguuccagauucccaccaaccucucuccuccguguuuuucuaagggaggaauaucguaugccagaacaucuggccaagggaagcuggcuaucccuucaccaccuuucccugaggagugacagacagaugugguuagcaaagugcuaugaugaugaacuauaggaaaccgcuuauagucagccauuuuuaaucuuaaaaaaccccagcaauuucacauaaacugaguaugucacaacuuuuugguuucauucuuuggaagcccauagaaauaaacaucaauccacaaacuacaguaaacuuuuaggaagcacagagaccccacagaugaaauuauuuuguauuuuacucuuacccgagugaguucacaagguacuucucggcaccguugucugacuacacguccacccucuacauagaaauccaacuggaaugagcacauauucaguuacugucaaauagaaacaagugaacagacgccaggugggcugaguagacgccgcacuuuuaaauuagagugcgggcucugaacaauccuccacacacaccuuguuuuacccccuaacugcucccaauuauguacaaaaugcaguccuuucacagauguuuagaaaguuuuuuauugguuacaauaauauaaaaugcauuguuuaaauucuccucuaguuauuaaguguuugcagcaauagcacaacaaaucuuuuuuuaauacaucugacaagccccaaugauuucaaugcugggaggggaaaaacaacaaacaccacucuugucuaucuauaauuaaccucucucucucucagugcuacauugguuaaaaucaauggacaaccccuuuuuguaugucaaauuguaaauuuuaauguuuucauuagaauagucuuuuauagcacucuccaaaaagaagcaauaaaauaacuaacagcaaaguucaauacaggagcacucuccggguuaacaacgccaacaaaaaaagugaaauguaaaucacauauaauacaauugaagcguccaaaacaauuuaaauaauuuuaaauauuuuauuuuuaaauugcuacaaaugcuuuauacaauauuucaacauaaaguccccauaacagaaauguaacaaaaugggaaugauaguggaaggauuaaaguggcacaaauucaccaaacaaauauuaaacuacaaauuuuucagagguagauuacuuuugaaguugagaacaaaaaacaguaugaauaaaaccuagccgcuuuccaccaacucagucauuaauuuagggggaggcauaaaauguaaggauaaaugauauuaauauacuuaggaagaggccaauuuguuguuuuuaaucucuauuagagaugcaaguguaaaaccugguaugcaaauucauuuauacuuacguguagacauacaucuguacaggccugggaugcgccugugcacugauauauugcuacauagucucugauaauauaauaguuauaaauuagugccagauaagaaucugagaggauaacguccauuuggauauacaaacgcaacaccagaauaggcauaaaaaagaguccauauccaaucugguuuccucuccauuacgcuggcaaucuacuugugauuuaaaaaaacgaaaacaacaaaaaaaagaaauaccagggguaagagaucagcuaaaugccucucucugucuauaauuaauuuaaaagaaaggcaucaagagcugauaugugaccaaaacguuuuaaaugagugcauccaaaucugucaucccugaaaccuacaacaaacuacugcuaaaacaggcaacuugcuuugcaagguuaaguucaaaucaauccuuucucugcuacgugccaaaaacaagggccaugcucagaucugagguaccagucccaugacgaggagccaguucaucuggccugucuuacagugcccuucucuuuggaucucaaucacccgggcgcccagcaugcgcguugggcccccaccgaagcagcagaugccugacucuaagccugccggcaaucagcugaauguuaggauuuuugagucagcuucaacuggucuugcaagcuugguagauuucguauccuuugccguagugcuuauccuaaguugagcaugcaauacuuuuuagucaauuaagguuuguuuuguuuugggggcuuuucuacaggaaguuccuagaaaauaagaaaacugaagauaaaugacaacagaacauaaccuuacaugauugaccauguuaaagaaaaaggugaauagaccguaagacaaauguuauuaagacgacaacacauacaugacugaaggcauuuaggaacgagcguccuacccagaagacacacccugcaaggaacuacacgcauuuauuuccaagggauguagcagagauggaggcaugagaaauuagcacuuuuuuuuuuaaaucaauuccugguaaauggaaaaacuuggucuagaauuucauuuugcuucucuaccuuuuucuugacugcgaugggaacucgguuugaaaagaaaaauguggcucuaaaagaagcauuaaagaacccaaaaacaccaggcacgguggcucacaccuguaaucccagcacugcaggaggccgagacgggcggaucauaaggucaggagaucgagaccauccuggcuaacacggugaaaccccaucucuacuaaaaauacaaaaaauuagccgggcaugguggcgggcaccuguagucccagcuacucgggaggcugagacaggagaauggcgugaacccgggaggcagagcuugcagugagccaagaucgugccacugcacuccagccugggcaacggagcgagacucugucucauuaaaaaaaaaaaaaaaaaaagaacccaaaaacaccgugggguuuacaaaggugaaagaugaguaggaggugaguagagaauacaccucuuuccuucccuuucugcuuuacuggagcccauggaaaugaacccuuagcaacagauuuaaacucagcacuccagaaagccauggcgagggguggggggugggucacuguaguaagagcugcagcaggagaaccugaaugacuguggcaugccugcuuuccuguguuuucuccuaagaaaaauauuuggagcacauggcuuuuugacaccuugucuggcaccauggcuuguguuccaggaaaugacccucaguguuaaguagaaaacucauggaaaaaucauauggcugauugcaagcauguacuugaaaaacuguggaauccgaaaguggcauucacauguaaaauaucugaguauggaaaacuagcucuuaaucacagcuuguuguaaagaaauaacacaggacaaggaugugcugccuguucuguaagaaaucccuguguacccaacaggguaaguaaagcaagcugcaaacagagugaaagugaguauuccucgacauguaauagaugugaugauuccuugugucaggaaucaucccuacacgaaauuuacaaguagaacuauacuuaaacagaaagacgacuguaguucaaacaacuccuuauuaguguaaugcaacaaauaugcacugaggcugaggccuccucucuacgagcccugggcaacacguuaaugacaaucaucauauuacccaggucuaaguuuaggaaucccaguuuugugcuaaacucacuacaaaguacuaagaccaaaacaaacacuuuaaagaaaugcccacuuuuguguccagauagucaaaaucuaucuugaugaacaucuguuuucuaauucccaagaacacaucacagguuuauggugacuugguaaguggaccccuggaucacauuccugaccuacagauguguccgcagcacaguuccagcaccucacacagaggaggaagagcugccaccaaugccugucauuaccaucuacgguuaggacaauaccaguguuuucuuaucugauucuucugugcuuccuuuuaggcaaaauuucacuccagcaagguaacccucuguuaacuaucaaacaaagcaaaauaaugaaaaugaacuggggcaaagaagagacaugauuuuuaaggcccuuuaguccuuuguagccuuaaagguuacucaaaagacacuggguagaggcuauuugaauaggccucauaaauuuauggucacucugacagcuuuucuuugcagaacuuaauuuuuccaaaucaacuuuaaccuugaacuguguaaguagggccaaguacaaaacaagcauuucuuuuagauaauacugaagacaaaagggauagacaguacauucuaaagcaucaaccgccugggagguguuuuauaguacaaucugugaaaaugaaggcacacucugcuuguugaagacacaagcaacuugaaaaggacucaauuugaucauguccuguugguguggcaccaccagaacacagacugagcacaaacaggugcacaauucaauuacuaaaggcaagcagcuuugacagcugauaacacaggugcuuauuuucagcagagcuaaccuccaagaugcuaccuauguaugugccgcggccagagaccgagcguuggucagaccuauggcaacuaaauauuuaacacauuuaugaaguaacuuuuuaaaaaucugauccauuaauccuacaguaaaucauucaaaucagccuuagcuaaugauucuucucuaucuuuagcugugauuuaaggcacaccagcauuaaaaauucuaccucaucaaucaugcagggcuaauggcaccucuguguccucgugaccucuacaaaauggcagucgcguccacacuuaggaucccuaauucugcuugcuuaaaacaccaaagaauuuucagacaccaaaagcuauagcaugaaagccuagagucagguggcauccugugaaaagacaagacuuaaaaguauuuugcagaaaugcuaucugaugaguaauuuucacaugagacugaacuauucagaaacagcaggaauuccaauacacauccacuucggacaaaggacucaggaaguuugagaauccaauguaacaaauuuaaccgcugcccucucuucaucugucacugagaacaguucuuaauauaggaagcacagggaauaaagcaguaaagucacuucaaaucuaagacaaauccuucuaucauuacuggggaaacaaaggcacugacaaaugaggcugacaugcccuggguaucacacaggccugaaagagcugcaaggguccugccuggaguuccaagcaugucucuccugcucugcuucccauccagauccugacuuguuuaccguccuacggcugaguucaggaggugggggacagugcauaagaccuuuuuaaaggacuauguuuuguuuugaccgaugcaaucaauuauuaaaauuuaagcauuggcaauucugaaagaaagugucagguacuagaucuaugcugaagucacagaaauauuaaacaagauuguaacaugguuuacuaaugaacuuagugacccgucuuaaccuaagaaauguucuaugaucggaaaauaagacacaugacacugagcuauuacccaagacauaaaggaaguuugagaggauugcaucuuuucuuagaguacuuuugagagcuuuucuauaguuuuaaauucaauuuacaucuggccacauuaaagaaguggcacugcuuugugaguccuaagucugaaauuagaacuauuuauucaucucuaaaagcagccaaagcaaugacccuucaugccuuuaacuuauacaacagcuauuuccuuuaaguggggaaaaaaaaaaaaaaaagcaacaagaaaccaaaaaacacccguaggcaaggauacugucgccuucccggucuuucccucccaccagcuccugagcuuaccugaaguccuucagcuccugcuuggcgcugccguccucucucuuguucucacucaagucagcagcagcugccagcugaaggcuccgggugacuggccccccacuccgcucucuagauuuuauauugaaccggucuguucuuuucuuacucgccaagguggauuugcuuuguaaaacagcuuugcuuuucuguacccucacgugcaggcuccgugauguuuugcuggaaagcugagcagaaugauucuuggccacagcuuuagguuuuuuccccucaacaugaguuauuuuggccauucuuaucgggcuggaguuccuuaaagaggaggagcuugguuuuuuggauuucaccgaagcugcaaacuugacguucugcuuggaccugaaggaugaggagggaagugggacuuggguggggccugagcugcgggcucuggucuugcccaacggagucugcaugcuuugcauuuuaaucuccgcauccgcuguccgucugcggugguugcuguuacuguuuuugucacuacuugcaggugaugaguguccaccuuucuuagaugaaugagaaacuuuuuuuuugggaggagaaagggguuuuuugggacagcugaaggcggcguguuuauucaggcuuccaauguaagugaacucucgauuacaguaagggcagaugugagaggaugacucacaagcauuuuucaagucggccuucugcuuugcagauuuguuuuucugaagaauugcuuucuguacuagcugauuuuuuuucuucaaugcauuuaauuugagcuuauucgacgacauuuugcugagcucaacacuaaaguuaagccuuuugggcugucccauucgucggaaggcauuuuucccagaguuaucuaaaaccaccacgccauuuuuggguugcacaguuuguuuuaaugguacuggguuuuucuuaggcguguaccucuucuugucacuugcagaagcacaagccaggauauguuugugcaacuccggcauauugucgacaccuuuuccacacuuugugcagcgaauggcgguagugaaagucuguggaauauuguguguagugaaauuuguggcugucacaccaauccccaugggguuacggugaugguacugaaauggaggugguuuaaagcuuggguaaugcugauugaggcccaaucgaacaucuggaucuuuugucuuuauuccagaagccauuauuuuuauagucguguaaagcucuucagaggaaucauuuaacuccucuucuucuuuagaaguuucuaaaggaucuucuggcaagcucugcauaugcucuacaugggccuugcugggaucuguaaaguucuggggccucagagucccgcuuucaaacucgugaugugugcacaccuuaucuggguggagaucucgcuggugcugcugcaaauugcacaaaaaagcaaauucuuuuuuacaaacagaacacacaaagauauucccaacuccaugaagcaaaaagcgauguucugacaaguccguuuuauccuuaaaaagcugcacacaaaauucacauuugaagggccauucuucagcaugaauagauaaauguuugguuagaucuuuaauggaaagaaaaggugauucacagacguugcaaacaaaguuuuuguugaauguuuccugaacaacaacauccuguucagcagcagacuggggcucuucccuggguuucagaccuucauucucuaauuccuccuguuugaaagauaucauggggagagaagccuccagauuaucaccagaggaaacaacagaugauauugcggagagaggagguggagaaggagaagaggaggaagaugaagaagaaaacgaagaggaggaggaagaugaagaggaggaagaagaaaguguuggaggcccgggugaggcggcagacaucaggggcuccacgggaggaaugggagagggagagggggacacuguuggggacagaauuggaaguggggacugugcgguggcauuugagaguggagaggggcauggguguggagaugcacuggaagagggggcuggaagagguacgguaggaaggaggggagggggcggaguggcaacaguuaauaccgggggacaggguggaggggaagagggaucuguggggaucaagagaggaggcagcugaccggaugaaagggagggugucugcagggcaggugaugaaggacaaacaucagguguggacucaacaguaggggcagggaaaccagagcccggaccgaggucaggaucuggcugagcuucuagggauuuacaaggacuugggcuccuggucccaucugcaggguuuucuacagguaaaucgaugccauuauauucauugagaagaaccuucugcagcaugcaggugguugguuuccuuuucuuuacagcacuacacguaggcugcacugaaugacuuucuuugaauuccuugccuucagagucacuacaaugcuuuuuaugcacacugagaucuaagacagauucccacuggacuggagucuugccuguacccucagccuucuguuugacaccgcuggauaaauccaguggcugcugguugcacacacugcuaaaagcagaacuagcuguccacucuuuagacauuuuauauucaucaaagcauggagggcucacaguuucucucucaucucucccagacaaacuccaugcuggugagucgcugugacuuucuaauuuggauuuuuuggaagucagcccggcaucgguccaugcugcuuucccaucacuuggcuuuccaaagucucgaagggcaggacugugcuguggagaacugggaggagagcugguccgccucuuaaaccuacuugaggucacaggcaacauugaugcaggagcagacacacaaacaggaccuaauuuagcuauuucaguugcugaaaucccugcaggaguuaguuuaucuuggguuugaagaaguuguuugagcuuugaugacaaauaaacacuuuucucuuuguggaaagacacugccucuguuguugauaugcuaagaggaagacuuaaagagcaagaggggaccauggggucagagucuguuucggccuuaauuuugggcagugcaggugggcucgcaguucuccgcuucuuggccucacuauuugugcugcccaaaggcucuuuaggaagaucuucuguuacagggaccuguguggucuuuauauuuugaguaauuuccacuguaacuggagugagcagacaauuuauaccauacaaaucugccgaagcagacuccaucucaaucacaucacaguuacuaguguuguuauuaguuugaauuuuaccaucaauauaguaauuuaaguuuucagagauauugcuagaaauguccaugauguacacaucaucugcuuccccuuccuccuccggcucugugcuugguacauacacguucuggguggccugggccuguucugcuggaggcuggggcucuucaaggccuccuuuucgccguacaccuuugggaaucagaugacguucgugaacucuacgcugaugccgucucauauuaguaugaguuccaaaaaccuuuuuacaauauuugcacggaugaaguucuuuaacuuccccauucucuucuacgacagaagaauuuauugugucuugggaagccuucucugaauucaugaucagacagucuggcccaagacugggaggacucgaaucaucuuuugaagcaacguuuucuccagaugcuuugccaucagccagauccucugacggcuguaguguuuggcuggguuuccgcuuuaacccugcuucauggcgccgcucaugucgccgccgguuaaucugugugccaaaggcuuucccacaguacuugcauuugaaagcaugauugacgguggauauauggauaugcaugugacgcucaagccccuguuugguuguaaacuuccuuucacaauguugacacggaaacauaaacguuucaaauacaucaccauuggccucuucuuuaguucuggggauuugcauggcagguguuaccucugagcagucuucaagaguuucuucugaaguuguuuuugguuccucuaauaaaucuucuggcuucucaucacaccguauuucuggcucuuucacagaauuuucauuuggcaugcuggcuucuucuucccccucgucuuccaacucaucaucaucaucaucuucuucuucuucuucauccuccuccucuuccuccuccuccucuucccccaaaucauucaccucacaagcugccgcuucuaaucgcucgucugguucuggcuguggcucccaggcaggggcagggguugcuaguucuggaggcaccuccugacuggccaccuccuggaggguggccggcugcucaagugcugaggcugaaggcuucucuucgucuucuuuaggaccuagaaagcacauggaagcagaagcauggaagugaagcaugggaaaccagcuacuuggugaacaaucugaaugauucaaguuauuucucuuaccaccuaaaacauaagggagaugaugaugaacaauaaauuacuucuacuuuauauacuuaauugacaaaguuguauuggauaugaauccacuucauucaacaaguauuuaggguaccagccacguaccaggcaauauucccggcagugaggacacacacgagcgcaacagacaaggauguccguguggagcuggggauuuguguuuaguugcacacagauacaacucuguugacagaaacuguaguguuuaaaaucguguuggaguagucacuacuacauuuuaggaguaguuguaaauucuaauuucucaugauuccaaacuggaaacaguucuuuaccagacauaucaccagguuagauccuuggaagucugucuggaguaaaugauccucucucccucuuaaauaaaauguuauucucagaagcuagaacauuuuccagaaucauguaaucacaaguuuuucaagcuagacaaucuuuggagaucaucucuucuaagccuagccaaguuauuaagaacucaggagcaucucacugaagggaacagaaaucugcagucacuucggagucccuaggccuagcccaccugaggugggugguagaaggcagucagggaaggacuugcuuagaaggugacaguggaggagagaccuaaggaaaaugaggcaugcaaauauugggggggggggugggaggaggagcccuacuggauagaggaacccucaaaaugcauaagcgcugagucaagaacauacuagaugcauucaaagaacagcaaagacaucagugaggugagguggggaagcugggcaaagugagggcaggagguaagacuagagaugcaaacaggggccuacuuacacaagccccugcaggcugcuggcuuuuacucuugagugaaaacagggagcuaccagaaagaucuaacggaaauauauaaucugacuuguauucaagagaaucacucugguuacuacaaggaagauagugaacccuaggugacaaggguggaggcagauggaaagauggggcccaaugcauccuccaggagaggcaggaugguggcacagggguggcagcagggcgggacuacaagugcucuggauauauuuugucaaugaaguugacaacaugccugcugacuggcuguggugagagagaagaggagauuccacgcaacugcaauaauccuggcuaauaaaacguuggaagaccacaagagaagcaacuguggucugugugcaugugcguguugugggggaaaucaagagcuuacuucagacgugcuaaaguuuaagguaccugauuauagacauccaaguaaauauauuaaguagacagcuuuauaugaaucuggaauucaacaaagaggcuggccuagaaauuucaaaguccuagagaaggccagagaagguauuuagagcacuggacuggaugaggucaccuggcaagugaacgcaggcagaagagggaugagaggauugugucccagaugacuccacgacugaggcugggggaaaggccagugagguauccagagaaccaagagaguggugguccuuuggcaaaguaaagaaacugcuucaaggagggcaugaucagcuguguccagaacuccugauggguuggauaaaaugaggacugagaauggaacauuccaucugccaaggcagaggucuugugauugugacagcaaguggaguaguggggacaaaugucuaacagaguuccuaagagaauggaaggagauggagagacagggagacuauuagcaacucuuucaaguuuaccuguaaagaaaaagaaauggagaagagacuggaagaaaacacagggacaagaggggauucuuaaagacggaagcuguaaucgcgguuucgugcuaguaggaaugguccccaaugcugcugucgcgacagucccacuugcugcacugcagaagcggaccccucuacugcaggcacuaggagaguuaagaaagguuccacggaggaggcagagcuauucugacuucuucuccaggcuacauuaccuggcuguucccccaaucacuugcaaauacugacuuagcacccacuaucugccaguacuagguaaacaagacugucacgauccuuacccauagagagcuucacuuuaauacaagccacacacaagcaggaaggcaacgaaacuguagaacauugauggcuguguuuauggaagugagugugguacggaagcaucucauauggguuugauuaaucaggaaaggcuucuuagagaaaggacuaagcagacagaaccugaagaauacaagaauuaaggacagaagaggaaaagcaagcagaaaagagucaaaacauagagaacacuguaaauuaauguggacuuaucuggggacaguggggagccacugaagguaucugaaagcaggagacugccaucugggagauucggcugcagggugggugaagggaugggggaaggucaucacuggaggccgaggagcaagacuggcagagcagaaugagaauggagaugcuggcugcugugcuaagaaggaaaggggaagaggcaguggaggcagaaaagagcagccagacccucacgaucugagaggccugcuacuggacauggggacugcguggauacaguggggaagaggucaaugccaaguauuacucauacaagcucacuuauucaguccuagccuccuugcuguuucccaggaauaucgggaauuacuguuucccaucugcuacuccauuuacuagcaaugagguuucuguuuccaaacagaaacagccuucucucccccuagacuaauuucauaaauuccaugagcuuuccacaaagugggaaaccagucauucgacaguaguaacauauuucaaauuaggagcuaccucucuuuucaaagauauuuucaauagagaccccgaauacugccaaaagaguugaaaugagacaacagaaaacgccaacucuaaggcucagaaauuuccuaacagacuuuauuuucagucaaaaucuguggcuucuuuugauggggaaaaaaugucuuuccccaugacugguaaacaaucccagauauaaaacuguccaaaguaacauaaaccgaagucugcacagcuccauuaacaagcacggcccaugccagaguggauccacgcacuuuauguggucucuggaguuuugaacauaaagggagguuugggagcacaaagaagagucugaacuguuugcucaugguauagaccauuugcugaggacaacgcagaacauucagcggaagccuacgacaccacuuugaccagcugugccaaauacuggggggugaagagcaagugucauuuuucuuuuuuuuuuuuuuuugagacggagucucgcucugucgcccaggcuggagugcaguggcacgaucucggcucacugcaagcuccgccuccuggguucacaccauuuuccugccucagccucccggacuacaggcgcccaccaccacgccuggcuaauuuuuuuguauuuuuaguagagacgggguuucaccauguuagccaggauagucucgaucuccugaccuugugauccacccgccucggccucccaaagugcugggauuacaggcgugagccaccgcgccaggccagcaagugucauuuuucaugggaccugauguugugucaggagaaaaauaauugucucgaauuacugaaggggaguaggugacugcugaaucuguuuucuaauucuaccgccaaagguagugagguuccuuaguaauuuuuguuguucaaaaaaaacucucggcacaccugcaaugaggaggcagaacuuagucuuaagacucugggaaaugaacuugacuauucuuguuucacagaaaauuauaucuuuuaugaauguuaucaucacaaacagugcuuaaaaaugguuaugaaaggcauccaaaauauucugguuauuuuccucuacaaauauuucuuaaaagagucacaaaccugucuucugaaauuugccuacuuggcucacuauaaacaacucaaguaagcugcaaucugcaaaaauuugcccauggcaaauuaagacacaccuccuucccuucuguaucaauagucucaauaugguggcccaacugcaaugagcagagggcaagcugucuuucugauuaacuuucaauccaugccucuugguuggauucuuacgucguggcaggccuagaauauuaucaccagagggacuauaaaggagaaaauuuuaaggggacaaacacgaagagacaaaauaagaauuuaaauuccaacaaaaaacagaaacacacuucauucuguauacuuuuuguucuguuauacaaaaaucaaagucucugacauuguaaguaaaugcuuaauuugaaguauaaaacguacauguauuaaaguguacaaauaguugaguauauagcaagauaaaauuuucacuaaauauauauacccaugugaccauuccacagaugaauaauagaaaacagcgagcaccccaggugccuccucauguccuugcuaucacuauuuuuugaugguuuugaacuucaugcuauuuuuaaaugcaaucauauguuucauuuuauuaucauuauuuuuauuuuuuuagagacagucucgcccugucacccaggcuggaguacaguggggggaucacagcucaauguagccucuaacuccugggcaccagugauccucccaccucagccugucaaguagcuagaacuacaggcacaugccaucaucuuagugaauuuucuuauuuucuuuuguagaaacagggucucacuauguugcccgggcuggccucaaacuccuggccuccagagauccuucuggcucagccucccaaagugcugggauuacaggugugagccaccacaccuggucucauuuuauuuuaacaaaggaacaaguucauuuuuaagaagaaaagucuuucacaauuguuugaagggaagguagcauauagaaggcucagcuuaccacauuaaauuuaggcagcuuuuuugcuguuuaaccucguaaagauccuaaaugauucucagaaggacaauauaaagagauacaaaguuaaauucacuggguacauacacacccaauucagaccaagccaauaucacaagcuuaccuucugcagaaucucucauauuugcagaggugaaaucuggcucacuugucuucaguuguaugucuuggauuuuguuuccuuuguuuuuauuuuccugggauuuuuucuucccugaaacacaauuuuuuuuaauuuauucauucauuuuuuuuuuauuuauucauucauucauucccucauguguuauucugaauuacugaagauaauuauuaauccaaucaagaacacuguauauuccugggcaauuaccacuuuggauuccuaaagaaaggaaugaaugaugacuguaaauacucuguuauauagguaaauuaugacagaggggaaaagaaagaaacacaucaaucuugcauuuuugagaaucuugggcauuaguucccuucauagcuauaaugacuaucaaauuaugagguaacguuacuauugaugucaaaggaaaauuaguaauagcauugaauuucaaugccacacagcuaauagggauuggcuauuuguaagaagcauauuagagaaaaacaguauguuauaacuuggggcccuuuuagcuaagacaugauuauccauaauuguuggaagcaaaacaagagaagcagagauucugcggaauuucaaaagauacacauucacaauggcucaaauaccaaaugcagaguaauuaugaauaauucacuguccaccagcauggcacucugagagcccuaagggaucugacuguagguccaguccaggucaauauuucauuaacaauucagaggauggaauucagaaacacugacugcauuccaagugauaccauacguuuacaagguaagauuaaauugcaacaucguucucauaaguuggaacaacggaacuaaagucaugaagauaagaaacaauuaucuauaggaguaauaauacugaagaagucagaagcccaguuucuuuaggauuuaaccagaauuugcaaccuuucuuuuacauuuuuuaauuaccagauuucuauuuuucuggaagcugguguuucagucuucagauccagacagauccccauucuuccguaacaauccuccuuuuucuccgcugcucucccccagacaaaccuccaccagcuuccagaacuacaagccucugacaccuuuuaucucugcauuaguaaaaucaaacuaaaaacgacuuaaagcugcuauauacacguaaaguuacauacuccauaacagagaaucacuaccgggaagcauaauuagcuaaaaauguaaacagacaaaaaugaggucagagacauaaaauagcaucauugaaaacaucuagauuaaaaguagaaacaucaaauacaauacaaagcaaaaacaaauccuaaaaaacaccaccagauuuugacaaaaauuugagacauaaccuuaacagucauuuugcuuguuagucuuaaaacguaaauucuaaaauaccauuuuaaacaccuuuuuuuuucuuuguuuuugagauggagucucacucugucgcccaggcuggagugcaguggcacaaucuuggcucacugcaagcuccgccucccggguucaugccauucuccugccucagccucccgaguagcugggacuacaggcgcccgccaacacgcccggcuaauuuuucguauuuuaguagagacgggguuucaccaucuuagccaggauggucucgaucuccugaccucaugauccgccugccucggccucccagagugcugggauuacaggcaugagccaccgugcccggccuacauaccuaauucuucagcccauaggaaauccgauguuuuugccacuacguuuaucaggguuugagcaaauaaauuccugauagccugucuauccauucauuuccaaaggcacuuaaaauggaacucaaaaaacgagcacacacuucaccgggaccacacucuggugauaacaagagugaaggaucugcauggagaugaccaacacacgucuccaggugaagaauuauaagccaauccccuccauaaggggcacaaacaucuaagcaccuuuccacaggcauaacguccucuugugacucuuucucccuuugucaacuuaacagcauuuugucuaaaucagauaaugacaaagguucuucagggauccaguuuuguuuaagggaauuuggauucuaccuccuuuccaucaguuuucuuaugcuuaugacauaagcuaguucugccugugugugaugcucagcccguauuagauuacugagagcaaacaaaaugcuuaucgcccacccacauccauaaugcaaauauaaugacuacugacauaacauaacuucucugugcugcaacugaugugugaggaaauucacggcuucuuuuauuaccaugugaagagagaguuccugguguagcccacagauucaaaaaucauauucagaaacuuuuucucugaacccaaacaaugacauuuuuauaagacauaccccucagguaaccccaaacaggccaaggaauguggccuuuuuuuacugaucauuuacuuaguacuuacuuaguaugagcuuuuaaaauaaauuaaaauggagagguguaaucuaaaccuucacuccuugcauaaaccucacacacauuuaaagaagggccacaguguaaaauuuaauagaaaaaccgaugucaauuucuuguaauacagucacuugcaaaaaaaaaugcaaagauuuuucuacaaccucccaaguguuguacaaacccagucuguaggucauauaaaaagccaaguacacuguucuacauguaaauagaguauuaaauaaguaaaaugucuagauuuauaucuuaacaaaaggaaguacaaucuuaauaccauuaagaugcacucaaaaugaaaucacauaacugucuaaaacauaagugcuauuuuaaguuuuauucccuaccuaaaagaauguuagagcaccuagcugauacuaaaugucaaauguccuuuauuggacaaacaaaaccuaaucagcgagaacucccuuuucucucuccagguguccucuuuaaaagccaugacccuggaaacccaauccacugugaggagaagccauuugcaguagguacaucuccaguaucuuaucagaggacuaaggaggggaucccgccacagaccacuacaggguaccaaggcgccucaaccgcagcaugaacgacaucugggccagaucauccuuggcuguggggugggcugucugaugcacuggaagauguuuaacugcaccuguagccacuauuuacuagaugcuaguggcacccccccuucuaauugugacaauccaaagucucuagacauggccagauguccccuggggagaagauuuccccagguuaagaaccacuggacuagaucaaugcauuucuggaucacacucgacggucuauacauguauuaaaaacuacaaaaaguacuugaauaacacuaauaagccaauucuaaaaauggagagaugaagaacuaaauuuaccaccaaacuaaauuuggugaauaccaacacacuuaguuuaucaaggaaaugagucuaucacaagucuauaucauucauccauggaauugagauuaucugacaccuggaacaauguucucaaucuucaugagaaccaucaguuaaguuacgucucaucgugagggccuuggacuagagaugaaggggcuauugaaaucaccuguccugccuucaauuuugugggagaaagugaaggccagcgccagaggggaaguaauuagccuauggcagaacagaaagcagaaccagggguccugcccacacauacacaggcuuggugucccucacaaccgccaaauauugcagcaacaggcgguggaaccugcuacauuuccuuaaaccaguacugauuucuucugacaccugauuucuguccuauaugucaucaaauuaaaagaaaaaaccaaacccauaaggacauuuacagaggggagauggcauuugugagcuucucucugugaggcagaggagcaggagccgcugggaggccuggcaagcacacaagugcacuuaccaucggguccuggggguccuacagggcgcuacugccagcuggcugcuccgcuuggucuagacaagaaagaggaaugaaacacaagggaagugaaauggaaaugaugacaaggaacagcagagggacaggacaacacuaugugcaugaggaaaagaaaugaauacaucaagaugagaaauugaauacaacagaaggaaaacagcaguuaucuacugcaucaaggugcucacaugccaaaaauaauguuuaacuguguacuuaguugcugagaauaagaccaauguaguauauucauucuugggccuguacugugcgcccuuauuguaaaacugaugccccugccacuuaauggaucaauuuugcuagaagcccccaaagucccaacgcauaaaucacuuuacaagguagacacccaaagggcagagaugugaaauaacuugcccaaugacacacgacuacaguagcuguaaagccagaaugaaaacucaagggccaggagcagugggucacaccuguaaucccagcacuuugggaggccgaggcagguggaucaccugagguuaggaguucgagaccagccuggccaacauggugggugaaaccccaucucuacuaaaaauacaaaaauuagccagccaugguggagggcaccuguaaucccagcuacuugggaggcugaggcaggagaaucacuugaacccgggagguggagacugcagugagccgagaucgugccacugcauuccagccugaaugacaagggcaaaacuccaucuuaaaaaaaaaaagaaggccgggcgcgguggcucacgccuguaaucccagcacuuugggaggcuaaggugggcagaucacgaggucaggagaucgagaccauccuggcuagugcggugaaaccccgucucugcuaaaaacauaaaagcauuagccgggcgugguggugggcgccuguaguauagucccagcuacuugggaggcugaggcaggagaauggcgugaacccgggagguggagcuugcagugagccgagaucacgccaccggacuccagccugggcaacagagcgagacuccgucucaaaaaaaaaaaaaaaaaaaaacucaaggacaaaauguuaaaaauguucuuucucuuaauaguuacuucuuaauaucaauaaugacuuaauaugcauacuuuuucuuuugagacagggucuuacucugucucucacucugucauucaggcuagagugcgauggcaugaucucgauucacugcagccucgaccuccugggcucaggugaucccuccugccucagccuccuauguagcugaaacuacaggcaugugauaccaugccugacuaaauuuuguuucuuuuuuguagagacaagaucuugcuguuguccaggcuggucucgaacuccugggcucagcaauccucuugccuuggccucucaaaagugcugggauuacagauguagucacggcauccagcagcauaccuuacuuuacaaagcacucuacagauccauuauuucacugguuucaagugcaagugaaaaaaguugcauaaagacuugcaucggccaggcacaguggcucaugccuguaauucuagcacuuugggaggccaagguaggcagauugcuuaagcuuaggggcucaagaccagccuuggcaacauagugagacccccguaucuaccaaaaaaaaaaaaaaaaauagaaaaaauuagcugugcguggugguguaugccuguggugccagcuacuugggaggcugaggugggaggaucacucgaccucagaaggucauggcugcagugagccaugaucgugccacugcacuccagccugggcgacagacugucucaaaaacaaaacaaagacuuaaacugcauuuauaguuuaaaaaaaaaaaagcaacaaucaaauuggaaugcuuuuuuuuauuucuauuuuauccugugccagaaacaagucaacagcacagaacccugaucugaacaaguaugauucaccacugaguaauaucaauaaaacuggauuuuguagugaaauaguuaccauacaaagacauucaacagccauaaugacuauuuucuaagacuauguauagcauuauaccacugaugccugggauaugaguuacaaaauuaaaauugccuaaagcgucacaugaaaaauuuaaccuaggucuggacuauguucuacuagccuaauaaauuggacagacacaguaggaaauucuagagaauaauguuucaccuuaaaauguucaggcaguagagagaaugcaaaauucugggagccuugcucaaguuacauuaaaaauucaucacaacagugaaggcucaugcauuuggugauuuaaaugaauuaaauuuaaaacuauauguaacucuagaugugcugccuccucacuggggagcuauccaacucugaaggauaaaaucagaauuaaauaucugugcacagaaguuagguccauccgaucuucacuuggggagcuucacaguugguuccaaagcagacaagacuccaacugggagauuuccacagcuguaccaugaauggucaucgaggacacgggcuucccaacagggcugauaccaacucaccaagguggguugugccugcugccuccaguuccucugcccuccaucaguccuucauccuugcaacugaauuuccacccucucuacucuacaggcauccaauucccauggcuaucacuaauaccauaauuacaaaacccaacaguucuucaggcuuuauuugccccaaguuucuccuucacauuugacaacuugguauuucuuucauucuuagaauuccucgucccagccuuaagacacuacuaucuagaaucucacccuuuugcagagucuuccucuucuuccugccccuacauaagagggcccuuccuaggaaacugaagacuggaaccaugcuuucacacuagguugaagaaaggcuuugacaaaagcauaugacuaagcugagggcacagacccuagggaacaggguagauguugaacucacuaugcucaaggcugagagaagaaccagaacacucuggagcaaaaagagccuugaaggucaucuccgucaccugcacuucagguaagaaugagcaaugcauuauaauauacagccuuucaaauuuuucaaagucaaaggugucuuucgugacagcaggccagcuguggcacuaguaucacucaggauacaucugguuuggaguaaaguuagaguucucaaagcaagaugaaaaggcuuaacugggaggagaaaaguauaaaguacauguuaaaugacuccuauaaaauuuuuaaaaauuacaaucuguaauagauuguguugguaaggaagaggaaucgauggauaauggcaaaguuguuaucuuaagaauggccaagugcaggccaggugcgguggcucacgccuguaaucccaacacuuugggaggccgaggcaggcagaacacgaggucaggagcucgagaccagacugaccaacacggugaaaucccaucucuacuaaaaauacaaaaauuagccaggcgcgguaccaccgcgccuguaauuccagcuacucaggaggcugagacaggauaaucgcuugaacccaggaggcggaggcugcagugagccuagaucccgccacugcacuccagccugggugacagagcgagacuccaucucaaaaaaaaaaacaaaagaauagccaagugaugcuaugugugagauggugaaggucgacuggaauuagaccucagcucugcugcauaugugccuaguaguuuaacguucuacaguuggguugaugauagagaggaagagagaagcuggaaauggauaccuaaaauuaaguuuuccauaaggaauuaacaguucauuucaauauucuuaauguaugcuuuaauguaagagaaugacuugguacucuggaagucaucaaaugucauuaacaaaagaacugggagacuugggcagaaggacugaugggggcaccagugugccucaaccagaaaugcuuucagaaagguuugcagcggggugggugugguuaucagaggaucacaaguggcuguuacaacuggucaaggcgcgaucaguggcaaagcaagccccauagaucugaaguaguaagacacugcaacaguuaguuuuuauaaaaguuaacaugccaugcauuuucuauaguuuccuuuuucacuuaaaauaacuuugaaacuuaucugacaguaaaaaauucuguuaagcucguuuggcauaauuucaaaucuuuuucugcaguuaaagucaccaagaacuaucuguaauccuggaggcaaauuauaaaaauaaaaccucucugguuuuagguagcucaugguauuaaaacacaacucuagguuuugcuuccaacagaaacaauggaaaaguuuuagauuuugcaguucugcagauugcaguauaaauuccugaaaugcuugcuucccaccaggggggcuguugcacagccucugcagcuguggaggcugcaggcuacccuaacucuuccaaaugucaggcugauaggagaauagcaaagauccaucggaagggaguccgagcuuuuaugcugucagaaaaaggcuuucagugguuuugacuggauaauuccacaucuuaagaaagggcuucccaaacaaacuucaccaaauucaagauaagaaagcauuaaguuuccuuaccuucuuuggagccucaaaaaguguuguggcaugaacaaaaugauuugggagaauaauuaaauauaaacaagaugcugaccuguucuacuucauaaucaauuucuagguuucuuucucacguuuuuuuaguagccugaaaaauguaccuaaaaucugaaaaccuuacauauaaauagugacgaggcaacuacaaaauaaagaaccuaauucaacuuauggacucagccccccguggcugaaaaaaccaaagugggagguguuguagaggaggugcauuuccaguaccuggcaacccugaaaacagaagagacagccacgcccucgagaauugcuuacucucagcuaagaagaaaaucauguuucccccuuuaaagcccaugacaaauuuuacaauacugcauccugaugaauuaacuacaacaucguuuuaaaauauuuucaaggaguaaaaauuugacauaaauaugaaacaagauacaaugaaaacacucaaaauucauucuucacauuugguuacagaaaugcccauaugaacaauggucaagccacaugacuaauuaaucaaaucaggcuacgauauauccacagagauaaauuuaaggaaaaucaagaggauauacauucagauuuuggcagguggcucccagugagagaguauugauaaggguaugauauuucuaucugauuguauuuucucagaugagcacuugguuacauuacacacaaaaaaaugaauacaugauuuuucauaaagaagacgccaacaaaaguaaaaacaaugagauaauugaaaauguuuuuauugguugagacaaaauauaacacuuuaaaauuuuguaaaauacgcaguuuuacaagugcuauuuggaaaaagccucuacuuuguacuuggccuagauggcaaaaaguacugcucaaguguuucucucuugucuacugccuacccauaaaacucaggaaaaccguucaggaaaaaaaccacaauccccaguaacaucaaacccacaauggacacacaguuauaaagacuuuaaagggauuaaaaauacaagagauaccauuaaauagccaaaaaugcuuagcauucaaauuacccuguuaaccuuuugguagacaucuuucaauuccaugcuacacaucaucacuucaaacaaaaaaaucaucuguuuccucuuuccaaacagccacauaccccauauucuuuuuccuguucaccgcacuugguucuuauacccaucauuauuuaaaucaaauaucuaauuuaaacaaucauguugaaugccugccaguauuaaccuaagggucgaugucuuggcaguuggcugugaucaucauucuuuaccucagccuuuauuuugcuucucuuaaaaaugcaaagacuaagcaacggcauuugaauaugccacauuuuagcagagguuuauaaaaacaagagcauuuacagagauacuaagcuaccuaaucacucggcccaccaugaaaugaggcacuuuuauuccagcacagguuuucagacucagcuccacugcugcugaucaaacagaucccacugcuguggaggaucucaacugugccccagccaccuccugccugcagcugugccucuaugagcacucacggaccgacacaucauccacauaaucgcaggggaggauguaaaguuccauccaccaagggagccagguaaagccgggaagccugaggagcgcgcgcuguggaccuggccuugcuaacaggcucuggcacugagaauggagccuuucagaagcacacaaucuuccuuggugcuggucuccaaggauuaucccacauuguccuugagcugaggcuuuucuauuuuuugccaauauagggguaaaguaaugaccacagggaacaaacugagccugggaggaaggcucacagaggacuagggcuugaaacaggaguccuuccuaggccagcguccaauggcugguggaaagggucucucaaccuaugcacucauuucaccugcucccagcagguuccugugucuccaagguuacucgugcucccugcaaagagcugacgcuaacugaggcgagacagugggcuaggcucuuguccccuuccccaguguggugguggcacucacaauaguagguccucaagguaaguuugguccacaaaaacagauacccauaaaagugaaauagcaugaaacacugcugcgcagcccuugggccaugauuugauuaacaagaaauaaucccauucgaggcagaugggaaccagcucugauauauacugguaauacugaucggauacuguugucaaagagaaguaaaugagguaaugcacaaaacgaaugccacacagugccuggcacagacucaauaaauggaaucgauuguaaggaguauccacagaugcuacuaaacaaauuacagaaagugcacgccuacaaaucuaaauugucggcauauguuccuucauaugaagacaauggcguucugcuuccacuaacaauuccuaauucauccauuuguuuuguucauuuguucuccgcugauucacaggaucccacccagauauuauuauaaaaauguacaaguccaaugaagacagaaguuagagagaauucugucacucacucacucauguccacaucaguauauacuaaugcucuaacaguguaagcugugaguguauuucauuuuuaaagucuguaaccuacugauuuuauugcuccuaacugucucugcuugaguuugaaaacugaacauacugguucacuguggugguucuuaaucuuucggagaggagacuucugaguaucaaguaacaccuaaggcccuucuccccagucacaaacggacguaaacacaacauuugguagacaacacugggggucagggacuccuguguuauuacaaaguuaagcugugaguuuguacaagcauuguguaucaacagaaggaauguaccugugcgacugcugaaaaagaacuccaacuccucagaaagcccagucaagaugcugcacagaucaucgggacauuucuucccggaaaacugguaucgucaaauuaauuagcaccuucuaagaaaacuguccuuucguccauuuguuuuuuuccugauuucacacccagaaagacuguaaaaaaaaauuugucauauacagcccugaaacugcucccacacaauuacuuucagggcugucugauaauuuaauaccuaagaaaauguuaagaaaaauucauucacauaaaauccucuuauaacugucaugagugcuuuggaccacauaaagguaagacgagcaaacagugagacguguuugcuucugcccaggcaaauggaacaaaucaaauuccaagaguuaccuaaugcaccaaccuaugucaccacagguguccucguuugguuaacagugaaacaagacagcuuuuaagagagaagcagguuucuugcacaugaagaauuccuuagugccacgauguagcuauuuaggugcagauccaaacaggcccuuuacucuuaacuaauuugaaacccacuuaauucacuccacgaugcaaaaggaaaauauauggauuuuaagagaacuuguuacacaagauggugaaacugcucauuuuuuuuuuuuuuuagaagugugccaaccggccagagaacggcaguuaccacagaauguauuuugcuggugcccaccauuacaaugggaugaaccaaagguuggugugccaggaauguuccuauaauguucucacuuaaugcucacagcaaccuuguaggguagguagcucauauucccauuuuauagacagaaaaauuaaggaccaaaacauggagaguaacccauccgaagucacaaugcaauuaacuggugcagcugguaugugaaucuggucucuuaauuccaaagcuauguucugguguaucacaauaaauucugcaugcugcacaucuccuaacacucaagguauagcugggucagcaacuuucccccucuccccuccagccaacauacacgcacacuccaggcucauuuuaaacaagcuauccauuuucaaaguacugaucaaucugcaucuaaugcaaaagcaacacugaagcccaagcaguauauucccacccacuaaaaaaaauuuuuaggcagguuuuuuuuuuaaugugcuuagcauagaaacugaagguagggggaagcacaagaaucauuugcuaugaaaacaaaguucaccaauuccauguacuuucugacaaucacccaugagauuuauaggauccugucuuuaaaacuuaaaagggucagacagaaauugaguaaguaucacuuuuucuugauuuaauauuuucugcacucuacuacaaccccaaauuuuaucuuggcauacaaacaguaauuuacauuaucuucuauccugaauuccuggauuuauaauaacuaaaaauagguauuaagcuuaccacucaaauuugaucuuaucaaacaagcccaugacccaccuaacaagggaaggacacuguggaucacaccuuuagcaauuaacaaaauuccuaaaaucaaguagauuuggaaucuuaaaccccugguccaaaaauccaagauugagaccacugacaacauaugauauuuauuauuauuauugauacuuuuuccuuauuuucuuggauaucaaagggaaauuauaauuucaacauuagugcuaauccuacaaaaauuacaguccaucguguguaaacagucaaggagauuguuccacauauaaaagaucaaaacuacaacuauuaucaucauggugcugcccacagcguaaaccugcuacagaagauuagaagacuugggacccagcuaugaccaacauuaacaucgucauggcaaaagcaccaagacaagagguggacaguaggaacucucauuucucacaggcccuuagacauucugcuuauggccaguaaucucuuuauuccagagaagcaggcucugauaaucccaaacaugaaagacaaaaauguagccaacagaaccagaaaggcauauccuacaucucaaacuggcaacagaaugaaaacugaaccugagaggccaaaugguaaaaagaauaacaaaaggcucagaaacugcauuguugcccauucuaaacggcauugcaacuucaaacauugcacauaauuccgucuugggguucuaaacaugggugaacaaaccaguuugccuucauuuuucuggcaugugguguuucaggaaaucuacaaaagacugccccaagagguagguuuauaaauacaagaaaaaagauuguuuaucgcuguaguuuucauuuaaaaaaaaaaaaaaaaaggguaggggaauuuuagccuaagcaaugcugaauuaguuuucuuuuuaaccggccaauccuuugcuacucuccauaacugguaacagacagcuaauucacuaagagugaaauuaguuuuucaucauucagacacugauuaaacuaacaagaacauauaaaauugaaagucaugaaaaguaucaaauuagcaguauuuuagauguuauauucuuaucuuauaaacuguuauuuuuauauaccacacacacaguaucauuaucuuauucauuagaauaaaucucuugccucugaaacuauucaaauagucuauuaaaaauaaaaaaugguauguacuuuuaauauauaagcaucuaaaauaacuacacguugacuagauuauuaaaacuuucaucaaaauauuuuuaaauuucaggaucauggccacagaagcaggaauagcaagcagcuacaauaaaugcuccagaacacugagaauuuucuagucucuuacccagaaucccuuaggauauuuucuuaauauacgcaccaaguuuuaaccuuuuaaacaaaguuaccuucuccuauuuuucagagaacagguuagaacagaaagaaaaaugcuaaagaccuuugaaaauugaaagcauagauuacaaacuguaguucugccuugccuacaguauguuugggugguuggggcggguguuaacuacuuacuuuuuuuuuuuuuuuuuuugagacaaagucucacucugcugcccaggcuggagugcaguggugcgaucucggcucacugcaaccuccgccucccaaguucaagcgauucuugugccucagccucccgaguagcuaguauuacaggcuccagccaccaccacgcccagcuaauuuuuguauuuuuaguagagacgggguuuuaccauguuguccaggcuguucucaaacuccugaccucaggcgauccacccaccucugccucucaaagugcugggauuacaggugugagccaccgcgccuggcuacgacuuacuaagucuuaacaaucaaauaaaguacucucaguaaaaguuccaaguagaaaaagccacauuacauuuggcuacaaacucaagcaguuuuaaaaauuuuauauagacauacauauucuaagaaucuauugugggauaaagacaaugaggaaaucaacgcgugccccuccuuaggaaaauucaagagcacacauggauagguuagggugacucuuuucaccuucuggucuucuuuaaugcuucuccucugguaugagucaagcagcuagaauaggaaagcuuuaucagcaaacaaaaccucuuaggaagguacugcuucaaauaguucaugugcauuccucuuaaaugaaaguuaaaaaaaaaaaaaaaaaaaaaagcuauccaccucugcaaauaaacauuuuggcaaaacaaauaaaaaacaaaaugucaccaccuaaagcugaaaagacuaacaagcaugauguaacucaauuauauccacaaacaaaucagaauugcacuuacaguuucuguaauuaaucuuuagacuacacauuaauuaaaaagcauguucauugucuauauaacauucagcuuaagaaaacuuuaaaauguguauuuuuauugguggaacaaccagacuguuaacccagucucaacacaagaccagugcugcagagcugacagcuaaagcuucucaucaauaagacaaaaugaaagagcucuauaauccuaaacucgauccucugcacugcagagggaguuaggcaaaagcaaugucuuacugugcucuuuugguuucaaaacuaaugccaaaauaauauaaaaccuaagagaaagaaaauauucauuagaaacuuaaaccaacaaauaugucauuuaaaaaacacuugaaagacaauagcuagaaagcaguaaaaaugcaaucuguguuuuuaaaaacuauuugggguguuugaaggaauacaauauaccuaugcaauccauaaaucuccaaagcaaaaacagcugaaggugucaccaugacuggucucuccuacaccaaacacuucacuuaaucauagucuugguauuuagaauuaaagugggcacuucuuacagugagcagugaaaauucaccuuggcuaguuaguaaagcaaauaaaacacugcaauuuauacaguauaacuguccuacuuagaaacaucaugcauaaaaacuggauuuagacagacagagccuuuuauuuaggaccugugugaacucggccaaagcacauaaccccucggagcaucaguuuccucuucuacaaaugaggauauggaucucaacuucgcaggauuauugggaggauuagcuaugguauacacagagcaaccaacauaaugcuagaaacgaguguaacugcugucauugucaccaucaacagaagugagcaauucauggcauaaugacaugaugugcaaauaagugucaagucaugacauauguccacaucaaaauacauuguaauaaaugaauucauccaagaacucuuguaauguaugaaaacugguuuaaucuggguggcaaaaagaaaaacagcuacuugcaguauuucucuuuuucacuuagagaauagcauuuucaaguaacuuuuguuucuccaugucauucagcuccucuaaacuauuucaaccaaauuaggaauauuaauaaaacacucugagccagauggauggucaaaauaaaacuucaggccuguacuuggcagcaugugaaauauaaacaagccaucugaaugccaacaaaguaccaugccagucuaccugaaacuucagcuucaguucaccauacaacauuuaacuaaaagaaaagucuauuuuuaaccuccacaaugguguucuugggauauuuauccaagcccucaauucuuuuuuuuuuuuuuuuugagaaggagucucgcucuguugcccaggcuggagugcuguggcgcaaucucggcucacuacaagcucugccucccggguucacgccauucuccugccucagccuccggaguagcugggacuacaggcgcccgccaccacgcccagcuaauuuuuuuguauuuuuuuuuuuuuuuuagaagagacaggguuucaccauguuagccaggauggucucgaucuccugaccuugugauccacccgccucagccucccaaagcgcugggauuacaggugugagccauugcgcccagccuccaauuccucaauucuuuagaggcaacuuuaaauacaaagcuacacccuguacaagccuguaauaccagcuauuagggaggcuaaggcagggagacagcuugagcucaggaguucgaguccaaccugggcaacacagaaagacccugucucuacaaaauaaauaaacuuuaaaaguuauuuuauugaaaaauaaaauaacuacacccuccucucuauaaugcucccacgaacauuagguuugaaugucguaacagcuaucuguaaacuggaacaugaaauugucuagggaaaaaaaaacacugaacgaguuuaaaaaaaaacaauaaaaauucaucauuuagaaaaauaaccuaguguucauauuuaaggaaaacacaggaaauuagguuuuuuacuuucaaauuauaaguggauuuguaaaaaucaacuaaaguauuuugaacuaacuauaaggaucuuguuaccucuuuuauauaguuuagaaaauuuaaucauaaucgaacuuuauuucuguauuaggcaagucuuaccuuccaauuuacauauggacaagagaaccaaaauaaccaccuaaaaauagggcacagcaugguucccaauacacucaauuaugauauuuaaaacuuuuuaaucauggcauauguuaggauuuuugcaaauccacccacuaaaauacagcuaaaaaauuugcaaaaugcuuugaaaaauuuacguuaauccacauaauuucccuguaaacaaggauagacauaagaaucaaaggcacaaaacgaaaauacugaccaacauuuucaucuaaauuuggagcaauucaguagcagcagcagaacugcaaauuuuuuauaauucccgaacuccuacuguugaaaaacuacuaauuaaaaccguacugagcuuuuaaaaacagaccgccaccauaacagcagcagaguucauccuggcaggcaaccaccagagacgggacauucaaugcucagcaaaggcacccucagcuaggaggcagccagaaagcuacagcagagacaggccccuccaagacugaccaacccagaaacagcucauuugugucucaugccacaagcuugccagcaaaaagccagacacaggaauacugccauguccaagcacuccacauccugcuccagcaccugcaaacaggaaccacaggccagugcccuauaagucagugggcacaggaccugcccaccaggcacccaguaggcauagggcccaucuaccaucauccucagacaccacagccaggccucugucauucagcuuagagccugaaacagagcugcuggcugcuacgaaagguuaggagaucaaacuccacggaagcccguccacucucugcuuuuauuaaauguauucucuaaguucaacuuuaaauggaaccaaugcugucacuucuguuguugucaacugcauguaggaguggacaaaaagcuccacauuauguagaagaaaaggcaugggaaaacugguucaaauucugacugugacacucauugguagggugaucuuggacaaguuauccaauuuuggaaaguguccuuuuccuucucucccacaucaaccagaacacccacuaagucugaccugugcguggcugucaugaaacggacuggagacuccgcacuggaggaggaugcugccugcuguagucaucucucucaucucccccaccaaccaacccagccacuuggugcagcgccuggcagaaaaagggccaauauauguccauuugcagaacugaguuucauaauccaaaaauacucauguagguuucuacaugaguagaacugcuaauagaacuaggucccucuuccuggagaccucagccccuagaacuuccugugucacuuaugucacaaccucagaauggucaccccugaucucccaccuacagucaggccauaccuccuccacccacccugcaaaacacuacugacaugacaagguuuaccuacuucaucuguuggccuguacuccccacucuccagaaugugauuccaugugaacagggacccuugucauuuuaguucuuugcugaaacuccagcacccagaauagugccugacacagaugcaaggaauacuuguuaaguaacagaagggaagaccauccacacagucacaacuucucaguccccaagguuccucuugauguccuccuccuuccucucucucuucugaaacauccccauccugccacucuuucuacauaaaggcucccuagccagcccagcccagcucagcaucccuuuuuccuucucuuagggagggucaauaguccuuacugccuauaccauccguguugcacuuuuuuuagacuaccuuagacugaguuaucuuugcauguggcugucuuaccucccuauauuuuaaguuucuaaaggcuuguuauuucgcaccuuuagagaagaauuucaaauauguacaauuucaaaaaacuugagugucgucacaguaccaagguuuuuaauuuaaacaauucugaucguagagacagauaaaauauuacuuugcuaagcugauuauaauuuaacuguucuguggugacuaagagucgcugagauaaauacuuauaagcuauagcugauauucucaggcacuacugacgguuuuuaggaaggacuaucugaaccuacuaacugaccuuaaggaacuuguucuuuauaauucauuaccgauuuuguaauaaacuuucugucuucuucacuauccagcuuucagguauaaaaacuucuugccgcuauaaacucuucucucuuaauuugcugugaacagcgaggucaauagguuagaaccuaaaauaagggugaaucagcacagaaugaggcugugacguaggagggaagagggaaagaagagacccagugcuuauuuugggcuuacacaggugcuccauaaauccccauugauuaaaugagucaccaacucaguaguuccuccgcaaguagcagggaaguaaacgccagccauguucuaaggagugguacuuacaguucccaagagcccacagcuucacagagcauguuucuauuaucucacuugcucuugacaacuuugugagguuagguggcacaagcaucaucgauaugaugauauucauuuuuaaggcuagggaaacuucaucucagaaaggugacaugagcuguccaagaucgcacaccugguaaacgcccaggcaucccgucuuuuucauuccuuccacuaagcccauuuguagaaagccacuguuguuucuccagguaaaagaacuucagguuaaggcucuuauguaacugagagagcagggaaaacacucugcuauuauaaucuacacucuggaagagcauuugccaacagucauugcuuacugcuaacaagcaaauucaauuucucauuucucaccaaaacaaacaggggacagaaaucaagaagaugagaaauacuucuaaauuugaccguuucuaugcuauuuuauaauuauaauuuuucugugguucacauuaaaauagccugaaacaccugacacuaaaaacccuccuugcucucuaccugaaagauuaaucuauuccaucuaaggaacuuauuuuccauuuuacagaggcugcucagauauguaaaaagugaagcucaauuacaaaucugggaauccaaauuaaaguccaguuuaaaaugcugauguauauccaucuuuggcccauggcaaaaaugcacgcuccaaggucgcagacaauaugaacuguguucucauagcacugcauucuuuuccuuccuaacacauuugugugagucauugccaaucaaugaauauuuauugagggccuacuacaugccaacugucuaggcacugaucagcuauuuacugauuuaacguuugucggcgccauaagaagagucgccgcugcuuuuuugcucaucacugugugcuacaacccagcagagugccuaguacacagcaggggcucaauaaacauuagaugaaugaaugaauauggggaggggaggggaggggaggagagaagaaaggugaugaggggagagagaaggggccacuacuuuguauauaaagaaaucagggcuuugcucuacccaaacacgccuuaugauccaccagcgaucugaugaauucugaaaggcaccacaugcaaugcacagcuguaaguauagcagcugucacgcaaaggagcugagguccagaacuaugaagaauucagcccuuuguuuuucucucugucucauaacgaaaaugaagucaagcccacugucaaucuaccugucggcucuauguauucaacaugcggcuuucagcaauacuaaguuaacacugccucugaaugacauuuauguugauucacucucugacaucacugccugaaaagauauuauuuaaauguuugaggucacacauaagaccuaaacagaacugaguuaauuaaaaaaaaaaaaaaagacuccauuucaggucuuugcaagcuauaaauugguuuuaacugaguauuuaauuuaaaaguaaaaaagguuugacucauuacuuaaacucuccaaaguuuaagucuuaaagagcaaauaggucucuuuaaccaguaagcuguuaaaaacagacuguaaguuccaacagagagcucugcauaaacauaagucuuuuaauuaauuaaaaccuaggauucuggguuauaggcugcccagaguaguacaaaauaauaggauaauaagaaauaugaacuauuuaauacgaaacaccaacagucuacgcagguauaaaaaugcagcuauuaaguucauauaucacuaauaaaacaaaaaguauauguucaaguuuuuccccaaauccaaccaagagaaaaauaaacagauaaacaaaaaagcaaaagaguaaugacauauguucuaaacaugcacacuaaaguaugccaaacagagaaaagcguuaaaguaagguugcuauuaaacuacaaaucuauuuaaguacaggaguuaguuaugauuaguggcacaguaaagaggguacuguccuccccaucuccagcccccuacaaauaacuuacccggaaggcugguaacauuaguuauaaacaaaaugaauacuaaauaaagaaacaaguugaauuacauaaaaaguuuucacuacaaacaguuaagcacuaagccuaauagcaauaaaaucccagaacucaguuaaaaguuaaaaaaaaaaaaaacugggaauuuucuagacucugaucgucugauucaggaucaaaagcauuuaaugcucugaagcagugacuacaucacauucaauaaauagacaaugcauauucaguaauaggccuacuaacuguuucacgggggaauuaauucuauuuccauuuuguggugacauacaaagaauacauacuugaaaaaucagaacagacuucuugccuacauuccuuaaugccgauuuuaacauuuucccaaaucgaguuuacgauaugauuuuauuuacaguaugacuuccacaacucacuuugcaauguucuggauaaaggauggacucguucguucagaugacuaaaaagaaaucuacuuaagaccuaaggagagcaaaaaaaaaacaaaaaaacaaaaaaacaaaaaacacaaaccuguauuuguaucaauaagaaacuaaccauacugugccuuggcauauuuucaaacugggaucuaugaacuauuccccaauucacauuaaaauucuucauuaaaaaaaaaagccccaacgugucaguaugcccacuggaaauaugauacagccaaccaaacuauuuuccuacccagaaauuauccccucccuuuuuaagugugacuacacuuuaccuuuuguucgaaaucaucagaagucguaaaacuaugagaauugagucaaaacgacaaaacaacacgcucucuaacuuccacaucccccugggcauccuuucggaagcccaccgcacccgcagucucccugcccuccccgccgccuccugucucugucucucacugucucugccucccccacucccacaccccgacuccgcgaccgacgcggcccgcguccugcgcggcgggcccgagucugcggagccggggcugucaagcuagccgcgagaaagcucgggcgcccgccgugcgcgcggcugcggagcgcggcuuggggugccagcgggggaacguccggccccggaacgccguccgcgcacuuucugccgcccaggagcuaagucacaaguuaagaaacagcccgagcgcgcggcggccgugauucagcagcggggccgggucggcagggcgggagggcagcgaucgcagggcccgagcgggaccgcagggcgggagcggggccggggcagggccgaguccggaaaaggucaccgagaugccgcgggcgccgccgcccgagcccgcgacccgccucgcggucgggccagcagcagcgagggcggcagggcggcguccugggcgggcguggcgccggggccgggcgggcgggccggggggcuccuaccuuuccggcucuugggggagcuccgcuugcuccgggcgcuggcucgcucuuccucaaucgcagcugcuaucucaggguugucuuccccauuguaccagaccaggagcuccucgcccggcgcgauuggcugcggggagagaagagacaagcgccgggccaaucagagcggcgguuguuggcgggggcggggcgcgcaccgggacgcgggcgggagcggcgccgauggcaaacagcugucggcggcgccgcgcgcacccggccggcaggaagggcucccggccccgugcgggccgcgccggcgcccggaacccucugcuggagggaggaccgcacccgcggcguggggcgaggggcgcggaaggcccggugacggguagcggagcccgggugcugucccaguuuccuguuuaaagccucacgacggcccacgcacgagaaaaaauaaaacaugggcccauuuugcucacgaaaucuaagucgaggagaaauguaaagcauaacugaaaagcgugcgguguggaaagcggagugcugaaagacaacgacuagcgcgcguuccagaccaagagcaacuucaacaggacaacgaggaggaaccacgcgcaagcacuuacaaaugcgccgcgguuucuaucccagagccgccaacgggaggccgcccggggccaccaaccugcucugguccagggagguccgugccucgcccuucggaccggacaucaaacuuccacauuuuaacuuuuaaauacagcaggaaguaucucccauguauuaugcuccuaaaccaucacauucuuaagccacguaugacuggaaguagugagggccaccaucaaauugauuccacccagaacaagaucccgaagaaaagauccacugagugcaaaguucacaccccuagaauuuggggaaacagccuauugguuucucucacaacaaaugaucuguuaaaaaaguuacaaggguaucaauacaaguaaaauucuaucuaaaacccacugaauaaaaugagaauccgugaguccagccucaugugaaugaaugaagaaaggaaggaaugaacaaguaaauaaaaaggaaagcucuuccuuaaaggagaucccaacuaaucaguaaaaaagaaauguuggaauuagaaaagcgccauuuggcaaucaucacaguaaugauuaauucaggcaagaaucauaaauggaugcuaaaaguagguaaaaguuugaggaguaacaaaacacauagccucagaauaucuccccauaaaauauuuauuaauuacaaaagaaaaaaaacaacacuuuuguaauaagacauaccaacaucauaugucuccugauacgaugcacagaaaacagagcaucacuucugguagauuucugcccaaaaugcauacgucgaaucuaaucaugaugaaaccauaagagaagcucaaacucugggacauucuacaaaauaaccaaccaguucucaaaacugaaagguuauaaaagacaaagacuaagguaccagccaaacacauaagacauaacaacugaauguggaaacguuuucuuuuccuacaaagacaugauuggaacaauugacagaaccugaguaagguguacauauuagcuaguaaaauaauguguugcuguuagcuuccugauuuggaucauugcacaaugguuauccaagagagugauccuuuuuguuuuuuguuucuuuuuuuuuuuuuuuuuuuugcggggagggagauuccaccuacgguuuagaaacaaaauaguuccucacuucaacauaccuucuagucuagauaaagcccccaaaagugaauauuacuucguuuaauucucugcagaacucucacugucuacacaguccaaauuuaaaaauauucuaaauucuuuaaauuaaaacaaggcagcuguuuccuuggcucucacccaccccuaagaaggcuaaaaucugccuuuuucuuauuuuugaaccaauacaugauuucccuucuugaaccaguuaaaucuaaccaaaaaacuuacuuuaauauauauuaauaaauuaaaacagccaucaagaacgccuuuuggcauucugaugaacuaaucuguugaaagaacaggcuuauguuaaaguaaacuguuucuagauuguguaaauuccaaauguauacuuucucuauuuuuuuguuauaagucacauauugaagugguaucaacuaauauuugaaaugacuagaguucucagaaauaugaaaagucuucaaaccaaugcaaaaaagagcaugggaaggagugaagacaaauguauuccccauauauucccccacugaaaugguauaaccagagaacuggcuagaagauaccaccggacauuuucaagauaccucuaagaauaagagcuuaaguuucccuguucacuccacugcaguugucagugaagugcuaacugaacuagcaacuuggugaaguuaaauauccacacaaacucuacuugggagggcacucauguccuaagauauucuuguugcugcaaaacacacaaaguaaaaacacaccagaaucuguaucacaaaucaaauauaaaauuucuagcacuggugaaguguuagaucaagaggaacacauucguuagcugcuaaacagccuucaaaauuauuagcgggcauaguggcucauggcugcaaucccagaacuuugggaggccaaggcaggcgaaucgcuugagcgcaggaguuugagaccagccugggcaacauggcgaaacucugucucuacugaaaauacaaaaauuagcaaggcaugguggugugugccuguagucacagcuauucaggaggcucaaguaggagaaucacuggagcuugggagguggaggcugcagugagccaagauugugucacugcacuccagcccacaagacagagugagacccuaucuuaaaaaauaaauaaauaaauaaauaaauaaauaaauaaauaaauaaaaacaaguaguagaaaacaaaacaaaaauuauuagcaacuugaaaugguuauauuacggagcgauauaugcuucgcaacuuuauauuaaaacagcuacaccaauagacccuaugaagaggaaaaauaauaguauuuuuuuuaaaccaaggcuuguuuucuuccauauuauaauauauugguuuuuuucuucuguacugguuagcauuuuuaagucaaguucagaagaaaagaaaaacuacucccuucaacaaaggaaauauaaauccacauuaaaaaaauaaagucaaaagaccaaacaaccucuuuuuaaauauauuuuaauauuaaaaaaauuaacaacaacaaagauuuuaaacucuucccacuuucucuuuggguucaaacagguauaaaaccaagaaucugcuccauauucucuccuuuaaacaucagcauauauaaaauaaaacuugaaauuuuaccaaacaaaucaggaagaagcaagaguucuaauauuccuuauacuggguaaggaauauuagaaaaaugugucagaaauauuagaaaauuagagaaguauuccagaaucacucaaacacacacaguacauccacucauacccaccuacgauccaguccccagcacggucuuuuaaaaaaucauaggucagaucucggccucaacucgccagugggugaacagcacuuaagccuaaaacucauccaucccugcagaccucaacagccucaucuccuaagauuccucuccuccucccuacagccacaugggcuuuuguucuauuccuuuaaaauaaaaaacaaacaaaaggcugggcacgguggcucacgccuguaaaucccagcauuuugggaggccgaggugggcagaucacgaggucaggaguucgagaccaccugaccaauauggugaaaccccgucucuacuaaaaauacaaaauuuagcugggcaugguggcaugcgcccauagucccagcuacucaagaggcuggggcagaagaaucgcuugaaccugggaggcggagguugcaaugagccaagaucacgccauugcacuccagccugggcgacagagcacaacucugucucaaaaaaaaaaaaaaaaaccauuagcuuauuccuacuccaaggucuuugcuccuaccacuccucuuccuggacuguucuuccagcagaccuuuugcauggccagcuccuuccuauccaaggagugggguucgaacgucuguccucaggaaggccuucccugacucacuggagacaaagcagcccucuccuaccuagcuagucucuaucacauuucccugucuuaacacacugaucgcuaccagaaauuacuuucuuauuuacuuauuaucugccucuuccccuauaacacgaaacauccuccagaccagagaccuugucuguccuguucacuacuauaggagaguacuugguauacaguagacucucaauagauauucaccaaacuaaugaacagagaaaugaauagauagcagauuuaacagcuaacuuucaggaauuuuaaaucauuucuaaucauauuacaaacaaaaccaguguugagauuucccaauuaucuggguauaauaauaaguugagaagauacagagcccacagagcagcacauguaauuucuucacaaagccuaacccacgggacacuuaaucuagaagaauagaguuagauaaucacuaguaaaaaaucugaaaggcuuuguacauacuugagcagauaucaaagauaaagacugggggaggucugcaaaaaucagaacuauguuauuucggacaaagguaaaaauaauaguacuaguauagcuaguuaacacuugaggacuuacacugaacuaagaacuguucacagaaccuuauauauauauauauauuggcuuguuuaaccuucacaacaaacuaugaagcaguuuuauuauuaccuccacuuuauggaugagaaaacuaagacacagagagauccuuugcguggucacauaucuagaagccaaaauuugcucacaagucagucugcuccagaguccccacuccugaccaugacaccauaccaccuugugaaaaauaacaacaaucauguauaagcacuuacuaggugcuggagcucuauccguauucacccaugcaaucaucacaacaauccuaugaggucaauaccauaauuaccuguaucuuacaaugugggaauugaggcacacagaaggacuuagcuaagguuacaaagcuaauaaggucacaccuacuugccuugggucacagcaagucaagaucuaacccaggcagucuggcuucagaguucacucuccuaaccacuauucuaucuugauucucaguguuucugugaauuugcaucagagaugaacacauuuuaacuugaaguacaaugaaggaauugcaguguccuaauaucuacaugagcuugcaugccuccaaaacuuccuuccuauuaccuugauugucucauauucauccccuagcuaguauuucaucuccaccaggauucaaccucacugauucaaccauauguauuucuccuuuaaauacuucugagaaacaaugcauucuugaauccaacuucacacuccuauauaagaaaauuguagaguaauaccuacuagaaaagcaugcuacuacgauccagcagaauaaaaauggaaaacaagguuuuuaaaguccuaaauaagaaaguguaacaaaaaaucugcagggacuggauacaaggaccuggguauaaaugugauaaaaggcagucuaguuggcuaacaaugucaggaaagaugcagcaaaauuaaacagcuacagguuaacuaaacuucagaaggccuacugccacuacacuaacaaaacacagcacacugcaaagcuggccacaauuugaaaugugugcucaucaaaaguguucaacuccauggagaucauuuuuuccauagacuauucuccaaccuaugacauuuuuaauggaaguaagugaauaaagagaaacuugccuuauagcaauuuugcuaucuauugcaaaaagcaacaaccauccaucuuaacaggcuggaaauucugccuuagaauaucuccauguauaaugugaggaucugucuuuuuuuuuuuuuuuuuuuuuuuuuuugagacagagucuugcucuguuacccaggcuggagugcaguggugugaucuuggcucacugcaaacccucccucccagguucacgcccuucuccugccucagccucccgaguagcugggacuacaggugcccgccaccaugccuggcuuauuuuuuguauuuuuuaguagagacgggguuucaccauguuagccaggauggucucaaucuccugaccucaugauccgcccgccuuggccucccaaagcgcugggauuacaggcgugagccacugcgcccguccggaucugucuucuuaaagaaugugacccaugaaaaugagggagauauggccuuugcucaacaaagaaaugcagcaacacuccacgcuuccucacacucaugucccugaaugugcuccauaaccucauuaccaauccuaaaacaugacuuucuucuucuuuucaacaauuaauaucuccaaagaaaaauuuggcagaaaggaagaaacauguucuguucaauuuguauucugaguaaaauuuagggaaaagaaaagcuaauccaaggcugcauuaauaucagagacuaacaguguguauucaguuaacacagacccaccauaccuacugauaguuucuuacaguaggauaaaucugccagacaguuccuaaugccucugugucauaggagaagggaagcagcugccacaugcuuaacucaucaguaucuuucaagaugcaguguguaauuacuuaacacgaucuucaugcuuuagcuccaugacacacacagguaaccauauauuaaaacacagaaccuuaagaguguggauaaagcacuucccaauauaaucccucccaggucugcaaagucauugucagucacaacuaaggacagcauuagaaaaauauaagcaggcccaggcauuguggcuugugccgguaaucccagcacuuugggaggcugaggcagguagaucgcuugagcccagcaguuugagaccagccuggguaacauagcaaagcucugucucuacaaaaaauucaaaacucagccgggugugguggcaugugcccauaguccuggcuacucgggagguugagguccgaggaucgcccaaggcuggggaggcuuaggcugcagugagccgugauggagccccugcacuccagccugagagacagaaugagaccgucucaaaaaaagaaaaaggaaaacacaagcagcguaacuaacaguaaauuaauucuaaugcuguuaccuuuaaaguuuuauaguaaauggcucuguugauuuccagugggaauaaauuuugcucuucuccugagcaagcccaauucacauaucgcagccaguuucccuucucuggaucaguggcaucaaugcacauccaucccaaauuuggguaauacaccuugaaaauggagaaaaguaaaaaacuuuuguuaaaauaggaguaucuuuaaaaugccuccauuuuuaacuuuuaaggauaauucuuuuucauuauaugcaaguacucuauauaaagcauuucauaaaaacaaaacaagcgacagagaaaagaaaaauacaaggugaaaacugaaauucgaaacuguaauucucauuauuuuucuauuuagguuuguuugccccgcgccccccaccccuacacacacacacacacacacacacacacacacacacacacacacaaacuuaaagagcuauagucagcaugcuugggaucuccaaaugcuuuacaaauacguacacagagacaaaugacaacuaugcucuguaaagugugacuuagaaaggaaaacagcuugcagugguauucagcagcacccaaaucccaagcuuucuggguugcucugcuaaucgaguauggcaccuggcccugcagggcuauacaauucagcaggucccuuucuggcagagguggcagggacuucaggagugaacacgcauugugaaccaggcacaugggugacaggauaugaugcuucugcaaacucaacugacccuuaaaacauacuccauccagagcaucugcaaggaugaaggggugauggaauagacucugggaaauaucaguggccuucaaaaagaaaaggaccaaaaccucaaccccuuccaggagucaaaucaaaucuccucuugcaagaagccuucccuucucacccacaccaauuccucccacagaugcuuccagcacuuauuuaucauccuucauuuuaaaagaacaucuauuuggcaacuauuuuuaacuuuaauuuuguauauacaugcauacauauacacauuuucccaaaaccagucuacaaaacacucgaguaggcacugaaacagaacugcagaaucaacuggcugacagacgugcugggcaaaagaaaugagucuuuuacuuuauuuuuaggaagaaaggauauaaucuagauguuuccauuucuuucucauuauucccaccacucaugccuucuucccucccguacccacauuaaucaccuuucuuuacugcaacuuuccuucuggaacaaagcucccacuccccccgcugauggugaggaugcugcucuucugggcaugccugggugucuaggccugugauugccaaggggcagcauccaccuuaccgggcccuaacacugccuucuuccucuugaaagucaaacaucaggcauaaugcuacaugccugacauauuaucucauuuaacccuauguagcaggcuuauuagcucuccuuucaacaugugaaaauugaggcucaaaaguuaaauaacuuucccaaagucaccuguuuaauugucauaaagaaaggcuucgacucagaucuccuugucuucuguguaucacugccuuccuugaccauccuaguuaacugaacuaccaacaucuaaugagcaccuacugcguaacagguaccaugcuagaaggugcacuguaguuacuuuaaucaucauaggcaccaaggagaguaucuguacacaguaacuuacauuauuaccccaucugcaacauaaacugccccugggcucagggauaauaaguuucauuuuaauuuacugcagugauggcaaagucccacucacuccccacccaaauacuggcacagcuacugagacugaugagacuacggagacaaacacagagauaguugccaagaaaaccacacaguucacaagguagcuggagucuaucuaccugccucaggauaaaaauauagguugugccacaacuuccuggcucucaggucaauacagccauuugcaaaaagcaaaguguuacaguugaguacaauuuuuauucauacauaacucauuuuguuucaaaggagacuaaggcaucuucuaagucauacugacugauguacaaaaagagaauacuugcuuuuguagaaaaagaugacacuucaauuuuuaaaaauaggccaagaaguaauucacaaacgaauacacguagccaaaaccucauaauacuaaacuuaguuaauaaaaaauaacuugaaagcaaaacaauuuuaaccuuuuaaaugggcacacaaaaaaaauuucuuaaagauaggaaagggugugaaaaaacagauauucccccaaacaccucugaacagaaaacaaauugauuuugugaagaauuuagcaguaccugaccaaaaauauauauauauauuuaaaauauacacagacuaaccagcacauacacuuguaggaauucauucuaaugagaucauuggacaauuguacccagauguauauacaaaaauguucacagaagugugguuuacuguaaauugcuuccaauucauggcuaaauggaaaacaauauggaauuaacucaguaaauuaugguccauccauauagcugaaaccuuagacacuaaaaaguacuguggugcaaaugauuaauuagauuauauggcacgauuuauuuccuguuagauauaccuauauacuugaaaauuuuuuccaauaaacaugcauuauuucuguaauuagaagacagcaaagauaaccagauguuguggaaauacauugaucagcauaaaggcauucacaauacguugaugauugaauaaagcauuuauaggccaggcacggugguucacgccuguaaucccagcacucugggaggccgagacgggaggaaucaugaggucaggagauugagaccauccuggcuaacacggugaaaccccaucucuacuaaaaauacaaaaaaauuagccgggcgugguggcgggugccagaagucccagcuacuggggaggcugaggcaggagaauggcgugaacacgggaggcagagcuugcagugagccaagaucgcgucacugcacuccagccugggcgacagagcaagacucugucucagaaaaaaaaaaggaauaaagaaaaaaaagauaaucucaauuugguaaaaaaguguuucaaugaaagccuuuuuuuuuuuaaauaaaggauuuuauugacauugcuaccgagaaaauacuauaccuucuugguauguucaaauuccaguuguguuucaguuacagaauuagauaccugaaggguuuguugaagauuauaaaacugacauccuacagaauuaaauuucuggugacuacagacaaaaacgggucuucaguaucaacuacuucacuccucagauuacuuuaggagaucagagacuucuuuuaagaacuauucuaauacaucacuguauucuaaaauguucugaaaauucuagaauaaggaaauaaaagagaaucuaacaggugauagcacauuuuauuucaauaagcccacuugucagaggacauuucccaaaacauagguuacuuuuauagagauacuaaaauacaaguuuaaaaaauaaauagcuuggccucucgagcccuugaagccgcacuaacagacccucucuuaaaauuagacuaacuagauuuuauacuacaacuacacaaauguuucuggaaaaucucccagcaacaaaugcacaacaaauguugacugguucacaguagacccccagugaacggccacuggacaaauaauuuauuuucacucuuaaaucagaaauucuaucuaugaaccacagauguuuaagaaucccauauaaccguauaaguaacaugcaaaauuuugugcacauaugugcauuuguguacuuucgggggagauucucaaaaggguccacaacacaaaaaaaguguaagagucucugggcuuugcuaacaggaagaagacugaauaagcaaccaagaaaugggcuccuggccugauuccaggacuaauauucuaacaauauuauuuuuaaaaaggcccuuauuuaaaaaaggcuuucacugaaacacuuuuuuaccaaagugagaucaucuuuuuuuuucuuuauuccuacuuuuaaaugaggguaaguuccuaacagauuuguuaggaacuucaugaagccacauagaacucagauuucuugccuguggaaagaucuaggucacuucuaguauaucuuuauuccacaaauaaaaauuuccaugagguauuaccaguaguuuauaacaccacaaacauuuuaugccaagcaugguguucaagaacuuaagacagugccugguaugugcuaaaagcuuaauagggguuaaaugaaugaauaaauaaacucccaaagagaguuuuuuuuuuuacaccagaccaagcugccaaucugaguacaaguaaaccuguucaaaaagaucacuuaauucucuguacuucaauguccuugucuguccuacaguuccugagagaagaggaauguaauuggcucaucuguuucuaugacaaccaauucuacagccaucccacaccuuuaauuacuucauucaaaaccuaugcacugcuauuaaccacucagcuucucagcaaaccugaaaccagacaucaccacauucacuccuacugcuacucuucccuacacaucaagaccagggcucagcaaacuuucuguaaagggccacacacaaauauuugcaguuuugcaggccauauggucuccaucaccacugcucaacucugugauuauggggcaaaagaagccauagauaauauuuaaaugaaugaccagagcuguguuccaguaaaacuuuacucaugaacugaaauucgaauuucauauaauuugcauaugucacaaaacauuuuuauuuuuccaacccuuuaaaaauguaaaaaccauucuuagcuccagcgcuguaauaaacagguggcagguuggauuucccuggugaucuaaaccuuucccuacugcuagaaagcagcacugagagcugaaaaguacuuucugagaaaagguucugcagaaucagcugguugacuucucuucuugccugcaauuuuaacuuacaaauaauuugaaaucagaagaacugagauagcgaagacuauaaaacucaccuguuaauauuuaaucauagcagcgcugacugauaaaaaaguuuauauaucuuuuaaaaauuacauuaaagucuucucauuauacagagacaauuucucuaucaauuuuaacugacaugcaauucuacuucuucccucuauucuccugaccucaaaauuuguugccugaaugaauaaaauguaaauauuaauagaagcagugaccacugguuuuccucuacaaaaauagauauuuuuaacaauuuaauauuaaaaagauuaacaauacuggauuuuaaaaggcuggcaagaaacauauacucuuggugguuguauaaauaauuaauaguacaguccuucuggagagaaaauguuuggcaaaauuuauaaaaaguuaaaauguauauaacuuuuugacaacauuuauacuucuagaaauucaucuuaaggaaauaaucagacaagucaacacauauuuauauacaaugaguuuuauacuuugaaaaauuauuuauaaucauaaaaacauuaaaacaauuuaaauguccaacauaaggcuuaguuaaauaaaucaugaaugguauacaaugaaauuguggguaggcauaggaauaaugauguaaauaagccaggugcaguggcucgcaccuguaaccccagcacuuuggaaggcugagacgggcagaucgcuugagcccaugagccccugaguucaagaccagccugggcaacauggugaaaccccaucucuaccaaaaauacaaaaauuagcuggacauaguggcauaguggcacaggccugucccagcuacucgggaggcugaggcaggaagaucacuugggcccaggaggcagaggaugagcugugaacaugccacugcauuucagccugggugacagagcaagaccuugucucaaaaaaaaaaaaaaaaagaaaagaaacaaacaauaacguaaauaaguaguagacauagauauguccacaagauacugaaagaaaaaaaaagcauuaaaaacugcaugugcuguuugaucucaauugaaucaauuucuacauauagguuguaaauguaccaguguaugugugaggcugaaaauagagaagcagcuaagcagggaguuaaaagaauguucaggaagauguucacagugguugcgccuggaugauaggaguuucaaugauuuuuauguucuuguauauauuuuucuguguuguuucuauuauguugcagugagcauguauuaauuuuaaauuuuaaaagcuuuauuagaacauauaacagaaacagugaccgcuaauguaaacuauggacuuuggguaauaaugauaugucagugcagguucaugggcugaccaaugccccgcucugcuguaggauguugauaauggggaaggcagugcauguguggggacagcgaguauuugggaacuaucuguacugucugcucaauuuugccaugaaccuaaaacugcuccaaaaacaacuaaguguauuugaaagaaaaagaagaaaagaaaaaaaaagcuuacuaaaauaauucuuacccaagcaauucuaaaguucuguuaauuagaagcaauuugaaucccauaaaaguacaucuaaaaggcuuuuaucagaggugguuuuaaaauauggcagauuacucagugcggauggggagagucaagagaacgaaaacaccaagucccgagcgccagcuagcuagcggcucccugccagaaacucaucgaagaacgcucucuucuugugagaaccuauuuugugcauucacccugaggauacucuacuguuucucuccuguuauuucugauuuaacagaauguuuucagugaaagcuuagaggacuuaagacuggguuagauaaucaagggcucaaggagagcaauuuaacacuuugucuuagauuagcuuuaaaauggaauucuggcuggggucuaagacccugcugcuaaaagauaagcuggucuuaggggcuuugauggaagaacaaaugccaagaugagauucugaugauaagccauuucuguuacauuaauacaaggcauucugaugcaggucugaggguaagagcagaguuggaauaaguuaguaggaaacuacuaagucuuaccucaaugucauuuucuucuaagaaauauuuacauuauaauugauacuuccuuugccauauacauacuuacacauguaugucauaucuauucacuuuuauuuuaacagagcaaaaggcuuacagguuucuauaucagauguauauuuuguagucagaacuacuugaaugagauuuuuuuuaauugcaggaagacaaaaggcacccuugauaagaacuaggauucuuaucaaagauuugcaaacucuaguaguacaguauauaagaaguaucuuacauuaacaaugggauguuaacagguuuauagaagaaauucuaauaagucaugguuccaaauuuucaacaacuaucaagucauacuauguaugaaucucaaugcaaaugaagcuuaauguacaaaaagcacuauuaauaaauuauacaauaugcccaacaacaucaaguuguuacaugggauaaaauagguacuacuaacuuaaguuuaauauugauggcauuuguucaagauuaguguuauaaacacagcacuagagaaagcaguuucugguuccuugacauuauucucacuaaacguaguguuaaaccuggugagccaauuuguuaguuucccuugggaaacaucuaaaauuaaaaaugcaguuuauuugggagcauaauuuuguggucaagacauuuuuaaucaugcaggcauuaucuuuaguaauucacauuuuuuggccgggcaguuuuucuacaaauacagaacucuuacaccucaaaaguggugaaauaacagaaugcaaugacucuugugguaaauccucauuuccuaagacaccccccguuaauagucagaagauacauuauaacaaauucauaagaaacaaauaacucaaaauuauugggagaaacugucagauuuuucaaguugggaaacagcuuagagcauaaagaaaaauagcagcauacuucaaccauacaaaugccacagaacuucuugaugaaaaguguccacacacuuccuagccauacuuuauuuuuaggcuuuucuauguuaaugugugaaaaaacagaugugauucaguuucagacaaucugacaggaaugcuuuuucucaucauccaaaaacuuaacuuguuuugaaaaggagucacaccauggagcuccuuuaagaacucaggggggcuuccagggggcacugacuugaacuaaauucaucacaaaugcugaauuccuacgcaauaccccagggaacaacaaaagcaacaacgacaaauuuuaucuucacaacuauccuaggagauaucuucuaucucuauuuuuuuaauugaggguuuucuagcccagaggcuauguccccugcugcaagucacgaagcuagagguaggauuugaacucaggcaaugcaaugaaaaccuuaacugccucccagugaggcaggagagaugcauucuaguucugcaucuacaggccucccggguggagccccccagggaaggagagcucagcucugucuccugacugcuucuccucucaaaggagugugcagaugcccugcugucuuccagaauugcugggaaaacaugaaauuaauagaugaaaaacuccugaaaaauuacaagcucuauauaugugccauaugcuaaauauauccaacugaauauccuagcaacauagaaauuacuuucuaaaauauagagaagaaccuaacagugcuuucuuugcagccaccauagagugucuuuuaugggguuuauguggcggccugugaagugacaaaccaucaaacaggaagucacggucuuaguugcaaagcaaaacacccuggacacggcaauguaaaacauggauuugacauuuauuguugaggacagccaagcaguuucaaaauacaaaagcauauauaaauagcagucuguauccagggaaacacauuuucucuuuaauaaaaauauucuugacuuuaaagaacacauuaaaaugauuguuuuaaauucaaaaugucaaauucugagagaacagaauaauuauuucauaaaacucugaaaaacaaagaaucagaauuacuucuuaccucccacauguauacauuauucuuaaccugagaucuuuuuuucuuaucaccaacaaauggcccaaauuuuuugccuuuuaaaauugguuuaguggcccagacaccuagaaaauaaaaucaguauuuuuauaauguaucaugguuauuuuaaagauugaaaccauuaaaaucgcuuaaguuucacaaaacaguuaaaaggcuagacugccuaaaucaagcuaauguuaaaauagccugagaucaaguuaaauuaagucaaguccucaauggggauuuuuauuuuucuucuuuauacucuucuguucuauaaagaaccuauauuguuuuacgauuagaaaaaaauguuuuauauacuuuuaaaauguuuuacauguaacacuacccguacaguaggaucacaaauacuugaauaacacagucacaacaacugaagagaaaaaauauuggaauggagugaaacuacaacugauuuuugaacuccucugucugcuuguuuauaaaguucaaauugucucuaaugaacaugacuuguucuuauaaaggguuagaaauauaguuuuaugaauaaauaguuuugaaguucauuugcuuuaaaguagaaaacccuuuccugccuaacuaagcuuccugaaaacuuagcuacuggaacggcucacuuuucagaguuucuaacagccaaaauagcuguucauccacaguauucuuaggguuguuucuauuuacuaugcacugaccauaacggaaagcgauauaaugagcaagcagacaguaaaauggcaggagucuggcccagcagucaacagcaucacuuuagaucgguucccucaccuuuuggcuucaguuuccucauauacagaaugggggguaaaggcugggccaguccuauccugcuaggauguacaaauuccacuucucuguaaguccgcuauguaagucaacaaucaguugagcuauaaaaucaaccacuuucauuugaacaauauguucaaacugcucaaugaauaaguuuccaaugagaauuuuuaaaagcauguauuaaaauuuuuucauacauauguacauauaaauugggauaucggaaguacaucuaaaaaaaagaaacagggauauaaauaugauauauuccaagacuguauuuugacuaaaguuuuacaauuuacuuccuuagcuucugucuaaagauuaggccacauaaaaaccaaacacacacgcgccugguuuguguucaaggagaaaucccagccagaagaauuuagauacacucacagcaugucauucauucaaguaucuacugaggguccacaaaguaucugguacuggaggcacaaagauacauaagaaauaaaggcacucacaagcaauaacagagccaaguguaaaaauauuacaaaacaaugaagugaauauaaugguacaaucaugcuccucauggugaaaucagagagaagggaacaacacguucuguggggugaggcucagcagggagacucagaggaggaggacacucaggcaagagggaugggaccuacguguguguguguguguuugugugugugucuguuuguguguuccugguuuuauuuuuacaacccauguccaaccuggauucuugacuagaaaaugcaucaacaccauauaaucuucuaagucaaggguaaauugcugcuuuuauggugcgcucccuaccugacaugccccugcaggaagccucacugccaccugcucuuuacugccugacuugcuccgugacaggaggagcacucaccaauccgggucuugucaacagcagaagggaaaagccucacuuccuccggaaguccucgcagcacauguucggguaccucagccagggucucgguggccgccacaggcucaguaguguucugcaagucaagaaauggaaggaucacagcaaaagaaagaaaacucaaaucauggguuuuuuuuuuuuucugguucaauaagcaaguaugcaaaaauguaaccgaaaccugaagcuggcaagacagaccaaaacgaugaugucaagcauuugaggagcugcuuugaugcuuguuuguaacuguccaaaggaaaccacugcaaccuucaagcaugucuguguuacucuauuuuguuccagccaccuguggccauuuccaaaauaugauaaucucugccaccauacugcuuuaaacacaaauagaaucuggcagcaaaauauagcauaagcuuacuucuaaaucaaaggcuaccaucaguaccuuagcacauuuaaaaaauaaaaaccaacacugcccacuucaaugaaugcuuucagcacacaccacaaaggcuacuggggcccuccaacccugccccauccauguugcccuccagcaacaaccccuaacuggauggggcuugaauauuccaccccaaaacacgacaacuuauuguggucccuuacugcaagugccaccuuuccaggaaacaguaauuuaccacuguuuaccaagucacuaaacagcaaagucaccaggauaucacagaguugcuaagaaacagagaauuuuuuuaaauuauuuaucaaaguuuaggcuggaauucaucauaaucuuaagaaaagauuacuauuagauauguauguaaggaagggagagauuugagccaacugggagaauaugacuguuauuuucucauuaacuuucaaaucaaaggaacaccaagggucuaguaaccaguacaccauauauccuacggagcugaugugcacaucacggcacugcuaagaaugauaggcuuuguagucugaguguguuucauuucacugcacagggaaacacuucuccaggacuuuuaaaugaaccaacacaggcaaaaguaaaccccaaacaaaaaagauuaauuuuucccacaaccaggaagcucuugucgucuucaagaauauauguaccaagaaaagaauaucauccaaacuggcauacucucagcauuucaauuuuuggcuuauuaauuaucaacagucuacuucaagagaaauaaaucucacagucauuauaaacauggucaucuacucucuggccugcuucaagcucgagagcccaagagagggcaucuagagacagguuugucucucgugcagagccgagccaacugagccuccauuucagacacacaaaugcuuuguuccugcuugauuuacaccuuugucccaacaauaucccugaaacauuuuccaaaacauaagauagccaauuagccccagaaaauggucuuaugguauuuuuaauuagcuaaagugugaauaaauuaaccauagacauuuuucacuucuaaauauaguguccccauuuuuaaauucuuaaucuauaagcuggauuuuuggaaaugugaacaauuuauuuccaaagagggaaaagguauuacacugguaguuggcauuggcauccuaagcuacauaaugauuauuucauaacacugauaaaguaagugacauuaacaaauauuagccagagugauguccuaucagcacuggccauuuaguaaaguaaaaggggauuuucuucuuccgucucagcugggacccuaggcaaacacucagcaccauuuauccuccccaggagcacagccgcuuugaaaagucaccaugucugcuaaccuaaacggauacuuccaggcacuuucacaguaauucuaaugacaacuucguauuuacugagaacuuccucgcucaaggcacugugcugucuuacaugcuggguagaauguacuccaaauaguccaagagacagguauuaucagugucucccccucuccacacagagcagggaauuagagcuuagagacauugcuuaaagggcucaaagccuggaucugaauaucugucugauucgagugccuauagucaguccuaaucaucaaggaguuuucacuuaagauucugcuggaauaucaucuaagaaccucugaccuaaaacuuccagauuuccauggaaaugucagcaggagauggugcuuaaggcaggaauggucacucccacaagaaauguguaacuugaguacaaguuagagaucacauguauuaaaauuucugaagcgcccgagaacaugaaggaccucagcagagaagccaugggaaaaagaaauaccaaaaaauccuauguauuuguuuaucuguuuuaagucaacccauuauuuuuugucuuuuuuuucuuuuaaauuacuccuuuauuccacaucuugucccacuagacccauugguuuuuccuuuuggacucauacacccagcagaggaaagcuuuuucuguuauugucguauccuucacauuacaaaaagaccaaacuacaacagagcaccucaguucacagcagcacaacccagacgcugggcagccccagggcccucccucccuucuuccccacagccccgcuggacucuccauggccguggcuauggcugcaaacugccuagaacauuucuagaaaaucaaugauuugagaaguagaagguagauucaugggcuggacuucugaaauagaaccacccucuuuucuuccuugguucuccuucacagcucuuaccacaauuuuaaaugcuuauuuguauagcuguguguuuacugugugccuccucugugagacugcagugaagacagauggugucuaucuuauucaguguuguguucccccagcuuagcaguagauuucaaauguuuguugucacuuaaauacuugaaugaguacauggcucuuuguaagcuaacuuaaagcuuuuuuuaaaaaggagggauagaaauaaaugaaagagcugggucaucuaucaggaaguaucuccuccacaugugccugaauuucuugaaauugagguagguauucuucuggaucaauauaagaauccuuuuuuagaaaaugugguaugccauuaauuccaagcaaccaauguacaagugaaccuuaggaacaaaggaauguuuucaaaaaauucucucccccacauacucauaaacugggaucucuucuugguacauauccugacaggauaagauguaauaucauaucuaaacagguucaucuugauucuuauacuaaagaaucacaauuugauccuggcacuauuucccagauugaucuugucuaaaauaaguugcaccaucuacucuauuuauuuauuucuauauuuccaaaucccugcuacaggccaggcaauguucuaggcagcacgcuugccucaacacggcaucacucugguaagaaauagagacaaaauuaaacacauacauacaauggcugaugcccuguagaaaacucaagcacaaaaaaggggacacaugccuuccgaucaguggcgaaugaaaaaaaagaggggaacgcgaggcgugguggcucacgccuguaaucccagcacuuuggaaggucaaggcgggcagauuaccugaggucaggaguucgagaccagccuggccaagauggugaaaccccgucucuacuuaaaauacaaaaauuagcugggcgugguggcucaugccuguaaucccagcuacucaggaggcugaagcaagagaauugcuugagcccggaagguggagguugcaaugagccgagaucgugccacugcacuccagccuggcugacagaccgucucaaaaaaaaaaggaacacagucauggaguagggauggagaugccuguucagacagaaugcugaggccucucuagaaguagaaagggaaucugugacaauauuggggaaacaugucaggaaaagaaaacagccaggaccaaaucucaaauuaagaggaaacgcaguauccaggcaaaaagacccauguguccagagcagagaagguaggagaagcagcuagaacugaggcaggaggggcaggcagggguaaggucucugagaaacacucaucgccauucgcuugucuacccagaauaagcagaauagaagucaucaagcagagagcagagagcagaucgcaagcuccgcaaggcaccccagcugcuggcgucucccaguacgcccuguccuugcugccccugaauagaaguauguuccugucucauggguuuuuaacacugaucacugugauaugaaagaagcuaaagaacuucucugcuucccuauuagcugaccucaaugaggacucauuauuugacugcuuaaugaaguacagucuuuaaacauguaucaaugaacagaucuggaacaguauguauuaaauuuaacauguuaaauuuaagucaauuuaaugucauuuaguuauuaacuauuaauugaucucauuaauucgauguuuccaacuuccuaccucaaacucaaagaaagucacuacccgcuucucuucccccaauuaaucgccaaagcgucucuccuucauucagcccauccgucagucauuaacacauacucccugagugucugcucagagcuagcaccaugcuaggacccccuccucaugaagcccacuggcuagaggaagaacuucucuguuccugcucccugagacaagaaaccuuggacagauuuugauucacgaguuuugaccuugcuggggagccucugaagggcccuucuacugcuuuccugauacauuuucucugacccaggaugaccuuuccaugcuggacggggugaggagcuuagggaauauaacauuuauuccauccucugagccaagaucugugcuaagcacuuuacaugcauuaccucauuuaaucaucacaacaguaacaaucacaacuaacacagauggagcguucaagaugugucagauacaacugugagcacuuaucaccucauuuaaucugcacacuaccaauugcuauaggcacuucuaugaucuccacguuacagaugaaacuaaacuuugcccauagucccagccagcagguggcagagcuagguaauuucaauccagacaaucucgcuucagggucuggauucucaaauacuaugccacagagcagcccugcugaguaacuuucccaagcuacauaguuuugaaguaguggagccaagauaaaauccagacagauuccagagucuacauucuaaccaccaacccaguggggucucauaccucacaguccguggacaccugagaauucccuuucuggggcccacaaggucagagcuauugcuauaacaacacuaagauguugucugccuuuuucacucucagauguguagaguggaguuuucuggaggcuaucaugugugaaaaugucaucauucugguggcuuaugaaaugugugauuguuuaaucuuauguuuuaaauuuuucugauuuaugaauaaggccuguagucuaacuagcauuauuauaccaaaucaauuuccuagcuuucauauuguacuaaagcuuuguaagauguuacugcuagaaaaggcuggguaaagaguacacaggacuugggccgggcgcaguggcucaugccuguaaucccagcacuuugggaggccgaggcaggcagaucacuugaggucaggaguucaagaccaaccuggccaacaugguaaaaaccuaucucuacuaaaaaaacaaaaacuagcugggcgugguggcgcacaccuguaaucccagcuacucaggaggcuaaggcaggugaaucacuugaacccgggaggcggaaguugcagugagccgagguuaugccacugcacuccagcccgggggauagagcaagacuccuucucaaaaauaaauagaguacauaggacucucuacacuauucuuauaacuucauguggaucuauaacuauuucaaaauacuuuguuauaauuuccaauaugguaaacauccauagauacaacaaacaucaucaaaaagcucaagcugcuacugcacuaagaccgccuccagucuuccaucguaccuccccucucagggcuaagaagacaggaccgacuccuagagaccaaaccuacaagaguggagggaggcaggggggcuuaauccaaacauucauguccuacguucuccccuuccugggcaccucccccacuuccugaguacaacuguuaacauuaaaaacuacaagcguuacaacuauaagcuuucuccccucuuccuccuccuuccuuuuucucccuuuaugcccugcaauaucuuuuucuuccauacuuuguuuuauacauuuucccuuaaaaauaagccaugaacuuugggagguugagauggguggaucacgaggucaggagaucgagaccauccuggccaacauggugaaaccccgucucuacuaaaaauacaaaaauuagcugaguaugguggugccugccuguagucucagcuacucgggaggcugaggcaggagaaucgcuugaaccugagaggcggagguugcagugagccgagaucgugccacugcacuccagccuggggacagagugagccugucucaaaaaaaaaaaaaaaaaagccaugaaaaggaauuucuauaacuuucuacaucaauguacaugugaaaagagugugagcagugucaaguaugcaaaguuagggacaaaacauggcugugacauuugcuuuccccaaacaggcacaagagucuuuaucauuugaaggguuucacugcuaaucucuaaaggagaaaaagcaaaauauaccagaauaaacugagauaaguugcaauggcuucagaguauuaauaaacacaacaacuuacugucaaugcccguuuaggcuccugcagggaauggagaaaaaagcagaagaaaaguucccaauacuuuaaaccccaggguggugaagcugagaccccagcaaggugagguuaccaaaaggggccaauuugcauuuguauuccaggccugggcucuacccagagaacacuuuagccuccuagaagcuaguccccacuauccuaaccuaguaggauuuccccuauggcucuguuacaacacucuccacaacuugcaacagugugcccuguguauugugaaagcccuuccugguuggcuugguuaaucaccucuccagagaggcaaguuuagggcuguagacaggcaggcugugcuuacucgccucgauacagccuggcacagagugcccagcucagagcaguggucacugcgaacgggcaaacaaaugccuggcaaucaacugcccagaggucugggcacagagagauggcuguaagagcaguacagccccagcuggccauggaguccauggaaguggaugagaauccucgauggaaagcagaggagagaacagccgaaaacaaagcccucagaaugcccuuaucaaagaaugaaacggaagaagaagcacagcaaaugagucccaguccuagaagucaucgcagagccaaagaggcaccaagcacauggcaucaccaaagcuggggaagacuccaggaagugaggguggucaacagagccaaacccugcugcugauccuucaaaaucugucacguccaauuccuuucuccaguucccauugccacugacaucuuccaaccugaaguuauucaggaaucuccaaucauccugcacauauuagcagcaaguguccaugugcuggagcagcgcuaccuggggaacgcagcaaccaagagaaggggcagguccugcccaccugcaccccaagcuaauguggcagacuagggguguucaacgucucagugaccuaaagagugauguaggagagauaaggaggggacagugcagugcuuuaguuaggauggcagggggaggccucucagagaagaugucacacagggacuuggacuugagagaugaaaaugagucauguauuaagaacugagcaguccaggcaaacaugccaaggagagaaggggccugggcuguucaggaauaaaaagaggccaccgcggcugcaccagaauagagacgggaagaaagcagaggcagccaccacuggaacaugcaaaaccaaggcagggcaaagagcuggacucaauucagagagcggugggaugacacaagaggguuugggcaggagagugacgagauggggugaggcuuucuggcaucuaggcuacucuacauucaacuucucugaaccuuuugucuucuugaauaagcagucuacaaaguaucugauucaaaacgcuuuuuaaacuuucuaaauaaaaucuagucauuggucugcuggcuuuagagacugucaacguucaagagaagcaaagaaaauaagucaccugagggcucauccccuccucuuguccagaagauucuaauacagaaugggaaugggugaggguggggacaggggauugguaagcaggagaaggagcuuucuacugccucccacugaggcuguuacuggugagacugaguuuuaacuucucaaacuaucuucauccaaagcaacaaacugugggcuacagccuuucaucucagaugggguuuguucggucuacccauggauuuaaaaaaaaaaauucuauuggaagaaaucacagaaaaauccccauuuuacucuuacaggucaucccuggccccuacaggcaucuggguuccuggcacacccucuggccccuccuacccucaccacauuagguccccuugcuacucugggccuuucucaauuuagacuuucaccuggcccucaauucuucugacgaucaauauccuccacauccuuccaggucaaguucaaaucccagcuccuccacgaaaacauucccaacaacucgcaacgaccgcuggcuuuucugauuucccagauggugagcugcauguucuguaaggccuauggagaauggucccauagggaggaaaacguuggcgaggaaaucaaucaggagcuuucuguaauagcccagagaagggauguuugggucugaauucaagcaguaauaguaauuaaacuauuuuacaggacagaaucaggacaugguuaccggcugaaaaauaacaguaauaaauaauaauuuacgguguuuccuaugucaggcacuagccuaagggcuuuacaucuauaaacucauuuacuauugacugcaaccacacgggguaggcaccauuacuguccccauuuaacagauaagaaagugaacacaaauaagccgaggacuugcccaaggucacacagcuggaaugacauugccagaacugaccaaggagagugaguuagagggcaucaaaggagaggcagagaaaaacagucccacagcuuuuuucucugccgaaguguuacuauccuaacauaagaggaaaggcuucuugccacaagcucauuccacugacuuaaggaaaugcuauucagguuguuaauuuuuuuuugaauuucacaaauaauauuuucauucagaaagacaaggucccagauuuucuaaaauuugcuaauuuaucuaguagaauacaugauucaaaaugagauuucaagggcuaccacuauucauucaacaugcuaauuuccuaaacuacacauuuauuaguugagguuuaagucaaaacagauagcaaccaccuuacuuagaagucuuuuuuuaaagugaaaaaaucagauucauauuuauaauuaucuauaaaaaauauacuucuauauuaauaauaugauaaaacagugaaagugguuucaacuuuuuauaucauauauauuuuuagaauuagaaaaaagggggagagauaacuaagaugaaagauagaaagccaucccaggguuucgcuaacucuuuggaauuaagauuaugaauagacauaucuacauggucagauggucucccauaaaacagcucccguaaagaaaugaacuacugauacaugcaacaauauggcugaaucucagaaacaguauaaagaccaaaaugagacaaacagcaaagggcaaggacuauauguauuccacuccuaugaaaccccagaauaggaaaaaccaauguguaggaacagaaagccgaucaguagugaccuugggcagggaaagacuaacuucagagcaguagaaaagaacuuuuuggggugacagacauguccuaugacucgacagcagugauaguuacacgggugugaaacuuguacuauacaguuaaaacaguuaccuuuuacuguaugcagcuuauaccucaaaguugauuuuuaaagucaaauaacuaaacaggucaauaaauccuaaauucucaucuuuaaaucauguuaaaaugaaacuuuaaugcaccaagaaaauauuuccgauuguauucacuuucuuaucuguuaaauagggauaguaauggugcccaccccaugugguugcaaucaauaguaaaugacuuacugaacggaaagcacuuaggcuagugccugacauauaugaaacacgguaaguuacuauuuuuuauuauuauuauuuucaaccaguaaccaaguccugauucugcccuguagaauaguuucauuauuuguauuuauuaagaauuuuuuaacucaacucuaacagcccucuccucaaaacccuccaaagguuccccaccucacuggcaaagucuacucuguccuucuggcgaccccagagcugagcccacacuucuuugaccauuuacuccacccuccucaggucugcuccagguacaugaaccacagaaccaaccuccuccacucucccuacccagcccuucucuccauacucuuuagacaaacauugacuguaaucagcaagguaacucugcucuacagcauaacauuggcauuggcugcuguuacauaaagcugcauguaccaucuuacauggucaacacauacuaauguuuuuauuuuuaaaaguauauaagaauaagcaaauuuuauuagcgucucauuuaaauuuauauaaguaacuccuuuuacaugcuuugcccagagaauuaucagcaaguauuauaucaguuuaaucuauuuaauuaaagcaccuaguuucaaauauugacuugaucaaaacuaacuggaaaguggcagcaauacaugacggaauagauuagaccaauuuuccuuaauauuaagaacaauucauaguauauucauacuaaaauauauauuauugcuacaauagacuaauaauaaucaccaaaguaacuguuacaagcaaaaaacagcuuagaaucauaccauauuaaaaucgcuaaaauucuacgaacccaucuuuguauagauuugcaaacaagaaucuaagcuacuaugcuggaacaaacgaugggaaaaaaaaaaucaaacaagcuucaguuuacugaaauggcauuaaauuauuugguuaagaaaugagcaggacugcuauaacaauaaacagaugaaaacacaaaccaagaaaugcuuauacaccauuuuuuaaaaagaacaggagucaaauuaguucugaaauacaaaaaaguacccucuuucaaaaagcugucagguccauuaagucguccaacugaagaaacuguccuaaagcaugguguuaaucucaguagugaacacacguuaucaccacacucuugcucccuuacaauccagucuccauagcacaguggggaggacauccuaaaaaugaaaaucagcuugugucacugucccguagcccuaaaggcccuauaaaacuugccucucacaccaauguccucuuaucccagagccccugauagggccaagcuccagaccauagcuugcucuccguuucaugaacuaccaagcucauuuccacuucagggucuuuguacuacuguguguucacucugccuggaauuuucuuuuuccagaucuucaugugucuaucugguuccugguuauuaccuaaguuucaguucuacuagcaaucaccuccacagaguagccuucucugaccauguaauccaaagaccuucuuucaccucuacccaucauccuuuauaacaagaucuuguuuaauugucuucacagcacuuuucacuaucugaaauuaccuugcuugucuuccugcuuuuuaacugucucccucuuggaguauguuacuggcagagcccuugcccaccuaguucacugcagaacccauaacaugcugggauacagucuguccacgaugaaugagggaaggaaugaaugaauuuuagggacaacugagauaauggaaccauuccugagauaaagccauuccuagauaagucuaggaaaauaagaaggaaaacaguggaacaucucaaaaguuaaguaucaggauggguguggaacguuaaugaagcaaguaggauaccuacgaucugagaauggagagaagggagcauggagagccaggggaggaggcacaaugacuacugcucucgcugccacccaggcaugggcucaagcggaaggaucgaagacucacaugcagagcaagcugggcucuaauugagagguuaagagauauuaagaaaggggugaguuuugagugaagaacagaagggaagagaaagaaagcaaagaauauguaggucggggagcuuugugagagcugggcucagagggagcuaucacacuaggaccgacuuggaacacacugauacaacugagcgcaacaguccagaaugccgccucaauagucagugcugaaaguacuggcaggcuguggacucuacugcuucuucuaaaggaaucaauaacaaacaauaugauaugcccaugacgaggauccugcagucccugaaacucaacugucaggcauauaucaacaaauuauucuaugcuauugucuuugagaccauacccaucauaagaaacagaacugacaauuaaaacccaucaaagcaaugcugauccauuccuggggagaauaaccuaacccuaaaauaaccaucgggauuuuauuuauaagucaaucuucuucaaguucaaacuuuuuuauaucugaauuuuguugugugguuauuuuucaguuuuucaagcauuuacugcucauuuucacugucugaaaaugacagcaauaaauacgagaagggaaaacuguaaauuauccugaaauaagucuuaacccugaagaaugacuggggugauuguugaaaaacacugauagauuuuaugccauaacaauugggucuaaacagcauauaacuaauauucuucuaguaaugaaaauauaacaaaagaugcuaaaaauuuuacucauaaaaagugggcaauuuuuauaauccaaauaaaagcuucauuacuaccagaccauuuaaauuacacccaaaucagaaauguguuaaccauuagaaacauaagaggacacuuuuccacugauacuuggcauuugggaucaaaggcggucuucugcagaucugauauuaaaacuugucaaaagcaaaacgaaauuauaaaagagccaaaaaaaaaaaaaguaguaguuauugcuaccacuuuuugacuggcaagcagacuuuuuuaaacacaaguuugauauaauggaaauauaaagcaaaaguuugaagugucaagucuaauucacuagaaauauuacaagucuaauacuguacaagaauuaaggcauaauuaauccuaagguuaaagauguagacauaucaaauaaaugauuucugaacagcgaugcaacaagaacaauauuaacauuuagauuccacuuuggaagaacucacaaccauucuaacgcaggaucaagacuccuccaacaaaacaguuccuagacugcagagaaccgagcuccuuugggugaccagguucguaauaagaaucaaucuuaaaauaggaaaauaaaugaaaucuaugaaauauauaugaguauaacuuugauggacgaugacugugaaaauccacucuguucucuuuucccucccccaucucaccauuucaaaaauaauuugccuucaaaagcaugucaauaaaucugcaaguuuuaaaauaauagaaagcaugugccccauguguucgccagauucguuuuuuaugacauauguccucugcauuaaaauaaacauuucugauaaagaaaguaaugaaaucaaaagaauccaaaaauuucacaucucucaaugcagcacaggacugaauguauuaaacuuggcccagcuaauuaaauugaacuugugaucucuagguagagucaccuguacaugaaaaaaaaggugucuaaaguuucaguugaugagggauacaaaauguuuucaagucugagaguuuuaagcuaaggacuaaaaaaaaaauuacauacuucauauuuuggguuuuguccuucauauuuuaaaaguaagugcuuaugaacauuuuaaaaagaaaacauuucugacacccacguauuucuguaacuacaagagagaugauauugaaaccagaaaauaagaauccuacucuagaauauauuauuagauccacauaacuggcucuacuuaucagaacacccuugaagcuaugaaaauauccauagcagaauaauuuaaucaccagguaaucccacaucuccuguaaagagaaacacaucuuacauuucaauauuugcccucuuguuuuuauucugagaacagguuuuucaaggacaaaugcuuaaaguuucuucuuugaucauuugcagucucuauaaauaacuuuuaauccucucuuuuuuuuauuuuuuuauuauuauacuuuaaguuuuaggguacaugugcacauugugcagguuaguuacauacguauacaugugccaugcuggugugcugcacccacuaacucgucaucuagcauuagguauaucucccaaugcuaucccuccccccucccuccaccccacaacaguccccagagugugauguuccccuuccuguguccaugugaucucauuguucaauucccaccuaugaauaagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccaguucuaucauuguuggacauuuggguugguuccaagucuuugcuauugugaauaaugccgcaauaaacauacgugugcaugugucuuuuaaccaacaaauaaucacaaaauaaaaaacgcuaaaaaugaaagcuuaauaagcuucaaaacaaacacacacaaaaaacucacacuagaguguggcaagggagaggucaaaaagaaagucuuaaugaaaaucccuaagaaugaguccucuccucagggaaccacagaaacgccaacccacgcccaaacaaugcacauuccacugcacgaacaaaugcacgguaugaacacaaugaacuaauuaaugguauuaagaaacaaaaaugagaauccaggagaaaugaaugugugugcuacuaucuuguaaaaaucaagagcuggucuaacaucuaggucauguauuuguauaaauucugauuuuuaaacucaccugauucauuuucaauuccuguuguguucuguaaagauacacacaacaaagaaacuucuuugauuacaugaacccuaaaaagaaaaacagacaauuguaauauguaccugccuacaaauuuacagggauuuaaaaccacauacagaacuguagaguuugcugaaagggcuauuuauaaagcaacucuaugccaaaucaacuucaaucuaugcugagagcuuccuugucagauuuauuaucuccaguaaaauagauuucuuacuacucuuugcuagggcuucacuguacucuacaacugaaagcggacucauuaggaggacaucaaaucuuugcuuuggaacugcaucauuccuaagaagaaauaaauuagcuuucuuaauagaaauacaaagcauuauugaguaccuuauuaugcaauauaagugucuuuuucuuuuaccaauacuguguuguacguaaacaccauuagaccccauuacauuauucuguuuuucaaguuccugaauuagaaaguugaauuuacuaacauuggccaccaggaguucucucugaggaaaagaacaaaaaacuggcaguaaaaugcaaauguuuuaauaaaagauguugggaaacagcuacauugucccuuuaaaaacccauguuccauguauucauaguauaguaaaauaaaaagacaaaauuauuucuuguaaaugcguaugacauacuuguuucuaaauaauaaucucugaaaaugguccuuucugcaacguaugccuugagucauuugauguaauucauaauaaauuaaaucaugacacuuuaaguagaacuuccacuguaagguucuaaacauuucccacguuuacauacacauaccauuaggcauaauucuccuauuucuuuaugcacuugcuuauaacuuaucuuuccuuccuugacccacaagccucugcuuacauuguaacauuauguucuaauuguuaauaacccaaagaauacauaauuuagugacauucuuccuacugccuacccacuguuuugacauuuuacccuuguuuuuuaauaagguaguuggauuuuucuuuccuuuucuugaucuauuuaaccacucaccugaucacccuuaaccaccaaaggcacuauauuuaaguuagggccuggccgucugaacuacuuuuauucauaauuggcauaaggauguauuccaugagauugcaucuuguuagacagcucacugcuagccaaaccaauauaaacucuugguaagcaaguacucaggaaaaaaaaaaaaaaagccagagaauugcaaguuaaaccaugaaguccauuccuuuacauuuuaauacugagcaucuuucucaucuauauuuacauguccugccuuaguaaacaucacauauugaacauaaucaacccucuucucuaagacauaagauuguuaucaaguuaaaaauguauauuuugggccgggcacaguggcucaugccuguaaucccagcacuuugggaggccaaggcagguggaucacgaggucaggagaucgagaccauccuggcuaacacggugaaaccccgucucuacuaaaaaauacaaaaaauuagcugggugugguggcaggcgccuguagucccagcuacucgggaggcugaggcaggagaauggcgugaacccgggaggcggagcuugcagugagccgagaucgugccacugcacuccagccugggcgacagagcgagacuccgucucaaaaaaaaaaaaauguauauuuugguauuaaacagugaugagguuagugaucccucagaugugcacaccugacccucgaccagaaacgccuacugacuacuauccaguuccacgugguggcccugcgugacaccuuauucccccaggugaauaagauguuagggguuucacguguccucugacaaagcuuuuauagguagauuuauuaacacuggcucaggggaguucucuuugaggaacagaacaaaaaacaucugcgguaaaaugcaaauguuguaauaaaagauguuuggaaagagcuauaaugcuuuaccauuucccuuuguuugccuuuucccucucacaagaaucaucgguaucaucaucacuaucauuuaugaagcuucuuccaaggacuugcaggcacugugcugccuucaaugaaccagcucagguccccuucaccaaaauaagcacagcacugguauccucaauuaacaagagcuuaagauaauucggucaaggucucauaauuuugguuucugcuaaugcaucuuaacuacauuucaccaauuuuuuacuccugccuccccaugagcacccacuaugugucaagcacugcccuugagcaguggaaaggaggaagaucacugcccuuuuggggaagacagucacaguaaauacauaaguaaaauauguggcaugccagaaaaugaaagcgcuuuagaaaaaaauaaagaguuauggagagggagauaguuacuacaaucucuaugcaaauucaacaguguggucagagaaggauugagaaggagcagucuacauaaaagccaggaaagggacgagcuucaaaccaggaaaguauggggagaaauguuauauggagguggagguggaagcaaaagcgagaagccucacaaggcugcagccuggggaagcagagagggagccaggauguugguguggcuggugcagagucggugaggggcgcaugaagaggcaaugucggaggcugaugcccagucuaaccaagagacaaugggggcauggcucagccaguagaagagaugugaaaaguaacuggauccuggacggacagacggacggauggauggauagauuuuauuucuuuuuuuuguuuguuuuuugagacggagucucgcucugucgccaggcuagagugcaguggugugaucuuggcucacugcagcccccaccuccuuccaggguucaagcaauucuccugccucagccuccugaguagcuaguacuacaggcacgugccaccaaggccagccaauauuuuuguauuuuuaguagagacggaguuucaccauguuggccaugauggucucgagcacccaaaaugugcugcaguuuuagaucuuaggcaugaaagaaagaaagucagucagggauggcacugagguuuugguccugagggcaugggaggauggagcugcuguuuucugagaugcugccuucuucuuaccaucugcuuuucauguuuucccucuuuauuuaacacuucuuuucuuuuccucaccuuuugucauugcuagcuuguaggcacaauucagacaacugagauauccuaacaucugauauugaauaauuacaauaguacuuaaaacauugcauuauuugauuaucucaaggaaucucauguucuucuuuuuuucuggagaugguguaguacucucucacccaggcuggacugcaauggcacaaucauagcucacugcagccucgaacuccugggcucaagugauccucccaccucagccuccuaaauaacuaagacuacaggcucgcgccaccaugccuggcuaauuuuuuuuuuuuuuuuuuuuuggguagagauggagucucaccuuguuacccaggcuaucaucuuuuucuuaauaaaaaaagguuagaauaaaauucagacugcuacauaauuaauaaucuucucuuucuacacuaccuguuuccucucuguccaaaugagaaugcacuuauuucuuuccagagaaaagaaagaucauaacaucuuuuucuuaaagauucacuauauaucuguguggggagagccuccucccuauuacuuccaaauccuaauugcuaaaaaccagacucucauuuuuuccucucucccucuuggacucacaaaauugucaagcuauauacauaaaauauuguacaacaacaaaagcacuguaaaucugacagugaauucucaaauguuauuuuaaaaacuuaauucuuuauucaacuauaucaaaaacaagggguguaaaaggaaaagaaguaagaccugggcggagucucucaacagaggaacccugcauuuuggacuggccaacuccuugagcaagacugucccuuuccuuaugggcacuuaacauugcuuugagcaaucaacacuggcagugccuccaaucauuuugacaaucgaaaauacguacacacauucucaaaugcccuuccaacugagaaccucugaaugugguaaccaugugacgagcugcaauagaauacuaaagcaacuacagcaucuaaaaauguuuggaauaacuuccuuaagauuccuccagcacugcucaaaacccccguggaagugccauggcaauccuacauaaccuucauauucaguguugacuucaacaguccugucuuuacacacccauuuaacuaauacaugguaucuccaggccaagguuuuaucaaacgugugaaacggaaugaucaauccagcagugcagaggcagagaaaaaucuuuccaagcguaucacugaaaccuuagcaauucuaccaaaugcucuuuuuuuuuuuuuuuugagacagagccucacucugucgcccaggcuggagugcaguggcacgaucucagcucacugcaagcuccaccucccggguucaggccauucuccugccucagccucccgaguagcugggacuacaggcgcccgucaacacgcccggcuauuuuuuguauuuuuaguagagacggaguuucacuguguuagccaggaagcucucgaucuccugaccucgugaucuguccgccucagccucccaaaguguugggauuacaggugugagccaccgcgcccggccaaaugcucuuuuuugaagugcuaaacaauuaagugccucugcuuugcuaacagcagauacugaaaaucuuuaaaucccuaggacuucucugaccuuggcuuaugccuuaguuucuuuucugcauuuccacgccuaaucaaaccuucuugaauauuuguacagcaccccucgaauaagucuaacauaucccuucuaucccaccuuaauauuuaucagucccagaagagcaugcacucuuagaaaauaagagcuugaucucuauuuuacauaucuaacauuuuuaauaacaugaguauaugcacuuaacuuuucaagauauugcuuucaaguucuagacaaaucagucuuagaaacauuuauuaauagcauaaagaugauuugaugauuaaugaucaguaucaauauaaccacaauaaaauaauuugagucauuacuaagacacuagucccauaaagugucaacacaaccucaacaacuguuaagcugcugucuucugacacggaaguccagagaccagaaaaucuagacacaugugggacagcccuuucccugggucauaccagcccugcagccccagcacccucuauuaccaauccucugaaauaaagcagguuuaucuaaacaaagacacaaacuagcauuaauguaaugcauguaacacuuaaacugucuucauaucugcccuuuacggacuuguaaaaaucuacaaaucuauaugaaaggcaaaguaggagaacagauuuuuuuaaagauuaguuuacaucuguggggcaagggacagaauugggaaaauacauauuugauuuguacauucaccucuaaaucacugauauuauuuuuuacaauuuucuuuaggaucacuuuagaucucuggcagggagggaggaguaacuggaaaauaauuaacuuugcaauagacacauagaggucacuuauacuauuuuauaauuauuuuaaguuacaaaaaauucuacauugugacaucaagaaucagaaaaaacuuuaacuuucaugauucaggaaguuuauggauaaagaguaaaacagaaauaaguaagagaauacguuuuuaucaaauuuaaaagaccagaaugaaaacauggacuagacacaagaaaaacaguugccauuuugggaaaggagucuuagaaaguucauggccaacacaaaaaaaauucuaaagcuaaucaccacagaaaguaguucucaaggcaaauaaauacuguagcaaauacagagaugaugcagcuuuuagcagacuagauuuguagugucgucuaacacugaccuuacucugaccaaaagauucuugcaauccugaaacuucuagaaaaauaauaaaaaugucugaaauaugccaacuucucaaaaacaguuuuuauugauuuuaaaaugcuauuaagguauucauugucauagaaaacuaccacgcacaauuccuaaauuacaaucugugaacuuuuuuucuucagaaagacuccacgauuagaaucuguugaaauuuguuguagaaaauucuuuaaaccaaacauuuaaaucuaggacuucaauuuaauuuguuccuugaaucuauuuuuauguggcccuuaaaaacauauccaaaaaacccacugcuaauauagcaauaaaaauacuuuggguaaaaaaaaaaaaaacuguaaacuucagaugucaauaugaaaacauguaguauccacuuguuagacuaaacaaaagcacagauauugaaucugcccaggaauuugcuaaaugaaaauucaucaguuuuccuuuucuaaaauaauacaauuucacaagaguaaucaucuagcuucguacuaaaaaaauacagccccaaccuugguauuaaagugcagacuauauuaccaaauuaaauaaagugaaaaaucaaaccugauacguuaagaauaaggagauucuauguguguggagagagacugcgcagacaggaaagguguggcaagcugcugaaccagaggcaauaaauuccuucugcuugaaaccacucacgccucucacccaccgaaggauuucucccaauaccaaaagacaauguuuaacacagaguauaucauauacagcaauuucccuaccuacaaauauauaagagauacaagaauagaauguucacaaauaaaccaguaauuucucccauuucaaugaucaguuuccucagugaggccuagaacacgacagacagacaacuaucgcaggcccugacuccccgaaugcauagagcagagaaaccuaaauagcgaaguggaguguaucgaguuuacuccaggugggacgaucugauacuaauaacacaguuuccauguaacagauuagaaaaaccaagggucugcuguucucaguggcuuuggagcugcagagcuccagugagaaaaugagacugauucaagcuuuuguuugauauauuuaaguuuauagagcucugaggucaacagcccuccggcuccaaugggccuagagcaauuaaauaacaccauaucaaaauggcaaauaagggaccugcugauaugcuaggaaaggacuauaaauccgcauuuagauuguggcauuccaggguucuuucccugucagaauaacucuuccuuuacuugggaagaaaaaaaaaaaagauuaaaggggaaauuuucaaaaucuacugcuccaagcauccauuaauaaugugccagcucagaaguaaacguauggcaguugcugauuauuuauucuuuauuauugauugcuguuauugacagcuauuaauauaugcucucccucauacuuuugauuaaauuuauacaccuaagucauauuccacugaacauguaauuuauuacaucacaaaucucaagcuuuguuuaggguuccuacaauaauucccugcaacccccuuauuaaaacuacccaguuucucuaaagaaauuaaaacauauuaucuuagcucucacuauaggauauuccuccccuccaacaguacaaaaaaaaaaaaaaagaauuauugucaauuuuccugcaugaaguaacuccauccaaucaaaggacucuugaauuaaaauguuaauuuccuuuccuuauuuuuaagacuaauugccaagaaauacaaauguaaaaaucugggggcaggucagaauacaagaguuuuccaaucagugcuugcucucugaugagaacuaugcuucagauucaaggccauuauuaccuccugcaaaacaguauuaaaguaacagaaguuuccaugaaagauucuuuucugacauuuucccuacauuagauguauaaaaacuuuaacuuauaaaaggaaaauuaaaucaauucuugacuaaggcucaaaugccaagcuucuaacucagacaaaauuucuaaagcaagaugccauaugauagcucauuucacaauucccaaaacaaaaugaauccucaguugaccccuguguacuauuuuuccacuggaguugccaaugcagauguuacuuuuaaaauuaagagaugucuaggaauccugcaaaagauuugugaauuuccugaaaagcggaagaacacuacagcagcacgggcaggguagugguccuggcaccaaagucuucaugucucacaugaagacucucugagcaacagaggcaucuuacaaggagcugcucgaagcucuuuucauuuuccauacaaccugcacauaaaugguggggaggcuuccugaauucacaggugaacaaccuaaagcaaaacuggaagucauaauagauaaaaugacaacuuaaacucuuuugcuacggugucaggcacacuuauauuacuacaagauucuauaggucuucuccgaagauuuuauuaaguuuuuuuuuuuuuaguuuugguagaaagugacucuucuauuuuaaauaauuugagauuugggauuuauucucuaaauauguuacuacuucucacaaacauuuaaaaauaauggcaaugccuacuguuugcaaaguguguacacuauucuacaguuuaagaggcccuuaaaacuacauacaugcaagcuuuuuuuggaaaaaaaauguauauuuccucaaaauaaaucauuaguucuuguuucaagguaaagagaaaugccuaaccauuuaugauuuaaaaaaaaaaagaugaaagacugucuuuugauguuugucugcuuuagucugcaaaacagugcaacucaagugagcuucagugcagagcaaggacagaacagaugggcaguucuugggggcucuuaguuccagguuaaaucuaaacuugaccuugugguagaguucucagauaccgugugaggaguugcuaauccuauuccacacccuauuccaaaaggucuguggagaaagauggaagaagaaugacugagaagcagagccuaugaucaccuguaagaggagccggguuucauagcagcccagaaggaaggcagcuuuagcaccugggauggacuaagaaggcaguguuggcaagaaaaauugaauauuuuaggaagauuacguugacagaaaagaauaaggaaguaggugaggagagggcagccagaaagacuggggcugggcaagucaguucagaauccaagagaacaggcaauuaggguuugaauugcagucaagagcugaaacaaaaaauaugauugacacugcagagggaaggaaugggcagaauguuagcuaacugaacaggagguaaaaaagaaauggcaaagaugagucccaaaauuggaaugugagugacugcaggaauggugguuugaauauauuuuaaagacagagcagucaggaguagggacaauauuuaaguaaaagguggugagcuccauuuuuuuuuuuuuuuuuuuuuuuugagacggagucucgcucugucucccaggcuggagugcaguggcgcgaucucgacucacugcaaccuccgccucccagguucaagcgauucuucugccucagccucccaaguagcugggauuacaggugcccaccaucacacccggcuaauuuuugcguuuuuaguagagaugggguuucaccauguuggccaggcuggucucgaacuccugaccucgugauccaccagccucggccucccaaagugcugggauuacaggcaugagccaccacgccuggccagugagcuccauuuuacugacucuaaggagaugcccgaccuucccgggaaaaguaccucagucucaaguggaagaacacguccaagcacaaacgggccaucaacauggagauggagauucagaugucccaagugggugccucaggaaaggaaauugccaagcggaaaaauauccacagagaaggguagacggugcaggauguggcuuugugaaaggcacggaaggagguagaaaacauaguggccccuuccaccaaguucuguaagaguggagggaaggucaaaacgccuaaggacucaauacauaacugggaaggcuuuucucucaacaauaacugccauguuauuucacaacacucauuguauuaggagaaauaucuaagaaaaaauguuacuaauguucuugaaaagccuaaaguauccaaauugccugccuauucuuuauucaucucaaaccaucccgaucaaaaagacuaaucauagucuucacuuuacaaauaguaagagacaacaggggacaagugaccuaccuacccccaccauagccgaaaaucacucguacuccauucuugaucugugauacugucauucuguacauugagguagggcuccauuaaauuacucgagagugcauucauauauuuaccuccccaagcaggugagcugaccugccuucuaacaagugguaacagagcuucacaauuaagaaucuaaauuuaucccaagagccauacuucugaaaacuccuacuuucagauguacuguaaaacuaagucuuucagaauuauagcaaagucccuaaaaaauaagccucgcagagugaggaacauuuagaaugucacuuuuacacugauacuccaauuuauauuuaauuuacauucucuuaacaaggucuugggcaauguacaggauucauacugaaguauauaaggguuuagugacucuuacauggcauaauuuaaauuaugugaaagugccacggaauuaucccaccagaguuuaacauaggucuuaauagaacuacauauaagcacauauaaaauguguggguuuuaccaauuuccagacagacugcccccuauaaucaaacuaacacuugcacuuagcuuuacauauuucagacaagcugugccaagaaguaauucagcucuuucaaagcaaaacccagaguaugauuuauugcaagagcuacaaaauauucuuuucaccaaaauggcuggaaaauaauaaguauucaguaaaaucuccuuuauugcauguuccaaaggacuaauaaaugaaaacacaguauaggcaugacaugaaccaagacucuaagaauaaauacuauacaguacuaagaaaaauacuguaagcauauuucauuccaaaugagccagauuuacuacauacaauaacucuaauucaugccucaggaagguggggguggggaaugaaaggcauucucuuuaagaaagaauauuuaaacgacacaugcauucauuccagugaaauuauacagauguucuguaauucagaaaaccaccccuaccaaauguagcuccaaaagcacaucucuuuucacguuuuauuuaucaauacauuccgacuaaagauuacguaugccacaauaaaaauucaaucaauacuaucuacacuuagaaagauuacaaauaaggauuuggcaacuuauacuuuucccccuagaggaaagcugcauuaaugcugcauguuuuccacaaagaucaaugaacuaucuuuaaauuauaauguauuaaguuaaaguuagguaagcacuucaaaaguaagccuuauugccucagggcaaacucaccauuucugugcauaaccucaaauugguuguuuucaaaaaaacagguuucggaaaaacuacagcauagccucuaccaucaaucuucaagggguugcuggaccaaguugcuuuucuagaagacaguuguuucugcgcuguucagcauaauggucuauaugcuuaaauuauuuaccacgcaucaacucuaugcaaauuuauucaaauuucauaauuuaaucugcauacuaagaaugcugauuccacgucaugaaaacuccuuuaugaucuccaggauaccucacauuguuuuaccucaugccacaaaacugaugccgaagcaaaagugcugaaacugaccauucaauaaagucacaaaaccaaagguggaaaggaacguggacagaccugaaguccacuucuuggcuucaagguguaaaccaucuagucuauccuuacaguucuuaaagagauucaauaaucuguuucaauaauucaaccauacaguuagaugagccuuccuucacugcagcgguucaagugcuauuuggaaaugucuggagauuuuacuggcugucacacuggaaggaggugcuacuggcaucucccugauagaggacagggaugcugcugaacauccuacaguguacaggaucguccuccacaacagagaauucucucacccaaaugucaguaagugcagagguugagaaacucugcuuuaauggaagcuaaguauuguuuucaguaauggaguccacagcuuucagacacuccauaaaggugguuuuuauagcucuaacuagaaacuuguagcuucaaaaagagagagauggaccaccaccccaggccucuaaccaaauguuguaaccauaggugacagcauagcuggugcucagcgcacaaagcgugaagcccuagacacagggcggcaguuaucugugguaaggacagucaggugaugucccucaucaucuggaaacucccuuagcuacccaucgucaugcaaguuugacgauuuucccccaaccaucaaccuccuccucuuccacuccccauuauggaguuuucuaguagaaguccgcuguuuugguuuuuuuucugcaugaguauuaaaaauaacaugaaaagcuacucagaagacaugaaaauaguaaauaaccuaaggugcuuuccauccuggaaagucuaugauuuaacaggacuuaaaaaggguuuguaaaucagguuuggaacuugaaaagaaacaggcugcuuaaagaaacagucucaugaauaaauaaacaucuaacguaaaauaaucaucaaaagaauaggcgcagauauauguacauaacugcacagccacagccaagaacggaagaaaggaagcugaaauugaguguuacuucuuaugacugcacccgcaagaaaaaugcuuauuuagaugcuaaaaagcagaauuuauauuuuucacuguaaucucaaaagauuacagaacuuuaaaacccacgauuuuaaaaaaacuuucaaacaaaucuuaaugaaaagaaaacucaggcuugagaaaccuuacagaucaauauggacuugauugauaacuuacggcccauccacauauuaaauagccauuaaacauaauauugacuaguuaguggcauggauacaugcucaccguaucauaaggcaagacagguugcaaacaauauacacacuauauuaucaauccuguauaaaauguaaauaaauauauauauaugugaaugaacuguaaaauaaggaaagaaauacgcauauccacaccaagagagacaggaagaucugccaaacguuaacaaugguuaucugaagaggggaagguuaugcccaauuucuguuucuucuuugugcuuuucucuacuuuccaauuuucuacagugagaaucuuuuguuauguuuuguacuuacaaaauuaauacauucuuacagauuuaaacuguacuguuucaggcccuguccacaaaauaaggaaaaaacaaaccugaacauaccaaccuuucaauuaaagaaaccaccuucagaaucaacaaaagcaaacauuuacugagcaguauuaucauguucuggcacuuuucuaagcacuuaaaauguauuaacuuauuucaaucaaaccaaaacagauguguugaguaaaaagagcccuggaaucacagaaaauguaaaugaguuuuaguuccacugugaauuuugauuuguuuccauagcucgaaaugaggggguuuaauaaaaaugaucuuuaaaggucaucucaaggcuaaacuaagauucuacauguaaaaauuuggccaauaaguguuaguccggaagccucaagagugauggggcaguuuggaccaucucaaaaacacagaacccuacuaaaaaagaacguaugacagugugucucaguuccuccuccuuaauauauguaaauuuccuaucauguuuuuuuuuaaaaggccuacauuuuucuaauacuuggacacaacugaucaaaccgaggcgaaguguguaccauuguaaaagaaaucauugaagaguuccauuuguuguuaaaaguuucggucacuuuuaauaaaccuggaguaaacaaaaacuuaaacauuuuagucgaguucugggguaaaaaugauucuucuagugucugguuaaagggaucuaaggaccuacugggauucagcaaaagacguuccacgucucaaauacacccaaaaucucaauacaacacuaaaagaaaagugaggggccagcacgaaauuucuguuaggggaaauuucagcugcguaguuaaggaaaucaggacuucccgguuaacuauggggucuuugccgcagcucacagcccgacacaaagcuacaagcccggagggucgguggcucacgcguggaucgaaagaaccacgaagguuuggggaaugacacugaccuguuagguuuacuucaugucucacuuaccaccaucaaaagagguucauugauagcuuuauuagcaaaauuaguaacagaguugcacgucuguaacacacacacacgcgcgcgugcgcacacacacacauacacccgugggucuaugggaacauugagggagacaaucuccagguuaaaaccacacaaaaacuauuugggaaacacaaagacgcaagacacaaaacaaauuuggagugcaaaugugcaagacacacucagugggaacacaaaagagaaaagcacagcggcuugacaauugggacggcgcccggccccacguggggccccagguggccccaccgccgcccgcacccggccagucucugcagcccgcacgcgucccccgcggggcgcgcggcucuucacggcgacaaaccgaaucccgaacuucgccgcagggaccccacggccgacaaggaggagcccggcgccgccacccacccgcggggccaccgacccggaggcccgcgccucgucccggggcccccggcacgcccgggaccucugagggggcgcguccgccgacccggccaucccugcggcgccggguccccagcgugucgccgccgccgucgccgccgcgcuccucggggggagggaccagcgucccggcgcgagcccagaggccgcccacccgcgccacuccuuacccgcgcccgccgcgccagcgccucagagcaccgagggccgccgccgccgccgcuguuucgccggccccggcgcccgcggccgcgccgccgccaucuugacuccagucggaagugacgucgggcggcgaggcaguggccugcggggcuggggggcuccgggacccccggucuccccacgaucccagagcccggcccuugacccugcgccgucgcccaauggccaccacccagccgccccucguaggucaccgcggaucccauggcggcgccucgggaaggaaccccggcggcuggcgucgcggcaaguccgaccgcacccuagggcuaggauccugcgugguucaaagauu

SEQ ID NO: 14211 - RNA, 1321 nt, Homo sapiens
aauguuaagauuuuauuuacaaagauuuuuguuguacagaaaguaaaaaugcuguuacagucccaguguaacugguagccacagaugguugacucaccaaucacagcuaucuacgcuacagcaagagucucacacaaaaaccuaacaacacuuacaauuuuguuggggugaagucccuaagcucgaugguagauugguagauuaccaagagggacuacauggaggaagacggaaugucacaggaacuauucuuuggcucuuuggguggguggguguccugggguuuguaucagcuaccuuuuuuuuuuuuuuuuuaacagcuaccaaauccaugagcaguccaaccgauacuaaacaguucuguuucugcaggucaucuggggucuuaaucaucuucuccuucaucauccguuucucucuuccucuuuuuaccuuuccugccuucuuccuccuccuucauccucauccucaucuucaucuucuucaaguccaaauucuucuuccuccucacugacuucaucuucgucaucuccuucuacauuuucaucuucuucaucaaacuccucuucuucaccaucuucauccuccucgucuucuucgucuucuucuucgcccuccuacucuucauccacaccauccaccucagcaucugagucagguuccuccugguccucuuggucauagccauccauguagguaagcuggggcaggagcuugaagacacucucaguagucauucauguuaguaaccucacaguuaaagagguccaggcuuuucagacauucuaacuuuuucaaagguuccaaggugcugauaucuuucaguuuauuuccacuuaaguuuagacgugugagauuuggaagcuuuucagcuaacauguccagaccuccaaagauucuauuuucacugaguucaagcuuuuucaauuuaggcagcuugggaagauuugaaacugagaucaagccuacauuuauuaaacuaaggaacucuaaguucacaaauucagcuguuaagcccucaauuuuuccaucauuugauuugcaauuguccaagacaaguucucgaacagcugacgggguccaguuccucagcuccagguggauccuccucuucauguccauguuccccucuuccccccucuucaaacuuaacuuuccgcagcgggggcggaugggggagaggcauccuggccugcacagcgagggccgucagaaggguuuguucgcggcagaggccggcggcgcgguccuggguggcgggcggcgugggggcaggcgagcggagcccccggagccaaguuacucacaggagcguagagga

SEQ ID NO: 14212 - RNA, 1150 nt, Homo sapiens
accucaaagaggaucuaaguaauuuauaucagugcucaagaauaauucuggacaucuugguccacagccuacagcaagugguaucuguaaaauuaaaggauaauuccagugggcuuggucggacugcugcuuugccaucucuuguuuguuuugaggaaguggggggaggcuagguaagaacacggaaauagggaacgggguaagggagaggugagaagagcaaggagagauaaagcaggcugugaacauacugcucguuaaccaagccauacucauacuguugagauuuccaucauuuugaaguacauuaucauaacauuaaaaaagaaaaaaaauguuaagaaaauguaucuaauuuuuaaaguuaucacuggaauacgcugaaauaguuuggcuuuuuguaaaauauaaauaaugaagacgcugacuuuuuuugugcuugucaagcuaauagaucaucuccacgagacaggcagcaaugaugaauugcaaaacguuauuaaugaagggaaaagguucaagccaauauucacacugcagucaaugaaagaguaagggggcuucugaggaaggguugaagaugacaugggagaguagcaggaacaacccccuucgcugacuguuugcuccugaggcuuuuccaguuuuaugucacucaugucuucucugcuuccguccugugugcuuuccauucccggcaaagcugcugcuacacgucgaaagagcugcuuuacauuguauccagcuuuugcccuaguuucaauaaacguaacauucagcccuuuggcuuuccucucucccuccucaauugacacuugccucuugucagcaagaucuguuuuauuuccuacuagcgugaugauaacaucacuuccuccuucuguucugacaucaucaauccacuuuguaguuugcuggaaugaguuaacauuugugauaucguaaacuacuacagcugcagcagaaucacggauguaccugggaaugaggcuacggagacguuccugacccgccguaucccacagccgaagcccgauuguuccauccuccaaguacauaguuuuugauaaaaagucaaugccaauuauugccugauagguguugucaaaacugucauaccugaaucuggugaucaaagaugucuuugcaa

SEQ ID NO: 14213 - RNA, 8546 nt, Homo sapiens
cagaaucuccucucagccuuuaagcucaccuggucagaauccuuggaugagccugugggaccguuccuccuagcccggugguuuggaaccaguggcuuugggacuguaagaggauggacaaagguaguaugaggccgggacagcuccccaaaugcucgggcgccaagcaucugcugauuccacucugugccuggcacgugugucuuucgguccuggcuaggccuugccaccucccccugggccagcaccacccauguaccugucggcagagccacaguugacugacuugcuguugagcugcugcucuuuagcacggcugcauuuugauggcagagggagcaguuaugcccagagcccagcgugucggcaucaccagucugaccugagcaccaugugcugcacgacaugacacguggcaccgggggaacugcccagcguggaaggucugggccaggucugagcccagaugggaucuggauggccaaggaacucuaccuuaaaaccucaagugucaaggaggcaggggaggggccaagagggcuggcaggggaagggggcuggggaggggucccauuugcagaggcucuaggaucuuaggaggcccgaauccaccauuucucucuugcuagauucucaggggcugcuagauucaucccugauggcaucaggcacugccagccgcucagaggaugaggagucacuggcagggcagaagcgagccuccucccaggccuugggcaccaucccuaaacggagaagcuccuccagguaguaaggguucggagggccaggaacugggaaaggguagaaggucuguggcguuaagugccacaugccuccccaucuguugggaauggcugccugagccccucuggggccuuaguauuggcagagccuugugcuuuuccugucccugcuaaauccuucccugugggacugagggcaggggagggagaucuuaggucucugacgugaagucuuuguggugugauacccugucaucucagagggcuggaguguagcaguuccauggccacaaccaggcuguggcguaaagugaaagcaggcuggagcagauagcacccuacugggcaccugcucucuuuugggggcugggggugugugaauggguaccagggugggguaaggaguguucacugggcaggacccuuuacagguucaucaagaggaagaaguucgaugaugagcugguggagagcagccuggcaaaaucuucuacccgggcaaagggggccagugggguggaaccagggcgcuguucggggagugaacccuccuccagugagaagaagaaggugaggaauugggagacuuaggggaugggagguagugccagauuucauguuuccccagaaccuuugccagcugccaagagcccugcagagcaggcuggugagaggaccaagcugccccagcccucaucucagaugccccccuccugggaacacaccucucccuacuccccauuucuugcugcagcccccacccccaacccugccauugcauccuguaucacauuccgugugggaggcauggagcaugcaucuauucugggagcagacagccuguucccagcauugcagaguguaaaaauaacccccagguggcauugcuguggcccuagacacugcaccagcaagagugauuucccgguauccuccccacccaacuuucacucuggggucggggauacugccagcaaagagaagaccccguauggucaaggacuauauagaaguaacuuggugggauggggguggguauuagaaagcugagcuccuuuccugugcuuccuguugugggcuggaguuggugcugaggcuggggcuggggcugccgcugccacagaguaugugaaacucuagucaugaagcgccagcugacuggaugcuggcuuugagcuugguuuguuccuguccucugcccagguauccaaagcccccagcacuccugugccacccagcccagccccagccccuggacucaccaagcgugugaagaagaguaaacagccacuucaggugaccaaggaucugggccgcuggaagccugcagaugaccuccugcucauaaaugcuguguugcagguagugcccccaccauaggcucagugugccccuuucccccaaccuccaguucgcaccccaaaauuagcccaacagggcccuguggguggcaaagaaggguuguucccagcuccaaggcuggagcaaauccuucuggggccuugcagaccaacgaccugaccuccguccaccugggcgugaaauucagcugccgcuucacccuucgggagguccaggagcguugguacgcccugcucuacgauccugucaucuccaagugagugggagcugguuccagcaguggggagguacugggacaccagaauuuggguccuggagcagagggaauuguaccagggccccaggaggggucugggaggcaggacuccuggaggcuccuugggggugauacugaggccugagaggcuucaaagagaaguuucuuccugccuccaggcaagggagucugcaggcagagggaauagcaugggagagaaaacuaaaaugagugcccggagugcacuguguguguuguggcuuugggcggagaaaacuaaaaugagugcccggagugcacuguguguguuguggcuuugggcgggucaccuccagccuuuccacauugaccuccuacaguuucauccuccuaacaagggggagucgaauagaagaacaccaagcccccuucuagcuccaguagccacaggcuuccaaauaaacucauacacaugcaacacacaguuccucuuccucugucacuuaaugucuucagagcuugguuggaugcuuaacacccauccucuccacagacccugguaccacuuaaguuguagcugcaguucugauauaccaggaaaugggcugggcucagcuuggaaaggggaggugguaggcaguggcuaggggguggcagcuuuggccaaguaaggaggaaggacuuggagggagcagcagcugguccaaggcucugccucaggaaggacugggucugaaggggacauaggggccuccguuuucugaguuggcuguucauucacuugacaaaccuguggagccacagauuaucugcuaagccuuaggcccuuccuaaugagggccuggccucuagguucuggaucucaaaagccuguagguuugggggaaauaguaggaaccccagauugcuugacaccuuuccuucaccccuccccucugucucuuuccguguccagguuggccugucaggccaugaggcagcugcacccagaggcuauugcagccauccagagcaaggcccuguuuagcaaggcugaggagcagcugcugagcaaagugggaucgguaaggcugagggcugggaagguggaggaucagggcacagcgagagcuggaccaccuagaaaaccacugauguggagagcuccccacccacugucuggauaugugcacaugcacacgugugcacauuggcaggggcguuugugacaggggccucaggaagagccaagccugacuucuugggugacuagcuugcuucuuccagcuccugggggaugcugaggugggagguagagaugguaaggcagagaggcaugugugaaaaagcccagaugccuagagaauguuucuugcccucuagaccagccagcccaccuuggagaccuuccaggaccugcugcacagacacccugaugccuucuaccuggcccguaccgcgaaggcccugcaggcccacuggcagcucaugaagcaguauuaccugcuggaggaccagacagguaacgccccaggagcuggcagaaugggggugugugcacgugcaugugugugugugucugaaguacucgacacagcugccuucaagugcccuguaacagauuccucagugauccccagugucuuguucaccucacauugcaaaaaaaacuacuuuccagagagagaaaguggcuggaauggucuucagcaucaugguaagaguagccaacauugccuggaaucuuuggcaaaagguccaaauagcggaguuaucuaccauuucuugucuuuuguuuuuuucaugacauauuuuauucucacauaaauaacacaugaauuauuauggauaacauucaaacaugagcaaaauaagaaaguccacuuuccugcccacccuucaguuuguuuuccacccuagagguaauaaccacuuuuucugagcuuuuccgcucuuugccucucuccguucuuccuucugucuuccuucuuccucuucuuuucccacuaggccguuagugcugucaagcugcccucaggccauucauaaauccccacugggacuucacacccaguccaucugucucucccuuuccccaagggccucacugcucccuacuuccucuugccucaacagcacagcacucacucucccagugaugggguaagaaaacagugugauuaaacuggaggaacuccccagugaggucuguaauucggguucugauuuccauaguacaagcacguucucacuuucuaaaaguacugcccauugccgucuacauaguuuuucacacaguucaaacaugaagcuucauugguacccaucaccuuacuaccagggucccgcagcuucugcuuaggaaaaaggauuccugcaggagcauuuuaggaaaucucaucagaaggaggccccaucuuccguuccuaaggaccucugauuuuaguggcccgggggcagcccucuuuauuccugcggcuuccaaaauucugccucuuccucagacucagauaucacagaauucccacagagagaacagauacugacuggauaacuuuucuuuuuacugcuaaagcuaguuccuuugucacuauuuuaaaaguuaugccaggcaugguggcucacgccuguaaucccagcacuuugggaggccgaggcacgaagucaggaguucaagaccagccugaccaacaugguauaaccccgucucuacuaaaaauacaaaaaguagccaggccugguggcacacgccuguaaucccagcuacucaggaagcugaggcaggagaauugcugaacccgggaggcagagguugcagugagccaagaucgcgcuacugcacuccagcugggaugacagagcaagacuccaucucaaaaaaagaaaaaagaaaagaaaguuauuuuguguaaauuuauuuguuaacuaaaagccuuaucaugaaaguuuuauuuauuccuucaagaguuuuuguauuucuucaaaagggauuugauuucuccuuugccguugagagcuaggagacccuaggaauaggcaggacacauugcuuagcugucaagucagcggaagaugagauucguggaacuucaggcagcucugguggggagggacuugauggagugacugcccugcuuccccccauauggucucaccucagugggaggaagaggagcaucuauggccccuccacacucccccucacuuccucaguugacaauugcauggccacuagcugcuauagagcacacccuacagucuugggaacggcuggccuaaaagcagagguuuucagauuuggggggccuuuaucccuuuaaauuuuuguuaagagacagggucuuucccuguugcccagcugaacuugaauucucagcucaagagauccucuugccucaggcuccgaguagcuaggucugugggcacacaccacuguucccgacuuccuuucacauuguggccagaaaaaaaaacagacuuucaugaaacuguauuuauccugagcauaucugaugggcucugaugcucauuuuccuauuccauuucauuuuuugaaaaaaugaaacugauuucaugacccauuagcaggucaugaccccagaucaagagacauuggcuuaaggugggcggcgcccaccagcacguacuuucucaguggaacuuggcuggcaggugccucccagccccucacagcguggcaggaaaugcuggagagcauaugaugugauggaaggagagguugagauuucgaauggagagagcaggaucuaaauccugccuccgucccaaacuagggucacauaguuuaaccccucuccugugucuguuuccucaucuguaaaauagagcuaaugguagugccuccccugcuuaguucaaggcuguguaaucaaagcccuuugcacaccaagaagcccauacaaaaggucaauuuuaauuuccuucccuuucuagaaccaccucuacccucaacuaagccuaaagaugcuuugugccaaauuagagcccagccuaaucugguaugggcacccuugcuggugcugggcucuccacccagcgcagucugcagcugguccacuuggcuuagugguccgcucagcaucggguucagcaagacccuuggugcucacgcuuucucuguccuuuguucagugcagccgcugcccaaaggggaccaagugcugaacuucucugaugcagaggaccugauugaugacaguaagcucaagugaguggcuggagacacaggaagggguggagagagccgagucacuccugucagguagagcgccccaggcugcccagccccagcccuugggcucccguuggugcuuggcccccccuggcugagcccccuccccucccacuggggccuucuuaggcuccgcugcuuuacccuuauccccagcccaaccccagagaaggaggcugggccaaggccugauguaccaccuuccaggccacuuggcuaaaggggcucagggaugcccuaaugagccaaguaacaggcaagcugaagguggaccuaaaucuuccuucucuucuugccccucagggacaugcgagaugagguccuggaacaugguaaguauggccucaugggguggugaggggauggaagcuccugccagaaucaagaggaccaguacaaggugcugguggccucagagcaucccuccuuaccaccccaccucaccccagagcugaugguggcugaccggcgccagaagcgagagauucggcagcuggaacaggaacugcauaaguggcaggugcuaguggacagcaucacaggugaggaggccugggcaccagaaggcucacucuucagcauccuucgccccagccugugccccuguugcugccuggcuggggagacccucguuucccaggccccgacccccuucccuuauaaaccuugcccugguucccugccuugcauucuggcccucagggguaggcucuuccaaacucccucuucucccaggcaugagcucuccggacuucgacaaccagacacuggcagugcugcggggccgcauggugcgguaccugaugcgcucgcgugaggugaggcaggcccauccccgcccuucuuaggcugcuuccucugucagugccuuucucugcguaguccuugguuucccaucuuucucuggccugcauagaccuacucccccaauucuucaggucccagcccucaccugccccauuuccccagaucacccugggcagagcaaccaaggauaaccagauugauguggaccugucucuggaggguccggccuggaagauaucccggaaacaagguaucccccacccccugccccagcaggaagcagugugaggucgucccucccagccucucgcuguccuuucuagcccugggcuugguguccauggggacccucguggaccaccugaggcagggauuccuuggugucugcaggaagcagagcugguccauggaagcuccuggcucucucuggccuuuccccaucccaucaaucccuccccaucccaucaucccuucuuucuuucugcuuccacaggugucaucaagcugaagaacaacggugauuucuucauugccaaugagggucgacggcccaucuacaucgauggacggccggugcucuguggcuccaaauggcgccucagcaacaacucugugguggaggugagcuggggaggaggcaggaaggccaggaugagaccuaggcguggugagccaguacaccaacuugguccuggugccaccucugucuuaagccaccuuugucucccacccagaucgccagccugcgauucgucuuccuuaucaaccaggaccucauugcccucaucagggcugaggcugccaagaucacaccacagugaggagugguggcaggacucgugggcccucuccggccuguuuccccugccacuccagcccccuugagcugggaacucaggcuccuggaaaaaccugggcagugggaggcucagcugcgggccauugauuugagccuuugagggaggauagggcuggccuuugugaagccagcagaggcugagaaccucaggcuucccuagauccagagccccuccccaucuuccucucucuaaaaacaacccuaccccccauugccaccuucacuccugugucuccagcugauuagccucagacucuucuuuuauuguuuuucuuuuguaaauaaaaagcaccagguuccaaagua

SEQ ID NO: 14214 - RNA, 8546 nt, Homo sapiens
uacuuuggaaccuggugcuuuuuauuuacaaaagaaaaacaauaaaagaagagucugaggcuaaucagcuggagacacaggagugaagguggcaaugggggguaggguuguuuuuagagagaggaagauggggaggggcucuggaucuagggaagccugagguucucagccucugcuggcuucacaaaggccagcccuauccucccucaaaggcucaaaucaauggcccgcagcugagccucccacugcccagguuuuuccaggagccugaguucccagcucaagggggcuggaguggcaggggaaacaggccggagagggcccacgaguccugccaccacuccucacuguggugugaucuuggcagccucagcccugaugagggcaaugagguccugguugauaaggaagacgaaucgcaggcuggcgaucugggugggagacaaagguggcuuaagacagagguggcaccaggaccaaguugguguacuggcucaccacgccuaggucucauccuggccuuccugccuccuccccagcucaccuccaccacagaguuguugcugaggcgccauuuggagccacagagcaccggccguccaucgauguagaugggccgucgacccucauuggcaaugaagaaaucaccguuguucuucagcuugaugacaccuguggaagcagaaagaaagaagggaugaugggauggggagggauugaugggauggggaaaggccagagagagccaggagcuuccauggaccagcucugcuuccugcagacaccaaggaaucccugccucaggugguccacgaggguccccauggacaccaagcccagggcuagaaaggacagcgagaggcugggagggacgaccucacacugcuuccugcuggggcagggggugggggauaccuuguuuccgggauaucuuccaggccggacccuccagagacagguccacaucaaucugguuauccuugguugcucugcccagggugaucuggggaaauggggcaggugagggcugggaccugaagaauugggggaguaggucuaugcaggccagagaaagaugggaaaccaaggacuacgcagagaaaggcacugacagaggaagcagccuaagaagggcggggaugggccugccucaccucacgcgagcgcaucagguaccgcaccaugcggccccgcagcacugccagugucugguugucgaaguccggagagcucaugccugggagaagagggaguuuggaagagccuaccccugagggccagaaugcaaggcagggaaccagggcaagguuuauaagggaagggggucggggccugggaaacgagggucuccccagccaggcagcaacaggggcacaggcuggggcgaaggaugcugaagagugagccuucuggugcccaggccuccucaccugugaugcuguccacuagcaccugccacuuaugcaguuccuguuccagcugccgaaucucucgcuucuggcgccggucagccaccaucagcucuggggugagguggggugguaaggagggaugcucugaggccaccagcaccuuguacugguccucuugauucuggcaggagcuuccauccccucaccaccccaugaggccauacuuaccauguuccaggaccucaucucgcaugucccugaggggcaagaagagaaggaagauuuagguccaccuucagcuugccuguuacuuggcucauuagggcaucccugagccccuuuagccaaguggccuggaaggugguacaucaggccuuggcccagccuccuucucugggguugggcuggggauaaggguaaagcagcggagccuaagaaggccccagugggaggggagggggcucagccagggggggccaagcaccaacgggagcccaagggcuggggcugggcagccuggggcgcucuaccugacaggagugacucggcucucuccaccccuuccugugucuccagccacucacuugagcuuacugucaucaaucagguccucugcaucagagaaguucagcacuugguccccuuugggcagcggcugcacugaacaaaggacagagaaagcgugagcaccaagggucuugcugaacccgaugcugagcggaccacuaagccaaguggaccagcugcagacugcgcuggguggagagcccagcaccagcaagggugcccauaccagauuaggcugggcucuaauuuggcacaaagcaucuuuaggcuuaguugaggguagaggugguucuagaaagggaaggaaauuaaaauugaccuuuuguaugggcuucuuggugugcaaagggcuuugauuacacagccuugaacuaagcaggggaggcacuaccauuagcucuauuuuacagaugaggaaacagacacaggagagggguuaaacuaugugacccuaguuugggacggaggcaggauuuagauccugcucucuccauucgaaaucucaaccucuccuuccaucacaucauaugcucuccagcauuuccugccacgcugugaggggcugggaggcaccugccagccaaguuccacugagaaaguacgugcuggugggcgccgcccaccuuaagccaaugucucuugaucuggggucaugaccugcuaaugggucaugaaaucaguuucauuuuuucaaaaaaugaaauggaauaggaaaaugagcaucagagcccaucagauaugcucaggauaaauacaguuucaugaaagucuguuuuuuuuucuggccacaaugugaaaggaagucgggaacaguggugugugcccacagaccuagcuacucggagccugaggcaagaggaucucuugagcugagaauucaaguucagcugggcaacagggaaagacccugucucuuaacaaaaauuuaaagggauaaaggccccccaaaucugaaaaccucugcuuuuaggccagccguucccaagacuguagggugugcucuauagcagcuaguggccaugcaauugucaacugaggaagugagggggaguguggaggggccauagaugcuccucuuccucccacugaggugagaccauauggggggaagcagggcagucacuccaucaagucccuccccaccagagcugccugaaguuccacgaaucucaucuuccgcugacuugacagcuaagcaauguguccugccuauuccuagggucuccuagcucucaacggcaaaggagaaaucaaaucccuuuugaagaaauacaaaaacucuugaaggaauaaauaaaacuuucaugauaaggcuuuuaguuaacaaauaaauuuacacaaaauaacuuucuuuucuuuuuucuuuuuuugagauggagucuugcucugucaucccagcuggagugcaguagcgcgaucuuggcucacugcaaccucugccucccggguucagcaauucuccugccucagcuuccugaguagcugggauuacaggcgugugccaccaggccuggcuacuuuuuguauuuuuaguagagacgggguuauaccauguuggucaggcuggucuugaacuccugacuucgugccucggccucccaaagugcugggauuacaggcgugagccaccaugccuggcauaacuuuuaaaauagugacaaaggaacuagcuuuagcaguaaaaagaaaaguuauccagucaguaucuguucucucugugggaauucugugauaucugagucugaggaagaggcagaauuuuggaagccgcaggaauaaagagggcugcccccgggccacuaaaaucagagguccuuaggaacggaagauggggccuccuucugaugagauuuccuaaaaugcuccugcaggaauccuuuuuccuaagcagaagcugcgggacccugguaguaaggugauggguaccaaugaagcuucauguuugaacugugugaaaaacuauguagacggcaaugggcaguacuuuuagaaagugagaacgugcuuguacuauggaaaucagaacccgaauuacagaccucacuggggaguuccuccaguuuaaucacacuguuuucuuaccccaucacugggagagugagugcugugcuguugaggcaagaggaaguagggagcagugaggcccuuggggaaagggagagacagauggacugggugugaagucccaguggggauuuaugaauggccugagggcagcuugacagcacuaacggccuagugggaaaagaagaggaagaaggaagacagaaggaagaacggagagaggcaaagagcggaaaagcucagaaaaagugguuauuaccucuaggguggaaaacaaacugaagggugggcaggaaaguggacuuucuuauuuugcucauguuugaauguuauccauaauaauucauguguuauuuaugugagaauaaaauaugucaugaaaaaaacaaaagacaagaaaugguagauaacuccgcuauuuggaccuuuugccaaagauuccaggcaauguuggcuacucuuaccaugaugcugaagaccauuccagccacuuucucucucuggaaaguaguuuuuuuugcaaugugaggugaacaagacacuggggaucacugaggaaucuguuacagggcacuugaaggcagcugugucgaguacuucagacacacacacacaugcacgugcacacacccccauucugccagcuccuggggcguuaccugucugguccuccagcagguaauacugcuucaugagcugccagugggccugcagggccuucgcgguacgggccagguagaaggcaucagggugucugugcagcagguccuggaaggucuccaaggugggcuggcuggucuagagggcaagaaacauucucuaggcaucugggcuuuuucacacaugccucucugccuuaccaucucuaccucccaccucagcaucccccaggagcuggaagaagcaagcuagucacccaagaagucaggcuuggcucuuccugaggccccugucacaaacgccccugccaaugugcacacgugugcaugugcacauauccagacaguggguggggagcucuccacaucagugguuuucuaggugguccagcucucgcugugcccugauccuccaccuucccagcccucagccuuaccgaucccacuuugcucagcagcugcuccucagccuugcuaaacagggccuugcucuggauggcugcaauagccucugggugcagcugccucauggccugacaggccaaccuggacacggaaagagacagaggggaggggugaaggaaaggugucaagcaaucugggguuccuacuauuucccccaaaccuacaggcuuuugagauccagaaccuagaggccaggcccucauuaggaagggccuaaggcuuagcagauaaucuguggcuccacagguuugucaagugaaugaacagccaacucagaaaacggaggccccuauguccccuucagacccaguccuuccugaggcagagccuuggaccagcugcugcucccuccaaguccuuccuccuuacuuggccaaagcugccacccccuagccacugccuaccaccuccccuuuccaagcugagcccagcccauuuccugguauaucagaacugcagcuacaacuuaagugguaccagggucuguggagaggauggguguuaagcauccaaccaagcucugaagacauuaagugacagaggaagaggaacuguguguugcauguguaugaguuuauuuggaagccuguggcuacuggagcuagaagggggcuugguguucuucuauucgacucccccuuguuaggaggaugaaacuguaggaggucaauguggaaaggcuggaggugacccgcccaaagccacaacacacacagugcacuccgggcacucauuuuaguuuucuccgcccaaagccacaacacacacagugcacuccgggcacucauuuuaguuuucucucccaugcuauucccucugccugcagacucccuugccuggaggcaggaagaaacuucucuuugaagccucucaggccucaguaucacccccaaggagccuccaggaguccugccucccagaccccuccuggggcccugguacaauucccucugcuccaggacccaaauucuggugucccaguaccuccccacugcuggaaccagcucccacucacuuggagaugacaggaucguagagcagggcguaccaacgcuccuggaccucccgaagggugaagcggcagcugaauuucacgcccagguggacggaggucaggucguuggucugcaaggccccagaaggauuugcuccagccuuggagcugggaacaacccuucuuugccacccacagggcccuguugggcuaauuuuggggugcgaacuggagguugggggaaaggggcacacugagccuauggugggggcacuaccugcaacacagcauuuaugagcaggaggucaucugcaggcuuccagcggcccagauccuuggucaccugaaguggcuguuuacucuucuucacacgcuuggugaguccaggggcuggggcugggcuggguggcacaggagugcugggggcuuuggauaccugggcagaggacaggaacaaaccaagcucaaagccagcauccagucagcuggcgcuucaugacuagaguuucacauacucuguggcagcggcagccccagccccagccucagcaccaacuccagcccacaacaggaagcacaggaaaggagcucagcuuucuaauacccacccccaucccaccaaguuacuucuauauaguccuugaccauacggggucuucucuuugcuggcaguauccccgaccccagagugaaaguuggguggggaggauaccgggaaaucacucuugcuggugcagugucuagggccacagcaaugccaccuggggguuauuuuuacacucugcaaugcugggaacaggcugucugcucccagaauagaugcaugcuccaugccucccacacggaaugugauacaggaugcaauggcaggguugggggugggggcugcagcaagaaauggggaguagggagagguguguucccaggaggggggcaucugagaugagggcuggggcagcuugguccucucaccagccugcucugcagggcucuuggcagcuggcaaagguucuggggaaacaugaaaucuggcacuaccucccauccccuaagucucccaauuccucaccuucuucuucucacuggaggaggguucacuccccgaacagcgcccugguuccaccccacuggcccccuuugcccggguagaagauuuugccaggcugcucuccaccagcucaucaucgaacuucuuccucuugaugaaccuguaaaggguccugcccagugaacacuccuuaccccacccugguacccauucacacacccccagcccccaaaagagagcaggugcccaguagggugcuaucugcuccagccugcuuucacuuuacgccacagccugguuguggccauggaacugcuacacuccagcccucugagaugacaggguaucacaccacaaagacuucacgucagagaccuaagaucucccuccccugcccucagucccacagggaaggauuuagcagggacaggaaaagcacaaggcucugccaauacuaaggccccagaggggcucaggcagccauucccaacagauggggaggcauguggcacuuaacgccacagaccuucuacccuuucccaguuccuggcccuccgaacccuuacuaccuggaggagcuucuccguuuagggauggugcccaaggccugggaggaggcucgcuucugcccugccagugacuccucauccucugagcggcuggcagugccugaugccaucagggaugaaucuagcagccccugagaaucuagcaagagagaaaugguggauucgggccuccuaagauccuagagccucugcaaaugggaccccuccccagcccccuuccccugccagcccucuuggccccuccccugccuccuugacacuugagguuuuaagguagaguuccuuggccauccagaucccaucugggcucagaccuggcccagaccuuccacgcugggcaguucccccggugccacgugucaugucgugcagcacauggugcucaggucagacuggugaugccgacacgcugggcucugggcauaacugcucccucugccaucaaaaugcagccgugcuaaagagcagcagcucaacagcaagucagucaacuguggcucugccgacagguacauggguggugcuggcccagggggagguggcaaggccuagccaggaccgaaagacacacgugccaggcacagaguggaaucagcagaugcuuggcgcccgagcauuuggggagcugucccggccucauacuaccuuuguccauccucuuacagucccaaagccacugguuccaaaccaccgggcuaggaggaacggucccacaggcucauccaaggauucugaccaggugagcuuaaaggcugagaggagauucug

SEQ ID NO: 14215 - RNA, 39592 nt, Homo sapiens
ccuccaccaguuuauugcgacguagcauccaggccuaggccuccccguccauccccgccggacucgggccucuggcagcagcgggugacgcagacggaacaucaugucguccgcggccgagccuccgccacccccgccucccgagagcgcgccuuccaagcccgcagccucgaucgccagcggcgggagcaacagcagcaacaaaggcggccccgaaggcgucgcggcgcaggcgguugcgucugcggccagcgcuggucccgcagacgccgagauggaggugagggcgacuugcggcauggggagcgggugcagcggggaggaggagcuggcucccucgccggaucguggcgaucggacgcagagccggguuucucucucugcaccagacucagcuucacacccuguggauacgaaaugaugcucucacucuugcucccuuguucuuacccuauucgagcuaagcaaaauggauuucuggcuccucacauuuaaauuauuugucucuuucgugaauccugacaaauauuugaacgcucucagugaacagauguucuugguuaccguggcccgggggacccaucguuuuuuucccacuagacucccauaauucccucuccuaccucugaaugugguuuuuaguuuccaccaaacuucggggaagggcgaggagaugaccccuuaggagcgggaugcacgggcggggugaaggaggcauuuaaaagcagcgcguccgaggacuugggccuccuuuucuucuucccgguccuugcaggggcgguaucuguugugggcagaaacaauggcgagagcuggauggccgagugcgcaguggggauaagcggggcgcagcugcuucugugaagggagagaaggccccucccaggcacuauuccacuggaagggaagcaaccaaggcagcagcagcugucucggaucccccgucuaauuuaggggggaugaauaaguguaggaaugaauuagagaaccaggcgcaguugguuggcucucaguccggcacuuuucucuuuuuggccucuggccuuaagaaaaaaaaaaauuaguaccacucgcugccgagacuuauggguuuggguugggcaggggaugcugacaguacugagggggcuggaaagaugggggaagcugccaggcggguaaauuggauaugcuuccaggcuuugcaucugggaacaaaguaauugcuccuuccaauuuuuauuuucuuggccuucgaccuguuuugagauauuuugugagucggagcccaaagauuucugggauuuuccuauccuuagacagaaugaaaguaauacugcuccgaagaugagucuugaugcagaaucauuauacaguaagaaaaugguagcguaauuuaccauugaggcuuuuggcacaguaguuauauuuggguagcugggguuaaguaacauuaauguuaguaaucauuuaaagaacuuuuaguggugaggguagguuuagugacauaggaacuccugauaguuccuguaguuuugagugauuaagauaagauuacuuccaaauuaaaauauauucaguguugcuuuuuuuuccuuaaggaaaugguucuuuuggguuacuagggcucuuuaacuuggauuucuguuccaaggcuuaagggguuugacacaaagcaauuauguguaaaugugcaguucucuacaaaaauuguuuauaguuuuuccucagcuucucaaaggggucugccauccaaacuuuggaaaaaugaauguuucaccagaggucuuauuaauaucugaaugcagaguaauuuuaagccuaaagcaagucaacauuuuugacuugaaguugcuauuuuaaaugaaaauugauuuuaaguucaaacgugaguauagauguuaucacuaccguauuaaauuagugauauuuucauuugccagauggggaaauugaguucuacuagguagaaccuguaauaaaacucggaucugccuuuaaaagugagccguuucccacccaucuugcucugccauguucuuaccaaaaaaaacauauuuggcgguucaauuuauugaauaacauuguuauuuuuaccuuccuaguauagaaauauuaggaauuuuauuuuuuuauccaucuuaucacugacacauuuuuuuuuugguugacauuauagugugauuuuuuuuuuugucuuuuaaaaugucaguuuccuguuuaacaaaauucagaauuacugcaauucaugauauaaacuaaguuugagcacacaugcuuaauauauaugucacaacuuaaucuguuuugcacuuggaaaaugaauauuuuauaaaugacuuuuucuuguuuggaaguaugaucuaagguguuuuucuaaacagaguaaacccagcauucaugaauuuuuuuuuuuuuuuuuuuuuggugacaaagcugauuuucccagaaauagccuuccuauguauucaguuacuuuuuuucuuuuugcuugauacuaauaggucaauggagcacuuguuuuuuaguuauccuuuuggcaguguggaacucuucuguguucauccucaucucuauugacuagauugauuaaauagucaccuguauaccaauaaugugaugucaagaugccugaagcacauuuuauuuuuguagguugcauuucauggcauuuuggaauuuuguaaacuggacuggguagguggcuuugucacuuacauauguagaccagagauuuaugaugaacauagggucacacaagugccaagggucuuaacaaugaaguuagacuugacuuaaggucauuuuaccuucuauuccaguaccguaccagaucuccuccccacaacuuuuuggucacagauaguuuuauuauagcauauauugccuagcauagauuugugcaucauuaaugaagauuacuucugccaauuuuuuuuaauggaugaauagaacuuugcaguguagaaguuguuuuuuguugcuugugacauaugaaugucaggauaaauauauuugcaagaauaacauuuauuacuaguuuaggaaucagacuguaguuagaguauucaauuuaggcugcgagauaaaguuuuuguaauauuccagaagguggaaaucagggugacuaauucugauuucuuuguagacauuugugugguagcacaguagauacuguaguuuuaugacaaaaggggaacuuuuccccacauuuuauacuauuuaguuugguuucaugguuauuacagaaaaagagaaacagauuggcuuguauuaaauguaguuuucuuuuaggaugaugaagauaaucuuguguucuaaucuuggcaacaaccauacaguuuauauauauggguuaaauacguuguuauccccauaguaucuaauaucauuuuaucaguuuuucuguuagcuuagaugacagcuguuuaaguuucuaggaaguuuggggugagaauguauuauuuaagauguguuuuggucagaaauuggucuauaaugguauguuuacuauuuucgaagaccaauucuauuuaauuauuucuuucuaccaggaaauauuugaugaugcgucaccuggaaagcaaaaggaaauccaagaaccagauccuaccuaugaagaaaaaaugguauguucuaggcuugugaauagagucuauaaggaaaacuuuuuaucaggugauuaaauguacuaaacaucuaucuuaguccauuuuguguuacaacaauaccacagacuggguaauuuauaaagaaacgaaauuuauuucuuagaguucuggaggcuggcaaguccaaggucaaggccagcauuuguugagggccuucuugcagugucauuauauggaggaaggccaagagaagagagcaagacaggacugaacuuucuuuuauaacaagcucacuggugauaaccuccuccugagauacugacaguaaucuuuuccuaaucaccucuuauuaggcccuaccucccaacacuguugcguuggggauuaaauuacaacaugggagauuuggagggggacacagucaaaccauagcaaugucuguuuaauuuuuguaauuauggcacagauauccauuugaaauauguguaauauggaauacuauaacuuccauaucuuaugugucuauguaagccaaauggaaguauuauaugaauuaacauaauaugaugucauuaucuaguuauguuaacaacaccuuuaaaaauuuaaccuuggaagcgaggugaagaccagaauaguuacucaguguauguuuauucugcacuugacuagcauuguacucugcuaguuaccaaaaaaagaaauaugcuccuuguucacagcauuuuuauauuauagauggggucuuuacaaaaagaacaugacauuauauuggagucauucaagucccaguucacguuccguaucuucuaagaaacuucucaaaacuaugacuugacuuaaacaguaccuacacagagcuuuaaauuuaaauucaguuuuaguaauaguaguaguggcuaacagugaauguuuacuccguaucugacccuguuaggaaugcuuuauauggauuaaacucauuuaauuguauugaaaucucaaaaaguuaaaauaacaauguauuaaauaagaauaccacuacacagugugcuccuguaggguaaaaacagugucuuaaucuuucuuucugucuucaguacccagaacaguaucuggcacauagcagaucuuacauauuuuuuaaaacauacuuuuuucuuguccuuugacuuucucuuccaaaucaguaaauauuuuugaaugucuuaaauagcuucaaaaucuuaaaauuaugguauguauuuuaugugcauguauaauaugcacaauacauauaacacuauguaaauuauaaaugauauaucuuuagguuugauuuguuauauauuuuacauauguauauauguaacugucaccuuuuuugcuaucaaacuuagagaaaaaauagauuugccgcucuguuuuuuuaaagugaauacuacuuugaauacagucuacauauuuuaauacugcuuuaacccuuuauaguuuagauucugacacacucugcuggugaaucuaauugccaauucugaggcuuaguuuuaguuucuugauuugugcuugacauuguugaccauuccucaaaaaucuugacuugccuugaaagacauuuuuucccgugauaauauccucuuugcuuuuuuauuccuuuguccuuccuuauuaaaauuugaacauuucuuccuagacaguuugauucuuacugguuuuuaccugguaucuuuaaacugaauauuuucaaauacuuaaccucuagcccagaagccuguaauccguauuuucauuuacuuuaaaauccuauucauaccucuuacuugagaauauccaaaacugaauucauaauuuuuacuuagcauaccuuaguguuaccucaaugaaugaaaguuccucuucagguauacucaagauguucaugacaguacugcauacuuguaaacaauaaguuuacuuacgaguuuauucucuuuuccauaucacccuaguuuaguauuuuucuauuauugcauggauuauuuugugcuucuguauuugccuccuuucuuaugaucuggccccuuccaaguuucuuaacauuuuugcaaaguguuauuuauaacacaaauuugacugugaaauggagguuuuucaguggcucucuacaaugcuuuucauuuucuuaguggccuuuauuggaacucuuuucguuucuuccagguuuuucagucucccagcauuauuuccuuuuuugacaucaugaucuucaccugcacaguuuucuucuaagcaagaagcucccuugucaucugcuaguucuaaccauagauaaguucacuauccacuccucguucuugaacccagaaugcugaguacuacuucagaaaacuaaauacuagugcugauuggugccaguauaaguuuaugguuuuuauuuucuuggaccuugaguauuuauugccuaucagucucauuuagccauucuaaaauguccccacucugaucagucuuucuucuccauuucuaccaugcccucauuuccaaucuuccuccacaaagaauugcaggccugucuuuauuuucuuucucuuuucaaacauauguauagccucuauuauccuaccucauuucuuccuguuucagagaaagaagcuaguccaaagcuauucacuuuaauuuccguuugauuuuauaauugauuucuuucagguuccuaaucauacucucuuguuucugcuuuuuagguucuguugguuuuucucccucaagacauuucaguuuuaaccuuuucauucuuucaagcaguuuaucuugauuccaaacauaauuacaauaauuauuuuuucaguccaaacaucuuguagaugcgugcucuuggcuuuuguuucauuaucuauaaauuaagaaauguaauuauguaaaauaugcauucacauauguaucuuguucagcacuuuaaaaacagucuguaaucuuggaaaacauaaauaacagaggcuugucaucuguaggacauuacugggguucuagcauguucacagucuuguuacugugcagauucauuugcugcuaugacugccauuugugacccaaugaaacacuauaaccaugugccuuccuaauagcaaauugggcuucaguuuuuacauuggugugaccuuaaaaaaugauuauguuccuuuuaaaaauacguaguuguuacaacauuauggcauuuggauacuucuuguguuugcuagguaaaaugucuuuuuguaauuuauucccaaacugacauuuuaaacauuuauagacagagauguugaguaguugguuucccuguuuauugagcuuuucuugucuugcuucuccuuuguuucaucaaacuauuauuguuuuuguauaaaggcugccuaauggcucccaauuucauuauuuuuaugaaaauuugucuucgaggcucuuaagguuuuuuuugcccaaguaaauuuuuuccauucucucgguauuauaauagggaacauucaaaggggcagauggcagauacgaaaggaaggaauaguaucaaucccaauaccguuuuaaaauuugucacagccuaacuaaugaaugagcacugcauuuuuuccagcuucugaguaaauucacuuguauugcacaguguuuaauauuuuaaaaauuguuccgaucaacuguauugaaguauaauugacauaaaauaauuuuaaguuuguaauucaaugaguuuuagcaaauauuucuuuaaauaccaucacaaucaugaugcagaguaguuccaucauccccaaaguuugcuccugcuccuuucuaaucaguucuugcucccaccuccuugccacuucugaucugcuuucuaucacuaguuagcauuucauuuaaguggaaucauacagcauguagucuuuuguguuuggcuucuuucacuuugcauagugcuuuugaaacucauccauguugcauuuaucuguaguucucuuuuuuuuuuugcugaguucauuguauggaggcaugcugaaacuuugauuucugaaguuuuaauugauacucugauaaaauguaucuuaaauuuuuuuuuuucagcaaacugaccgggcaaauagauucgaguauuuauuaaagcagacagaacuuuuugcacauuucauucaaccugcugcucagaagacuccaacuucaccuuugaagaugaaaccagggcgcccacgaauaaaaaaagaugagaagcagaacuuacuauccguuggcgagugaguaauaguuuaaacuucauaguucaaccaaacuuauuuucgauagucuucaguggaagcauaaaaucacuaugauaaauaacuuaaaauuauuuuagugccauuauuuauuuggcccuguuuggcuuggcaugauuuagccauaaauguauaaguauauaaaaauacgcauaaugguuagagcacaguggcucuugccuguaaucgcagcauuuugggacgccaaggugggaggauugcuugaguccgggaguaugagagcagccugggcaacguagggagaucccaucucuacaaaaaaaaaaaaaaaaaaaaaaaagaauaaaacugcauaacgccuuauuuuuuguagcauuauauaguuuaugaauuguaacaaucauguugaguauggaauuuagaugucacgucauuccucagagaggaaacaaaugcagagguuaaguggcuuguuuaacaucacauugaagaaugauccagacuugaauuugaaucugacuugggugugcucuaggcuccuccaucacauacagauguugacaguauuuuaucuaaaguguggugugugggauauugugaugacuuacaucacggcagccuguuuaaaauuuuuauugcauacuuaguuguuuuuauauaaauugaagugucacguuguaugccguccuuugguggugguugaaaauaauucuuacauguugaauuuggaaauucucuagaauuuucauucugguuggauaaauaagauguuuaauuaguaauaguagauuuagggcagucuuggcucccugaaauggcuuuguguaauucccaaagugaaaacugugauuaguaauuaaaauacaaaagauuguuuaaaagaagaaguaucaacaagguuaaauucacuacacaguuuguugaaagagggaaguaugaucuucaucuugaagggguuaucguuguaagcauaauaccuuuuauuugggguauuccacucauucauuauaucuuauuucucauccauugugaccaaagcacuauuuuaauacuuacgaaacuuugaagggacaauuuugcccuucagcuguauuuaaaauauuucagacuucagaaguuugcauuagugucauggcaugaaacuggaaacuacuguacugaauauuguuaugggauagucaguaugaugucucgaaaagaaacacuucuuuuauucuuuucuauuuuauuauuauccuaauuuaucuuuuuuauaagauaaaaaagauucuauuggaaauaguaauaauaaauuguuaggcuuaauguauuaaauaguguuauuagggaaaaaaguccuaguuaacagauuucuuuacuccucaaaccaucuuaaaugggaagcuaauuuaccuaaaguaaugagggucauaguauugucuuuggguaucaggaauacauuuuuuuaaaucuuuuuuuguuuguuuguuuuuauugagacagagucuugcucuguggcccaggcuggagugcgugcaguggugugaucucgguucacugcaaguugugccucugggguucaagcgauucuuggaccucagcugggauuacaggcucacgccaccacgcccagcucauuuuuguauuuuugguagagaugggguuucaccauguuggccaggcuagucucgaacuucugaccucaagugauccacccaccucugccuccuaaaguguugggauuacaggcgugagccacugugccuggccaggaauacguuuuuuuuuuaagucauucacgauuauauucaauuuuuaacaauaaaugacaucucagcuuuuaaguuuuacaacuguaauaaucaaacauuuugagaguaacuauaaaggauauuuuauaaaaagaauuuaaaauuaucucccaguuuauggagaauaaauaggggauggaaguagaucuuuguacucaauuucauaggcucagaaugcagagaaguacaaggaauaacagacuaggauguacugauuaugauuagaagcauauauaacaaacaagaaggcccuugaauuucugaggaaugcuucuaucuuggaaggccgcuuauccuuuuagcaagcaugugguuuugguagaaaugaaguuacaaauuagauucagcggucucaacagaggcauaacgugccuuuuucuaaauaagaugaaaauauuuguugaaagugucagaauuggggaguaaguauuaauaguuuuacugaaccaagcccuuuagagauuaauuggcaguauuaaaacuuuagaaaaucaguuuuuaaggggguaguauaucugauucucuuaggauguagaauuuagauguguauuuaaaaauuuuuuugaugaauccguggucacugcuuaaauuucugaguccuuaugcugcagcuuuugcucgaaguuacaauuuuaaacaugugguuucuggaacuuuuuuuuccuuggcaaaaagauuuuuaaaaagguacacuuuaaaauucaaauaaugagauuuucugacuacauaguucuugaaauuugacuaucauauuugaguuuauuggguucugguuaauguaucguacugguguauuuuaauaacuaauguauauuuuaaauaauuauuuaaaacauugcagauuuaaauguacucauauuuucuacuguccacugguugaugccuguuaaaaauuuaauuuuguggaaucuuggucagccacuugacuaugauguuuaaacaguagcugauaauuaaagccaaaacucaaaucagguuauuuuauuuucaucuuaacaguuaccgacaccguagaacagagcaagaggaggaugaagagcuauuaacagaaagcuccaaagcaaccaauguuugcacucgauuugaagacucuccaucguguauguuaaacacacuugauuuuuuuaaaaaauugcccuuugagaucuccuuugguuaauguuuuggauuuguguuggcuacuauuugugaagcaaauuuuuaguagucuuagauguuuauugguuaugaaauaaacuucagauuuugauggagaugagagcauauuacaggauaguagugcuguauuucaaaguuauauaaaaugucauuguguuuguuauugcccugaaguauauguaaaucuaaggaucguuuugcuuuauauuugucccacauaagaaaacuaauuuauuuuaaaaaagguacuucaugaacacauuugcuuacuucugauguuuuuauauuaauuuaauuuuuugugaaauguauuuguuuauugguuagcuuuuuauccucaaguguuuuucaaaaggagauggagggcuacacuguguacauauuaaaaaagaaaaaucaggugaccguuauguauauuugguaauuauucuggggagcaaaauaaguaguauacccugaaagagagugcauuggaauguauaagauauauuggacaaguaacuuaggaauuuccuauuucuuuuuuuuuuuuuuuuacuagaaagaaaauaaaauccccagauaaccuguaucuggucuuuaugaaagcugaaaauacuugguuaggaacacuugguuuuucauuaaaaagacgagaggccaaagagucucucagaccaguauauggguaacguaagaacugaguuguuggaguggguacucugaugcccgcagucauguuucccgcacuugauuaucuuccauguccagcuuuuccacuucagaccauggcagcuaccucuaguauuuuggaacuugcagaguuccuauucaagaauccguuaguaaugaaaauaaagucaguagauauguguaggcuuagaugaagagauugccuuguauuucuugucuuaaaaugccuauugugcuuuucuuuuguucuuagauguaaaaugggguaaacugagagauuaucagguccgaggauuaaacuggcucauuucuuuguaugagaauggcaucaaugguauccuugcagaugaaaugguauguguugguaguuuuuuuugaaggguauguuuuguauugaaaauaucuuauacguugauaaaaguuucuuacagucuacaacuguuagcaaauggauccucucagaaacuaguauaagcagcuugccuuaguugcauaagugugaucuguauuuuaauugugagaaauuuccaucgcugaaaauaugauaaauuuaaaaagaauacauuugagaaacauguuuuuggaugacuuuuauaguacaaugauuuauuugcuuccaguuuuguaaaacaaaagugaggucauuaauuguuuauaauugauaaauguuuuuuccaggugguagcuuguacaauucuuagaaaacauuuaucuuuuguuaacuacuaguuauguaaugaauguuuaaaaaaguuuccuuauugcuauaaugcuaaaacguuuaauugguuggagaaaguaugaagucaaaagaaauguguuucaaugcuagcucugcuagaugacuuugggaaugucacuuaaacggggccuuaugcgggugauaauaauaccuccuuuagagacuugugaaaauuauaugacauaacacuuacaaacuuugauauauguuaaguuuuugccauuuauuaacuguuauaaauauguagcauuucuuuugaacauuucuauauguugggagguauaauugugaaauaauauuuucauuuuucacugcuucaugguuauuuugaaaucuuucagggccuaggaaagacucuucaaacaauuucucuucuuggguacaugaaacauuauagaaacauuccugggccucauaugguuuugguuccuaagucuacauuacacaacuggaugagugaauucaagagauggguaccaacacuuagaucuguuuguuugauaggagauaaagaacaaagaguaaguuucuaguauuucauuacauuuuugaggcuaaaauaauuugaauucaggcuuggguauggguauagcuggaagaaggauaaaugagacgggaucuucgcaaauauuaguauuuacaaauguagcauugucuugguggauaaaaaacagcacuuugggaggccgaggcggguggaucaugaggucaggagaucgagaccauccuggcuaacacagugaaaccccguuucuacuaaaaacucaaaaaauuagcugggugugguggcacgcauggccuguagucccagcuacuugguaggcugaggcaggagaaucgcuggaaucugggagguggagguugcagugagccgagauggcgccacugcacuccagccugggcaacaaagcaagaccaucuuaaaaaaaaaaaaucauacugggaagaagacauuagaaaugguagaaagcuguaagacuguaguuuguuucucucccuuuugggagugguuguauaaaaucauugguugugcucucauuagaaguuauuuucuuguuuuuaaaagauauuuugaaaugugaguugguuggaaauuuaaggagccacauuuuuagaugaauguguguagugguaauagucacagaauuagaguuuuuaaagacggguugagucauauauaguaauuuggugauuuauuaugauauuuaacaaaauaaguuaaaauuucgaucaguugacaacauccuugugggaagaagagauggaaauaaugacauuaguauauaaagcucagauuuggaaauuuauucagacucuacugaauagcuguguacuuguuuuuuauuuccucuucauuuaccugugagugauaagucuauauuuuucucucccuuucuaguuauguuggauauuuuaaguuaucaauuuuuguuuguuuguuugggagcccaaagagugguaauuacuuaaccagucuuugcuucaguuuccuuaccuuuaaaauaauacuauuaggaauguguuaauacauuuauaaaccugaaaggaaugcagaugccuacuacugcuaacuaucuuuccacccucuuccuuucuuuauguuaaaaccucccucuuuuuugucuaaaccugccuccuaagaauuucccgaucuaguggaauugcagaaagacauuuuaagugucuauugaauuuuucacugguuaacuuugucaguuuuuuaaaacuuaaugguucugacauuuaaaugauuaaugacguuacuuuagucuuaggaaagcugguucuaaacguuugcauaauauagcuagcuacucuacuccuuuuuaguauucccaccucuuuuuauauacuagauuacuugucaucaguaaauguaaugcguaguuuauuucuacgugauguaauuuuuuucucuuguuacacaggcugcuuuugucagagacguuuuauuaccgggagaaugggauguauguguaacaucuuaugaaaugcuuauuaaagagaagucuguguucaaaaaauuuaauuggagauacuuaguaauagaugaagcucacaggaucaaaaaugaaaaaucuaagguaauuugauacuuagaugugaaaagccuucauguaagaauuugauuaaaguacagauuuuuuuuucuuuuaacuuuaaguuaugagauacaugugcagaacgugcagguuuguuaacauagguaugcaugugccauggugguuugcugcaccccaucaucuagguuuuaagccccgcaugcauuagguauuuguccuaaugcucucccucugcuuucuccccacuccccgacagguccuggcaugugguguuccccucccuguguccauguguucucauuguucaacucccacuuaugagugagaacauguaguguuugguuuucuguuccuguguuaguuuacugagaaugauggcuuccagcuucauccauguccuugcagaggauauaaacucauucucuuuuauggcugcguacuauucgcugauguauaugugccauauuuucuuuaaccggucuaucauuguugggcauuuguguugguuccaggucuuugcuguuguagauaaugcaauaugcagaauauucuaaugguguauuugguucuuuucuuucaguugucagaaauagugagggaauucaagacuacaaauagacuauuauuaacuggaacaccucuucagaacaacuugcaugagcuguggucacuucuuaacuuucuguugccagauguguuuaauucagcagauguaaguauuuccuggugcuuucugguuaauaauaauauuuugcuuaaugcuauauauuuuuguaauaaaaguggccugccuuuuagcauggcuugagguuauuauuaauuuuuuaugcuuuuauuuacauaguuagccugguguuaucuccuagguugucucuguauaaugggaauuuacuuuugugccuuugguuucaaucuuauuucauuauuauuauuauuauuuuauuuuuuuugagacguagucucacucugucaccuaugcugaagugcaguggugugaucuuggcucacugcagccuccaccuccggaauucaggugauucuugugccucagccuuccgaauagcugagaucacaggugugugccaccaugcccggcuaguuucuguguuuuuuguagagaugagguuuugccauguuguccaggcuggucucaagcuccuggccucaagcgaucugccugccucagccucccaaagugcugggauuacaggcacgagccaccacaccaggccucagucuucuuuaaaucauuguuuucucuaucugaaauggcauaaauugucacuccuauuugguaagucagguuggccugacuuuguuucaguggcucuagguugacugguuauguuuuuaaggugcugcucaagguauuccugaagugauuuguauaccucacauugcuuauguuuuaagucccaaggaugacugucaaauuuagugaaaucugucuggcuuuucuuauauuauagucuaacaaacaaauagaaccuaaucuuuauggauuauuuauagucauagaaaggauaguaaugguuaauuagcuauuugaacuguuaauaguaauauaauaacuaugucaagaguuugugcuauuagaaauugcaguuuuuuuugccuggaccaguguuuauuuuugaagcuuuguuugcauagcuggcgucuuauguguauuggagggauuugaagagcuccauguuaguauauuuuuguacaauuaaguuauaaaaagguauuaauuaauuuuguuuuuuuucuguugaagauuguuuugaaagaauagauuguguuguaaaaagauauuuaaucagacuccaaaagcaauuuuagcuucgauuuuauguauuuugauguuuuugagauaauuccuguuucucacuacauugacacuuucauuuacuuuaaagcagugaauucuaagauuauguuuacucaaaaacaaagcacauauauaauacauauguucaagagaugagguuagggaaacugcccuuguugaaaucguaaccaaauauuaaugaaaugcugguaauuucaauuucauuuaguaaguuugauuaaaauugacauuguucguaaacuuguauuugaguagugcgaauggucucagagaacaaacuauaaaauguuuuaauuuucaagcuuuuaugaaacuugaaagauacuuuacaagaauauuaauuuucuaauccuauagaacuugcucuccaacuuuuuacugugaaacuuguuauuuugauguuuuugagaagaauguuuagaagguagugugauuucugaacuacuuguuuuaaaauuaguaacaaugacacaugaaaaccaggauuggacuaagugauuuuuuuuuguggguuacaauucaaauuacuaauucuagaaaucauuucuauaucugguauuauaggguauuuguuaauauuaucucugaucugaguauauuuuuuguuuguuuaucuaggacuuugauuccugguuugauacaaacaacugccuuggggaucaaaaacuaguugagaggcuucauaugguaaguauuuuggaguaguguuaaagcauauuuaugaugggaaaaaggauaaagguuuaaauuaguagauuauuuuccuguuaauaaaaaacacaauggcuuaagaaucagaucugcuugaauucugacacuuaacucuuacaucuuacaaucaguguagggggugaugugugguuguuucaguguuagaaccuagaauggaauccugacuuaagggagaaaguauucucuuacaguuauacaaaauacaguggggggaagaagaauugcauaauaauuaauauagacaaguuuuuguuguuguuuuugagacagucucacuuugucguccaggcuggagugcaguggcaugaucuuggcucacugaaaccucugccucccaggcucaagcagucucuccccauucagcgucuagaguagcuggggcuacaggcucuggccaccaugcccagcuaauuuuuguauuuuuuguagagauaguguuucaccauguugcccaggcuaaucucgaacuucugaacucaaguuaucaaccugccugccuuggccucccagaguguugggauuacaggcaugagccaccacgcccggccuuaauagacaaguuuuuaaagcuuaguucaauuuacauuccauggaagaaucuaacagguucacuuuugaaagggcuaaagauccaucuguuuuuucuuaaaucuagcuacauuguguauaaacaacugcuaauauugcauuaugagcacaguugguauguuuuugcuugcuguauagcuuuguuucuacauacagcuuccugugacgguucacaaguaaaaguugguagguagagaaacuucucuaacagacaccagauuaaaauacccugcuaagcagguuaaagcaggagcuuguaagaauguuauauaaagcccuuaaugaccuaacucaggaauucucagccucuuuugacauuuuggucuggguauaucugagagggguaaggagagaggggagaacgugauuguccuguguauuguagcauguuuaauagcaucccugauacuuuuacucacuagauggcaguaguaacauuccuccaguugugacaaccaaaaauuucucuagacauugcagauguccccuggggaacaaaauugugccccuccaugaccuaaccuuuuuaacauucuuuggcaucuguuuuacuucuucauauauugagcuuuaauuugauagauugcugaccccacugucaguuuucuguaaacauugugguaauucuaaucuauuuuugcuuaucauuuuugcuacaccuagaauccuuuuuccuggucucuuuacuaauaccuaguccaagacucagcgacaucaccuccacugaaccagccaggcugaggcuggccuaggugcccuucuguguauuccaucuuuaacaaucugagcauccuaauauuauaggacuuugcagaggauauugagaugauucacaaguguuuuccauacuggauuguaagcacaaaggcaggaagcacagauuuauuugucuuuguauaccuggcacaaugccuaguuagaguggauauuugaacagggaaaaaaauuuaaguucaugauuguucaaauauuucauuauaaaguacuuuaaaauucuuaaauauugagaguuuuguuaaauauuugaagguaguaauuuccuagcuaccuuuguuucaauucagauggcauucaugcaucuaagcacucucuuuguauuuacuuagaccaaggauuguggaguguauauguaaucuuggggguagaaaaggaggcagaagaacaugauuuuuuuucaugcauuuuuuuccccuuauuccucugcucuuggcuuuccuuuaguaaauacguagguacaucuagguaaagcaaaugaacaacccauucagcaguaucaaccagauuugguaacucuguuuuguucacaggguauuuugaaaaugcuuaugaagucagggagaagaggucuuguagcuaccucucuacuuucuccugcucuuuacuuugaaguuucuacaguagcaccuguggucuuauaaugaaaggaggguuuagaagucgguauggaugcgcuuaggaaugagauaacucuuauuugauguauuaguuaucuaaugcugcaaaagaaccccuuauucccuccaccccccaaaaacaccuuaaccccccuuuagggguuacuaagacccccuuauuucccccaccuccaaaacacuucauaguuuauauuuuauuaacaaccccagaauuuauggguugacuggaugguuucuuuguggauuacacuugggguuauccaguuacauuuauuuagcuggacaaugcuagaagagaaccgguggggcuaaaggucuucacuuacacaucuggcaguugcugccgccuguugacuagggcugaacuagcuuuucuacguggugauguuagagagguguugcugguauuuuucccacuaaugucuaauuugguuugugauauagucacuauuuuuaaaaaccaguguaaauagaacagagguacaaaaaaggguaucuuuaguuguguaguuaauuuuaaaacuuacuguucuaugaaaaugagugaacuacuacuacauauaacauggaaaugucucauuguuuaauaaaagaaaccagauauaaaugggugcauauugagugaguccauguauauaaaguuaaaaaugauaggcaaaauuaauuuauggugucuaaaaauaagaauauugcuuacccuugggaaggaaaagaggggauagugauuggaagggacacaaaaaugauuucuagaguguucuauuuggguaauaacauggguacuuuuacaguacuugaauaaaauuucuagaacuguacacucaugauuuauugaaguguguacuuuuauauucuuucccuaaguuaguacauuaaguuuaaagacuaaccauaaggagaucuuaaugagacccuuguccauucuuuuuuuuuuuuuuuuuuuuuuuuuuugagauggagucuagcucugucgcccaggauggagugcaguggcgccaucuuggcucacugcaagcuccgccucccggguucacaccauucuccugucucagccucccaaguagcugggacuacagguaccugccaccucgccuggcuaauuuuuuguauuuuuaauagagacgggguuucaccauguuagccaggauggucucgauuuccugaccuugugaucugccugccucggccucccgacccuugcccauucuuaggcacuguuagacagucugcaugcaaguaacuaguuuuagaccugaaaggcagcaaauuguugaaaacauuuuaaaaauuuacuauuguuuuuaguauuuuaugguaguauaacaaguauauacucaaacauauacaggcacaucucauuacccuuugcagugcuucacagauacugcauuuuuaagaaacauuuauuuugcgaaacaaauagaugguuuguggcaacccugugucaaggaagucuaucaauaaacaccguuuucccaacggcauguguuuacucuguuuuuaaagcaguaauguauugcuuuaaauaauguaucacauuuuuaaagcaauaauguacuuuuaaaauaagguguguacguuguuuuuuuuuuagacauaaugcuauugcacacuuaauaguguaaauguaacucuuagaugcacugggaaaugugacuugcuuuauugagguagucuggaacugagccuacaauaucucugagguaugccuuuauugaauaaguaauggucuuguauuacuacccuucaggaacccaguaguaauaaauuauauacaguuagcccuucauauccauagguuccacauccauagauucaaucaacuauggauuggaaauauuuguccccaaaaaagauaaaaauaaaauagaugguuccaucuguguuaaauauaccgaccuuuuccuugucauuauucccuaaacgguauaguguaacaacuauuaacauagcauuuacauuccauuaacuauuauuauaaguaaucuagagaugauuuaaaguauaugggaggauguuuguagguuauaugcaaauacuacauuuuuuauaauggacucgagcauuuguggauuuugguauucaaagggaaggggacaggaacuagucucccacagauacugagauaugacuguauuugcagggagaaguccuaagaaaucacuugauacucacgcagagaaauuucuuuuucauguauuuuauauacaauucuaagaugcugaaauaugaccuuauguguaauauugguauuaccuguuuauuuuuguccuuuuuaagguuuugcguccauuccuccuucgucgaauuaaggcugauguugaaaagaguuugccuccaaagaaggaaguaaaaaucuaugugggccucagcaaaaugcaaagggaaugguauguauucucagauguacuugauagcacuauugauucuucccuaaauuucauguguauuuuguuuuccuaauuugugucuucauggaauuccaauuugcuggauugaacucaaccugaaaagaguuuucuugucacguaguauaggacuugcucauuaaguucguuauagaaaguuuugaaccuguuagaugacagaaucaggauggaaggcuuaugaauccaaaauuaaaauugggauuuaauuaaacgggguucauaugaaaccaucuacuugggauuuuuaaaaaggaaacugugauagcacagugugggagauauaugguucacuuauaguucauaaauacugggucaguguaaaguagcugcagaaaaagauacuguuggccuuaauguaaauguaguguucaaaggagaggaaauaaauauagcuacccuuuucuuuacuggucucaucauauuucauguauauuuaacugcauacuuaaauuuugauaaguauuugcaagaggccagaguuguuugguuaaaggacuuaauaucauauagagaacugggcauguuaucuggguaagagguuaucuguagaaggugguugguccuaaauguccucaaaaacuucugaaaggguagcagauauuaggcuuaccuuggauggcucuaaaacagaacuaagaugagucaaugcuaaggaaagacaaaucuuuuuuaguuaaacauuugagugaacuuuauaucagaauugagauggaaaggucugccuuguuguuuaagcauagauugccuaggcuacuuacuuuguucaaaggauccaaggcucuaaaacuuugaugcuuagacaaauuacucauucuuucauaacaaugucuacauccuuaguauauguucaaggcuuuuuauaaucuggccuuagcuuauggcuguagcuucacaguccugccucacagacauaccucccucccccauguauuuauacguauguuuaagucacguuguauucauauuauucucaucaucaugccuuaccauuucauuauucuuccugucuucucagauguuaggguucuuaccuaaaugcuacacuagcuaugggguauauaguaaucgaauaguggcacuuucuguugcaaaaaaacugcaaacuaaaauuauguuuaaaacuuacauuuuuuaaguuuugcuuuauuacuuaaaaauauuaugucuuacugcuguaauucuacccaagggaacuguuuuuguacuuuaaaaauaauauccucaaggcccaaggcguaaguaugaacauuauaaugcuauggacaguaaagaaaaauggaagcaaaaagagguuacagauguuaaauuccuaaccauaccuagaaguugaugaguaguuucuuacagauauuuggggguucauguggggaaggggauuaaguauguaaaguggcagggauugaucaaggaacauuugagcucuaaaaauguuuuucuucuuugaauagguauacucggauauuaaugaaggauauagauauacucaacucagcaggcaagauggacaaaaugagguuauugaacauccuaaugcaguugagaaaauguuguaaucauccauaucucuuugauggagcagaaccugguccaccuuauacaacagauaugcaucuaguaaccaacaguggcaaaauggugguuuuagacaagcugcucccuaaguuaaaagaacaagguaucgguuacccguaucaaauuaucaaaacuguuuuaaaaugcucauguuaaaacaaaggagcacuguacuuugaaaugacugcucugaugcuuuccaagguugacguguagaacauuaaaaaaaccuguucauuaucugagcucuaacccccacuccugauuuuaggccuuaagucucuuagaagguaagcaauaguuagagcaaccauacucccuugauuuugggaagaguucauacuuuauauauacuuuccuagaaauuauagcuuucugucauaaaaugugaagaaugcaucucccucccacacaugguuaccagauccauuguuagacaguggugguguguucaugauauuguuuuuuaauuauuuauguggaguuuuaauuuaauaagguaccauguacauggaccugaaacauuuuuauuuguaguaugcugacuuuuuuuaugaaaauggguaugucuguguuguguguuuggguauauuuaaauuacacgaaugcagaaagaacuuagaagccagcuucugauuuuaacuaauaaaaacguuuuuagucugcuauacccuuccuccucccagauuauucgaagcaaacgccagacacuauagccuuucauaaauuauuacauaucucuuaaagauacgaaauaucacugcuauaguauuaagugugcagauucaaguuuguguuucucucuauauuuuaauaagaaugacauuuggaccaguaggugaaucuccucuaugauacuaucaaaagcauguuguaagaguugucagugaauggguuuacuuuuuccuuuucauaccuuuuuguagagauagauuuuuaaaaaaugcuuuccuugaaagcaaaguaauuaaaggaguuaaauugguggggaggaguggcaggaacguggugggaauacucagauauuaaugaaagguauauuaaacucugcagggaaaauggagacuauuaaguagucucaugucccagcacuuuuuggaaggcugaggugggcagaucaccuaaggucaagaguuugagaccagccuggccaacauggugaaacccugucucuaucaaaaauacaaaaaaaguuagcugggcaugguggcaugcaccuguagucccaguuauuuggaaggcugaggcagaagaaucacuugaaccugggaggcagagguugcagugaacugagauggcgccgcugcacuccagccugggugucagagcaagacuccaucucaaaaaaaaaaaaaaaaaaaaauucuuaugcauuugaggugcaggaacgugugacaacagcagauugucagccucugcuucuaggacaggaucauuucauaaucauuacuuuucaaaaugauccuuugucuugauauauucuacugaagguauuauguagcugccuaaagaaguggaaggcagucggauaguuugaaucauggcagauaagugauaagugaaggauagucauuguagauauaugaggcacauauuaugguccuuugaucuagaauggaucuucagaaccaggcugagaccaggauuauuagguguguguuggagguuuggggagucauaugcauugaagaguuguugugaaguaguggaaaguuauuuuuaaauguauaugggguaacaagauaaugauuaucuuacccuuugggauggcaaagccuuccagaccagaggcaaauaugcuuuucuguacaaauguuacccuuuuuuauuugugccauggugagaaaaaagugggaaaugacugacuuggauaauaauguguagauuuuuuucccccuuguaaccaaguagguagcuuuggaauuaaggauaauugauuagucuuaguuuugguuacccuuaaauuuuucuacuuuugaagccacugauaauagauuguuauauuccccaacagguucacgaguacuaaucuucagucaaaugacaaggguauuggacauuuuggaagauuauugcauguggagaaauuaugaguacugcagguuggauggucagacaccccaugaugagagacaagugaguaaaauuuggggagggagauaaaaaagaaucagauaaauuuuuugacaaccauuuuguuuuauccauaggacuccaucaaugcauacaaugaaccaaacagcacaaaguuuguuuucauguuaagcacgcgugcugguggucuuggcaucaaucuugcgacugcugauguaguaauuuuguaugauucugauuggaauccccaaguagaucuucaggcuaugguaagagauaacgaauaaauauauucugugcuuaguagauggcguuaguuaggacaggcuaauucuacaaauaucagugacuuaacccaauagaauuuuauuuuucucuaaucuaaugguucagugagaguauauugaggugaucuuccaucuaaauaaggguauuuccaucucagggaucugccauaucuuaggacccuggaguccucugcuauacugcauccuauuggcagaagggggaaacgauagaguuggggauuucccaggaaauucuuuaugggucagaccuugaaagagccuccuugucucuccacccccuugaucaaagaauuagacagaacucaaaucauguagcauaacugacugcaagggaauugguaaauuauaguauaguuauaucacaggaccaaagagaauuggguuugaugagcaacuagccugucuuccacuuuaguuauuuaaaagaacaccugugugagaguaccuggucagaucaggaagauuauuuuuagauugagagaauugauacugcagauuggccugacccaugauauuggugaccacaaacccaacuuuaaucucugucauuagucacuuucuuuuuuuuuuuuuuuugagauggaguuucgcucuuacugcucaggcuggggugcaauggugcagucuuggcucacugugaccuuugccucccagguugaagugauucuccugccucagccucccgaguagcugggauuacaggugugcgccaccacgccugacuaauuuuguauuuuuaguagagaugggguuucaccauguuggucaggcuggucucgaacuccucaccuucaggugauccacccaccuuggccucugaaagugcugggauuacaggagugagcuacuacacccagcccauuagucacuuucaucuuguacucuuacuaagggugacaggggaaaauggaccaauuauuagaaauaagggaguuuuuuaggaauguaguuagcaaaaguaaaacaaauucauauucagauuaguuugacuacuuguauauaguuaauuggguaauauuuaaagguuagaauuuuuguguuguuugcuaaguuguuucaugucacuucuuugccugauagcagugacaauuuggguuugauuuagauagaaaaacauuuugaauuuaaaccuaggaaaaaagacuuaaaaucuuuccucaucagacuuaaaaauuauaauguuguauauuguuuggagacauuauguguuuuaucucaguguaaccuagcagaauucaucugauuccuuacagaugcaguguuauuacaaauuuuuaaaaguuuuauauuucagaauauuuuaauuuuuuuucucaguguacccauuucaguguuauuuaugugacuuuuaaacuaaauucaaaauaacaugguaauuuauuuaggaccgagcacauagaauugggcagacuaagacagucagaguguuccgcuuuauaacugauaacacuguagaagaaagaauaguagaacgugcugagaugaaacucagacuggauucaauagucauucaacaagguaagccauggaacuuuaaaacuuuaccaaguuggauugacacaaccuguuuuuguuugaaaaucgucuuagaagauucuuguuacuaagcauccauugagucaagcuugcagccaguagagaugacuuguauugcaaauacaguaaacuuuaguuuugucauuaaaaagauggauuugggcucaggacaguugagguuugaauaaugagucugccaguuagcaguucucucugguuacaugaacccauuuccucaucuguuaaguggggauaaaaauaacuacacuuaaggauuuuaaaggauuaaaggggauaauguauauaaaauaucugacauucaguguggugguuaaugauuuauauguacuaacuacucuugauuacuguggggaaaacugaagaaauaaaaaucaaagagccugauuuuauucuuuuuucuugucugcaauuuacugaguacccaccagaugcuaggcaccguucuuggugcugagaauucagugguaaauggaacaaacaaguauucuuacuuucaaagaguuuacaauuuaguugggagggagagaugaaguaaacaaggguauaaguaggaguagggggugagagugggauuuuauuuuggaucaauugaaggaaacuuaaguucucauuccagaucagcuuuuaaggaugacauaauuuauguuuucaugaagccuacuauaaaguugaugaugggaaauauaaaauucaagaaaaggggugggaaacuuaauaauuucaagugugcauugguuuccuuuguaacugcauuugugagcauguauuuacuaucugucuauaaagcugaaaggcauacuguuacauuguuuacugauuauguagguaucuugauuuugucagucucugauguccauguaagagaguauuguacaugucuuugguaucccuaaugcuauucauaguguuagccauaugucugcauaccugaagacaauaaauuauugcuuauuuuuacaaaucguuucccuuaauaaaguguuuacuuugugccaggcagugugcuauauacuuaacauuucauuuucuccuuuagucuucaugccaacuugagauguuagcaucagagauaaaggcuuuugagagguuaaauuacuuguucauuguacauacagcugggaagugacucaagggggaucaagaacuuuguuaacucuuaaguguuuaauuagaaaagucucuggggacuucucgaggcugccaccccgugauguuaucucaugggugauauaauggcuaauguuuuauuuuucuucacacauccauguguuuugaaauacaccugccguguguuucuuguucucaguuauuuucauccaugaaacacuuuuuuuuuuuuugagauggaguuuuguucuuguuacucaggcuggagugcaauggcacgaucucggcucacugcaaccuccgcuuccuggguucaagcaauucugcugccucagccuccugaguagcuggauuuacagaugcccgccaccacaccuggcuaauuuuuuuguauuuuuaguagagacaggguuucacuuuguuggccaggcuggucuugaacuccugaccucaggcgauccacccaccucagccucccaaagugcuggauuacagguaugagccaccacgccuguccaaaacacuuuuuuuaaagauaaaaaagaccuuaauugauucauaauuaauuuagaaaucuugagguuuuuuuacuucauauuuacuguggcaauuuuuggagcaaaccuucaggcuaauagcuuucuugugccguuuguagacauguuagucaaacagcaagccuuaagugcauaccuuuguguuacuguuuuuuauuugagggacauaauuaaaaacgagaguacacaagcacuuuacaucugaagguuccggaaccuuccugcccaacuuggaaguaguuuguauaagcauaagaacauuuugguagcaaugguagcauccaauccaaggaaacauaccuuguggauaucuccucacuuacaaagucauggauguuuggcuguauauccuauuaugggucccaaaccaugauacaaguauuuaaagaaguuguugaaaacuuggaucuuuuuccacuuacuuacaaguugguuggcauauaaaaaucaaagcuuuguuuagguguaugugagugacccuugaggagggugaaaacaagucuuucuggguuuuuguuuguuuuuuuauaccuguauuuuugaaaaauuacaagguuguccaaacuccugccaacugaaaauauuuauuaauuuauuaauggugaguuucuucgaugauccagauacauuuucucaccaggugugguagugcaugccuuuaguccuagcuacuugggaagcugagacaggagaauggcuugagcagggaguugaaggcugcagugacuaugguccugucauugcacuccagccuaagcaacagagcaagacuccaucucaaaaaaauaaacgaauaaaauaaguuuuuaggaguuucaguucuucuggaaguuuucuuuaaaaagaaacugauguuacauauuucaguucuguguaaaguuuggccuaggugaaggauuuuuuacuuuacuuuucuaaggagaaaagcugauuuggggaguauuaguuaauaacaccuuucugcucaucagaaacuuguguguauaaugcuuccaucuguugaaacuuguagguuuuugaaaauuuuucauaugcagcuuucacaaaagauuauauuucguuggcacaguauacagcagguuucauuauauaauacauaagguuuaggaauguuuuguagcuuaccaacugaaaauuuggcauuaaauuuagugcaaaaaucaaaauuauuagaugugaauaaacaguaaacagaaaugauugacauuugagauaaaauuauaaagcauuaaaccuuacauuuaaaguuucaaguuuccaguaaaauaaagucuguucaguuaacauuauacaacacaaucuuuuuucagggaggcuuguggaucagaaucugaacaaaauugggaaagaugaaaugcuucaaaugauuagacauggagcaacacauguguuugcuucaaaggaaagugagaucacugaugaagauaucgaugguauuuuggaaagaggugcaaagaaggugagauguagauuaaauaaugcuuuuaauauagaauguuuuagaccagaaacaggaaauauuuguuacauugaugauaaauaauuuuauuuccuuaaagagaagcuuuuguguacgugaaguuaauuuauuuugacugcaguuuucaugcuuucuuugcugugaaucuaagaagcugauuguuuuguucucuagacugcagagaugaaugaaaagcucuccaagaugggcgaaaguucacuuagaaacuuuacaauggauacagagucaaguguuuauaacuucgaaggagaagacuauagagaaaaacaaaagguaauuuagaaauagguuuggguuacaugaaagcuuuauuuuacuggaaacuuggaauuuuaaguguuacuguaaugucuuauaauuuugcuuaaaacaguagucauuuuugcuuauucacaucugaauauuuucaucauuauguaaaauuuaaugccaguuuuucaguugguaagcucugaaauauuuuuaaaguuuuuguaaugaaguuugugguauauguuuacagugaaauauauucuuguaugggaugaauaguaauuugggaugguaaccugauucauuuuauuuuaaacagcagaauuggcugguaauaaagggaaaaauuucuuaacuucauaaguaauacuugguaauauagagauaaauugaaaaauacccagagauuagaagaaaaaaauaauucuacccaguguuuuucuuguuaauauuuaggucuauaucuucagaauuuuuuguaggcuaauuaugugucuacauuuuucuccuaguuuagauuuauaccaaacauucuguagcauuucucccucauuuaacaguuguuccuuuaagcaagaaauacugaaugcuuacucuguugacuagacacugucucguguuaauuauauacauaauauugagcaaaguaucauagucuccacccucauagagcuuauagcccaggauuuugugaauaucuuuacauuuacaaacauccuucuugaugaugauuuguuacuguguauaauaaaaguuggugauuugaguuguuucccaugugcuagauugcauucacagaguggauugaaccaccuaaacgagaaagaaaagccaacuaugccguugaugcauauuucagggaagcucuucguguuagugaaccuaaagcacccaaggugaguugacugacacagcauaaaaauaucuaaaaauuuugaaaauguaauuuuuuucauauauucuugcaaaaagauugauaauuagauuuuguguuucuuuuuuuuuuuuuuuuuugagacagagucucacucuguuaccaggaguucaguggugcgaucucagcucacugcaaccuccgccucccggguucaagcaauucuccugccucacccuuccgaguagcugggacuacaggcacccaccaccaccccuggcuaauuuuuguaauuuuaguagugaugggguuucaccauguuggccaggauggucuugaucucuugaccucaugauccgcccaccuuggucucccaaaguauugggauuacaggcgugagccacugccucuuuccuacauuuugcauuucuuuagaguguacucucuucuguuuuuaguuaacauuuuucaaaaauuaauuuugaaucugugcauuuaaaauuaagauauaaauucaguuuuauugaaagaugcauucaguugcuugcagaauuggcuguugugguuuaugaagugaggacuaaggauacauuuaaaaugaaauuucuuuuuuauggauaacacuuauuuuuguuuuucuuuaggcuccucgaccuccaaaacaacccaauguucaggauuuccaguucuuuccuccacguuuauuugaauuacuggaaaaagaaauucuguuuuacagaaaaacuauuggguacaagguaauugaaauuaucugccuuucuguucauuccuauccagaaauuauggaagguauaaacauuaguuauaaauauuuaucuaauuuggaccuagugugaaacaauacugcuuuagccuagucuaguuguauguaugaaauacauaaacuugggucuguuuuucuuuaacaagaaaaaauaagacuucaugaccaaucugguuuguuuuuaacauaauacaugcaauguaucaguauauuuucuuuccugguugaauugaaacuugugaaaugucaguuaguugguucaucacaugcucuuuaaaauuuacugauuugauggcauagaaaaauaucuuuuagguaccucgaaauccugagcugccuaaugcagcacaggcacaaaaagaagaacagcuuaaaauugaugaagcugaaucccuuaaugaugaagaguuagaggaaaaagagaagcuucuaacacagguauagccuuuaaucaguacaaacuuuaguaacaguuuguuguaaaggacuguguuagguuauguuggggcauaaaaauaaauacaaguuucugcuuuuaaagauggaauaauuggagacaauaaaguaugggcauguggauaaaugcuccaucugauugucacuaguugagguaguugagaagacuacagauuuuauuacucuggcucgguagaguggguaucuuuuuuaucaccuuacuuugaauguucccgucuuuccuaugaauuuuccacauugcuacccagucaccauuuucaacuauaaaucuuggcuugguuauuuuuuaaacauccuuugguguucaucaaggucuuucagaaucuggccuuugacuuaccuuuaaagcuucauuuuccuuccauuuuucuacuugcucauauuuuugcccuuuauguuauucacucuuucuggccaacugcuaguaauccuucaaagcucagugaaacugucaccuuuucauacaguauuccuuacucucagccacucauauuuaauugcuuggguauuugagcaauauauaauguguugucaaaaguguauauuuauguacacgaaaaguuaccacucuaaaagaacuuaauaaacuagugaaaauuuguuuuuguaauauuuagaagguuugcuaauagcauguuuuccaaguuuaaugugcugugauuaaauauuuuguuucuguuccugugaagggauuuaccaauuggaauaagagagauuuuaaccaguuuaucaaagcuaaugagaaguggggucgugaugauauugaaaauauagcaagagaaguagaaggcaaaacuccagaagaagucauugaauauucagguaauucuuuuaagcaggcuguuggaguuuaguaagagcuguuggaagguucuuguuuucuuauucugaauuauguugugauuagcuaauuuugucacaguguaguuaguaccuucuucauuauuuuuuacaaauuagaaaauguucuguuuccagaaauggcguaaugguuuccuuuuuaaaaauuuuuuaacccuagcuaacucuagcgacagcaaagaaaaucagaauaagucacuggauaauugcccuugcauuuuuaucuuaauuucucugcauaacuucaaguauuauguguuguguuuccugaagucaguuguauuauuagguuaacaugugaggguaugcuguggugagucugcuuagaauagcagaaauuuaagaauuagaagauaaauaauccaguugaucccauuuuuuuuacauuaaagaaauaaaaauauaaaugauuuguuuacuuuguccaacuuuuacagcuguguuuugggaaaggugcaacgagcuccaggacauagagaagauuauggcucagauugaaaggggagaggcgagaauucaaagaagaauaagcaucaagaaagcacuugacacaaagguaauuugcuuguuaauaaguuagguaguuaauaaaauaacuccuagcugugaguaugagagagugacuuuuuauaaaggaaaagaaguaaggguuuacaauuuaaaauuucuucagaguagcauucaaacaugguauugucagcagaauuuaccuauacacuagacugauagaucugagucaaagacacuaagauuagcuuuuuacuaaguagaaucaggaagucuuagucuguauuucucuuuauaauaauaaagacuauaaaggucuuucgggacaaagauuauauaaagcaauugaagugcucuagauagaaaauucugauuugaaaugcaacauuuuagcuaauuauacuaaagcugaguuugaaauacagauuauauaggauuuguauuuuauauaauauaaaaucugacuuucauagauuggacgguacaaagcaccuuuucaucagcugagaauaucauaugguacuaacaaaggaaaaaacuauacugaagaagaagaucguuuucugauuuguaugcuucacaaacuuggauuugacaaagaaaauguuuaugaugaauugcgacaguguauucgcaacucuccucaguucagauuugacugguuucuuaaguccagaacugcaauggugagugcucagggcuuuuuuguguaauguagcagaguucagaguaagugucaucuuugguauucuuuaaggugacuuuaaaaaaaucuaugaaguagacuuuuguuacaauauuguuaguaucauaaaaccuaauaccagggauagcuuacaaguuuauugguccuauccuuuaguaucuuacgucuuuaaauaucacuauaugauaagacuagcuuuucaaguucuaagugggaggaaguaucaguuucaacuucugaguguuacgacuuuuugguuuuucaaaugaacauauuucuauaaagaaaaaugguccuugcauucaagcaucugcacaucagaaucagcauucugauuuauuuaauauaaaucauccagagucuggauuauuuuaagauggcuuauuauagugaaacacuacuuuugcacugauuuagugcuagguuuuguuuuuauucccaauaucugacuaacaguuucugaccaaauagccccauuucuaauaaccuaaaauuugaauucagaaaaguuuaacuuugauggauugcuccuuuucuuccuuauuucaccaccauugaacuuugagcuucaacuuguuuucugccagaugaggauaaugcuaauaaguucuuuagucuuaaguuugggauauucugggauaagcaaaguuuaaacaucuuuguguuuguuuauaguaagauuucucuguauauuuaaaguaaaaugucacuuuguaagacaguggauaguaagcaguauuuucauguuugaccacugaaaauuuuuuuucacuagacaucacuguuugugauacccaaguuugggaaauguacuaaacuuaaauacaugaagauacuuugaagauaaaacacuguauaaauauauaauuagagaaaagauccaguugcugaaagcuuauuucuucuuaagugggaacaauuuauagaguuaauaaagaauaauuuuauagugauuguaacaagacagugccauguuaauuuaacuaguacaguaccguaauuuaaaacuguguuacuucuuaacauguuccauguuaagaugcacaaaaaaugauaauguauucuucuaucucuauauacuauuucuaagucuugugugguguauucuauacaguaguauuuuaaaauuauuuuacuguaguuguguguguaguaguaucacuuacuauaagaaaaaaauaauuuugcucuauaagaaagggggcugcuacccagcagccguccgugcagauggacuucuguuucuuucaggguuaacugcuacuucuauguuauacuuuaaaucuuuucuggaggcuguauguccaguuugccagagagagaugagguagaacucaucguagacuuccauggcugguuuuccaaaauugggaaaggugccaugugauugauugacuaccauaauucuagugauacuuugaagggaaagauuauacacaccuguuaaaguucuuguuguuuuugacccucacauaugugcacuauuaaucuuuuuaaguuuuggauauaaguagcacaguaguucucagacauacacacuaaguagcaguauugcauauguucauuuuuauugcuuuaauuccuaagugaaggaagaauuuuugaagaauacacaguaguuuggcuuuaaagauuggaguaaaaacauuauuuacaaauaucuugccuuuaaucuucauagcaugaauuguauaugaaaaucaguuguuuuuuuuuuaaaucagggguguauuagugguuuuauauauuauccuauuaaaacauaccuuguuuuaaaauugaaaucaugaaacuuguggauggaaagugcguguaccauguuuguuuauaauuuaggagcuccagaggagauguaauaccuuaauuacuuugauugaaagagaaaacauggaacuagaagaaaaggagaaggcagagaaaaagaaacgaggaccaaagccuucaguaaguauucaugaauauguaaauauguggauuauguaaauuuccccuuucuaaguauuuaacacugcuuggcugucauugauguguuagucccuguugugcaccccuccauugccuuuacuuuuuuuuuuuuuuuuuuuuccuuaagggagaacccaagcucauaauuugagauucuuccacuuucaaauuuagguagugguauaauuuuuaauuuuuaguuguuaugaguaaguauguauuuauagguuacaugagauacuuugauacaggcaugcaauaaguaauaaggacaucaggguaaaugggguauuuaucaccuccagcauuuaucccuguuacaaacaguuuaacucuuaguuauuuuaaaauguauaauuaaauuauuuauugcgguagucacuguguugggcuaucaaauacugggucuuagucucucuuuguauuuauuuguauccauuagccagccccacuuucccccacccccacugccuuucucagccucugguauccauccuucucucugucuccaugaguuuaauuguaguuuuuagcucccacaaauaagugagaacaugccaaguuugucuuucugugucuggcuuauuucacuuaauaaacuccaguuccauccauguugcugcaaauuacagggucucauugcuuaugguugaauaguauucuauuguguauacauaccauguuuucuuuauccauuuaucuguugauggacacuuagguugcuuccaaaucauggcuacugugaauagugcugcaguaaacaugggagugcacauaucucuuugauauacugacuuucuuuuggguguaaaccuaggaguaggguaacucuuaucuguaguuuuuugaggaaccuucaaacugcuuccacagugauuguacuaauuugcguucccaccaaaaguguaugaggguuuccuuuucuccacauucuugucaggauuuguuauugccugacuuuuggauaaaagccauuuuaucugggaugagauguuaucucauuguaguuuugauugcauuucucugaugaucagugauacugaacagcuuuuaauaugcuuguuugccauuuguaugucuuccuuugagaaucaucuguucagaucuuuugccuauuuuuaaaucggacuguuaggauuuuuuucaguagaguuguuugagcucuuacauauucugguuauuuauuaauccuuugacaaauggguaguuugcaaauauuuucuuccauucugugggaugucucuucacuuugcuguuuccucugcugugcagaagcuuuuuaacuuaaugugaucccauuuguccauuuuugcuuugguugccugugggguauuauucaagaaaucuuugcccaguccaguguucuggagaguuuucccaauguuuucuuguaguuucacaguuugaggacuuaaagucuuuaauacauuuugauuugauuuuuuuauauaguuagggauacaggucaaguuucauucuucuguguauggauauccaauuuucccauuaccauuuauugaagagacuguccuuucuccaguguauguucuugguagcuuugucaaaaaugaguuccauguagauguauggacuuuacggacuuaucucuggguucucuguucuuuuccacuguugcacugaucuauguaucuguuucuauaccagcaccaugcuguuuugguuacuauagcucgguacuauaaguuaagucagguaaugugauucuuccaguuuuauucuuuuugcuuaggguggcuuuggcuauuucuggguguucuguggguccauauaaauuuuaguauuuuuuuuucuauuucagugaagaaugucauggguauuuugauaaggauugcauugaaucuguggauugcuuuggguaguauggacauuuuaacaauauugaauuugcuaauccaugaacauggaauaucuauuuuuuugugucuucaguuucuuacaucaguguuuuauaguuuaucuuagagaucuuucgcuucuuugauuaauuccuggguauuuuauuucacguguaauuacuguaaaugggauuacuuuuuauuuuucacauucuucacuguuggcauagaaaugcuacuguuuguuguauguugauuuuguauccugcagugucacugaauuuguuuaugaguucuaauaguuuuuugauggagucuuuagguuuuuccaaauguaagauuaugucauuuacaaauagggcaauuugacuucuuuguuuccgauuuagauguccuuucuuucuuucucucgucugauugcuguagcuaggacuuccuugaaauacuuaaaaaguacaaauuuagcuugacuggguugugugggaaaaaucacuucuugaugauaugguaguccuuaauauggggcuucgugaaaaucaggaaaguaugucucguaaaugucaaguguguacacaucucauugagaauacaaguuauaauuuuagaauaauuuaagaaacauuggaaaagcagugguauuaugacuuuuacuguuagucucuaagcuuugauuauuucagugauguuuuagcaaugugaaggcaaacacuuaaagggaaaaaauguuauuuaauaauaguuaauuuaauaaaaaaugguuaauuuauaaagucaugaauaaaugaguaucucuggauaauauuugguacuuauguaacugccuuuuaaaaacucaaguguuucuuacuauuuugggaagcuugcauuuauuugauauugaucuacuacuguuaauugugcauuaguuuuauaacgucauuauuaacauuaacauuuuuuauucuguaaguaaaauaaguagguaagauuauuuggaggcuuuauaguuugcuuugaaagauuuauauagccugggggaaaagucucauaccuauuacuuuguaguaguuguuauuacuaaaguguuauaaugugucugcaacuauauuucauguuuauauuagucuugugaaaaguaauccuucugucuguuuguagacacagaaacguaaaauggauggcgcaccugauggucgaggaagaaaaaagaagcugaaacuaugaauauguuuuuguuucauaaucacuaacuuuaaaccaguaguucuuuaauuuacgggucuucauaagauguacuguacaaugcucaauuguuaugucauuuaaagacaucagguucaucuguuuacugagcuagaaacauaguauguaguuucacuuuuuuaaaugcaacagcugugcugaaauuuuuuuaucauuaacacuugaaguaauaaaauaggcuucauuuauu

SEQ ID NO: 14216 - RNA, 2714 nt, Homo sapiens
uacauaauuuuauuacaaaauuuuuuuuaaaaaaacgaaaugcaacauccuaaaaaacccaaaauuuacuauugauacuaauuccuacaaguuugcugugcuaccauacacaagaaauuaaaaaaaccauuaaauauuuaggaacauucaacaucagaagcuguaaaaucuaacuguaugaguagcccaucaaaaagcuacaaccugcauuuuuuaaaaguauuuucucuacagagaaucuuaucagcuauacaaaaaucuguacaguuuuuauacugaagcuaguauugagcugcacuugaauucacauucuuagcaaaauaauugccugagcacacacacacauuccacacgcaucauuaaaggauagccauuuauucuucaucuucauccucuuccuccucaucuucaucuucuucuuccuccuccuccuccucaucuucugguucguucuucuucuuugagccuguuggccugccagggcccuucuuuccugcuucacuuuugcccuuggcacgauaugcagcaauauccugaaauauugucaaaaaaauaaagcauccgguaucauuacucaacugugaaaaaccacuuaguuguaaacaaucuaagaugauugaccaauaacccuaauaacugucuaaaaagguaaccagucuaaguuuuuagagcacuuaucccacuaggcuuuaacaaguuaaugacguaaaaugacaaggguugcgauacagcaguaucaguacuuucacuaccaauacccuuuuacaucacacacagugccauagucccuccuguaccuucacauuuuauauauaucuacauaaaacaauuucuuugacucucugcuuaaaaaaaaaaauaacagacuauacagacuauacaauaacuacaaguaacuacaagucugucugcaggaauauacuagugcuacaaacacugguuucagucaaaaggaagguuucaauuaccuuguguugaaguguacaauuuucauuaggccuuuucaaaacauagcugacaaccauuaauacaagauuaacuaaauuucccagguuuucuacaguuauuaccuauaccuagucuuauccacggcuuuaaaaaagaugacacuguaccuuuucauauuucuccuuuagcuuagcugcuuucuguucauaugguuguuuaucuuuggcugacugcucagaccacauuucacccaauuucuuugcaguauccccaauggauaggccaggguguucacuuuugaucuuugggcgauguucagagcaaaacaggaagaaggcagaucugaaaggaagcaacagaguuuaauaaacugaaggaaaaauccaaggagcaauuuggguuauuuuaaacuuacgguggccuuuuaggagcauugggguccuuuuucuuccccuucuuaucaccuuugggaggaacguaauuuuucaucucccugucauagcgagcuuugucacuuuuugccauaucuucaaacuucgacuucuccuuugcagacauggucuguggacauaaaauaagagccaaaaauacagcaaaauuguuaccuauaaacauccaaagacgacaagaucaucuuuaaggaccacauuuuccuuaacagcauuuugcuuucgaagucuuauauaaguaaaaaccuaaaaucgucugccuggaacucuuaagauauucaggugagucacugggguggcaaaguugaagcucaugaguugccuacuaccugccuaaggcccuccuagccgaaaaccacaccugcacccccugagcuccgucccucuccugccucaccuuccaucucuccgaacacuucuuggagaauuccgcgaaauugacggaagaguccggguguuucuucuugugcucuucccggcaggucugcacgaagaaggcguacgaggacauuuugccccgcggcuuguuggggucuccuuuacccauguugacagauccgcguccaccugacggggccgaggggggagaggggaagccggagggucggcgcggagcccgcagcugccagggcgggcgcuggcggggcuccgcuucccgcccaaauccgcucccgcccugcccgcgccccccuccucccgagggcguccucccaagggcggccgcccgcgcccccgcccgcgccccggcgcacacccuccuccuccuccuccucccggcccgagcggccgcggcucagcccagcaaguggcucccggggcccgagacgccgccgcccgcccuucaccgaguccggugacuccgcaagcgcccucaaaacgccuuuccugacagaaaugucccccagcucccacgucgcgagccucacuuaaccgcuaagcaccucgugaccgacauugaaaacucccagaaccgggcccggucaggggcaguuuccgccuccuccgacugcccgccggcccuccacagacccagcccucgccggcccgcaccccaaaugccgcucgccgggucagaccccgagagccacugcgccgagaccgaguagaggcucugagggaauggggaaaggcagguccacgaacccgaggguauuggaggguauucuugccuggugcgagcuuuuccucagagucccgcagagcggccggacccaacggagacgcuucccucacggggcuccggcgugaacugguuuaucucuaacgcaauccucagccucuuguuuugcagaguucuccgcgccacggcaacuugac

SEQ ID NO: 14217 - RNA, 1569 nt, Homo sapiens
caaagcuuuuaaccauuucucagaccuuagaagacauaagauaauucauacuggaaagaaacccuacaaaugugaagaaugugggaaagcuuuuagccaguccucaacccuuagaaaccaucagauaauucauacuggagagaaacccuacaaaugugaagaaugugguaaagcuuuuaaguggucaucaaaacuuacuguacauaagguaauucauacuggagagaaacccugcaaaugugaagaauguggcaaagcuuuuaagcauuucucagcccucagaaaacauaagguaauucauacuagggagaaauuguacaaaugugaagaauguggcaaagcuuuuaacaauuccucaauccuugcuaaacauaagauaauucauacugggaagaaaccguacaaaugugaagaauguggcaaagcuuuuaggcaauccucacaccuuacuagacauaaagcaauucauacuggagagaaaccuuacaaaugugaagaauguggcaaagcuuuuagccauuucucagcccuuagaagacauaagauaauucauacuggaaagaaaccguacaaaugugaagaauguggcaaagcuuuuagccauuucucagcccuuagaagacauaagauaauucauacuggagagaaacccuacaaaugugaagaaugugguaaagcuuuuaaguggucaucaaaacuuacuguacauaagguaauucauacugcagagaaacccugcaaaugugaagaauguggcaaaucuuuuaagcauuucucagcccuuagaaaacauaagguaauucauacuagggagaaauuguacaaaugugaagaaugugucaaagcuuuuaacaguuucucagcccuuaugaaacauaagguaauucauacuggagagaaacccuacaagugugaagaaugugguaaagcuuuuaagugguccucaaagcuuacuguacauaagguaauucauacuggagagaaacccugcaaaugugaagaauguggcaaagcuuuuaagcauuucucagcccuuagaaaacauaagguaauucauacuggaaagaaacccuacaaaugugaagaauguggcaaagcuuuuagccaauccucaucccuuagaaaacaugagauaauucauaguggagagaaaccauacaaaugugaagaaugugguaaagcuuuuaagugguugucaaaacuuacuguacauaagguaauucauacugcagagaaacccuguaaaugugaagaauguggcaaagcuuuuaagcauuucucagcccuuagaaaacauaagauaauucauacuggaaagaaacccuacaaaugugaagaauguggcaaagcuuuuaaugauuccucaacccuuaugaagcauaagauaauucauacugggaagaaaccauacaaaugugcagaauguggcaaagcuuuuaagcaauccucacaucuuacuagacauaaagcaauucauacuggggagaaacccuacaaaugcgaagaauguggcaaagauuuuaacaauuccucaacccuuaagaaacauaagcuaauucauacuaggga

SEQ ID NO: 14218 - RNA, 2686 nt, Homo sapiens
aaaaaaacgaaaugcaacauccuaaaaaacccaaaauuuacuauugauacuaauuccuacaaguuugcugugcuaccauacacaagaaauuaaaaaaaccauuaaauauuuaggaacauucaacaucagaagcuguaaaaucuaacuguaugaguagcccaucaaaaagcuacaaccugcauuuuuuaaaaguauuuucucuacagagaaucuuaucagcuauacaaaaaucuguacaguuuuuauacugaagcuaguauugagcugcacuugaauucacauucuuagcaaaauaauugccugagcacacacacacauuccacacgcaucauuaaaggauagccauuuauucuucaucuucauccucuuccuccucaucuucaucuucuucuuccuccuccuccuccucaucuucugguucguucuucuucuuugagccuguuggccugccagggcccuucuuuccugcuucacuuuugcccuuggcacgauaugcagcaauauccugaaauauugucaaaaaaauaaagcauccgguaucauuacucaacugugaaaaaccacuuaguuguaaacaaucuaagaugauugaccaauaacccuaauaacugucuaaaaagguaaccagucuaaguuuuuagagcacuuaucccacuaggcuuuaacaaguuaaugacguaaaaugacaaggguugcgauacagcaguaucaguacuuucacuaccaauacccuuuuacaucacacacagugccauagucccuccuguaccuucacauuuuauauauaucuacauaaaacaauuucuuugacucucugcuuaaaaaaaaaaauaacagacuauacagacuauacaauaacuacaaguaacuacaagucugucugcaggaauauacuagugcuacaaacacugguuucagucaaaaggaagguuucaauuaccuuguguugaaguguacaauuuucauuaggccuuuucaaaacauagcugacaaccauuaauacaagauuaacuaaauuucccagguuuucuacaguuauuaccuauaccuagucuuauccacggcuuuaaaaaagaugacacuguaccuuuucauauuucuccuuuagcuuagcugcuuucuguucauaugguuguuuaucuuuggcugacugcucagaccacauuucacccaauuucuuugcaguauccccaauggauaggccaggguguucacuuuugaucuuugggcgauguucagagcaaaacaggaagaaggcagaucugaaaggaagcaacagaguuuaauaaacugaaggaaaaauccaaggagcaauuuggguuauuuuaaacuuacgguggccuuuuaggagcauugggguccuuuuucuuccccuucuuaucaccuuugggaggaacguaauuuuucaucucccugucauagcgagcuuugucacuuuuugccauaucuucaaacuucgacuucuccuuugcagacauggucuguggacauaaaauaagagccaaaaauacagcaaaauuguuaccuauaaacauccaaagacgacaagaucaucuuuaaggaccacauuuuccuuaacagcauuuugcuuucgaagucuuauauaaguaaaaaccuaaaaucgucugccuggaacucuuaagauauucaggugagucacugggguggcaaaguugaagcucaugaguugccuacuaccugccuaaggcccuccuagccgaaaaccacaccugcacccccugagcuccgucccucuccugccucaccuuccaucucuccgaacacuucuuggagaauuccgcgaaauugacggaagaguccggguguuucuucuugugcucuucccggcaggucugcacgaagaaggcguacgaggacauuuugccccgcggcuuguuggggucuccuuuacccauguugacagauccgcguccaccugacggggccgaggggggagaggggaagccggagggucggcgcggagcccgcagcugccagggcgggcgcuggcggggcuccgcuucccgcccaaauccgcucccgcccugcccgcgccccccuccucccgagggcguccucccaagggcggccgcccgcgcccccgcccgcgccccggcgcacacccuccuccuccuccuccucccggcccgagcggccgcggcucagcccagcaaguggcucccggggcccgagacgccgccgcccgcccuucaccgaguccggugacuccgcaagcgcccucaaaacgccuuuccugacagaaaugucccccagcucccacgucgcgagccucacuuaaccgcuaagcaccucgugaccgacauugaaaacucccagaaccgggcccggucaggggcaguuuccgccuccuccgacugcccgccggcccuccacagacccagcccucgccggcccgcaccccaaaugccgcucgccgggucagaccccgagagccacugcgccgagaccgaguagaggcucugagggaauggggaaaggcagguccacgaacccgaggguauuggaggguauucuugccuggugcgagcuuuuccucagagucccgcagagcggccggacccaacggagacgcuucccucacggggcuccggcgugaacugguuuaucucuaacgcaauccucagccucuuguuuugcagaguucuccgcgccacggcaacuugac

SEQ ID NO: 14219 - RNA, 12640 nt, Homo sapiens
acuucggaucgccgaguaacgcucaccagacgucccggcccugccccucaccugaccaaucaagacggccggccgaggccccuggaacggcucaggcggcugcggcugcuacggcggcgcaugcuaggggauucugccgggugagugcugggcggcaggacugggguggggcggaagggcucggcaggaggccccacgugcauucccgcgaggggcucgggggccgcaguggaaaagaaggguaggcugcaucugccucugcgggggucccgccucggcguccgcccgcucgcccucuguuacuucugcggccccgguguuucuggagcgucgcuuucccggugucuccgcucagcuuuucccuuuccaaagcgcggccggggccaggggagggcaaggccugcugugcccuuugaccccgugcgaaaacggcgacccucugacuauagggguguggcccagagccacuuggccaguuaggggugggggccgggaucuuuguccugcggaucaaacaguuggccccucuggacugcaucuccgugccccccggcccugcgggguaauauacgugugugggggagguuccgggguagucggcuacucugugcuccagaccuugcacccgauccugaggauccuuggagguggggggcaagggcugggaggaggaggcggaguuuucccaggcucccccacacuuccagggaaaggcuuuccaagaacccugaacucauggacccuggagucaaauuuugguucagaucuagccucuugcuagcugugugacuuggggcaaguugcuuaacuucccugagcuuugguuucuucauauguaaaaagaaagugaaggaggaagggagggcaggaaaggaggaagaaucccuuuugaagccugauuuguguuggacucaccaguuauaaagcaagcuuguccaaaccacugcccaggaggcggagguugcagugagccaagaaaaaaaggaagcaugcccuugccccagccauuuugguaauaauagacguuuauugaaugcuuacuguauaccacuguaagcacuguauuaaguaagcacuguacugagugcuuuguuuuuuguauuuugugugugugugugacagucuugcucugucacccaggcuggagugcaguagugugaucuccacucacuacaaccuccgccucccagguucaagcgauucuccugccucagcagccuccugaguagcugggauuacuggcgcccaccaccacacccggcuaauuguuuguuguuguugcuguuuuugagacggagucucacccugucgcccaggcuggagcgcaauggugcgaucucggcucaccgcaaccucugccucccggguucaggugauucuccugccucagccucccgaguagcugggauuacaggcgcgugccaccacgcccggcuaauuuuugcauuuuuaguagcgacgaggucucucgccacguuggcuaggcucaucucaaacuccugaccucaggugauccuccugccucagccucccaaagugcugggauuacagacgugagccacuuggccuguuuuuuguuuuuuuuacagugaugcaaccauggcucacugcagccugggucuccugggcuaaagcuauccuccugaguagcuggggccacagacaagugccaccauggccagcuaauuaaauuuuuuuuuggccaggcacuguagcucaugccuguaaucccagcacuuugggagaccgaggcaggcggaucacaaggucaugagaucgagaccauccuggcuaacacggugaaaccccgucucuacuaaaaauacaaaaaauuagcugggcgugguggcaggcgccuguagucccagcuacucaggaggcugaggcaggagaauggcgugaacccgggaggcggagcuugcagugagccgagauugcgccacugcacuccagccugggcgacagagcaagacuccaucucaaaaaaaaaaaacaaaaaaacaaaacaaaaaaaaauguuucuacaaauguuguccaggcuuaacaugcuuucuuuaauucuaacaacaaucguaugagguagauacuguugucguccagcagaugaggaaacugaggcacagagaaguuaaauaacuugccugaggcaguacaguuaaagagugucgaaugggggucucuggcaccacagggcacccuacugagccccguguccugcugucuugacuucagguagaagagcugggccuggaacccagcccugaggacauccugcggcccaggggcaagugacaccugcugagagaggcccaggaugguggaggcugaggaacuggcacagcugcggcugcucaaucuggagcuccugaggcagcuguggguggggcaggaugcugugcggcggucaguggccagggcagccucggaggugcgugcccgccuugggaaccccagaggaaggggcuaccugaccuucaggccagcauccaggcuucugggcucaucuuguucaauacacccauuuuacugaugaugggacauugagggcuggggagggaagagacuggccuuggucacugcugaggccggagcaggaugaggaugcuugccuuggugccuggcguaggcccgguggguagguucuggcagccacucccugggugacccggccccucucuccagucaagccuggaauccagcagcagcuacaacucagagacuccaucgaccccagagacguccucaacuuccuugagcaccuccugcccacggggccgguccuccguguggggcccaccagaugccugucgaggggaccuccgugauguggccagaucggggguggccucucucccaccugccaaaugccagcaccaggagucccugggccgaccgagaccccacucagcacccucgcugggcaccucaagccugagggacccagagcccucagggaggcugggugauccaggaccccaggaggcacagaccccgagguccauccuggcucaacagagcaagcuguccaagguaacgugggagagcgggacaucugcugaugggaggagcuuccuugggccucaguuucccuaucugacacaugugcuuguggguagccucccuugcagaauaagaggcuccugggagauacugugaguugggucuugcucagccuaaaugcucgcuaggugguagcugugaguaucucauacagugcuuugagaagaggccaggauuuguucacagccacacauaaaguggggccaaacguuucccuucuugcucuugugcccuuggcugagcccugggcugcaagucaggguguaaguuaagacacagucucucugucccucgaauugcggcuuccucugggccaggccucuuggcuuaguccuugucccucugugcuuccuuccucagcccagggugaccuucucugaggagucugcaguuccuaagaggagcuggcgccucaggccauaccugggcuaugacuggauugcagguaaggcgugcuguugcccugcacacacuuugccugggagugggagguggaggccugggauccuccaugcuccugucugagccuccacccggugcuguugcuuguuucucugaccgugccauccuccguggggagcacccucuuuuuuuuuuuuuuuuuuuuuugagacggagucucacucugucccccaggcuggagugcaguagugugauguuggcucacagcaaccuccaccucccagguucaagugauucucaucccuuggccucccgaguagcugggauuacaggcgagcaccaccacgcccggcuaauuuuuguauuuuaaguagagaugggguuucccuguauuggccaggcuggucucaagcuacugagcucaagauauccaccuaccuuggucucccaaagugcuaggauuacgggagugagccaccgccccccacagccaccuucuuuguuuucuuauuuauuuauuuauuuauuuauuuauuuauuuauuuuugagauagucucucgcucugucgcccaggcuggagugaaguggcgcaaucucggcucacugcaagccccgccucccagguucauaccauucuccugccucagccucccgaguagcugggacuacaggugccugccaccacgccuggcuaauuuguuuguauuuuuguuuuuuuuaguagagacgggauuucaccguguuagcucgccucagccuuccaaagugcugggauuacaggcaugagccaccaugcccggcuuuuuuuuuuuuuuucuuugcuuuuuaagagaagacaggccgggcacggugacucacaccuguaaucccagcacuuugggaggaugaggugggcggaucacgaggucaggaguuugagaccagcuugaccaacauggugaaaccccguaucuacuaaaaauacaauaauuagccgggugugguggcacgggcuuauaaucccagcuacuugggaggcugaggcaagagaauugcuugaacccgggaggcggagguugcagugagccgauauugcaccacugcacuccagccugggugacagagugagacuccgucuccaaaaaauaagcaagcaaaaaaaaccagaugagcagcagugagaagaagggggaaagaguagaacaaagaguuuggucugucacugacugugaguauacaauugcgauaacucacuaccuucacgccagccucugagcaccuucugagccguaucugcucucucaaccucaggcacugagacggugcaucuguugaaugaaugaaugagucccagcugccguauguuugaacauuuguuaugugccaggccccugcacaacuucauaccaaugccagcucuuuucacguuauuguccagcucuccccgacagcaaccuaaccucagcugccuucuggcugguuucccccuggccuaugucccauugcuguccuuugcauguguauguguguuuguguaaauacauaacauaaaauuuaccacuuuagcauuuuuuuugagaugaagucucacucuugucauccaggcuagagugcaauggcgugaucuccgcucacugcaaccuccgccuccuggguucaagcgauucaccugccucagcgucccgaguagcugggauuacaggugccugccaccacacccggcuaauuuuuguauuuuuaguagagaagggguuucaccauguuggccaggcuggucuggaacugaccucaggcgauccgcccgccucagccucccaaagugcugggauuacaggcgugagccacugcucccagccacauguagcguuuuuuaaguggacuguuaagcggcgucaacuaugucuacacuguugagcuaucauuacuaccauccaccuccagaacuuuuucaucuucccaaaaacuucucuccccauuaaauaauuacucccauucccccucccuccagcccuggacagucaccauucuacuuucugucccuaugaauuugacuccucuagggaccucauauaagugaaaucauauagccuuuguucuuuuguacuggcuuauuuuauuuaacauaacggccucaagauuuauucauguuguacugugugucagaauucccuuccuuuuuuuuuuuguuuuuuguuuuuuguuguuguuuuuuuuguuuguuuugagagagagucgcacugugucucccaggcuggagugcaguggugugaucucggcucacugcaaccuucaccucccggguucgagugguucuugugccucagccucccgaguagcagguauuacaggugugcgccaccacacccagcuaauuuuugcauuuuuaguagagaugggguuucacuguguuggccaggcuggucucgaacuccugcacucaagugauucuccugccucggccucccaaagugcugggauuacaggugugagccgcugugccuggcuggaauucccuuccuuuuuaaggcugagugacauucuguuguguguagaugccacauguuguuuaucuguucauucagggauggacacuugggugcuuuccaucucuugacuguugggaauaaugcugcuggugacaugguugugcacugucacuuuugacauagcagccagagggaauuuuuaaacaugggaaucagaucaugucacuccccuacucaaaccuccccaugggcuuuucccagcacuuacuguaaaauccaaaaucccuaucuagacuuacgaggcaugaucuggccucuacuggccccaugaugugaccucccgucuuucuuccagccucgcggccuccuccuuuuuuauuuuuauuuguuuucucuguugcccagagucaaguccagugguguuauuucugcucauugcaaccuccgcuuccuugguucaagcaauucuuccucagccucccagguagcugggauuacagacguccacuaccaugcuuggcuuauuuuuguauuuuuaguagagacgggguuucaccauguuggccaggcuggucucgaacuccugaccucaggugaucugcccgccuuggccucccaaagugcugggauuacacacauaaugggguggccacaggcauggcaggaccagaaaggaggccacgaccaggcaugguggcucacgccuguaaucccagcaauuugggaggccgaggugggcgaaucacuugaggucaggaguucgagaccagccugagcaucguggugaaacucugucucuacuaaaaauacaaaaauuagccaggugugguggcgggcaccuauaaucccagcuacucaggacgcugaggcaggagaaucauuugaauccaggaaguggaggcugcagugagcagagaucaagccacugcacucuaacccgggcgacaaagugagauucugucucaaaaaacaaagacagguguacuguggaguugcugagagcaacugguggcggggacacaggcccugcccuugaguacuucuugaacucucagcucacugcccuccuuccugguucugggaaaauggaagcgccugucccaguaccugcucuugguccaugcgcucugcuccccugccuuugccgaggugacuguccaugcugccaccuggacccuggcccugcuccagcgugcuccgccccucugcuucuggcuccuccaggguuuccuuccugugauccucucccucucuguccugcauccucauccugccccuuagcaugagcaugaacgugcaggaagcauucugggagcugguuguaucucaugcucccugcaccaggcaccgcuccgagcugugcuuccuguuccucccgcugacuccuuugcccuucaugauaagcuuauuagguaggcaccaccauggugcccauucacagaugggaaggcugaggcccggugagacagaaucuuaccagcagcucacauccagucgggguaaagccgcugucuguuauuucucaucccgaugccacauuccuaccuuuagcccacauuugcuuccagugacugccuguuuucucgauaacaaaacuuccucuucaaaagggcugucuagccucguugccuucaauuucucuccacuacuauuccuuuucuuuuucuuuuuuuuuuuuuuuuugagauggagucucguucuuucacccaggcuggagugcaguggagcagugaucucagcucacugcaaccuccgccucccagguucaagugauucuccugucucagccaccuaaguagcugggauuacaggcaugcaccacuacacucagcucauuuuuguauuuuuagccagagacaggguuucgccaucuuggccagucuggucuggaacucccgaugucaagugaucugcccgccuuggccucccaaagugcugggauuauaggcaugagccacuguguccagccuccacuacuauuucuuaaaucgggcuucagcucccagcauuucaucaacauggcccucaguugggucaucaguggccuccguggugccaacuccccagcuuagcccucauccacaucuuccuuugaguagcaggggacacaguggucacuccugaagcacuuucuccccuggacuuccagccacuugcuucccgguucucccccaucucuguuggugcuccuucccaggcuucuggggaaggaaagguccuuguucugacugcuacaccccuaggccugggacucggucuucugacuccuccucucuaucuucccucuaugaucucccaaacgcugagguguuuggacacuuucucuacuucuccauuuguaucucuagcccgcaccucuccuccgaauuccagacuuguauaucccacugucuucuccacaucaccaugaaguuauuaaccuucuguccgaaaucaagguccugauuuccacugcugugcuccuccugcagucuuuccugucuccauaaauggcaacuccaaauacuaaauaggucaggccauaaacuugcuggauuuaccauccagcuacauccugauacacccaacauaaguugaaaauacuguuuaggccgggugcgguggcucacgccuguaaucccagcacuuugggaggccgaggcagguggaucaggccaggaguuugagaacagccuggccaagauggugaaaccccgucucuacuaaaaauacaaaaauuagcugggugugguggcgcacgccuguaauuccagcucuguagguggcugagacaugagaaucgcuugaaccugggaggcagagguugcagugagccgaggucgcuccacugcacugcacccugggcaacacggugagauucugucucaaaaaauaaaaaaagaaacauccuaagucgaaucaugguaaguugggggcugccccuaccucuccccagcugaauccuaaccgaugccucugcuuccccucaacuugaagcagccagaggaggaguucuguaaaaauauguggcugaugugguugugucccucccauuccccagacccucccugggcuucuuaaccucaucuccuccacccucgcugccuuccugccacuuuccccuccuggcuguuccucagcugaaccaugcacaugcccaccccggggccuuugcgcuugcucuuucaucucccugcgauguccuuccugggaggucucuguggcuucuccaugucucugcucagggucaucucacucggagaggccuucccugguauggcugcccggccauacuaggcucugacgcugcucucuugcuuucuggcagguaucagcauucagucuuguaucacggguuuuuuuuuuuuugguggcuaguucaucucuugccaccuuacaguguaagccucauuaaggccaggggcuuugucugucuaguuccuggcacaugaaacagcaucuagcccugucauaagggcucugucgauauuuuuuccauggaugguuggcuaugcaucaggguagacagacacugaaaccaaccaacagucccagugacuggaggggcccuccuggccuguuugaggcacaguagggaugaagcagguggccuggggugccagggcugaucgucucuccaagccuuggccgguggccacacagcagcccccagccccucucccgucagcugccuggugcuuugcccacaccagggucucuggacaccagcucuuccaucaccagccagccugaggccuucuucuccaagcugcaggaguuucgggaaaccaacaaggaggaguguaucugcagccauccugagugagcaggggcgggcgagggugggcgagggcggcugagcggcuccaucccccggccugcucaucccccucgcccucucagaccccaguugccaggccugcgugagagcaguggcagcggcguggaggaagaccaugaaugugagugcgggcccucggcuaggccgcugaguaguccagccucgcgcugcccuggccuccccugccccagagcagucccauuugagguuuggggccuggggaggccccugagauguugagacucauggagggaggccugcagucuggacaggguggccaagcccugguagggguggagugagcuaaggccuggccaccgaauuaggggcugcccuguguggcaccaucccacccuccccagcagugccccugugcuggugggacuccaucccagcuccugagggccccaggaggaugucccuccccaccccuuagggcgugggccccagguucugggaggaaagggguuaggaggaaaugggccgaagggcuucccagagggauuggcagcuugugugguugggggccgcugagggcagcacggagccuggggaccuggguuccuggcucagggagagcuguggcuucucaugggccucgcaggcguguacuguuaccgugucaaccggcgccuguucccggugccuguggaucccgguacccccugccgccugugcaggacaccgcgagaccagcagggcccugggacccuggcgcagccagcgcacgucaggugagugaccagaguauugggacaccuugggggacagagccugaaccacugguuuuaagaaaagaugggccugggcgugggcccccaaccgcugggaggcuccucaggggucccccacugccccccugcgcagggugagcaucccgcugucgauccuggagcccccgcaccgguaccacauccaccggcgaaagagcuuugacgccucugacacacuggcccugccccgggugagcagccacguggggcuggauggugaugagggcggggcuggcucagacuggcccagauccccagggagggucacagagcgagacugggcucgacaagggugagcgcccaagucucuggagcacagccugggccucuuccaucacccacaccuguaccuaagggagguaggacccccgcuccacguaccccggugcuuccagggugaucugccugcaggcuggcaugacaugaauggguccuguuuauugcgcuuuuguguacugcaggcacaguccuuagggggcuuaucucauggagcccccacagcagccaggaguguaggcacugcuguacccccacccugcagguggggagaccgaagcagagggggaggcgccuugguggaggagcugggauucgaaccuaggucucugugcugcugcugcugcuuuuuuuuuuuuuuuuuuuuuuugagaccgaguuuuguucuuacugcccaggcuggagugcauuggcauggucucagcucacugcagccuccacuguagucccagcuacuugggaggcugaggugggaggaucgcuugaaccugggaggcagaggcugcagugagcugagaucucgccacugcacugcagccugggugacagagugagacuccaucucaaaaaaaaaaaaaauguccuuuccugugucuccaggucgggauggggugccaguggcaacucccccugacuccuaaauugagaguagggcagcuggggucagaggaggagaaggaugcagaggaaagucaguuugcugguccguaaaauggacauaacagcgccauccucagggauguugguggugagguggggcuguugagugaagcaauccaugcaggugcuuggagagccuacagcaggaaguacccugugaaugucacugucaccguccuauccuccucccauuucagcucucagggccccagggauggcuggaucugccaggauaagaaaggggagagcugggguagucuuguggguagacacaggcccugccuuggugggggccuccuuccuaauggggggcacaguuccucccugaugggggugugcccagucagcggggagcuugucccaggucaggcacuuuuaacuccuugccuuccacagcacugccugcugggcugggacauuuuuccuccgaagucugagaaaagcucagcccccaggaaccuggaccucugguccucugucuccgcugaggcccagcaccagaagcuguccggcaccagcagcccuuuucacccgguacgguccagaucgcauccuagccuggggugcccccuagagggacagagaccucgcagcaggccuggggacugcagagccuccugggggguaggauugagguggggaggauggagccugggagugucucucugcaggguccagcccuccagcccugacccuagccaucccucggaacuccucugcucccugccgccugcccugcuccacccaggaaggccacccugacugcaagauccaggagggaauguggcuggaacuggggaugaccugucccuuucaaguggccccccugagacuucccuauuccccauccaggccucaccaaugcagaugcugcccccgaccccgaccuggucagugccccaggucccucggccccacgucccacggcagaagcccugaggacugacuccugggggagaacagcauucccgccgccuccagccucuccccucuggcaggcgcacccaggagauggaauccccugcccgcccagcucaggcccagcuguccuagguugggcagguggguggacccaagcuugucugcugccugaguuccagagagggaggacccugggguggagggugagggauucuguggaaguuuguaaauaaagcucagugcucugcagcucaagucccac

SEQ ID NO: 14220 - RNA, 3059 nt, Homo sapiens
caguaccccaugaagguaguuuggcucauuugcccaacugugggaggaaccgaaggugcacucaagagcgagggcagagaagccaccaagcagcagggaaaagcagccgccugccaaacagacggcaaaacccacacgaugcacauuuggcaccuguccuagugcagcuaguucagaggcggcucacaaggaaggccucugugcaguccuuuuugaucugacuuuugauuuuucuucgaacuugaggaacucagcccugucucccacucuucugcucuuucaggucaaguucugcuuccuuuuccaaguccuggucuugggccagaaacuagaagccgcaggcaucccuguggaugugaugggacacuucccauuucuccagggugggaucugggcucucugacuacuugggggcacagacgcagagccuaauauaccucucuacugucacuacaguuuaaaaagagaagauaaaggagaaaagaagagaagggaggggaggggaggaagaguagaggggaggagacgggauacaggaggagagaagagaaagggaaacagcucagcucuuugggaaacauuuucuucuacaacugcuaacaaaggccucccccuggaaucccugcuggucuuucuccugaggaagcacagaaggccgggcggcagggcacaguaggcagccucaccccgcgacagcaaugcugaugcuaagaugcugccccgaugacagucuugcagcaaugauggccaaaaucaccgcuuccaggggcaaacaugucucaggaaacuugagggcaaugcuucuguccuguguccuaugcuaacgagauggccacucugguccgaggccuggagcaaggggcugaccucugcaugccaugaacaggcacauggggggaagcuggggaucccgccagcaguucagacagaggcuucaagucaaucuaggggcuuguugcaguuauuuuuauuuuauuauuauuauuauuuauuauuuauuuuuuauuuuuuugagacagagucucacucugucacccaggcuggagugcacuggcaugaucucgggucacugcaaccuccgucucccggguucaagcaauucuccugccucagccucccgaguagcuggaauuacaggcaugcaccaccaugcccagcuaauuuuuguauuuuuaguacagaugggguuucaccguguuggccaggcuggucuugaacuccugaccucaggugaucugcccgccucagccucccaaaguacugggauuauaggcaugagccacugcacccagccucauuauuauuauuuuuagacagggucucacucugucaccugggauggagugcaaugguguaaucacagcucacugcagucucaaacuccugggcucaagugauccucccaccucagccuccuaaguagcugggacuacaagcgugcaccaucacgccuggcugauuuuuaaauuuuuuguagagacaaguccucguuauccugcccaggcuggucucaaacuacugggcucgaaggauccucccaccucggccucccaaaguguugagauuauaggcaugagccaccaggcccugccucuaauuuuuuuuuuuuuuuuuuuuuuacuuuuauuugcuuuuuuguuuuuugcuuuuuugagacagggucuugcucuguugccccagcuagagugcaaugacacaaucauaguucacugcagccucaaacuccugggcucaagggauucucccaucucagccucccaaguagcugggacuacaggcacaagccaccacacccagcuugcaguuauuuuuaaaugcugagauuuaugaugcgggaggaggggagggcugcccuggaaagccagaagaccaucaauucacaccuggauuuccagcuuucccuuccucgucgucuccucucaaaacacuugugcgcgcucucuggugucaagggcugagggcaucaggacacccauuccugcccaggccucacccccccucgccaggcuagccccuuccgagacacagggcugagagcaaggccaaggccucggguuucgaccagauggcggcuuccuaccuuacuccugaagaggggcuuggcuccaggcccacaguacucguuguagaugagcuugaagaggaagagguggaagagggugauuagggaggccacgcugaaccagaagaggaagggcagcccgggguccugcugggccaugugcucaucaugggccaggauggccuugaggugcagcgugugccgcagguccugcaggugugugaggucgguggagauguagagcaguggcgugaugggcugugucaccaugaccgagaagguguggcccgugggcgccgaggucagcuccacuggcucguccaggcagccugccuugcaggcauagaucuugacaggcuggccacgggacuccacggacacguguagguagggcuugcccucggcauccgccagcacggccagguugauauggucguucuuguagcggaugccaugcaaugcauagcuguugugcagcacgucggggucggccuggaacuggaggugguucucugugaacugcagccccccaaagcugagcaccauccccugcaggaugccuggggcacccaccuucaccagccccuugcagccacgcuucuggagggucagccuccacaggucagagagcugcaggaucugcuggacggaggacagccgccccggccacagguucucggcgugcaugguggcgugcccgcugaagcagugaucuucauaguugagcgucgacuccaucuggucucgcucccuguggcucagggaggggcugagcaguggggcuggcgagcaggagagcauguaauagagcgucagguucacggugaggccagacggcgugugggugucagugaucuucuucauuuccacuccugcaacaccaugaaagcggcauguuaagggggaaggacagcugggaggcagagcauacgaaauaaagaccaagggcagcagaagagugagguguugugccuuaaugauaaagacaguggugccc

SEQ ID NO: 14221 - RNA, 2099 nt, Homo sapiens
uaaaggagacagaggagacagaagacauuuuauucucacauguuaggguuacaaugagaacucccaaguuccaaagguucaaauaaaaauagcauuuuacaaauuaaaaaaaauacaauuuauauacacaguggaauuagcuaacaucauacaaacaaacagugcaaacagaaaaaaggaagcugcgacugcggcaauggccaagguccgcagagcuguggugcaauacugcacaucaauacugcagggcuggcgaggccaccuugggccucucgaaaggcuuuccugucacccagggucaugucagugcauaauucugcaucacaaaugccauacaguggacuggguccugaaagugucccuuccagcugggaacuguuaaguuaaucaaggucaggagcaaaucaucccucagcacaaggucccaaagccagggccgggggcccauuggccccacucccugaucaccucgccuaggggccauggaacaccaagcuggagaugaaacacaaaacaccacuucuuaccacccguaggcuccccauccacagaucugcuuuacugaggcgacugaucacugggugauggggcugcuaaugggugagaugcugaaaaggcugguuucuaauggacagaaauggaaggagcgagggucacaguugauuugucaugaguggagaaguugcugucuuugggcuuaucuggaaagcgcagaugcagagagaggagaaaaggaaaccacgugccuuugcauggggccuggguuuggggccuccuuggcagccguccagucaguuuaggggagggagguauuugcauucuacugucuaucucugggcuaaacugaugggaacaaaauaucuggugacuuaaacacaacaggaugugcacgagggaugaauuccaauaacauucaccggggcagccucagggcaggcggcugcugauccagcccucgagaggccgggguccuccugcagggcguuagcucugccagcuccaggaaggggcggggagaggggacaaagugucugugacaggugaucacaccauucuccugacuuggacaauuggcuuccuucuuaauaaaaggaagaaauaacgugaucaagcucugaacacugccauaaaacacagcagcagcuggccaaauaguaacauuuaaauaagaauugccuuuuugguccuugugauguccugcgcuauuuccugggaguauuauccccauuucauaagucaggugcauucugggaagcagaaacauuuagaagucaaagcaauuuuggucagggagauaagaaaauggggaaaauggaggggccacaaucagcuagaaaagaccuugaagcagccccaucucuggaguggaauuauucccuagagugugcugagcgcaagaucuggaccagcagagccaggacugaugcucaccccagggugaaaggcagacuuggccaaggaggucgcccagggcugggccugagagcugugcugccagggccaggugccgaggcccgugggcaaccuccacgguuuuaaaaaaaacuaaacguaaaugaaggccaucuugagccaaagcacgucugccccagggaugccugcugggacuaauaccauguagaaggugggggaagauaagcaugaaugcccaaugcccagaugcucacuuugggugccuagucagagggggcgggccagccuggagaagaaugacgucacugaacgacagggugcgcuucccaugcuucaugugaaaccuucaggcacgugcuggcaggaagcaucuuccccacgcacccucccugcggcacaggaggcccuccugaagggccucuguauguaagcuugggacagcuagugcaggggagagagagguguuugugaagggcagacacccucuuccucaaauaggccaucugcuuuaucauagcacauaccuuucaguggucacuggcucagaagugcuuccuuucuacuuuggaaaaaaaaugguagcauuccccagaguugagugaagcugcuuuauccaggagugcccugcuuucagcuaacuuuggugggugaugccaagauccucugagcucugccugcuucaucag

SEQ ID NO: 14222 - RNA, 21171 nt, Homo sapiens
gaaagggugagggauagagugagaaaggacuggagaagcuaaaacagcagcaugauaagcacaaaguccugugaggaagcucauucugaaaacgcuuguuucauuccaaacucuuuucagauggaaauaaaaggaaacaugggugggauuuacuggagcuggccuggauucucccucagauuccaggagggguuaugagaaaagaccccagacuuaggcacgugaagcaggguagacgcuucgagagcccuggcugcgguccccaggccccacccgcugccaccugcgggcccagauuggcccggccccacccccggcaacgccucucucagucccuuagcaaccgcccccuccccaggccgacuccgccggcuucuuaccagcuccucgggggugcgggucucacgcucaccgcagcagcagcaccaccugcagcagcagcacagagacccccugcaccccgccaucuuccuccuuuacugccacucuggaccccucuaccaacccccucccagccaggaucugcgccucacgugacuggccccgggacggucacguggcccucucgagcucugggacugagaccaggaguggcugcagacggguggggcgaggacucgcgucacaugacgauaaaggcacggccuccaacgagaccugugggcacggccauguugggggcggggcuuccggucacccgcgccggugguuuccgcccuguaggcccgccucuccagcaaccugacaccugcgccgcgccccuucacugcguuccccgccccugcagcggccacaguggugcggccggcggccgagcguucugagucacccgggacuggagggugagugacggcgaggccggggucgccgggagggagauccuggagccggcaaacaaccucccgggggcaaggacgugcuugugggcggggagcgcuggaggccggccugccucucuucuuggggggggcugccgccucccuugcgcacccuucgcgggauuaguguaacucccaauggcuaccacuuccagcgaccgccaacccucaagcgaagacugacuuuggcucccugccuggacggaggggccccugagccaggggugacgaucccgccccucugaccggcccaggcccguguccucgcccccaucggugacucagugaccuggugacuggauucucggccaccugggcgccgagacggcuuccggcuccugccuuuuaaaccugccuccccggcgaucaccuggagaagagcgcugggcccggggcacugcggucccuggcgcccacugcgucccgcugcgcacggggguccgccgggaccuuucugggagucguaggcuuaguaucccagugcuuggcgcagacuaguuguucaguaaguggcagaggcuuauuuugagagaguggcagcaccuggcccuuuggcgcucagugaauguuggcuaucaccgugugccaaacucuggggauaccccaggcaggacaccgguccugucucagggaacuggggaaagagaaaggagacaggccuuuucacccacaguuacaacccagggugcuaugggaguccagcugauaacggauaaaucgugggaguuggcuuacaaauauggcacaugcguggcauauacuaggaaugcaauaagucuuugaaaaucagaggguuuacaggugguucagcuuccuccuacucuagguucuguuccagcaagcaauuaacgaggugcgcccuuaaacgcuggaggaaagccaacuggcugcucuugcuguuacuccucccccccgcccccguuccucacuccccacagccauccccacugagaaucuggaguuugaggucagaaugaaagagagcagcccuagagggagaaagcuuuggcccaggguucuuagucuggaaucaacuccuugucuuuggauguauccccguguagucugugcaccuguguguguauuucaggggaagggagcagugcauuuaaucagauugucaaaagagucuaagaccccaaaugguuagguacacaggguuagugguggacagucugaaagaaaugaaccucaccugggcuuuccucuguugugccaugucaccacacacccauucacuacuguguguuugcccauugcugugcaaguguuuuguuuguuuuuaaguguuugucuuauuuucuuaaccagacugccagaugacccuaugcccucuguuggccugucugugcccugguggcucugauuacuuguuucuguuuuuuguuuuuguuuuuuuuuuugagauggaguuuugcuuuugucgcccaggcuggagugcuauggcacaaucuugguucacugcaaccucugccuuccggguucaagcgauucuccugccucagccuccagaguagcugggauuacaggcgcccgccaccaaaccuggcuaauuuuuauauuuuuaguagagucgggauuucaccauguuggccaggcuggucucaaacuccuggccucaggugauccacccaccucggccucccaaagugcugggauuacagguguguuuuuuguuuuuuuaagagauggagucucgcuauguugcccaggcuggccuugaacuccugggcucaggcaauccuucugccucagccuucccaguagcugggucacugugaugauuugaauugaauucugugauguguaagaagagcagccugcaaggcaagcacagauggggcagcuuuuguucugagaaauucgugcccuuacugaacuugggucuggcuauuuuuggaacauggccagcaucaaguucuaacccacaacacggucuuuuuggaguagcaugaauucaggagaaaucuggcugcauagucaagcccucaccccuuccauccugugcacgaacuguuucaaguaacagauguuccaggcagagccagccagagugagcuguuccuucucuggagggugaucugguaucccugaacgccuguuggccucaucuccaccaaccccugcagucucugccccugagucccccuccuuccauccgccuccccuuacuagagccucagcccucccuccucgccuggaagccuugcccccgcccccuugugcuggcuggagcucaagccucuuccuuugucgcagcuccgcccaguugaacacacccgcuggggaaggugccucuguucccuccccacgcacucugggccugagcugacagagauggaccaucgaaaagccaggguccucccagcugggcacuacugccccucgcuaggaauaugggccucgcaggucggcagcgugagguccucugugccaccuuccaucagguagcugucaccgaggagcauguugcagugccgggugggggcugccuugcaugcaaggagccuggcagcagcggagggcaaggcuuugagugaggcggcccggacagccauagcugaggagcauggagccacugggagggggcagugucaccuuuuuuggccuucuuccuguguggaaauacagcgccuccggcuugaaccugccacucaggugucuugaugugucggggguguggcugccugcccccugaugcucccugccccacccugugcaguaggaacccagccauggugaacgaagccagaggaaacagcagccucaaccccugcuuggagggcagugccagcaguggcagugagagcuccaaagauaguucgagauguuccaccccgggccuggaccccgagcggcaugagagacuccgggagaagaugaggcggcgauuggaaucuggugacaagugguucucccuggaauucuucccuccucgaacugcugagggagcugucaaucucaucucaagguaaacucaugcaagguuaaggugggaggcgggagugguggugccuggggagcaaacugucagcccugaggcugggcugcccuuuaacccggcagaaaaaagcagccggagggggcaggaaggagaaggcagagugggucaucugaucugcaacuucucuguugccuguaaaagucccuccacagugucaagguauuuuagacacacucuucaauggguuaaaaauguugauucucacacuguauucuuugagggaacuugggggcuggaucacgagugcaguuuaggaagucacaaagcagugagauuguuuucagcaaguuagaaauuuggauuaugcuucuugaacucuagaaaugccaacugaauuacauuagcacuucaugaauugcaguuuuuuuuuuaaguuuaugccuuuuacuguaugcacgucucacgugucacucccaaguuuuugaaguuuaaaugcacaaggauguuuaaauacaccguugauagcuuguaacacaaguacucgugcacauccaggcuuuuuuuugagucucguuucggaacuuggccuuggucugcauaacuguaagcugcugcacagggcuugggggguggcaugaaagaaagugagucugcugacccucuuucuaacuguuccuacagcgaggcugugcuugccacaguuaggauuccccuaacucucaaucaugaugucuuaacucaccugagauaauaaacaggcaagcgcugugaaaagucugaagugcugcucucacacaaaaugauagcgcuguuguugugucuuaccucuguaauagugauuauaacggcaccucacauauacugaguauucgguuuguacaccaggcacuguucuaaguucuguggaaccagcugccgucauauucuccuaguguuaugguuuuuuguuguuguuguugcuuuuuuuuuuuuuuuuuuuuuuuugagacagagucucauucuguggcccaggcuggagugcaguggugugaucuuggcucauugcaaccucugccuccuggcucaagcaauucuccugccucagccucucaaguagcugggauuacaggugcccaccaccacacccagcuaauuuuuguauuuuuaguagagaugagguuucacuauguuggccaggcggucuggaacuccugaccucaagugauccacucacuucagccuccugaagugcugggauuacaggcgugagccaccacgcccagcauccuaguguuauuaugaaguggguacuacuaucugccgugucuuauaaauaaggaaacagaacucacagagauuaaguaauguacccaagaucacacagcuauaaguagcaaagccaggauaugaacgcugauuggucugucuccaaccuucauugaugcuucucuaacucccgggccccaugggaaggcagugacggaugguauuucuccuggaaccucucuucagaaacaaacccccuacagguuugaccggauggcagcagguggcccccucuacauagacgugaccuggcacccagcaggugacccuggcucagacaaggagaccuccuccaugaugaucgccagcaccgccgugaacuacuguggccuggagaccauccugcacaugaccugcugccgucagcgccuggaggagaucacgggccaucugcacaaagcuaagcagcugggccugaagaacaucauggcgcugcggggagguguggagccagcacuccccuacacucuggguucuggcuuucccggaggccacuugguagccugaacuugguuccugaaaugguccuuuacuucuuccugggccccacgcugaggauccgcaggaucccauccccgccaguagugucaguaggcauuguggguagugagucauccugggcaccacacacaggcagccaccucuuccaccucuugaccucgacauaggaguuccgucaggaaugcagucgcggccugauaacccucugccuugccuacaccacugcaucgauugcuggcugcacccagcacuuggcccaaucacagaguaacagaguauccaggagugagaauagccggucaggccucuggugcccgcuguugucaggccaccuaagagugggaagagggagccugaugggugggauccuauggccucgugcucccuaccacaagaccccuucacuugagaugaguagaaaauucucccaggaggcaggagccccaaggccgugggaugggagaggguggcaggcaugcccagguagaaguagggaagggcucuccaauccuccaggcacggugagaagcagcgguggucuccuauucuccaccgccagcacagggucagcaugcagugaauauugaacuggugggcugcuuuuuucccuccugcugucuuaccaagugcuagaaagagacgaaccaaaccuaaauaauaugaaguuucugccuuccagggacucgcaguccugggugucggggcuagguagagggaacagaaagggucucuggagguugggugagacccagugacuaugaccuccaccaacccugcagacccaauaggugaccagugggaagaggaggagggaggcuucaacuacgcaguggaccuggugaagcacauccgaagugaguuuggugacuacuuugacaucuguguggcaggugaguggcuggaucauccugguggcggggauggagcuagggaggcugagaugcccagagagccugucgguguucgguucaggacacagugaucaggggcacucauggguccaugcuggaugaaggacaugcagaggugaacugcaccauguccuugcuccuuuuguaucacccacuccccuccugggccugccaccaucgaccccuagcuuuuuguuccucugccuggcugugcccuuagccugcuuggccuuauucuuuucuuuaaaacgaaagaggggucugggcgcgguggcucacaccuguaaccccaacacuuugggaggccgaggcaggcagaucaccugaggucaggaguuugagaccugccuggccaacauagcgaaaccccgucucuacuaaaaauacaaaaauuagccaggugugguggugcacggcuguagucccagcuacucaggaggcugagccaggagaaucucuuggacccaagaggcggagguugcagugagccgagauggugccgcugcaguccagccucaguggcagagcaagacuccaucucaaaaaaaaaaaaaaaacaacaccccacaaaagagggauauuuacuaacaggauuccagagggcagggaacccaagaucaggagauggccucagaccucacaaggcacuggaagaggucaaaaagcaaggcccucccucauucccucuggggccacagggucccccaucuccgcuucccacugcacaucugugcuucaucugggagaccugauacccaugcuuuuccacacaccuggccugcuccugagugugcagagugucaguuccagccaguuccccaggcuaauggacaggccuccguuccaaauucccaggaaagagaaucaccauuggccacagccacaagaccagguucccccaacagaaauggguggguuggacuucucucccacccuugaagcugaaggcuggcauugagcccucagcgucucagacagcgcucagguauggcaagacagugugcaccagggacaggaagucccgggauuggcacauuuucugggaugacaguuuuuuugccaauauucugggagaaauccuaccauuuuuauauuaaacauggcuauguuauggaguagcaucuaaagugauaugaacuaaaaaaaaaaggccaggugcgguggcugaagccuauaaucccagcacuuugggaggccaaggcggguggaucaugagaucaggaguuugagaccauccuguccaacauagugaaaccccgucucuacuaaaaauacaaaaauuagccgggcaugguggcgcgugccuguagucccagcuacuugguaggcugaggcaggagaaucgcuugaacccaggaggcggagcuugcagugagccgagaucgcaccaaugcacuguagccugggcaacagagccagacuccgucucaaaaaaaacaaaacaaaaaacccaaaaaacaaaccacguggcuucaagaaaauuacauguugugaguaacuuuggccuugucccuaacccccgauggacauguccauucugucaacagggguguuuaggugcuaagucugggaagcacugauuaggagucagagaacagacauuuccaacuguuaaauugucaucgcuuguaucagccauuauauagucaguuacugggggaauaugcacccgugaugggcguuaggugauaaugauuggaaacuagugaagcugugagcucacaguugcugaaugguuucuuacuuugcuuaucaaguggguaaugaagaugaguggauuagaaaacaccaaccuguugggcaugguagcucaugccuguaaucccagagcuuugggagacugaggcaggagaucaagaccagccugggcaacacagugagaccgugucucuacaaaaaauaaaaacauuuuaaaaaagaaagcccucagcuguucaugauagaaaaauagaguaaauagcaaaaucuauacguaaucaaaugcuagauuuguucggugauauuuagguauuguagcuauacuuuucagcuauuaaaaagccuuguuguuucugaaauuccuacugggaaaauagcuuuguuauugcaagugugaagccccauugcuuuaucccccacucccuuaccccuugaaacaauaguuuuuauauucauuuuuugaugacucuggguuucuuaagaacggaacugccuuaucagagcaaagcagcuuggccuuccgccuggcucagaguccugcccugggcuugggcugaugaaaccagcacuccauguaguuucaugaaggccuauggucauccugcuugccugaccgagcaaggcggcuaguaaguuuagucauugaggaaaggggucagagaguucacagagccaguaaggagccuaugggacaucugaucccaccuccuaagcaauucuggaaucuugucuucagcauccacugccccuguguuuucagacuccaggagcucauuguuuugugaguggcuuauaguacucuagccagcucucugaaccggaugcugguucugccauuagaaacaacacagaauaugacuaauaaagaacuucacuagggggcuggguacaguggcucaugccuguaaucucagcacuuugggaggccaaggugggaggauugcuugagcccagaaguuccagacaaaccuggacaagauagcaagaccccaucucuaaaaaauaaauaauuaauuaaaaaaauuuuuuuuaauuagccagaugugguggcuugcaucuguaguccaagcuacucaggagacugaagugggagaucacuugugcccgggaguucaaggcuacagugagccaugauuguaucacugcacucuagccugggugacagagcaagacccugucucugaaacaaaacaaaacaaacucaccuaugguggauccuuuuuccccaggacagaccuuuggacauuugaaaggaguuucuguauucuuuucauucuuuuuuuuuuuuuuuuuuuugagacggaguuucgcucucguugcccaggcuagagugcaaugguacgaucucggcucacugcaaccucugucucguggguucaagcaauuuuccugacucagccuccugaguagcuauuacaggcauacaccaccacaccuggcuaauuuuuguauuuuugguagagacgggguuuuaccauguuggccaggcuggucucgaacuccugaccucaggucauccuccugccuuggccucccaaagugcugggauuacagacaugagccaccgcacccugccauccauuauuuucuuugaagaaaacaucacuuucuucaguucuuccuuguguaacuugguuuuuagcuuuucacuaucuuggaccccugaguaauuucaguguuacauuaaaaacaauguuuaauccggugccuagagaaaagucaagcuuacuaccccagaugcugcccagccagugcuaacuguagcauuuucucuuuucuauggccaccaagugcaggccugauuugcuuggcugcucaaggcaggacagugugggaguuuggagcaauccacccccacucuuggaacugggcucugagccaccuccccugagagucaucucuggggucagaagcauaucagucaugagcccagccacucacuguuuuaguucaggcugugcugugcuguuggaaggugcaagaucagagcccccaaagcagaggacucucucugcccagucccuguggucucuucaucccucgccuugaacagguggaggccagccucuccugacugucaucccuauuggcagguuaccccaaaggccaccccgaagcagggagcuuugaggcugaccugaagcacuugaaggagaaggugucugcgggagccgauuucaucaucacgcagcuuuucuuugaggcugacacauucuuccgcuuugugaaggcaugcaccgacaugggcaucacuugccccaucguccccgggaucuuucccauccaggugaggggcccaggagagcccauaagcucccuccaccccacucucaccgcaccguccucgcacaggcugggggcucuggguggagugcugaguucgcugaguucuucccagaucuccucucagguccagaacuugcacagcguugcuuggccaccccauuuugguuaccucuaauuuuccccccaaaacccagcaacagugucuguugagggguuuguuguacuuuggccaacaagcaucaccaaaagggauucuaauucucauuacaaauccugcuuaaaucaguguuucccaaagguggcugucaucagaaccacuugauaagcuuuuucaaaaaguggaucuccaggucccaccccuggagguucucacucaguaaaucugagggagguccucggaauguguguuuuacuucuugagcuuggcaggugauucggaugaucagugcagcaugggaacagcuggguuagaugacaccauguuaccaacagacacaucuagggcuaaaaggcuggcucaacccaaggcuggaaugcuuagggcagcugcucuacucuguaaaaagugggaaagcugggcauaguggcacgugccuguagucccggcuacuugagaagcugaggcaggaggauggcuugagcccuggcguuugagagcagugagacucagucucuaaaaacagaaaaaagaggagaaaacggcaggccaagcccaggugugcuccuagaauaugaucggacuuucgugggucccucugccugacacugugguuggcauggaugauggaagggggagaaguauuuagggugggagacgggcuggccagcagccgccacagccccucaugucuuggacagggcuaccacucccuucggcagcuugugaagcuguccaagcuggaggugccacaggagaucaaggacgugauugagccaaucaaagacaacgaugcugccauccgcaacuauggcaucgagcuggccgugagccugugccaggagcuucuggccaguggcuuggugccaggccuccacuucuacacccucaaccgcgagauggcuaccacagaggugcugaagcgccuggggauguggacugaggaccccaggugagggcaguggcccagagauccccagaggaggguccaagagcagccccggcugcagugcuggcuccccacggugguacagauggaugucugugccauggcuagcugggcacaucgaaggcuccagucucagagggcaucagauggaagaacucagccucaggggugcuccccugcuuccggcucccucuagccaaucccuugucucaauucucuguccccauccucacccaggcguccccuacccugggcucucagcgcccaccccaagcgccgagaggaagauguacgucccaucuucugggccuccagaccaaagaguuacaucuaccguacccaggagugggacgaguucccuaacggccgcuggugagggccugcagaccuuccuugcaaauacaucuuuguucuugggagcgggagggcagaagaaguuugcaugcuugugguugaccugggaggagucaggggcagaauuuacaggaauggccuccugggcaugugguggcacugcccucugucaggagugugcccugaccucugggcaccccucugccaggggcaauuccucuuccccugccuuuggggagcugaaggacuacuaccucuucuaccugaagagcaagucccccaaggaggagcugcugaagauguggggggaggagcugaccagugaagaaagugucuuugaagucuucguucuuuaccucucgggagaaccaaaccggaauggucacaaagugagugaugcuggaguggggacccugguucauccccugccccuggccugaccccagcugcaggccaggcugcggggcugugacuuccccauccugugcccuccccuccaugcuguggacauggcaaagggagaaggguaaguugggagaccuccaccuggaagggcuuagggaggcaaagacaggcugggucuuuguugggggccgugagagggacucagggugccaaaccugauggucgccccagccagcucaccgucucucccaggugacuugccugcccuggaacgaugagccccuggcggcugagaccagccugcugaaggaggagcugcugcgggugaaccgccagggcauccucaccaucaacucacagcccaacaucaacgggaagccguccuccgaccccaucgugggcuggggccccagcgggggcuaugucuuccagaaggugugguagggaggcacggggugccccccucucuugaccggcacccguggguuccccagagcuuagggcagagcagccugccucuccugggcucuuaaauuuugaaugagcauggauuggagcggaugggagcucaugcuuuaagucagauagaccuggcugggcacggaacccggccagcacuuugggaggccaaggcggguggaucacuugagcccaggaguucgagaccagccugggcaacauggugaaacccauucucuacaaaaaauacaaaaaugaccgaggcauggugguguacaccuguagucccagguacuuagggggcuggggugagaggaucgcuugaguccgagagguugagccuccaguaagccauauuugugccucugcacuccagccuggcccacaaagugagacccugucucaaaaaaaaaaaaaaaaaaaaaaaaaaaagauuggcugggcuugguggcucaugccuguaaucccagcacuuuaggaggccaaggugggcagaucacaaggucaggaguucgagaccagccugacaaacaugaugaaaccccaucucuacuaaaaauacaacaauuagccgggugugguggcgggcaccuguaguugcagcuacuugggaggcugaggcaggagaaucgcuugaacccgggagacggagguugcagugagcugagaucaugccacugcacuccagccugggcaacagagcaagacuccaucucaaaaaaaaaaaaaaaaagauagaaaucagaccuauggaggcaggucacucgaccucucugagccugguuuucucgucuguaaaaugggauguagcuuguguucugggcaugaaaccuaacaaagcauguaacgugcuuggcacaugguaagagcaggaagcacucccugaaaggcagcugcuguuacuauccugaguugacaccuuucucccagggcugcuggaguuaacauuauguucugaucuaaggcccacaggcccuggagcagaaagaccugaguuuaaggaccagcucuacuguuuacugucagaguagccaacgugcucaacuucccugaacccacuuuccucacguggggcucacugugcccagccucccguauuaucagcauucuagcaaaugaguuugaguaaacccagcuuaaucccugauaggcacugguucuagaggagaugucaaugucauugucagcuugcacuggggaggauggaauguguggggccucucucccaugacucggccugucaaaccaguugcugcuguucagaaauggcuucuucguggagucuucccugacugauugggagagggguggcugauagcccucagaccuguccagacugagaaacucacguccccacuccccucacccuuugcuuauggacgugccaacgccacaguucauuauuccgcccacauggcugccaguaguccugauaccuuaggugucugcgaaagggcgucuggcagggcugggguuggugacaggcaccugucucucccacaggccuacuuagaguuuuucacuucccgcgagacagcggaagcacuucugcaagugcugaagaaguacgagcuccggguuaauuaccaccuugucaaugugaagguaggccaggccccaggguucccacagaguaccaggcccuucguugagcaaacacccagcaccuagccugggcuaggcauugugcaagacagagagauacaggcagaacuggggcccugcucuuaaggagcucccagccuagagugagggaggcagaucaaugugugaccaccagccaguguaagugggaaaaucaaguucaggagaggaugcugucggguccagaggagggauaucucaccugggaggccagggaaggcuucucagagggucaucugugggaaucacugaggacaaagaggaguuggccaacaggagagaaggguauuccugggacagggcagaggacaggcagaggcagugagcugcaccaucuggggaaacggggaacaugagcaggaggaggcgggaguguuaagcaggggccaggcccgcagagaucaugguuguccugcuggaauuugaguuuucccucaaugcaagggaagccuuucuccagcagugggguggcuugguuccugcuuuauuuuaggcaaaucacaguggauagucauacggaugagagagauuggggacggcuagagccggggaggccagugaagagaccccuggagugacccaagccaaacacacuccuggaggugggcuagacaagagggaauggaucagagagugagcagggggugcucaaggaggagaggggaaguggccaggacgccucuagguucaggcuuguguggggagagauaucauucacagaugcaggcagaggaggccaggagcggaggcacagggagaggggaguggaggcgcagggagaguggaggccgggaguggaggcgcaggcagaggguauugagcccagacagccucauugagucaaggcuguccaggcagugggacuccaguuguucuuggcccaggucuuacccccaccccacauccccucagggugaaaacaucaccaaugccccugaacugcagccgaaugcugucacuuggggcaucuucccugggcgagagaucauccagcccaccguaguggaucccgucagcuucauguucuggaagguaaaggagccgggggcaagcuugccccgcccaccuggaaaaccguggggagggauugggaccaagucccaagcgugugcugaaggccacacuggacccagccuucagggcacacccagcucugacucacccaugucacugcugaugcaggguguuuauuucugggcaggggugggaagugauacuggcagugggccuuguucuauuccgggaaauguccuguugagcagagcccuuggagagcccuguuaaucuugccucugugugugugugcaugugugcgugugugcggggguauguguguguaggacgaggccuuugcccuguggauugagcgguggggaaagcuguaugaggaggaguccccgucccgcaccaucauccaguacauccacgacaacuacuuccuggucaaccugguggacaaugacuucccacuggacaacugccucuggcaggugguggaagacacauuggagcuucucaacaggcccacccagaaugcgagagaaacggaggcuccaugacccugcguccugacgcccugcguuggagccacuccugucccgccuuccuccuccacagugcugcuucucuugggaacuccacucuccuucgugucucucccaccccggccuccacucccccaccugacaauggcagcuagacuggagugaggcuuccaggcucuuccuggaccugagucggccccacaugggaaccuaguacucucugcucuagccaggagucugugcucuuuugguggggagcacuugcguccugcagaggaccacaguggguggcaccuccugagaaggcgaggagagugguuguugccaacuaagcccucgaaccaaggcagccuccagagccagccugggacucccagugaacuuacacuuggagcccgugcaguacaggcaaaacacgcaagggcaucaggcacugguggcaucguagaagagauguggcaaagugcuguacccuuccaccuccuagaggugggcagcugggccccaccuacuugugacugaaggggcacaccacugcccugccugcccacuuagccguccauggcaccagcccccuggaugggcauugggcugacaccuaccaugcugcuuuuuggcacaguugucuauucugagccuugagagaaaaagugccccuuaaggguugaaggcagucugaacccuugugcuugguggggcucguggccuuccccuuuugccuggcuguggaggccugaugcugccccguucccugucagaggcuaagaugagauuugccagcacaggggccccagaucugccugggccugugcagcagcccagcuuccugguguauuuuucagguaggcccuuguccugccagcugccuuccucauccccucguccugucccagagguuaucugccuggccuggcuccccacgagucaccugcaagccccagggccugggggcagugacuggcaggugcagaugggcuguuucguguaguggaagagcagccugauggccaaggggguggacgcaauugugggauguccucuuuacucccuuccuggccucacuggcuggggcagaggggcagccgcuaggagagacugaaagcagcagcuaggacugaggaguggguuuuauuguccuucagagcucuucaagcuguccccucugucaucacucccuggauguguggggcaugguuccuucccugggaaggcuaaguucaguucuguuuuuuauucuaugagaacaagucacagcugcagcugggccccaugcucugccccaagcccccaaccccgcggugcucuggcggcuuccuguccacucucggggcccuuggggccuggcuugcuccagggucuugggcuacuggcagcuccucuccuugggcuccuggcugccaggcguuggugccacuucuuaaaggccuggaaccagggaggagaggaaaugcuauuguugugggcuuucuccggggucugugcugugccugcuagagcaaccccuguacccagcuccuuuuguccccagggccccucccucugccccaagcagccagccagucuugccuaggccaaaugcacaagcucagaauagaucugauggugagcugggaagcuguacucagagcagagcaaaugagggagggggcgcucaggacccaggcccuccaugggcuagugugaguggcagccaugccucaugccacaccuucuucgcaaacugauggaccgggugggccuggccugagcuggggccacaaaucaaagcaagggcuccagcauccagccuguguguucuguaauggaacugacccccuccccugaaaacgaaggggccccggggcuggcaagcagggaaagcuccacggugcguggcuguggcacagacuucuggaaggcuggcugaguggaaugcagggaagagggcaguaccugggaaaggacccacccaucuuccugcugcuguaacugcugagccacucgcagucgcaggauccgcugccaccacgucugccaggcccaucucaggugccacucccugagcuuuggggacaguuggcagagaaggccucuugugcucacgcucccccgcaguccccagcccuucugccuuucucccccgacacugcugcaccagagugaaagggcuauggcaagggggugucaucugaggaguauuaagaaugcagauuccugggccugucccccaagguuuuggagucaguagguccaagggccauacuuuugagagggguuuggguuaaguaugaggugaaaugggagauggucaguguggagaggggugcacccacucaccaggguccgcaccagcugcucugccccuugggcauccacccagugcugccaugccacugccaggcaccuggccugcugggaaccccgcagcccgugaagcagugccucgaggcaccggcgcugcagguacuuccuccugauggccaagagcaucgugacccuucagggccagaaggagggcagagccaugggccugggccugcuuuuccaggauccugcaggaacgagcacuggccagagagggcccagcuguagccauggcucaggcaagccccucagcccuugcccccaucccucggacccaccaaacugcacacacagcuccucuuaccguagccuccguuuaugggccuugcuuugggcuuugcaggcucugggcucagggcuggagugcgcucuuggucccuggucccucguccacaggggcaggccugggacccagcuacucuguccaggccacuguggccagagcuggaaggcagggcagagggaauguucccugcacccuggaaaggggaguugagucacaagagguuaagguggguccaggaaggcagcugcucuuagugcccgccuaggaguugaguacagugaggaggguggaggaaggugcugagcuuagccuugugcccugcccccaucuccccaggccuccagccucucccggcugccugccgcccaaagagaaaucacaggggcggggcaggaaugcaaaguguuuucucagaacagcugaaacauuccgaagagggaauggauggggagaauggucaauacacauaagaccgugucccaaggagcugauuuccaggccccugaggacuggagaccgcuucaccccugcacuucagacaccguuugucccccggggcaaggucuccuuacucugagcccaggccguuccccuuggcuuccuccguccacccaggcugcacugcagugauggcgcgggaggcaccagcucuguggccuguguccagcagcugcgggucugaaggaauagccagagaggagcaccugaaccccaugggcuuggacuuccuggggccccgcugggauuucuucgcugcucuagcuggcaggacacaucccggccucuuccacccauucccccauguggcugaagacauuccaacaauggggugggcccauaauaguuagcccucagucaguucccggagcacagcccugggagggggcuauuucucuccccacugaaaacauuucaaagcugaguuacuugucugaggccucaucccucggaagccgucugacuccagagucugagcccccggcuaguacccuauagagagggggcucuccaaaggggcugcuggggcaugugugccuguggcagaaaagaggagacccuggaauucagcacccugggugccauucccagcguuuaguuucuagaggccucaguuucuccaucagcuuaugggauccuugucuuuacugacaagaauggaauagaaauguaaaaguacucugaaaagcaauugcccuguaacuuaucuagaaagaaaagacccugagacuccagaaucugcuguugccauagccccauaugugugaauucugcaacuagccaaggcuaguuccuuucaauuccauuuaaaaaacaaaaaccagcaggugugguggcucauggcguaaugggccugcccaaugcuuugggaggccaaggcagguagaucgcuugagcccaggaguuugagacaagcccuggcaacauagugagaucccauuucuacaaaaaaaaaaaaaaaaaaauuagccgggugugguggcacacgccuguagucucagcuacucagguggcugaggugggaggaucguuugagcccuggagguugaggcugcagugagcugugaucgcaccacugcacucuggccugggcgacagagugagacacugucugagaacaaaaaacgacugaaaaaaaaaaucaccuuagcuuuuucucuuagaaucuucucuaaaacguauucuuuguggcauucugaaauaggauucaugaugaugccuguugaucuuagggacacuaccucaccugccaguaucuuuggggcuguguccuucaaggacauguccccagacugcugugcagugucauuuuuuguguuugguuuggugguggcuucuucccccuugcuaggcuaucaaccucuuaucaccacuuguuggugucagaacuaacugcuucuggucuggagagggacugaccgaugccuuuggguagagagaauuaugaaagaaauuuugguauuuuucuacuuuauauuuucugagguuucuguaauaagcauauuucacuuuuccaauaagaaaaaaaaaaacuuggccuggcgcgguggcucacaccuguaaucccagcacuuugggaagucgaggugggaggaucacuugaguucaggaguucgagaccagcuugggcaauauggugaaaccccgucucuacuaaaaauacaaaaauuagccaggcgugguggcgugcacuuguagucccagcuacucaggaagcugaggcgggagaaucacuugaacccgggaggcagagguugcagugagcugagaucacuccucugcuucagccugggcaauugagccagacucugucucaaaaauaaacaaaaaaacuugacaaaaaaaugcuacuguccucguguaccuauucugauccucaacugcaccgugagaaagcaugcauuucaaugucucccuaacaggcugugacccaacaugcuggucuuugcggccggaccugcaguggccuggcacucgagaggugccagguucaucuuugcugauggauu

SEQ ID NO: 14223 - RNA, 752 nt, Homo sapiens
gagccgucgcguaccuaggauaccuggaagccgaagccacaccucccgcauggccccuccggccagccgggccccucagaugagagcugcacccaggccagcaccagucgcucagccaccagcagcggcaccgccaucuacaguuggcucuucugcugcugcgccccggcagccaggucugauggcccagauggcaaccacugcagcuggcguggcugugggcucugcuguggggcacauacugggucaugccauuacugggggcuucaguggaggaaguaaugcugagccugcgaggccugacaucacuuaccaggagccucagggaacccagccggcacagcagcagcagccuugcuucugugagaucaaacaguuucuggagugugccgagaaccagggugacaucaagcucugugaggguuucaaugaggugcugaaacagugccgacuugcaaacggauuggccuaaucaagaaguucaaccuggagagauggaaaaucagcucucauacuaauuaauuuaguauaaaaauagaauugguagugaggguauaaaguguaagcaucaguuaaacuucuccugucauuccuagcuuccuugcuucagaauugaaauggaagggaggguguuccuacucuguagaaucugggacugggcaaauguuuguguggccuccuuaaacuagcuguuaugauuuuauucuuugugaguuaauuagaauaaagucauuuucuuccaaaaaagaaaa

SEQ ID NO: 14224 - RNA, 18929 nt, Homo sapiens
agauaaugagaucuaacauuuauuaaacacugauguugcaccauuuucaguccucacuaauacccgagucaggcacuauuauuguccccauuuucagaugaggaagcugaggcacagugagguuaagagauagugucucuuaacacagccaguuacagagugcauaggggauuuaaaccaaggcucacugacuccagagcccguuuagagacacagugugagaguuggcauuuccaggccauuccggagacucugagaaccggccugagguggggcccuguagguacugcagcucugguccaguucuggccaacaggagaaggcagugaccuccuguggggcaauuucucuggcuuccucauguggaaggcucagcuuugugaaaacaagaaauagauuugcaaacuggacaagugugacuucaguccugauaugguuuggcuguguccccacccaaagcucaccuugaauuguaauaauccccaugugucaagaccggggccagguagagauacucgaaucauggggaugguuccccauacuguucuggugauggugaauaagucucaugagaucugauggcuuuauaaaugggaguuccucugcaagggcucuaucucuugccugccuccauguaagacgugauuuugccccucauucaccuuccaccauaauggugaggccuucccagccauguggaacuuugaguccauuaaaccucuuuccuuuauaaauuaccccgucuuguaugucuuuaucagcagcaugagaacagacugauacaagcccucuccagcaggagaccagaggcaagaggaauuugcuuccugugguugacagccucaagaaugucagacacuauauaaaccugcagggugcccuacuuccaagucccuacagacaugggccuuuuaaaaguugcacaguggugagaauguccaguuggaaagccucguuagcacagugcagcccguccauggcugaaguccugggcuuauccuggaccugcccucauccuggaccugcccucccacguccucccuccuggcuagcggcagcuccagccuuccagucaggcccacaccucacagucccgggcuugucucugcauccucuauccagcccaucacagguccugcugcuuugccuucagagaguguccaagaguugaccacuugucaccacccccaccacugcccccauccaagccaccaacaugguccuuuuagaaugcaagccaggugcaguggcuuaugccuguaaucccagcacuuugggaagccaaggugggcagaucacuugaggcuaggaguccaagagcagccuggccaacauggugaaccccaucucuacuaaaaauacaaaaauuagcugggcauguugguaggcaccuguuaucccagcuauuuggaaggcugaggcaggagaaucgcuugaacccagcugcagugagccaagauugcaccauugcacgccagccugggcaacaagagcgaaacucugucucaaaacaaaacaaaacaaaacaaaacgccaggcgcaguggcucacgccuguaaucccagcacuuugggaggccgaggcagguggaucacaaggucaggagaucaagaccauccugaccaacauggagaaaccccaucucuacuaaaaauacaaaauuagcugggcgugguggcgcaugccuguaaucccagcuacucaggaagcugaggcaggagaauuguuugaaccugggaggcagagguuguggugagcugagaucgcgucacugcacuccagccugggcgacagagggagacuccgucucaaaaaaaaaaagaauauaaggcagaccuugcccggcucugaccaacacccuccaggggcucccaucucauucagccagaacuggaguccucagaaugacuugcuaagccugcacaucugaccccagccaccuucugaccucauugucuucuucucucccucccccacccucucugcucagccacucucugccucaggccuuguuagcugucaccaagaaccucucaugcuaaauggaaugccccugggugacuuuucccgcacccuggcauccccugccucuggaacacggccucacucacagugggcucuggggcgcuuguuguauguuagaagcucucccuguuaaggccgcuguguggaaggggcagccacaugguugccuccuccaccguuucugucugccucugauggcccuccggcucccgacugccugcacagucgggggguggcacagugccugcaaaucuaagccacccucucccacucccugagcagcuccuagccaaugacuggaaagccuggcacccuugcuuucaucgcaggcucugcuucugggguacacucugagacaggagcuuuccucuguccucucccgcaaagagccgguucaaccugggggucugggacgaugagggacugaggugucuagauacacuccccugugcguggcccaggcugcaucaucugcccccacugccugggccaagccccugcccuggcuuuucauucccuuugggaaucugacacguucacgacgcagguacacaagccuucccggggccaggaugcuguauacacaagauaaacggacuugggucuuagucccauuccccucgggucacgcuccuccuccacccaggguggcuacagucaugaaccugacagguguccuucuaguccaugcuuuucuauuuuaccgcacauacacccaggaacaacauauggcauugcugugaggucugaaaauucaucccaaugccauucugcaaucugcuuuguucacauuugcggggggccaacguugguggaaauaggucugguuuaacagcuguaacugcugcacugugcuccauacgaugaauggaccguggcuuacugguccguacucccuauaaugaauggaccguggcuuacugguccauacucccuacaaugaauggacuguggcuuccugguccauacucccuacaaugaauagacuguggcuuccugguccauacucccuacaaugaauagacuguggcuuccugguccauacucccuguaaugaauggaccguggcuuacugguccgucucccgacagugaggcuguuuccaguuucucacaacugcagcugcucagcagcccucugcccggagcacagccccuuccccacagcagccuuccucccugacccagaggcccauguccucuucuuucggggcucuugccucugucuguaauccuccaggugggaagacuccuagguugagagcaggcucccaaggucaccacugcagccccaagcccgcucggcaccaggcagguacugagccucuuuugauugacagauggacgcaagagaauaaugggaguugugcacuaggccuugacccugugccagggacaagccaggauggccugggaaagcccuggcacuuggugcccagggggcagaagagcaagcugugaauagcuagaccuguccguggggugggccgaggcccuggggaacuucuggacgugucagcccaagucagcugugaccagacacaggggcuaccaggaagaggucgccccugccuccuaaccuagcaucgucacuggccugaggagcagguccacugcuaacaaguucaccaucacuuagggagcccuccucacgccaggcacuucacaccuggagcaggcaccaacccuuucuagaagacacugaaggcaugcagcuaguaaguggcagagcaggauuccaaagagugccugggucaucugguucagagaaacggaugcccacgcaccacacccaccagugucucucucuccuguggccucugcuaggccagagccaggcucaagcccagcucagccaacgcacaugccuguuuccuccugccaugacagaauggggcagcacagcacaggcuccaccugggaacuggcaggagacaucuucccaggaacaaggccaggccccagcccagccaggagauugaaggugguucaaaacacagcccaucuacagaauuccccaaacuuuaaugcugugcucugaaaagggaggcuggagguuguggugggacacaguguugcugacaccucuggccuccagcccugcaucccuaggcaccaugugaccaggcagugagaaggacggggccucacucccaugccagacugcuccucgggcugagcaggaccugaagcucucagggcuuccaccaaagcccagcaaacuugggggaggccugagggggcaucagcaguccuuaaaggccugagcuugcaacacucaggcaggacucggcugagggccucuguggugccaccaugggguaggagguaaagagagacccugguuccagccugggaaccagugggugcccugaagggaggggaggccucagggaguucgggacaggagugugcaugguacugggcggcccaugggggcuccuggccucuugguucaggcaaucccugagcuggggacacauuccaucuuagguccaagagacggaggucaggagcaucccuagaacgaccucccaggcacgaggaaggcccggggcagggccgggcgcagcguggcuggcuucaguacccucgggcaucuugacuccugcccucugggacugcaaagggaucugcgggcgccucugcugagucaaucgucugguaggcacuacgguccugagaagacccaaggaaaccuaggugacaggggacauggugggaaagaaaaaugaagggugagaacucgggauguucagcugaguccaacccaagauccacccccgccacccucgggcugggcauccugacaccaugcacagagacagaggcagcagccccaggcccuaaaccuuuagcguguauuauucauucaauccugccguaucccugugcgacggguauuuuuauuguccccacuuuacagaugaggagacugugggucaaagggaugaagugacuugcccgagaucacacagcucaaagcugaugaugcugggacccacgccuaggcagccgaguccaaagccaggcuccuggccccugugccaugggcuuccccaggcagcacgugcuuaggaaccugggcagagggacaucagccccgggcccacgcacuccucuccagcuccccucccagguacaaggacaccacauuaccauauccagauggccucggaggcuggggcuggguccaaggcagggccguagggcuccgaguacgccacaugccucacucccauccccuacucuguacauucaucccgggacccugaacaagucccaaaggaugugggccucaguuuccucaucuguccaaugggagaaacauucuggcaccccucaccugggggcaggcccaggcagugcugaggucagccacugugggcagccccaggccauucccacccucaaccagcugguggcagucacaggccacguggggcaucucaucucaggagugaaaggcagaaggccacacccuaccaccucccuccacuccucucaaagagagagagaaaggaagagagagagaggugucagagagcaggcaaauggcucggccaccaggagaaggaguacaggaguucagagagggcgugggagagggcagguguaaggcugggugaguggggaggggccggugggcagggaaagugcccccuguucagggcugucuucacugaggcucccacagccuacacuggcacgggcucugcccuggccaccuagcagucucugcagcaggagagggaagaccccauguggcaggaaaugggguuccagugaugggccccggugagaacagagaggagaccuguaggugcccguggcccucaggauggagacagcccagggcugccccugggaacuaaaugguacccccagcugugccuguguucugggcugagagaagggcccagccucagcuucacagcagaagaaggucacggcagaccaggacaaccaggggaccccugggcuccugcagcagagacuaggagcuuggaccuguccagccuaguacagagcgcccaugccacgcucucccugcaccuugagcccuggccccauggggcaaggcuggcucacugagggagaggcuggaggccaggcaagggagagaagggagcggugaggagcuggcuggaggugguggccucaccaguguggaccaggagcucacccccgcgcucccgguacaugugguagacgaagcagcaggagagcggcuugagcagcaagcugaggauggccaugcccacgccaaagcggcccguguccgugaggcugacccgcggguagaagaugcugaugugcacgauguccaggaagaugguggccagcaagccacccagaaacugcaagacacaccacacugaugagcacaacacccccaccacgcuccguggcucccccgccacacaccggaugggaagccguuucaugcccugcuguguccuuggggcuugcgggaaaauggaucaagcaagcaggcagggccccgcuggggagccgcuggcugagacugcagucugggggcagggaugccgggggcccaggucucgguuccaccagagccucccuccccacccauuucccgucaucuccaaggccaugaugggcacaagacuuggcucuagaaccuccauagaggaagguuccuuggaguucacccaguccuucuccaacacaaagaaaaucucuucucagucauccugaggcccuggccucggcuugaagagcccgugcgggagugcucacugccccacggggcuccgugggugcugagaagcucccccugugggagguuucgguggggcagggucaccucuacuuccuaaaguagugaaaugcccucuuggccgggucucccagccauauccccuccccuaaaagagagccgcagagggagguuacaggggauguuccacugcucuugcgaaguggcuaauccgaggcacuggugggacccaccccauggcuuuccucagggagauaauggcagacuugggguucucuaagccagacaagaagagcagcaggcugggcuccugaacacaggcaugggccggagcccaggaggcugaugaacaggcuuuagacaaugggaagugguggcccaaggaagagggggaagauugggaugggacgggguagcagagccaggcuaugucuugcccugugcugcggcuccccgccuugccgccucucccccacccuggcucaccaugcuuauggcgucgauggagucccgcugagccacagcccacacgcccaaggccaggauggugaaguuggcccaggcauaggagccugagaauacaaugcagccccuguaggaagagguagcucagucccgucaggaggccaccaccccgcaggucaccucccuccugcuccggcgucucagggccuccucccagaacaugccauagucuucgaggccacccggcugugugccagcaaaucccaugggcuccgccucccacccagacccuggaucuggcugugucccuguagauccaaagcaccucccucuccuggcagaugacagccgcagccacccugugccagcguccugacugccacucuguucucuaaacagcaaccgguaacguagucagaugcugucacuccucugcuaaaaauccuccaacaguuuucugucccauuuggaauaaaaugcagacucuucaccagggccuaaggggccugugggaucccggacacagccucgcccuacugaccucccagccacugcccugugcggcgggcgcccucuacccugacaccuggcccuccuuuugucauucacccugagacucgaauguucacccugagacuccuucccuugcccaccggugcuaaguacaaguucgucacuuuccuaacacaaggcccgcccuauucuauuuuuaggguacugauacugacauuguugacuuacuugucaauccaaucaaaaucauagugaacaccgaucacuugcuaguaccuagcaugguucuguuuuaaauuaacucauucauguacauuuauguuaauaaccauaggaaggaaguauuauuguuacccucacuuuagagaugaggaaacugagacacaaugagguuaaguaacucgcccaaggucacacaguugcugagcaguggggcugggauuuggagucuggcuggagaggccaugcucuugcucacccugcugugcugcaaggaagacucagggggacagggacugagucuaccucauuuauuaccaaacccacugggccuugccuuccccugcaugcagcgggcgcuuccuagauuuauaggacauucacuaaaguguaacaugcagaagacaugugcaaggcagguguggagugccauucgguucaauaggucuuugaauaaaccaucuuaucuuuugcuuuuaagaaagcaggugccugggucccagcccagaaucaccaacucagaaucuuggggaagugugacuaagaaaucuguauuuuggcccugcuucucaaggucgugaaucaugaugguuacaguucacauuacucacagcuguugcccugugcgcugcacuucgaaguuugcaaagugcacaggugagcucaaugguuuccagucuugguuuggcagagaaaugucuccagaagcucaacagauuaaaagagaugguaaaggugaaaaucaagcugcagugcugaggccucacuguggggcaggcccuggggagcucugaugagcacuuccacgucucccucccagcuccugcagggugugcaauccuuaugccuauuguacagacggaaaucaagacccggagaggcagagcugucuggcccaaagugaccugguuaaaacacggcagaaccaggaccugacccggcugacacagacccugagaccgcaggagacacacaagauacccacagagucacuuaccagguugucagcagccagugaccuaggagaaucaccuguggcacaacaagggggagagaagaggucugugaacaugaccaccacaggggcaggaaagcgucgggugcagaaaacacaggacgccccugcgccuggcaccucugagggccucaguaaugucuguugaaaaggcacaccagcaacugcagguggcccaggagugaaggaggaggaagaaagcaggccaggccagggaggggccgcuucaugccuucaccccucccauggggcagcugacacccacaccccuuccaagcgucagaggcguaugaaccagagcaauuccaucuugaauaggagcuggguaaaauaaggcugaaaccuagugggcugcauucccagaugguuaaggcauucuaagucacaggaugagacaggaggucagcacaagguacaggucauaaagaccuugcugacaaaacggguuacaguaaagaagccggcuaaaacccacccaaaucaagauggccacgagaguaaccucugguuguccucacugcuacacucccaccagcacuaugacaguuuacaaaugccauggcaacgucagaaaguuacccuauauugucuaaaaaggggaggcaugaauaauccaccccuugguuagcauacuaucaagaaauaacuauaaaaaugggcaaccagccugggcgcgguggaucacaccuguaaucccagcauuuugggaggccgagguggguggaucaccugaggucaggaguucaggaccagccuggccaacauggugaaacccugucucuacuaaaaauacaaaaauuagccgggcaugguggugugugccuguaaucccagcuacucaggaggcugagacaggagaauugcuugaaccugggagguggagguugcagggagccgagauugugccauugcacuccagccugggcgacgagagaaacuccaucucaaaaauaaguaaauuaauuaauuaauuaauuuuuuuaaaaagggcaaccagcagcccucagggaugcucugccuauggaguagccauucuuuuauuccuuuacuuucuuaauaaacuugcuuucacuuuacucuauggacucgcccugaauucuuccuugugcgagauccaagaacccucucuuggggucuggauugggaccccuuuccuguaacacaagggugggaggcuccuuuguggaaugcagggaaucugcucugaaaucagaagaggccucgaugggaagcggagcgguggggacucacgugagggugauuucuugggacacuggagcuggcgcacuguggggggcagaggggaaagcagcuguuguggcuggagagagcgggcaaagggaggguagcuggggacagguaggggggccugagggccucgggaaggagcgugggcuucaugccaagugcaacgagggacaccacugagacuuuucuacagggagauagcuugguaugccuuaugguaaggaaaaacaacaacaaaaucccccuggcuauuuuucuggauuucugcaauauucuacuuuuuucuuuuuaaauuuggagacagggucuugcucugugggucaggcuggaguucaguggcgccaucacagcucacugcagccucaaacuccugggcuuaagugauccuccugcuucagccuccccaguagcugggacuacagguguguaccaccacgcccagcuaauuuuuguuuuuuuguagagacaaggucucccuauguuaaccaggcuagucucaaauuccugggcucaagcaaucuacccaccuuggucucccaaagugcugggauuacaggcaggagccacugcacccagcuacaauauuuuacccuuuuuaauguccucuguguccuuaaaaugacagccuccucuccuggaacuggucucuacuccgggacaucaacaaggcccugacuggaaagcacauagaaaaagggcagauggaggcugggcacaguggcucacgccuguaaucccagaacuuugggaggcugaggugggcagaucaccugaggucgggaguucgagaucagccugaccagcauggagaaaccccguuucuacuaaaaauacaaaauuagccgggcaugguggcacaugccuguaaucccagccacucagaaggcugaggcaggagaaucgcuugaacccaggaggcagagguugcagugggccgagaucgcgccauuguacuccagccuggacaacaagaacaaaccuccgccucaaaaaaaaaaaaaaggaaagaaagaaaaagggcagaugggcugggcgcgguggcucaccccuguaaucccagcacugugggaggccaaggcagguggaucacuugaggucaggaguucgagaccagccuggcuaacauggcgaaacccugucucuacuaaaaagacaaaaauuagcugggcaugguggugggcaccuguaaucccagcuacuccggaaguugaggcacgaaaauuacuugaaccugggaggcagagguugcagugagcccaaaaugggccacagcacuccagcuugggugacagagugagacuccaucucaaaaaaaaaaaaagaaaagaaaagacagaugccuugggagggcaggcagcugcagaaagagcuuccaaagggaagggacccaggcugagcacaauguaugagcggggcucggccaggcaaaguggggccaagccccaggcccugcauggguggcggugggcauggagauaacugaggucggggugggguggcacagagacuuugggaggccaggagccccaaauugggagcuucaacgggccugguggucaaugagggcccuagaaguuuacucaagggauugaggggucaggcuggaagggagagaugccacaugccuggggcagaggcaguguccuggcgcagacaugggcaagguuugcgaagaaggccgggguuucuggccuggguggaagggcagaaggagcccucaccaccugcaaaaaagaacugugggccaggucugguggcucacgccuguaaucccaacacuuuaggagguggagggagaagacugcuugagcccaggaguucgagaacaaccuggcuaacaaaguaagauccuaucucuacaaaaaaucaaaaaauuagccagguaugguggaguacaucuauagccccagcuaccugggaggcugaggugggagaaucacuugagccagugaggucaaguguacagugagccaagaucaugccacugcacuacagccugggggacagagcaagauccugccagaaagagaaaguaaggaaagaaagaaaagaaagaaagagagaaagagaaggaagaaagaaagaaaaagaaagaaaaggaaggaaagaaggaaggaaggaaggaaggaacgaaggaagggaaagaagggaaagaaaggacagaaaagaaagacagacaaacucacucuggcagcagaggaaaaagcauuucuagaagaguuacucuugaccacacaccaacuaugugccaggcccuaugccaaccgucucacaugaccuuaucuggaccucacagcagccucugguacuauuauucccauuucacagaugagaaaaccagacucagagauaaauuauguugaucaagacuccacagguagcaaguggcaaaacuggaauuaaauuucaaacucgccuccaaaaccagugcacccaaccuccccgcugggggcgcaggccuucagcugggaacuguuugggcuugugagaaagguccacacaugggggcagauggaauccagagcugguggcugagauacuucaccuuuaccuccagggcccagggccagagugaaccacaaggggccuggcucuguggcccaaaagaaauuccuuucucagcuccaagagacuaggaaaauaauucuguaaggaccgaugcacccaacuuuaagaucucgagacucugaccaggcugaguaguguguuacagaagucuagcucuagaaggaaucuucgccaucaccucaccuaccuucgucuacuauugagcgcuuccuaugugcuaggugccauucuaagugcuuucuguauauaaaugcacuaaauccuuacaauccucugaggucuuauuauccccauuuuacagcugagaaaacugaggcucagaaggaaguaacuugcccaaggucacagagcaggccaguggcagagccaggacucaaacccaggcugugcuguccagccauuaggccucuccccauuacaaagauggggaaacugaggcaagagagguguagucuuccauggauuucaauccccaggggcuugaagugauaaacgguguuaaguuucuuaaacauuuagugucacccagcaucacuggcaccugcuuuucauucacccuggggagucagaggugugcagagcagauucggagcugcgcucucaguacugaccucgcuaaccagguacucugcccuaggaauggaggugcagugaacccucaucccgaaggaaagcaccugauugaaggaaagcauccugaaggaaagcaagggaaagggcaccugauugaacagcagggaggcugggaggguugggguggucaggggcuucucugaggaagggaugggggaggcugagggggaagaagagcauuuugagcaggaggggcggcacucacaaaggcucuguggcagaaggggggcguggaacuuucuggaaacugaacagaagccaguguggcuggaguggaaggugaggggaguggaggagggagggacaggaaguugggggcaggcagggcugggcaugaggacgauucugaucuuuaucuucagagcuaaccacuguccccuccaucugauaguaaacccuggaccacagacaggaaggaacuugcucagggccacaccgcagagucagccacaguggucccaacauccagcuuuuaaagaagacaccgaggaaagagacagagggaagguagcucccaucaccccuuuccuccccaaaaucgacaccuaacucuucccacucugggcuuguuuuggaaaugaucuucauuuucaaugcucucgcuccuaugccuagacuguacacagaguaggucuuuaauaaaugggcccugcagagcccuggauuauuccggaaagaauggcaguuagcaugaaaggcugagucccaggggggccucugauccgcaggauacccuaagggucaugcuuacaaccuaugagguaaaggcuuuuccuagcgcuggaagggccuguaauacagagugagcacccagcugggcccacaccucugccaucucuguuagggaagaaaacaacguaaccuggaaauacugcagauccuuagcacacacacagucuccucugcgugacgucacuuugguuugauaaauaugaacaaaguuagcaccaguugcuccucuuaagccccugggaaaagaaacguccagaagccuaagccuccccugccucaguuucuucaucuguguaacaggaggacacccagagaggccuuaaugugcaggaagacuccagggagaaacugagccaaacgggcccugcacuuccuggcagcccagggaaagaggggccaguaacugucaggacaaaaccacugucuuuuggcccugggggagcuuccugguagccaaagagacacaggauucucagguauggccugaaagaggagcuggaagcagggaaggaaccugagcuaaacggguggcagggccaggaccuuucccagcugggcaggaaggacggaccugagccccuggacucucacuacagugcucagcccaggggaggccgcccagcucuuucccagacaggggucaauggaccaaggcagcagagggucccaggaugcuaugcuggaacaggaaaccugggugcugguccaggcgccaaggccucaggcuccuuucugcgaaacggaggcaguacccauuugucccacgggggugccucaacugccagagacaagcaucuaucuggacggucacuguaaguauccguuuacuaacuguuaaauaccuauguggggcagggauccugcaucaucaacgacagcagcaacuccugcuacugacaagcaccagccugccaugcaucuacacugcacugccccuaacucaugucauccguguaacuguaugggguagaacugaggcucugagagauuaaguaaauuggcccaauucauaaagcuuacaaacaacagagcccagacacaaaugucagaaucaaucuauccagccagaguuuuuguuuguuuuuuugagacagagucuugcucugucgcccaggcuggagugcaguggugcgaucucggcucacugcaaccucugccucccguguucaagugauccucggugccucaaccuccugaauagcugggacuacaggcgagcaccaccacacccagcuaauuuuuguauuuuuaguagaggugggguuacaucauguuggccaggcuggucucgaacuccugaccucaaaugauccaccugccugggucucccaaagugcuaggauuacaggugugagccaccacgccuggcccagccugaauuuguaacccuaauucuagacuacguccuggaccauggauccaucauccuaggagguagggacuguauuuaacuucuuuuuacaaugaagaaauagauacugagagaguucagaaaccuacucaaggucacacagaaaccuacucaagaccuugaaugcagaccugccugcccccaaagccugugcucuguccacugugcuacaccgucaggaucucgaagagccguagagggcagauggaaaugaggaagucuaaccuggagaaggaaaggcugaagagaaaccagcagggcaugcagaccaagacuuaaacccuuuguuugccacuagaggacccauggcgggguaggacuucccagaaauggaauaaacuccuaccaguccugugcaaacacuugguggccuguuacacgugcuagugagaucccccaggguggccggggcccagggacaccagucagggcugccaaggaugggaggcagaguugugcagcgguuaacuucguggguacuggaggcaaacagguggaucugauccuggcuccaugacuuuagaaccuagugaccuuaggcaagucaccugaccucucagaacagcuguuggcucuucugcaaagaagggcaauacugccugauucaguguuguuguguggauccagugguacagggagguggagaggugugggaagcgcuccacacagugccugugaggaauucagcccuccaucccagcaguccucauuacugaguuuuuaacccaaaugcuacacgacuaccuccuagaccaccagauccuccucccaaggucuucuucccacaagaccucuguacccuaguccaguccuuucuaagcucaucacaaugucauucuugcagcucaggaccuggcuucaagagacauggacagggcuuggucaggagcugcccuuugugcaaagggccuggggcaguuguuucuucucaccuggcaccacugcccacucuggcugagcugggcagaagcaggcacucagcccuugcccaaggaauauacaaaacgagggaguggggagggagugcaggccacagggagcaguuccccaccuccugaagggcucugaacucagaacauccccuaagugccuauaagcaaggagucaacagcugcccuccacaggguggccagauccagcaaacaaaaauacagaacacccaguuaauuuccaauaucagaucaugaauaauuuguuaauaugucccacauauugccugagacuuacucauacuaaaaaacuguucguuguugaucugaaauucaaauucaccuggaucuccuguacacgaccugacaacccugaccccucagggccuuccagcacuuuguugucucugacugguagcggcuaacacccuuggagacuggggucucguuugccaagucaaggggaggaccagccuuuucauccuggguaccgaaagccagcauagcucauaccuguggaugcucuuagccugucaggcccaaaaaguugcucaaaaaaagccccaaagagacuaagcccucccaaaggacagaaacagccaacguuaaagucagcccuaagcugguaccccagaaaggaccuggcccuggagucugaucccuauggguucaaauccugauauugccacuuacuccccgugggaccuuggcaauuuacccagucuaagcugaaguuugcucaucuguaaaaagaugaccauaucagcuuucucauaaggcugccuugauuaaauaaccuggcacaccacagaagcccauaaauuagagcucugucccucccacugcccucaccugauccucugucagcaauuauuuuaagcaaaucccucaucagagaaaaggcaguugguguuaaccccacauugccuggaauagagugcauauugauaccaacaagccucggcugcugucacguaaauuucuucccagcugaacguuccauccaagcccauucccuugcuccagccaugucuccccaccaccuuugacuggaagcuucaggaagguuugcugaagcaaguaugauuaagaagggaaacaugccuauagcaagucauagcacagauguuguguaauaauaaaguguauuaagccauuguuuuguaaccaucuauuucucagguuccuuuagucccagacaccaacagggagcuaaaugcucugucauucaugaguaagaggacauuccuggauauugccucaaaggaggcugcacuaagacccaaaauggccgguuugguccaagguccacaccuuccugaccaaaacuacagccccuagccccucuaaugcaaauggagcccagacacgugggcggcggggcugggcggggagaaaaagaacagccgcuggcacccagacccggacugagcucacggcucgggaaaugaagacaccacaggaagcccugcaguguuuuccccagugcacaaaguugggguuuucugcuuuuaaguaauuucuguuggaguucgcgcuucuugauuaugaaauaagggcgcuggauguguaaacuuuauaaaaccaacugcuugggaacaucugauuuccuuaacccgacuuagcaaacaaggaggcuccugaaacggugcugggacccggggggcaagcccagucccugaccccgcgcgggggaggugagccgccuacaagccccucccgcgcaccuuccuccuccuccaggggaauucugggcgugcaggcaacagcaaugcugggaccggcgcugcccgcugggagggucugaguccgggagggggcggcccuugcccuccgcugccaccucccacggccccucagugucgcccugcuggccugugccuggaucacucucccugcuguggccugccugcccaucuccuucuugcguggggucuguaccuucccuuccucccuaccaucccucuuuccccaaaacuccgguccuuccucccaccuuccgggaaaaugcaaaugucccacuuccucccgcaaaggggacccuccccccagcccgucgccaccuucagguucacagcaggcagcuccaucccgacucaggccgagggcaccugcgccgcagccgcggggggcuccuaggcuccgaacucggggaacaaacuugcccggccccgccccgccccgcccguugcggccacuccaaccccagcgcagcucaagaccacgugaaacgggcuggagcgggucacgugaccgccgcuugguugcuaggagacggcgucggcagcucgcgccuucagccaagcuccagacucccgccaccgcccaggcaguacuugggggccgcuggcgaaaguuggaguuucugucgcccagggcguauccugccuggcuaauauuccaggaagcggacuguucggacugccug

SEQ ID NO: 14225 - RNA, 3093 nt, Homo sapiens
agaggauauguuugcauggcaaauugauuucaaugguggggaccgcuggaagguggagagccucccuggagcccacgggacagauuuuccugaccccaaagucaagaaguauuuugucacauccuacgaguaaggcaaacugaaccuaccaggcuugcguggaggggacagagggucaggacaccuuugccaagucucaggcaaagucuuccuaagggaaguccucucugcgaagcucgagggagguggccccaaaacuugcccagagucacugcuuccugaaaucacucagugcuguguuaauggacaguggggguggggaucacugaagcaggccaggaguccauugggcaguuaagauaagccagggcuaucuacaggcaucuguccguaagcuaggaacuugaguuuacaaaagugcccuggaacaaugggccuuuggacugggaucaaaugccgcccaggcacaagugggucaaacucccuccugcacuggaggaaaagccagagucagccccagccagugccugucccgcagcggccaagggguacccuagguccccaaaccaccucccugggcucacaggggcugccaaggccugggugagggggggggccaugcagagcacacccagguaugcaagcccccaacucugcuccccagaaugugccucaagucccagcugguggaccuuguagccgagggcuacugggaggagcuacuagacacauuccggccggacaucgugguuaaggacuggugaguaggguccauggccuguguccccacacucuacaugcuccucuuacugcgcugcauguacgugagacaacccauagcaagugcccacucugcacagcagugcccuggagccagguagccccggccuccgccccugcucugcacccacacccugcggcaccuccuggccuccccaccacccugugacguagucaacaggacacaguagccccagugugcaggugaggaggcugaggcccccaggugcacugucauggacaggcacuuuuuuuuuuuuugagacggagucucgcucugucacccaggcuggagugcaguggcgugaucuuggcucacugcaaccuccgccucccauguucaagcgauucuccugccucagcauccugaguagcugggauuacaggugcccaccacuacacccggcuauuuuuuuuuauauuuuuaauacagacagcgucuuaccaugcuggucaggcugguuucaaacuccugaccucaagugauccacccaccucggccucccaaagugcugggauuacaggugugagccacugugcccagccacugugcacugacaggcacuugggcaacagaggaccucagcccucucuggacugggugggaacccccagguccccugaccuaccugccuccccugccccuuucccuauucaucccaugacucuuuuuggagcuccuacucugugcacagaacugugccaggcucuggcuuggccgguggcagaagcaggaccccaguucuaggcaggccccagggcugccacucugaggauaaagcggugaggauggagggguaugcagagcugcaggggggagagguggcugggcugagcagagggugagcuuugugccagccccauuacacaggccacccccuugacucucccacugaauccacagccugguccauuguaaguacaggugacauggcuuggacagaccaggccucucuggaggggucuuuugauuuuugaggucauaucuuuaguaggaugcccaaaagggucccucuucucagaugggguaacagaggccagcauggacagacagcuuauccccgggccacaguggggcauagggagcgcugaagccagcugggccuugcaggcagagcagugucagcugaugggagaugaagcuccgagcuccaauguauaggucccaccugcccccaccccuggggccagcccucgguggcuuggacacagggcucucaaccccuccaccagguuugcugccagagccgacuguggcugcaccuaccaacucaaagugcagcuggccucggcugacuacuucguguuggccuccuucgagcccccaccugugaccauccaacaguggaacaaugccacauggacagaggugaggccucacccacuugcucucucuacccacuccucccagggccaggauggcaggaagcaaagggcagccucagggcccagggugccccugcuggccuggagcuguugccuuccagccugggcagcucucuuagaggaccuggcuccugccuuccccucccccgucccgguggucacuuccucucccuuccucccaacaggucuccuacaccuucucagacuacccccgggguguccgcuacauccucuuccagcaugggggcagggacacccaguacugggcaggcugguaugggccccgagucaccaacagcagcauugucgucagccccaagaugaccaggaaccaggccuccuccgaggcucagccugggcagaagcauggacaggaggaggcugcccaaucgcccuaccgagcuguuguccagauuuucugacagcuguccauccugugucugggucagccagagguuccuccaggcaggagcugagcauggggugggcagugaggucccuguaccagcgacuccugccccgguucaacccuaccagcuugugguaacuuacugucacauagcucugacguuuuguuguaauaaauguuuucaggccgggcacuguggcucacgccuguaaucccagcacuuugggagaccgaggcagguggaucacgaggucaggagauagagaccauccuggccaacacggugaaacccugucucuacuaaaaauacaaaaaauuagccgggcgugguggcgggcgccuguagucccagcuacucgggaggcugaugcagaagaauggcgugaacccggaaggcagagcuugcagugagccgagaucacgccacugcacuccagccugggugacagagcgagacucuggcucauaaaauaauaauaauaauaaauaaauaaaaaauaaauguuuucaguaaaacc

SEQ ID NO: 14226 - RNA, 5258 nt, Homo sapiens
aauaacacccgccucaaaaagguguugcaagacagauaauauaugcaaauagaucaagacaauguaggcagcagaucaagaaacuacagaucugaaucuguuuaacagauucaguggaauucacaaggaagaagcugggccccacugccaccuugauguugucauagaccuugcugauggaagaguacauucugcaguagguggcggacaccagagucccuggaaaagucauucuguaguauggugagggaagcaguugcucagacuucucaucuccaagauauucacggagggucuggugaagcccgcuccccgucuugugucucugccccaaagccccauugcugucagcugguucagagaggagcagaaugaagaaggagauugcccauugccauggaaaccaaggcuagagcccagcacccugcagcuccugggcacagagcggauaugugccuccggguuccaaguacccagaugccccucccacccaguguaugugugccugcaugugcgcgcacacacacgcacacacacacacacuccuagccaccaguggcugaacuagugaacuagcagccauucaacugagcucucccagggguccaaguuucuccaggugguaaaagaccagcucuccggccagagaagccaguuccucugucaaggacaucaaaaagcaagacugaucagaaggggcuaagacaggccguuggagacacuuggcugucacauucaggaaaccaccuaccugggccagugcauggaggagcuuacauggccacgcauguaagccacgugccagcagacgcucuggcccucccagaggcaaaugaguuuugcaauucccgguguaacaagugauccaggcaaggaucaucaauggaugcaguaauauguucacaagucuaacaauaucaccacagauuacuuauucauuacaaaagggaaaagauaccuucaaaggagaaaucuagcagacaccacgugaucaaauguagggucaccagaaauaggacaagcugacauuacaugccuccuuggguaacguaaugagaagugcaagacaucuucuauuuaauauucucaccaaaaauguaaggacugaauugaaucaugaggaaacaaucgacauucagguugcugggcguuuuacaagacaucugauauggacucuucaaaaaugucaauuacaagaaagaccaaaagacuagaugaaaggagacuaaagagacaugacaauuaaaugcaaugcacgauccuuaaguggcuccugaaugggagaaaaccagcuauaacugacauuuuuagaacaauuggggaaaugugaauaugagcagaacguuagauaacauuauuacauccguguuagguccuuggguaugauaauuauaucauuaugguuauggaggagaagauccuugcucauagaagacaugugcugauuauuuagggauggagaaucagaugucugcaauucacuuccagauaaucagaagaaaggaaagaaggagagaaaguaaaaguggccaacguucacaaugggugcacccacgugcaggauacacagauguuugauggacugcucuuucaacuuuucugagguuugaaauguucaaaaucucaaaauaaaagaggaaaagacucuuuaaaaaaggagucaaaugauucaauauuccuggcaguuuugugggggcaugucaguggcaaaagacgggugccucuuucauuuucucuacgcaccucguuuuuuucugcuuugcccuguucugcaugagauuccucuccuggcucucgacaggggaaacugaaagcccccagggcacuucauggugaggaacaacuucucugacgguuuggagacggaggaggcugacauugcagaaaaugcagcauuuggcauccucuucuugaaaauaccuuggucucauuucucacccaguuguagcccaccaccacguggcuggacucuuccuacugggcucccucugcccuucuuucuccucucuuccccuccgcuuguucuucuccucugcccugggaucucacuagcucuuugaaaucuccuucugccuguguuccaaggaccagcacaacuggcuaaacaaagaaggcacuugcauaacuuuggaacccaaauuccucuugguguagccacauuuuagucuuuuuuguuugguucgguuugguuuugagacggagucuugcucugucacccaggcuggagugcaguggcaugaucuuggcucacugcaacauuugccucccaaguucaagugauucuccugccucagccucccgaguagcugggacuacaggcaugcaccaccaugccaggcuaauuuuuguauuuuuaguagagaugggguuucgcuguguuggccaggcuggucuugaacuccuggccucaagugaucugcccaccuuggccucccaaaguguugggauuacaggcgugagccacugcacccagcccacagucuuccauacucuaaaccuuacucuuuaagaaaacacaaggcugggugcaguggcucacgccuguaaucccagcacuuuggaaggccgaggcgggcagaucacgaggucaggagaucaagaccauccuggcgaacauggugaaacccccgucucuaauaaaaauacaaaaaauuagcugggcaugguggcgggugccuguagucgcagcuacucgggaggcugaggcagaagaauggugugaaccugggaggcagagcuugcagugagccugagaucacgccacugcaauccagccugggcgacagagugagacuccaucucaaaaaaaaaaaaggaaagaaaagaaaacacaaggcggcugggcaugauggcucacaccuguaaucccagcacuuugggaggccaaggaagguggaucaucugagguuaggaguuugagaccaaccugggcaacauugcgaaacccggucucuacuaaaaauauaaaaauuagccuggcuugauggugcaugccuguagucccagcuacucgagaggcugaggcaggacaguugccugaaccugggaggcgaagguugcagugagccgaaaucacgccacugcacuccagccugggcgaaagagcaaaacucugucucaaaaaaaaaaaaaagagagagagagagagaagagaagaaaagaaaacacaaggacuccauuccacuaucaguaauaauaauagcuacuauuugggggguacuaacccugcacuucgaauacaucaucucuaacacuuaugaaugugccccaucagaggggcccuaaggaacgugacauucaggauggcugaugagccagcgcaaaguccacagccaugaagcugaaaugcuacagaguggcaacacagacacugcagacucagaggggggaaggggacgugggguagggaugagaaauuaccuguuggguacaguguacacuauucaggugacagauacaccaaaagcccagacuuuaccacucucauccauguaaccaaaaaccauuuauaccccuaaaccuauugaaauaaaaaugauauuguuuuuaaagugaagaugcugccugaucggggccuuuuaagaugcuucccaacucugacaaagaguguuucaugaucagaggcugccggagcugccaaaggcuacccaaguacccagacagacagagugggggcuggaccugaggacacgcccucagggcugggaggagacuaaggagauggcgaugggccaggcgcgguggcucacgccuguagucccagcacuuuggaaggccacggcagguggaucaccugaggucaggaguuugagaccagccuaaccaacauggugaaacucugucucuacaaaaaauacaagacagcugggcgugcuggcacacaccuguaaucccagcuacuugggaggcugaggcaggagaaucgcuugaaccugggaggcagagguugcagugagccaagaucacaccaccacacuccagccugggugacagagcaagacuccaucucaaaaaaaaaaaaaaaaaaaagagacagagguggugaagcugggagggggcuaaagagacagcgauggugggacugggaggggauuaaagagauggcgaugguaggggcugggcaggaguuggagcaugaacaucugagacaauggcuuagcucagcgcucagcgccccccgcuccagaauaugaauauuggacaggacaucaggaagguacuggagugccuccucccaaagugggaagugggaauggccccucucccccaccuccuccaucaucccccaacucaccagccuuccccagagguucaagccacuucugcucccuccuggcuccaagcaagucagaagaccuaagggaaauaaacuugaaaagagacugggaauguaaucaaaaguagcaacgacgaugugugcuggaaaccaggaggaaacuggcaaacagcagcagagggcugaggccugggagagccggggagagacggagagggcagaggugaagaggaggaagggagagaggguagggagaggcagcucagccacacagccagggcgcagaggcugccagacaggaggaccccaggcuacgcuccugggaaacugggaagagaugauaucuagacccagagucugguguuucuucugaaauguaaauaaagcucacuucagucuggggacuucugaggaaggugagagaagcugagaacagagagaaagacagaggcgcgagaggaacacucuggaacgcuuucauguguccucuaacugaacacguaaucucuaggggaagauguuguuacacccauuuugcaagugaaaacugagcucagagagguugcguucucugcccaaagucacacugugaaaaagccguugacuccaaaccccuagacugggcugacgugagaguccauuuggaaguuauuaucagagugggagcccuucaagcucucagcaccaagacagugucgugaagcaggagacgggggacuuccugaggccacauacugaaucuaacagccaggucugagcaagcgagagcaugggaggggaacagacccagagacauggggccagagggaggcagggggaccaggaccucauccagaaaucuccuucauggcccucucaccagccccacagacuggacuucaggcaggaacagcacaugaccagaagacaacguaaaauaaauaaaucaguaagaggaacacggaacacccacacuuucucuguggggucucaaaacagcagg

SEQ ID NO: 14227 - RNA, 66750 nt, Homo sapiens
ccuguuuccgggcgggccuccagaggccggcgcacaagauggcggcucuggcggccuaaagaaggcggccgcggcucagccgugggcucuaacgcggggcugggggccggagacagacuucgcccaggugacggguaguaggggcggcgccgcuuggccucgugggguguaagacccacuugcuguugcccccggaccuugccgccacaccagcccuguccuggggcggaaccgaaggaaggucgggcccugcugccccgccccguccuuccuccuucccgggcggucacugugcguggcucacuuuuagaguuuacuucaaccacguggagcuuccauggcggccucucagguccugggggagaagauuaacauccugucgggagagacugucaaagcuggggacagggacccgcuggggaacgacugucccgagcaagauaggcucccccagcgcuccuggaggcagaagugugccuccuacguguuggcccugaggcccuggagcuucagugccucacucacaccgguggcccugggcagugcccuugccuacagaucccacgguguccuggaucccaggcucuugguggguugugccguggcuguccuggcugugcacggggccgguaauuuggucaacacuuacuaugacuuuuccaagggcauugaccacaaaaagagugaugacaggacacuuguggaccgaaucuuggagccgcaggaugucguccgguucggagucuuccucuacacguugggcugcgucugugccgcuugccucuacuaccuguccccucugaaacuggagcacuuggcucuuaucuacuuuggaggccugucuggcuccuuucucuacacaggagguaagauuuggccuguccugugugcugcaggucuuagucgcguccacuggaaaccgcugcuuuguaaaggaguuauagggaugucaaagguggcuuucuaauuuaagccgcuuuaauugaagucuauaauugugggugaugugaauuuuuugaaacagugauuugagaagauccugguuugacuuacggacguagggcaugacugaaaauuuuauauggacauuuauuuuuauuuauuuuuuauguauucauuuuugagacggagucucgcucugucgcccaggcuggagugcaguggugcgaucucggcccacugcagccucugccucccguguucaagcgauucuccugccucagccucccgaguagcugggacuacaggugcacgccaccacgccuggcugauuuuuguauuuuuauuagagacggggugucaccauguuggccaggauggucucgauuuccugaccucgugauccacccgccucagccucccaaaguucuaagauuacaggcgugagccaccgcgcccugucaggacauuuuuuaauuuuuuuuauuuuuuuugagacagagucucgcucuguugcccaggcaagggugcaguggcaccaucucggcuuacugcaaccucugucucccggcuucaagcgauucuucugccucagcuccccgaguagcugggacuacaggcaugugccaccacgccuggcuaauuuuuguauuuuuaguagagacaagguuucaccauguuggccaggcuggucuugaacuccugaccucaugaccugccugucuugcccucccaaagugcugggauuacaggcgugagccaccaugcccggccuauauggacauuuuuucugucucauuuuuuuuuuuaaucacucauacuuuauaaugccacaguuucaaauauuagaauuaaaucugaagaguucaaaaugauauagauaauuacuucuagcuaguuugcuaggugacuucuugcaagaggcugauuaagguagugaugggcagguggguaagcccuauuuauugagcaccuauuaugugccaggcacuguucugugugaacacagcagucacagaucccugcccuugugaaacuuacguauuaucaugaaaagagacagaaaguaaaaauagaaaauuauaguuagggugaccaauauccugguuugcucaggacuaaggugacaggacuaagucggaugugcgacuucuggagcuaaaaccagaaaaguuccugguaagucagguugaauugaucacccugauuauaguauaugaaagaugauaagugcuaugggaaaaaaaaguagagcaaagaaugggacacagauuacuauuuuaaguaguuugaucaggguaggcuucaucaaaaagguaacauuuggcugagugcaguggcucaugucuguaaucccagcccuuugggaggcugaagcgagaggaucgcuugaggccaggaguuaaacaccagccugggcaacauagaccccugucuguauaaaauauaaaauaaaaaauauuagcugggcaugguggugcuugccuguggucccagcuacuuuggaggcugaggcgggagaauugcuugagcccaggggucaaggcugcagugaguccugaucacaccacugcacuccagccugggcgacagagugagaccaugccucagaaagguaguauuugaguugaguuacauugaaggagguaagaggugagggaguuggccaagcagauaucugagagaggagcauuucaggaaaagcaacagcaagugccauaggccuucaggcaggaauguguccaaagagcuuacagagcagcaagaaguccagugugugaaugaaggagagaguaaagagagguaaaguaagagaaguacguuuggggaggguaaggaggcacacacacggauuauauagaccuuguaggccacuggucuuggcucuggaauggaggagccacugcaggacuuugagcaagggagugauguaauauaauguuuuaaaagaauugcucuggguaagguauugagaauggaucaaggggaguggggcaaggguagaggcaggaagaccaaguaggaagcucuugaauaauccaggcaagcgauguuugguggcuuguaucuagcgggugguaguggaagagguaaguagccagauucuaaauaugcuuugaagguagacaggguuugcugauggauuggaugugagguaaagagaaacagaggaauuaagcauaacucaaagguuuuuuuuuuucuuggacacauuccacauuuuauuuacauuuucagacuaacuuugggcugggugcugugccucaugccuguaaucucagcacuucgggaggccaaggcaaguggaucacuugagaucaggaguuccagaccagccuggccaacauggugaaaccuugucuguacuaaaaauacaaaaauuagccaggcgugguggcaugugccuguaguccuagcuacucgggaggcugaggcaggaggauugcuugagcccaguaggcagagguugcagugagcugagaucaugccacugcauuccagccugggcaacagagagaggcuccaucucaaaaaaaaaaaaaaaagaccaacuuuaguuucaaaauuauaucuccauauauguaucccuuuuuuguugaugucacuuaaccuuaagugcauaguuuguuaaaaaaaaaaaacuguaagcaaauauuuaccaugucuguuacguguaacacacaugaacagcuuuuaacagaaauucaucaacucccccccaacauuuuuuauuauaagauagguaucaaaacaauccugaacauauuuuucauacuacuaguagucagcacccacaccacuucaaaaauuaacacauuugugcuggaugugguaguuuuuacccauaaucccaacacuuugggaggcugaggcaggcagaucaccugaguucaggaguucgagaccagccuggccagcauggugaaaccccaucucuacuaaaaauacaaaaauaagcugggcaugguggugcaugccuguagucccagcuacuugggaggcugagguaggagaaucgcuugaaccugggagguuguagugagccaagaucucaucacugcauuccagccugggcaacagaacaagacuccaucucaaaaaaauaaaaaaaauuaaaaaaaucaaacacauuugugacaguguucauuguaccugcuacuuuuuuuuuuuuuuuuaauuuaacggagucuugcucugucgccuaggcugggguacaguggugcgaucuuggcuuaccacaaucuccgccucccagguucaaguauaaucccaguagcugggauuacaggugcccgccuggcuaauuuuuguauuuuuaguagagacgggguuucgccauguuggccaggcuggucucucuaacuccucaccucaagugaucaacccuccuuggccuccuaaagugcugggauuacaggcgugagccacuaugccuggccaauaccugcuacuuuuuaaacaauuucaacugcagcucucuuucacuaagcaagauggauaaagcaugccauuucuguuuucuuuuuucuugagacagaauuuugcucuuguugcccaggcuggaguacaauggcacgaucucggcucaccacaaccuccaccuccgggguucaagcaguucugccuccgccucccaaguagcugggauuacaggcaugggccaccacgcccugcuaauuuuguauuuuuaguagagacaggguuucuccauguuggucaggcuggucucaaacuccugaccucaggugaucugcccaccuuggccucccaaagugcuggcauuaaaggugugagccaccucuccuggccucuguuuucuuuuuccuuuccuuuuuuguuugagaugggggucuuacucugucacucaggcuagagugcaguggugcgaucucagcucacugcaacuucugccucccgggaucaagcgaucauccuaccucagucuccuaaguagcugggacuacaggcgcgugcuaccacgccugguuaauuuuuggauuuuuuguagggacggacuuucacuauguuggccaggcuggucuugaacuccuggccucaagugaucugcucgccugagccucccaaagugcugggauuacagacaugagccacugugcccagcccuguuuucuuuauugagauuuuuagucuuuagaaacacacaugcuuccacugccaucugacacuucuuaccacgcuuucaucuuguaaaccugaauuauauuucgaguacuccaaguuuauguuuaaaugacaguaccuuaacaagagaaaaaaauuggguugcauuuuuccuguuaccugaaaacauaauggguguacauauauuaaauauauucuuacaaauguccaggucauguuuaccagccggaguucuuuuauuuaacguguggguauuuugcauugugauauuuaaucaagacauuaacacgaguagaagguuguugauauaagacaaguuugagauccacuaaaauuaauuguuguauguuuguccuuccaguggcuguggaagcuucauauuuucuuuggacaucauuagacgucuuagcuccugaaguacaacuuuaaugcuauaugaauuuugucauuuugcuaacacuggugugcugcggucauccaccaucccacuggaguuauuuauuccauucauauuaauucuuguuacaaaucuaacugaugggggagcuucuggguauuuggguccacuuucuauuuucaggcuauauauucuuuuuuuuuauuuuugagacagaggcucgcgcuguggcccacacgggagcgcaguggcgugaucucggcucacugcaaccucugcuuccuagguucaugugauucuccugccucagcuucccgaguagcugggauuacaggugcacaccaccacacccagcuaauuuuuuguauuuuuaguagagaugagguuucacuauguugggcagacuagucucaaacuccugaccucgugaucugcccuccuuggccucccaaaguucugggauuauaggugugaacugccaugcccggccuauauucucuuuucauaauuuguccuugguggcccaauaaucaugccuguccaccuuguaaaugucauaucuucaucaucuuuaaggccccaguuaaucauaccauugccuaucaauagcugcauaagcauaacucaaagguuuugaccugagaacuggaagauaccaucuggagugaugucaucaugugagaagggcaaggcuggggauagaacaaguuuugggggaaaagcaagcaauugacuucgugguuuuuuguuuuguuuuuuguuuguuuugagacagagucucacuccgucucccaggcuggagugcaguggcaugaucucggcucacugcagccucugccucccggguucaagugauucucagccucccaaguagcugggauuacaggcgucugccaccaugccuggcuaauuuuguauuuuuagcagagacgguguuucaccauguuguccagacuggucucaaacuccugaccucaggugauccacccaccuuggccuaccaaagugcugggauuacaggcaugagccacugcgccuggccaacuuuggacaucuuaaugucuauuaaaucuccuaacaaagaugucaaauggguaguucaaguucagagaagccugggcuagagauuacauaucugggagucauuggucuauagauaaaguuguaggacugggugaggucaucaagggggagggaguguugguagaaaagucaguccuggucugagcccugggacacucccacauuagaggugggggaagaaaaggcacagguaaaggggaugugagcaagcauccagaggaguaagaggaaaaucaaaaggcugugguggccuggcagcuaauuauaaaaaguucagugaaggaaaucaaugaggugguguaauagaaaguacaaggugguggugaagggaagaggcugucuuugugaaagugacguucaaacuaggacuugaagacggaaggauaaggagcuggccacgggguggaauuggagucugauugugaugcugaguccuccagggcugaaggaccacuaagugcaaauguggugggugagagagagugugacauuggcuaggaucuacugaaaggucugugugagccagagggggcaugagacacaguuggugaguuaggcagggucucugucauggcgaucuuaaccaguccuacuccccaaccuccagggcucaguccuugggccucuuuucucuaucuccauguacucccuuggugauguagcucauggcuucagaugccaucuguuaagcuagugacucuuaaacuccagacucauauccaacuucuugcucagcaacuucuccuagaacugucucauaaacaucucaagcuuaacaugucugagaccaaauucugaucuucuccccaaggaaaccugcuucgcccacagcuuuuuccccauuuugcucaauggcagcuucauccuaguucuucaggccaaaagcugugggcaucguccuugacucccacgucucacauccaguucaucagcaaauucuguugacucuccuuucaaaaugcauguaggaucugaccacuucuuaccguguccagccaccacugugaucaucugucccuggauuuuugcggcaggcucccaacuggucucuuuaccucuguucuggucccauucaggcuguucccacucagccaccagaguaauucuguuaaaauauagggcagcccugucaguccugcuuagaacucuucaguggcucccaucuugcucagaguaaaggccagggucuuuacagugacucccuagggcccuacauucuuugcccaccuuuugcccuccccccaguucucugacccacccuccuccuuucuuccugcucauccugggccagccacacugcccuuucuaguccaggagcaugcacaaccccuccugccccucccucagguccuuuguagaugcagcuuccucuguuugaaaugcuuuuccugcuucuaaccaugugguucacuuucucacuuccuucaccuauuugcccaaaugucagcugcucagugaggccuugcuuucuaccuugcuuaaaauuacacacccacuccgugcccccaccugauacuuccccugcugcucuucucugcauuaguuuuccucauagcacauguuaccuucuaaugugccauauaaaguacuuaauugguuaauuaucuucccccuucgacugcgagcucccucccugcagucagggauuucugucucugguauuagcugaaccccuagcacccagagcacugccuggcauguaauauuacuuaguaaauauccagugaacaaaugggaaggcauugaaauauacugagcagaguagugacauaaucugguuuaagauuuuuuaaacauugucuuuuauugacauauaauugacacacagugaaaugcacagguuuuuaguguugcagcuugaugaauuuugauaaauguauacaguugcauaacccacaccccgucaucauccagaacacuuccaucacccccaaaagcuucccagugcuucuugccugucaaucccacacucccugcccccauccagagacaggaaaagaaccacuguucugauuccucucacagagauuaguuuugccugucauauaaauggaaccuuucacuaugaacuauguauguauguauguauguguauuuauuucagucugagcucucgucuggcuucuuuugcucagcgugauguuuuugagauucauuguuuuauugcguguaucaguaguuccuuuuuuugcugacuagcauuccauuguaacauaccacaacuucuuuuuauccauucuccuuuucagggacauuuggauugcuuccauauuuuggcuauuacgucugaacauucauguucaagucuuuuuguggauauuuguuuucauuuuucuuggguaaaugcccaggaguagaauugcugggucacagggcagaugauguuuaauuuuaugagaaacugccaaacuguuuucugaagugguuguacuucuuuacacuccccccagcaaguguuccaguugcucugcgucuugccaacuuuuugacuuaagucuuaacagauucauucuggcugccguguggagaaccggcccaguauuucacuguguaagcucauucagaaaaugggguugggagaggaggaaugccuaaaaggaaauucccagaugggccacgucucugaaucagguagagcacaugaagccuugggccauguaucaaaugcuaggaaacagcuuucuccccaagggcucuacuguuuucuugugucagauaaccagaucuuuuuccuccccagaguggguugcucuugguuuugggguggggacagagaucucugcucaaccuugcuuacaucacuuuuuuuuuuuuuuuuuuucaaaagacagaguuuagcucuuguugaccaggcuggaguacaauggugcgaccucugcucacugcaaccucugccuccugguucaagcgauucuccugccucagccucccgaguagcugggauuacaggcgugcaccaccaugcccggcuaauuuuuuuuuguauuuuuaguagagaugggguuucuccguguuggucaggcuggucuugacuuccugaccucaguugauccacccgcuguggccucccaaagugcuggaauuacagcgugagccacugugccuggccuuuuuuuuucuugagacggaguuuugcucuuguugcccaggcuggagugcaauggcacgaucucggcucaccacauccucugccuccaggguucaagcgguucuucugccucagccucccgaguagcugggauuacagacaugcgccacuacacccggcuaauuuuuuguauuuuuaguggagaugggguuucuccauguuggucaggcuggucucgaaccccugaccucaggugauccaccugcuucagccucccaaagugcugggauuacaggcgugagccaccauaccuggccgcuuacauugcuuuuugccgagugaucuaaggagguguucuuggagacuccagccaaaggucaaggcuguagugcuguugcauuuucuuucacagccagaccaguggcgucacuuggggagcugagaaaacaagcacagcaagagugggcagcuguagaggaacuggcuaggucugugcugggaguauuccugcccagcaucaucuuugcguggguguagucccuuaaaugugugagauauuggaagagacgucaauuuacuaauucugaacuggagcucgugcucugcuugagggaacuuccuccuggagggcauguccucauacaaccaaauuauuuaugaaaacauggcuugguauaaaaauuauccaaauagaaggaaaaaaaauauggcuugagggugcagaauuagcuugcugaauguugaagagugucaguggccaugccuuaaugcccuucccuggagauacuuuguucugaagaacuaaggguguguauuuagcaccaagggaccccagcugcugaugugaaggugaacuuggacuggaucuuguuccuuagcuccugucauuuuauuucauuuugauuccuguggcuagugggaacuucugucauuuuagacugguuaaaaugccuaaccagagcuuuauuuucugaucuugaguccacaucuuguagcuugguuagaacuggaguuugcuaagcuucuguagcaauaauugcaugggucaccucccucagugggcagcuccacucauuccauacugcuuuaccuguuucagucugagugggagaucuuuccugaccuugaucccaaauuccaggugcuuguuacuguagcucugucuucaguucagcccuugugccaaguauuggggagugagcugugaccaagccagacacauguccugcccucauggaacuuacaguuuagugagaaagguggagauuaauuagaagcaugaugaaguuuaugaacauggcaggcauauugccaugggagcauauugcaaggggaucaaauguggcuuaggggugagaggaggugguccuggggaauggucuuuaaagucuuaaagggugaguagaguuagccaggccaagggaggggugucugaaggcucugacggauuggaagaagucugugugaagaggggaggagagcucaaggugaggcaggagagguagggcugggccacaggugagccagguuaaagaucugggacuuuuauccccaggaugagugguugauaaggguuuaaguguauguugggggaggggguggucagauuccuuuauuuauuuauuuacuaauuuuuuugagacagagucuugcucugucugccaggcuggagugcaguagcaugaucuuggcuuacugcaaccucugccuccaaggcucaagcauuuucccugccucagccucccgaguagcugggauuacaggcgugugccacacgcuuggcuaauuuuuguauuuuuaguagagaugggguuucacccuguuggccaggcugaucuggaaguccugaccucagguaaucugcccgccuuggccucccagagugcugggauuacaggugugagccacugugcccacccagccagauuccuauuuuuaaagguucacucuaacgccuuuuuagagauuagauuagggauggagagggggagggguuaugagaggggaagcugauagaccaguuuggaggauguugcaguaucccaggcauaagaugaccaugagguagauuugguaagggggauggaggguggccccggggauggagagaauggauaguuuugaaggaaguggguuagacaggcuuugaaguagaugagcaggacagaaacaggagguaggggugguuuaguuucaaucucauaggagacagaggaggaaagcagcauuauaacucuccuguccucgcuguuuugcuuaucgcaggggugcagguuuaaggaccccgaaauuucacugaaauucacuggccguuuuuaaaaccagaagaugccuugagauuguaggggaaggagguggaaaaguagaaggccagaguggcuauucugugagggauugaucucacggggucuugcagggguuggugaagggugaaagauagcaaagaacuggauucuaagaccuuuagauccuuccugggcucucccauugaacuaagaguauagugggugccuagugugcuauguugcagagcucuguugggggacaguaggaagggaaacuuggguaugaaccugggaagagggacuugaggccucacugggcauucucucugcaccuguggcauuggagaagaaaucagaauuugcucugugggguuaagggaugaaaugagugcccaccugcacagucuaaggauuuaccauuuucagccggaaguggccugccucuucacuggugaacagucccuaaauuuccagccuuggucucacaccaacucucuggauuuucuggccgcaggaauuggauucaaguacguggcucugggagaccucaucauccucaucacuuuuggcccgcuggcugugauguucgccuacgccauccagguggggucccuggccaucuucccacuggucuaugccaucccccucgcccucagcaccgaggccauucuccauuccaacaacaccagggacauggaguccgaccgggaggcugguaucgucacgcuggccauccucaucggccccacguucuccuacauucucuacaacacacugcucuuccugcccuaccuggucuucagcauccuggccacacacugcaccaucagccuggcacucccccugcuuaccauucccauggccuucucccuugagagacaguuucgaagccaggccuucaacaaacugccccagaggacugccaagcucaaccuccugcugggacuuuucuaugucuuuggcaucauucuggcaccagcaggcagucugcccaaaauuuaaggggacaaguagcuccccccacgacaugucucccuuucuuagaauauauuaaagucagagucucugaggaaggaaugugauuuggcagucaggguacuaagcaugggugggaacuccugccuuauaaaaauuguuuuuguguucuuaaagauaauauguuguuuuucuguuuuuuguuuuuuccauuuuauggggaauuuaaaaaccauucuuguaucagaaggugaauuaggcgcauggucuuuguuuuauuaauaauuuccacuagaggguguucucaggucacuuugcagugaaguggacuuaguuccuccuuguucuguacaaaaugucuccagacuuuguaaaggagcugcccaguuuggccuccugucccgaaaagacccuaauaacuaggcagaguguuguccugcuuucuucgucucguaggaugugcuaugauuggugccaggccucacuaacacaggggcuaccugucucuuauucucagcaccuguguccugagauacgcugccugagacagagagagucccucauuaacagccuguguggcugucagcuuuuugccuaaauugugauucagaugcuuuuguucucucuccuuucacuuauugccacaguugaggaaaagugucagauuacccugcagcaagacaagccaaggacugggagggaaaaaaaaaccacucuggaggcaacugagaaaaucacugcuuuuggauaggaaucaguaggguggcuguuuucccuuuguugaaucuacuagagugacaggaaggacucccagcccuuucaguaacuaucaggagcccugaaacgguagaggcacugccauccuugugggauacucaaagcccacagggcuuuucccucccuauugcaucuucugaugcuccccacaccuacccuccaccucuccaccucugugguguucccauuuguguguuucccaucuguggagccagacugagcaauagcuuagcagcgagucagggacagcugccacuuuccacagagccacaggaugggcagagcagggacccagggaaugaauagccaguggacaaacagucuugagcucuguucagccagagugaugggcccugccaguuaaggggcugugucuucauccuugaagacagaugugcaauauugacccugccucuccccagggcuuuguggaaagauaguugagggcuuuagugagaucacacucagaguggggcaauuccagcauuuauccuggcugcguuucauugcauugucugugaaguauaauuucugggccagaauugcucaguugcauuugauccaggacuauagauuggaaaugggucaucauuguuuucuguugugauuauagccauucuaguaggcguuuaaggucauggccugcagaaaaugauguaagaacuaguucuuaaucuuucagaucaagcuaaugaugauauggaaccuugaguucgaauugauugguuuacuuggaaaaaaacauguuugaaaauugcaaaaguuccgccgggcgcgguggcucaugccuguaaucccagcacuuugggaggccgagacgggcggaucacgaggucaggagaucgagaccaucuuggcuaacacggugaaaccccguuucuacuaaaaauacaaaaaauuagccaggcguguuggcgggcgccuguagucccagcuaccugggcggcugaggcaggagcauggcgugaacccaggaggcggagcuugcagugagcugagaucaugccacugcacuccaaccugggggacacagcaagacuccgucucaaaaaaaaaaaaagaaaaagaaaauugcaaaaguuccucuaaaguuaaaucaaaggugguuugucuagcagagagccagaaucuucuaauagugggcagagcccagagacaaggggaagaaagaugaccuucuccccaguccuucccagcaccauuuuuguuucacaccaggcuuguggcauuuuggugcucacagggguuuugccuucugaccucuccuuggaguaggccauucucaugcagggcucacccugaggcaggaggaccaagggcucccugcguccacggaccacguaugccuugguggucacucccaucggggcuaucaguucugcacugugcccuggugcggauuuuaaugcauauuuuuauauauaaauguucccaaaggccaaauuuguugccagguuuuauacgcaggucaccauaauuuguauuauguucccugagucaaugaagguuuucuuuagacuucuuaauuaaaaagagaagaaagaaaauguucaccaauggucuggcuucugguuuuugcuuuccucauacuuacugucugauugugaacucugauuuguaaaucucagggagaccaaggcagugacauuggacauucaggcugugcagaggggcaccuggucuuuggugaugaguuuggguaggguuugaccagauucgacaggccuuuagaaaaggcagcagggacugggcaugguggcucacgcuuguaaucacaguaauuugugaggccaaggugagaggauugcuugagcccaggaguuugagaccagccuaaguaacguaguaagaccccaucucuacaaaaaaaauuuuaaaaaguuagcugggcgugguggugcaugccuguagucucagcuacucaggaggcugagguggaaggaucgcuugaaccuagcaggucgaggcugcagugagguaugaucacgccacugcacauccgccugggcgacagagcgagacacugucucaaaaaaaaaaacaaaacaaaaaacguugagggcugcauguagcuacaguggauuugccaagagccagucagcagucaggccagauuaaccucguuucauuuuucuuuuucuugauagggucacugugcugcuagauggagaacaugagguagauugaguacauguggguuucagcuaggcauuggacaauauauccuaugaacaaggcagagagacgugggauggauaacaguggaguuagauaaauuccugagagacugagcaggcggugggagagagcuaacugaucagcaugucaguggcagcugggaaggagcccuuaguagcaguuggagcccuguccucugcccuuugcuccgcuggauucaacaccuguuauuaaugacgcggaugaggcagccaaaaugaaagguuucaugaaccuuggaggaagagcuuacaaaaugacaauuaggagccucauaaaucaaaaggcugcuuugaugggucaaaagaaaaauguagugugaauaaauacaaagcaauacacuaaggucccaaaaucaacagcauaaacaucagagagggggagagccaugaugugacagccauggagauagggggguaugaguuuucucagugacuggaaucugacaucacuugucuuuauuuauuuauuuauuauuuuuuuugagacuaugucucagugucgccugggcuagaauggaguggcgugaucucggcucacugcaaccucugccucccggauucaaagccauucuccugccucagccuccccaguagcugggauuacaggcacguaccaccacaccuagcuaauuuuuguauauauauguuuuauauauaucucacucugucgcacgggcuagagugcaguggcgcaaucucggcucacugcaaccucugcuuccuggguucaagcgauucucccaccuuagccuccugaguagcuggcauuacaggcacccgccacuaugcccagcuaauuuuuuguauuuuuaguagagaagggguuucaccauguuggccaggcuggucucaaacuccugaccuugagauucacccgccuuggccucccaaagugcugggauuacaggugugagccaccgcaccuggcauaauuuuuguauuuuuaguagagacgggguuuuaccauguuggccaggcuggucucgaaauccugaccucaggcuaucuacccaucugggccucccaaagugcugagauuacaggcgugagcccccgugccuggcugccuuuauuucuuggagucagauuuauucugcuccccaggcagguggcugaaaauucaaugccagcuaccucuugagcacccucccaaaugucugggaucacccagaacuccuggccucuguggggccagagccagggauuuuugcuuaccaucuguaaggucaccucucugcuacuggaugcugggguuuggcccuggaaucugcccuugucuuggacacugcuccucuagaaggguucauaaagccccuuccuggugacaagugccaguggggcacagauccugcuacuccagucacauuucugcccagucuuggagcacuaccacucuaccuaugauaaugcuccauccaccuccccuacucaaagcauuucccuucuucucuacgcuuugcaggaccuuugugcugaaucccacucagggcaccuuuggaagcuuggugcugacuucuggagucgggugggaaaagauaugaauauauccuauguugucuuacuaacgcuuccguuacuccuguauuaaaaccaccaggccaggugugguggcuuacgccuguaaucccagcacuuugggagaccgagauggguggaucacuugaggucaggaauucaagaccagccuggccaacauggugaaacccugucuuuacaaagaaauacaaaaauuagcaccuguaaucccagcuacuugggaggcugagguggcagaaucucuugaacccaggaagcggagguugcagugagccgagaucacgccacugcacuccagccuggacaacagagcaagacugugucuccuaaauaaacaaauaaauaaaauaaccaacaccugagccuuugaccugggccaaagcuuagucugagucaguaaugagcuccaacuuccaugcagauuaauaugaucugagcuagaauuuaauaugaucugagcuagaauuaacaggagaauuagcguccagaauaaggaaggcagaaauucugcccaucccugucauucuucucaugcugggcuggggccaguccugggcacuuucuugccuucuuucuuuucucuagauauuaauagaaucaguguggugagagaucaagaacaugcuguggauauaauauacuuggauuucagcaaggcauuugacaacaugcuaugaaauauggaauggggccaaucacgguggcucaugccuguuaucccagcacuuugggaggucaagguggguggaucacuugaguucaggaguucuaggccagccuggccaauauggcaaaacccugucucuacaaaaauacaaaaauuagcugggcgugguggugcacaacuguaaucccagcgacucgggaggcugaggcaggagaacuaccugaacccgggaggcagagauugcagucagcuaagaucgugccacugcacuccagccugggugacagagcgagacuucaucucaaaaaaaaaaaaaaaaaaagaaauauggaauggaugaaaagacaauuacaggagcuugcuuucuauaugcaugugugugcacgcguguguguuugcauugguaacggcugcaguagagauuuccauuucucaguguaagaaccacacuuugaagauguuaucaacaaaguggaucuuguccugaaugcgguuggcagaugggugggggcacauaaagccaugucagccuggaaaggagagucacaagaaggcugucuucgggaagacggguuggacuuuuuuuuuuaaaacuuuuuuuugcguguggcuucaaaggguaaaacuaggacuaauggguagaaguuauauguccccaaguugaagcucuuagcucaggaagguuucuuucauucuuucuuuuuucuuuuuuuuuuugagacggaguuucgcucuugucgcccaggcuggagugcaauggugcaaucucagcucgcugcaaccucugccuccaggguucaagcgauucuccugccucagccuccugaguagcugggauuaacaggugugugccaccauguccagcuaauuuuuguguuuuuaguauagaugggguuucaccauguuggccaggcugguuuugaacuccugaccucaggugauccaccugccucggccucccaaaguacugggauuacaggcuugagccaccacaccuggccagaucaggaagguuucuuagccauuagaggaaucagcgagggggauguucagaaugucucaguugggggugaguuccuugugacuagaggcauucaagcgaaaagaugauuccucgucaggaacaugggugugaagagucgcaucagagaggcguuggaugagaagaccucuaagggucuuccaauccugugauucaguuguucuguuauuacgggauagucuuucagaccugccccacggguugggaggacagaguacaagagccguguugacauuucuucuugaugucagacuguugacugucuggccaucuuaacaggaacagcugugauugauauucuuuuuuuaaaagauuuuauguauacacacacacacacacacacacacacacacacacacacacacacucacagaguugauuucaccucgaaagcccuugaagugagagggaugacagcuccucucugagcccugcggaccacucugcugcuaauggacugucagccucuuucauuaugggcuccagacugugcaggcugguguaaaaggaaugccucuggcaagaaccuggcacuuggguuccagccaguugacauuugugaccugcccuucuucaaacugggacagcccucccacugugagugacuaagcuaggauggcaaauggugguauaaaccaaguuggguuccugccugaggagggggcaaaggcugagucugggcucaucaggaggcuugcaaacggcuuccuggggucagggaaaggcuguaauugcaaggcacagacucacuucagaagaugcuggagcucugggaggaacagugagggcuuugaucacaugcucccaaccaggcugagugggguaucacaaguuggucugggcgcuucuaugauguuaagggaucccaaggggcagggcucuguguggugugauucaagggguccuccaaauuccgcacucccacgguccugccauauccuggccccugucucccccagcuuggcuuagaauugccucccauuaggaucacaaauggguuuaacagggaagacaaaagcauagcauguguuacucaccuauuauuuugccaacauguuuauugucaauuucucccaguaagugguaggacuagaguauaaggaccauguuuucuuuuccagcccaucucagcacuagcacagugcauggugcaacagagcaggcagucaguaacugguuguugaaugacugaguuacaugggaagggcugggcccuccagggcugacugacaggugugagaguuuggaccacugcaucacaucagcugucaguaaggacaggugaguuccacuugggguugggaguagaggagaaccauggcaguaacuuauuauuauuauuauuuugagauggaguuuugcucuugucacccaggcuggagugcaauggcacgaucucggcucgcugcaaccucugccuccugaguucaagcgauucuccugccucagccucccaagcagcugggauuacaggcacccaccaccaugcccagcuaauuuuuguauuuguaguagaaacgggauuucaccauguuggccaggcugguuucgaacugaucucaggugauccaccugccucagccucccaaagugcuuggauuacaggcaugagccacugugccuggccccauggcaguacucuuaagagcuuuuaagauccagcucauauuccuggcacguagaagucucuaaauaaauaaacguuggaugacuggccgagggaauggcaguaauaaagcugucauuuguugaaugcucacuauggaccaggcacuguucugaugcuuaaauacauucuuuuagugcucauaacaaccccacgaauuggauauuaaggucucuuuuucauaagagaggaaacugagguucagggagauuauuaaacuugucuagggucaucuggcuaguaagugauagaaccaugauucaaaucuugcucuaauucagugcaaguucuuuuauuauuauuauuuuuaauuaaaaaauugagacagggucucauuauguuggccaggcuggucucaaacuccuggccucaagcagucuuaccuuggccucccaaagcguugggacuacaggugugagccaccacacccagccuucacuacaaacugccccucaucucucuugcccugcaguuccuugcuuguaagggacucaauccauuggucugcccuuagccgcucccaagugugugaguguuggggccagcuauaggccuacagagguggcccaugugccagugccacagaggugguucccaucagggugggauggcugcuuccuggcugguggcauuccuaccaacacccccaggggccagcucuguggggauaguaacuaagcuuguuggucuaaccuacucuggcuggcugggcgaaaguuacaagucaaagucugcccauccccagauaauggagaguggcuccugccuacccacgaugauggaggcgaagguucagucucagguuaaauuuaugcuccuguccccucaucugucuguccucauucgucucgucucuuccaguccucaucuagccacugaagcagagugcccacaucaggagcagccagugcucaagcucccagaaacugccuagugaccugccuucuagaccugccuccugagaauggggcuggccaccuucgaggagagggaagugagccccuuccugccucggggugggcagcaucuggagcugacaauuguaugcauguucaggacacaggauacucaacucuucggguucagugugcuguguggagggagaggaaguugacacacgugaaccauagaauaaacaacgaccacagaacaucaagguagagauggggcugcuggguaucaggaaggcuuccaggaagaggugacaaugagcggcgaucaagguuucuaggaagagguggccauaagaggugacuguuccauggaaaccgaggugcugauggacagcucaauucccccagcuggagaaagccccccuguugcugccugagagaguaagacucgaaguuuuccuuaaucagccucuuuuggcugugcaguuagacaacuggagcauugaggcaggugugccaagggcacucugaccacugccaaggucaaagccuucugcagaaugaaaacuccgacacuuccuugcugagaaacaaacaagagagaauggcggggcauuuaaucauccacagcugccaauaccuaaucaagaugaauggccuggagagacaaggccagggaaagcaucccgugaagcaggagcgcugagcccaagucuccugcgagucaggggagccccucagcccugggccacauugaggccaagggaauaccaggugggaggcccucagauucaggggaagugcugagggggucagaggucaccauggucaccaaugagggccuuccagcugacacuugccuuggccaaagaccuuuacugagagccugcucugucccaggaggcaagauaaacgaggcacaccccugcccuuugaggacacacagugaacuaauagcaaaagcuacaugcauacauuauccugccaccucaagugucaacauagacacuugucccuagagauccuuaaagccccucugaaggacaggccacucacagccaugugugagacauagaggcauaaaggcuguggggaaaugagggcagaagagaugaacuucuccaugccccauuguuccagacugcgaucaauucacuaucuaugacuagaucuccucugaugccaucugcagguggcugcaagaccagucaauuuauugaacaaguauuauguuacaggcacuugcuaagcucugggagguaucaugguaaaugagaccuuaucccuguccucaggaaacuuacacucuccagaggacagacagacaaacaggcacaccuuauaucacuccuggagcuugacuggugaaguggaaagaguuugggcuuucgagucuggcagcacuggguggguagaaguccaggcucgaucacucacccccgggauacccucagacaagcuacauaaccucuuugagcuuccggugccuccucugcaaaggaggaugauaggauuugcccuguaggguaauuuuggguuuaaaugagguagugcucacagaguacuuagcaugugccuggugaguaguaggcacuucauaaagugaguucccccugucccccccuuuguuuugagacaggaucucacucuguagcccaggguggagugcaguagcacaaucauggcuuacugcagccucaaccucccugggcucaggugaucuucccaccucagccuccagaguagcuuggacuacaggcuugcaccaccaugcccagcuaauuuuuguauuuuuuauagagacaagauuucaccauguugcccaggcuggucuccagcucuuaggcuaaagcaauccgcccgccucagccucccaaagugcugggauuacaagccugagccacugcuuccagcccccuuuccuuucuuauggaugacuauuuuagaauguuguuuuuuguguaaucuuagacuuuccuaccaaggcagagggcccauggcugaggguccauguucuucccaguacucagcacagugccugguacauucauucauucauucaacaaacauguauugagcaccugauaaguaccaggaacuguauuaaaacuaaacauagaaaaugaacaagaccagaucucuaugcucccagagcuuauaugauaguaagggagauagaaaagaaacaacuauucauugugaaacucucugcugugguuugaauguuguauccucccagauucauguugaauccuaauguugaauccuauguugaagccuaauccccaacaugauuguauuaggagguggcaacuuugggaggugauuaggucacgagaguagaguccucauggguagaguauuagugcccugaucaaagagaccccagggagcugccuugcuccuuccuccaugggaggacacagcuggaaggcacuaucuaugaaccagaaaguggccuucaccaaaccaaaucugccuugguuuuggacuucucagcccccagaccugugagacauuucuguuguguauaagccaucuaguuuaaugguauuuugcuauaguagccugaauggcacucuguguauggggguggggguguccauuuggugauuccgaggggcucugcccuggcaccaggauaaguuccaugcagaaaccaaaggaugacccaucugcagcccuucugucaggagagccaagccuggcugugcugagaucagaauccugguggggugacuaugaaaaaguuggggucuuggccuuggggucaaagauugucaaggugacuucucauucgaaugcuucacagcccuggaggcuugacaguugagaaugcgcugaagaaguccuggauggagagacagguggucuuacauguggcugugaguggccuguccuucagagaggcuuuaggaaucucuagguacaagggaaagauaacauccccuugggcugcaguccagguucauucaacaagggaagaaaacuggaaaacaucugaugucuguuuuaccagaguuguuacuauuacuuuuacuauuauuguuuuuuguuuuuuuguuuuuuuuuugagacgaaguuuugcucuuguugcccaggcugaagugcaguggcacgaucucggcucacugccaccuccaucuucuggguucaagcgauuauccugccucagccucccgaauagcugggauuacagcaugcaccaccaugcccagcuaauuuuguauuuuuaguagagaaggguuucaccauguuggucaggcuggucucaaacuccugaccucaagugauccacccacucuggccucccaaaguguugggauuacaggcaugagccauugcuccccaccagaguuguuauuauauuuuaaaaaauugggccagacacaguggcuuaugccuguaaucccagcacuuugggagaccgaggcaggugaaucaccugaggucaaguguuugagaccagccuggccaauguggcaaaaacccaucucuacuaaaaauacaaaaauuagccgggcaugguggcacauauuguaaucccagcuacuccggaggcugaggcaggagaaucacuuaaaccugggagguggagguugcagugagcugagauugugccauugcacuccagccugggugacagaaugagacccugucuccaaaaauaaauaaauaaauaaauaaauaaauaaauaaauaaaaguuucccaugugcaugugugcacauauguguguacacuuauggacauuuggggacaccuccugcaccccgcaguggugcaguuauuauccuggguauucaguaggugcugaacgugaagggaacccaaugcagugagcgacaccugguaaagccaucucaaugucuagacaagcagucuccaugcagcuccaaggaggauaaggggaaaccacagagggcugugagcagaggguugcucagagccccuccugacggaggcgaggaggagguggagccauucguuauccugccagcuuggcacagaggcugggugcaggggcuggguggcugugcugagaagagccauuccauuuccaagaaggaacagggaggggauggugaggagcgaagauaaccaagucagucaagcagggcagagcacgguguaauccaugcccuaggccaucacaguggcugcagccaaucucacugcaugagaggugggagaagaugggcuuccccaggagaggcccugcccuggaaaccccacugccugcccugggucauccuugauacucauucccuuguuucucucaguggcgggcaugacagcaacaugucaaggccgccuaaccacagucacagugagagccaccagacgcuggauccgggcagcaacuugggguucacugaagcuuucuccgugcuuuucucacgcuggccucccuauggcccugagaggugcaugcucggcuuguuucaugggcugagugguucagugacuugcucgggaucacaaccaccgcacaggagcaccacacauggccuggacugguucucuuccaacucuaaaagcagcacucauuugguuaacagucuuuuucauuuucaacacuucuuucuuuugaaggggggagcaaagcgugaucgguugccuuuuauaauucucguuuucaauuucaaucucuuuuaaaauguugaaagacucacagcugccucuuuuguuauugucuucaucucccacccucuuuccggccucuccuccuugccuuuccuucccuuaacccuucccauggcuccucugagcugcccaggcauguggccggcuugucaugcugguggccuuggauguuggagaagagggggaagagguaggauugaggggcuccaucagagacagggucucaggggucuucacaguuugauggauuuuuuuuuuuuuuuuugagacagagucucucuguugcccaagcuggagugcaguggcacgaucucagcucacugcaaccucugccucccagguuuaagugauucuccugccucagccucccgaguagcugggacuacaggugcgugccaccaugcccagcuaauuuuuauauuuuuaguagagacaggguuucaccauguuggccaggcuggucucaaacuccuggccucaggugauccacccaucuuggccuuccaaaguacugggauuauacgcaugagccaccaugcccggccuaauuuuuguagagacagagucuugccauguugcccagccaggagucaaauagcaggaaggcucugcuccaaacaaugcuugguuuuccauugaagacaucuaauaacuuuuacaauuuuuuuuuuuuugagacacagucucccucugucacccaggcuggagugcaguggugugaucuuggcucacugcaaccucugccuccuggguucaagugauucuugugccacagccuccugaguagcugggauuacaggcgcccaccaccaugccuggcuaauuuuuguauuuuuaguaagacaggguuucaccauguuggcaaggcuggucucgaacuccugaccucaagugaucuaccagccuuggccucucaaagugcugggauuacaggcaugagccacugcgcccggccaaaaaaaaauuuuuguuuauucaaaauuucugucuuuuuuuuugagacagggucucacucuguggcccaggcuggagugcaguggcaagaucaccgcucacugaggccucggccuccccaggcucaggugauccucccaccucagccucccgaguagcugguacuacaggcaugcaccaccacacccagcuaauuuuuguauuuuuaguagacacgggguuuuaccauguugaccaggcuggucucgaacuccugaccucaagugauccaccugccucggccucccaaaaugcugggguuacagacgugagucaccaugccuggugaauggaugguugauucuauuugcuuugugcagucugacugauguaaaucaucucagccaugucugggcauuggagucagguuuaggcaggaguggccuccaggucaccugcagaaacacacacggccguggcucacccccuugcucccagucacucugugucugagccaacuuaggaucguguauguguguucucacacuugagacucuuuuuuuaaauuuuuuauuuauuuuuugagacggagucucacucugucacccaggcuggagugcagugaguggcgcgaucuuggcucacugcaagcuccgccuuccggguucacaccauucuccugccucagccucccaaguagcugggacuacaggcgcccgccaccaugcccggcuaauuuuuuuguauuuuuaaaauagagacaggguuucaccauguuagccaggauggucucgaucuccugaccucguguccgcccgccucggccucccaaagugcugggauuacaggcuugagccacugcgcccggccacacuugagacucuuagcaauuccaugacugagguaugauagcucccauuuuauagaugaggaaacugaggcuccuucagcaaguuaaacagcuugcucucaauguccccaaacagacccagcagcccaaggucucagagcugauggcagagcugggaugagaagccaaguccuuugacuucuaacccagugcuuuucccgccaugcucugugucccauccuugguccuaaucuugagacggcaggacuaagauuggaggacuuguggcuuccagguuccuccugaaagccaccagagauuuaaaaaaaaaaaaaaagagugagagguuagccugauccagcgagagcagcgauggcucccugggugaggauacaugccagcgagugaggagcugcugacuggggggugaucucccugauaaaugauggagugccaguugcuucugcagcugcagggcugcaucugggccccagugcugaugcacgcuccgccuccagauccgcauugucaccagcuuguuggaaaaacagauguuauuguccucuguuccugucccuuugucccuaauaggcacuuaagcgcaggagggggaaaaagaaacggagacagaaucguguaacuauuucaggcucuuuccagaagcaugcacuucugugggacuuggggucugggauggaaugggugcagggaagcacccccugcccccugccccaguguuucugggacagcccuggggagaagcugcuuguugguccaaggcagugggugcugaggacuaguucuuggaggagacgccuuccuucucucuuagaucugcaccuggagugggcccuaagcugacauuucaaagaaggaaugcuggggaccucuggucuucugccuggacugccagaguuuggaagauuggaugaggucaagggcugaugagaucaaggucuuuuguuccauucuuguuugggcuucauccauccauccauccaugcaugcagugauuugcuaaacacauucuuuuuuuuuuuuuugagacaaggucuugcucccagacagggguggcaguggcauagucacagcucacugcagccuccagggcucaagcaauccuccugccucagccucccgaguagcugggaccacagguacaugccaccaugccuggcuaauuuuuugauuuuuuguagggauggggucucacuauguugcccaggcguaagcacaucccuaagggcauaacccuacuccugacagcagcauacugguuugcaggugaaaacuuuucauggaaaggacaauacauucucuuccaucaggucagccauggcuaugauuuaaugggagcucugaggcucuccugcaccuaaauagcucugcaucaaccugccucugugccucagauuccaccauuagucaguccucugaauaaaggccuuauauuucucaaagguccuugcuaaaauacgagcacauaacugaggagauucucauugaggaaaaaaaaucugcuugucaccauggagaacagaggaucagggccuaaaaugagugcuacacaagauggggacauuuugaucagggaaagaugagaagagggauguccauucugugggcugcuguccugggagggaggaccugaggagcuguaugagagaauuaggaauuuaggggaagcaguucuuuuuuuuuuuuuuuccaagauggagucuugcucucucgcccgggcuggagugcaguggugcgaucucagcucacugcaaccucugccucccggguucaagcaauucuccugcgucagccuccugaguagcugggauuacaggcgugcaccaccacgcuuggcuaauuuuucuauuuuuaguagagacaguauuucgccauguuggccaggcuggucucgaacucuuguccucaagugauccgccugucuuggccuccuaaauugcugggauuacagguacgagccagcgcaccuggucuagggggaacaguucagagagggaccugucugcaugcaucauugguugcccuauucugcuuugagaccggcuguguaaguacagacuccuaaagagcuaucucagccuuccucguccuugcuggaaucagagaugcuuuuuuuuauuuuuuauuuuuauuuuuauuuauuuauuuuuuuuugagacagggucuugcacuguugcccaggcuggagugccgugguggugcaaucauagcucacugcagucucgaauucuugggcucaauggauccuccugccccagucuccugaguaccugggacuaaaggugugcacgccucgccuaauuuuuaaaaaauguuuuguagaaauggggguuuuguuauguugccccggcugaucuucaacuccugggcuuaagugauccuucugcguuggccucccaaagugcugggauuaugggcaugagccacuucguccaggugggaugcauuuuuauguucuauugacccucaaaaugggaaagcucagagauugggccaccucuguccccauagguaccucccuccacauuucauugggauaugagggacagaaaugggguggaggcggaggcccuagcaccccauccaucucccauguuccugcugccuuaccacacccugcgcccugcucugcggcuucuagaugguaagaguggacagagcauuugagggcucaguccugccauccaggaugccggcaauggcuaguggggacucaacaaagggcauugguaacuguaucagucaugaauugcuguauggcaaaccaccccaagacuuaguggcuuagaacaaauuucuguuugcucauggucccguggguggccaauuugggcugggcucuccuggacuuauucguguggcugcaguuggcugguggcugggauggcaggagggucuaaagccagccucacacaugugucucugugccugucucccccaacagcuggaacugggggacugauugcaggugagcucaggccccuaaccaggggcuuuuucuuuuuuucuuuuuuugagauggagucucgcucuguggcccaggcuggaguacaguggugcaaucucggcucauuucaaacucugccucccggguucacaccauucuccugccucagccuccagaguagcugggacuacaggcacccaccaccacgccuggcuaauuuuuuuguauuuuuaguagagacgggguuucacugugcuagccaggauggucucgaucuccuaaccuugugauccgccugccucggccucccaaagugcugggauuacaggggugagccacugugcccagcaccaggggcuuuucaaaagcagagagugccccggcccaccuggacaauuuugaugaaagaagagaaaaugucacugagugggugugggaaggacccucuucugccaucccccucaccugaugaguauuagggagcuaauuaccugggaggugcuaccaggcagagaugcucuucauaaccucuuacugcuuaacauucagaaccuauuucaccuuucuguugcagaacuucugaaaaagccaccuaauaaagcacauuagaauuaaucuuuuuuuuuuauguucgaugcuuuauucugcaagauccacaagaucauauuuuaagagaaccagauacuauggagaaaaauguuauuuuaaaguuaaaaguauuaaauauacauaguguacuguacaguugagugcaacucaagauauaauuuugauauaccccuuuuuuuuuuuaauugaucauucuuggguguuucucgcauagggggauuuggcagggucauaggacaauaguggagggaaggucagcagauaaacaagugaacaaaggucucugguuuuccuaggcagaggacccugcggccuaccgcaguguuugugucccuggguacuugagauuagggaguggugaugacucuuagcgagcaugcugccuucaagcgucuguuuaacaaagcacauuuugcaccgcccuuaauccauuuaacccugaguagacacagcacauguuucagagagcaccggguuggggguaaggucauagaucaacagcaucccaaggcagaagaauuuuucuuaguacagaacaaaauggagucucccaugucuacuucuuucuacacagacacagcaacaaucugauuucucuaucuuuuccccacauuucccccuucucuauucgacaaaaccgccaucgucaucauggcccguucucaaugagcuguuggguacaccucccagauggggugucggccggguagaggggcuccucacuucccagaagggguggccgggcugaggcgccccccaccucccggacgggggcuggcccccaccucccucccggacggggcggcugcugggcggagacgcuccucacuucccagauggggcggcuggcgggcggaggggcuccucacuucucagacggggcggcuggcgggcggaggggcuccucacuucucagacgggguggcugccgggcggaggggcuccucacuucucagacagggcggcugccgggcggaggggcuccucacuucucagaugggguggccgggcagagacgcuccucaccucccagacggggucgcggccgggcagaggcgcuccucacaucccagacggggcggcggggcagaggcgcuccccacaucucagacgaugggcggcagggcagagacgcuccucacuuccuagacaggauggcggccaggaagaggugcuccucacuuagacugggcggccaggcagaggggcuccucacaucccagacgaugggcggccaggcagagacgcuccucacuucccggacgggguggcggccgggcagaggcugcaaucucggcacuuugggaggccaaggcaggcggcugggaggugaagguuguagcuagcugagaucacgccacugcacuccagccugggcaacauugagcacugagugaacgagacuccgucugcaauccuggcaccucgggaggccgaggauggcggaucacucgcgguuuggagcuggagaccagcccggccaacacagcgaaaccccaucuccaccaaaaaaaaccgaaaggcguggcggcgugcgccugcaaucgcaggcacucagcaggcugaggcaggagaaucaggcagggagguugcagugagccgagauggcagcaguacaguccagcuucggcucggcaucagagggagaccguggaaagagagggagagggagaccguggaaagagagggagagggagagggagagcuagaauuaaucuuaaaagguuuccauaaagaugaugaugaugauuaucuagggauaauucuaggugggcgcacaggcuuacugaaugcuggcacagaggggcgggggaggggucgccccuccaagcaaugcccccagccccugugggccacacacauuuuccugcuccaagaguguccccaaaagcucccccgacucccuguccucacugcaucccagcucuucugcguucgcgucacaaagucuugcuucccucugguggcccuuuuccccucccccaacucuuccacccaccugcccaccccugcuccuaugcucggaucugguguggcaauagaggugugcucuggaccaaagggcuuugcccugaggaugcaacacaaagacuuaggcuggggaggagccaugagaaguuggaaggcuauauccuugccuccgaacagggacuccugauucaauagcucagaaggcagugacugccuaccucugggacuugggccaugggcuuuuaaaggccuguuccccaugcuuacacaauccugcagaacuaaucuauggugucagaaggcaggacagaaguugcccuuguugggguggggguaggggucuguuuaaacagauguauucacuuugugaagauucauugaauuacacacuuaauugugcacccuucugaauguauguuacaccucacggaaaaguuuaccgccaaagcccuuuaugaaguagauuugugacuuccauaauauugaaauuaaauuaucucugauaggaugggaugacacaguagaaagcagcggauaauccacaguuguuuucuacuuggacucggaacuagaacauuccgcacaauauacacguuugugaaagauucguuuuuguaauugugcauguuccugcuaauuuuaacauugguaagagcacgcaagagcaugcacuugcuaauuucuaaacaguaguacucaacuucaggugagaugguccagaagcauucagguggcaggaagucacacugagacaggauuaagaauuuggcacagaucgcuggccagauggggagacucacaccuauaaucccagcacuuugggaggccaagguggguagaucacuugaggucaggaguucgagaccagccuggccaacauggugaaaccccaccucuacuagaaauacaaaaaguuagcugagcgugguggcacgugccuguagucccagcuacuugggaggcugaggcaggagaaucgcuugaacacaggagguggagguugcagugagccgaguuugagccacugcacuccagccugggcugggugacagagcgagacucugucucagaaaaaaaaaaaaaaaagagagaauuuggcacagauucccucuucccucugccuccugucccuuagcucagcauuggaugugguuguuguucaggucucaggaaugcacauuuaucuccugcuuggaugggucccaaggucuugaagaauaagaaccaucaucucuuggugugaaggguugaaaagaaacugcccauuggaggagggccccauaaccugaucccagauuggucucuguuguguccuguuugcaauaagucccccaucccuguggcacaccccucugucaugugccuuuggcucauucuucucaucagaagguggggucucuuuccccaccccuugaaucuggaucagucuuuuggcuuacuuugaccagaaggaucuggugaaaagugaugccaggagucugguccagcuuccugaaggaugagaugccacucaaagcagagaagggccaucccagcugaagucccuagaccauccggccgauaaccagcaccaaccaccagaugugugugugaggcuggcuuuagacccuccagguaucccagccaccagccaacugcagccacccgagugagcccaggaucccagcccaaauuggccacccagaggaccgugagcaaauagacacuauuguucuaagccacuaagucuuggggugguuugucgcacagcaauucauaacugauacaguuacccacacccuuugcugagccccugcuggccagcgccagcauccuaggagcgggacuaagccuucaaucuggaagcaacuuucuucccaggauuuguuucuucacucauccccaccaguuuccagggcugacacgccagugcccauugcucuuuauuaguuuaauauauauugaaaccuccaaauagaugcuggggcccagguggaacagaugaaaugugacuaaguucugggagaugauugauaaugaguagggacuggaaaaucaauuguguuaauuccuggucugucacugggaccaagaauuaaugagaaaaucugucuaacuuaaugguauuuacacauuauacagagugugauaaaauugucugcaggugcugccuggcauuucaauuauacgaggccuguaccgcccaaggggcaggcaggucucagcuguccaggaccugggcuggacauuuacagacucgcuggagucccccaaugaccacaccaacuucugagcaggucgcaggucacaggucccaggccccugcauggacccuguuggcauggcugguccuugcugaguguggaucauccaacuggcagcaucccaggguuuugcuagagggcacauuuugggccugcuuugaggauaaccacuccagaagccaugugggcaguuggacacaagaucaagccaggaagggcuugaucuuauguguuggcagaguccauggcuugagacacagauaguccucuuuaccccccaccccuuccccaagagauggucagcaccagcucugccccauaucacacccaccacuuggaaggcugccuugaaaagugucggggaaacugaugaaagagccugcuucaggggcugagugcgugcuucccugaaacucuguagaccagggcuccuccugcugaugugguuuggcuggguccccacccaaaucucaucuugaauuguaguucccaucagccccacgggagggaccuggugggagguaauugaaucaugggaacgguuucccccaugcuauucucgugauugugauguaaguucucaugagaucugaugguuuuauaaggggcuucccccuucgcucggcucccauuuuucuccuugccaccaugugaagaaagauguguuugcuucuccuuccgccaugauuguacguuuucuaaggucuccccagcccugccgaacuaugagucaauuaaacaccuuuccuuuauaauuuacucagucuuggguauuucuucauagcagcgugagaagggacuaauacaccugccuagggcugcccacaggagguggcaugacagccagccuccaagauggcccagcuccugacaauacuacuacuacuacuaauaauccccagcuccugauacauccuucauggucuucucuuauauugaauagggcuggucugaguauccaauaagauaucgcuuuggccugguucucucuuguaucacccacucuggggagugccaccacguggggaggcccauguagggaggaccccaggccuccugcuaacagccagcaccaugugagugccaucuuggaggcggguccuccagcccuaguaagaccccugaugacagcgaccucaggagacacccugagcucagcugcuccuggacuccugacccacagaaacuggaauagggauggagauguuuauuguugucuuaagcugcuaaguuugaggguagcucacuaauccagguggggagggagaugggugggcagacccaggguucguucacccuguaguguggcauucauggaaugccuccauugcucugcccuucacguccacucugauuuuuauuccagugaaauccacuucuguguuuugccaccucccaaguccacccugcccuucccaccucccugccccucccaccucccugccccuucccaccucccugccccuucccaccucccugccccuugcugcuuucuuugccaggaaugcccuuucugcuccuccuccuucucuucuucauuccuaagaugaacuccuacucagccuucaagacccagcugaaaugcgcccucaucugugaaggcuuuuccagucucucucgggcaguuuuugucaccuucuuuggcacccccgugaaacucuauuccucaauggauagcugaggagggugagcgaucaugauugguccacugagcucuggcauuuagaaauugaauuucauuaauuacaacucugcccuucucuguucauuggcacccagaggaggcuccagguaaggguguugaaugaaugaacgaaugagugugcaagcagaauggccgccuuggggagaaagggaggaaacuugugaagccugcauggcgggaggagggcagagcuuggccugagugagggccaggcugcuucuuggccugugucugugaguuccagggcuguucauucuaacaccaucaagggugcucuucucuccaaacgccccagagcuuuccugacucaggggaccaggcauaccugggaagcccuuugugucgguguguccccgucauccucuguuuuuuuauguugucuuguuuugaggcagagucuugcucuguugcccaggcuggagugcaguggcuuagucacggcucacugcagccuugaccuccugggcacaagcaauccucccaccucagccuccugaguagcugggaccacaggcaugugccaccacauccugcuaauuuuuaauguuuuuaguagagacagggucuuguuauguugcucaggcuggucuugaacucccggccucaauugauccucccaccucagccucccuaagugcuaggauuacaggcaugaaccauccugccacccugucacccucuuucccuaaaccuugcccucccuugcccacugcuuuccaugccugucagacagcccuccagagucccuuccccuuauuccagaccuggagggcagaugagccgcagccagacaaaucugauuucucaagcagguuuaaagggcuuuucccagagacccugagcucauuucuccuuucugugucuccaaagugccaaggcagcaauuuggaucucaaacgccccgauaggggugcagccaaguucuuuauugcacacaaugaauuuguuauguggggauucuuuggccuaaaggauggcuuaaaguccuggugucccacugugucccagcguggccagugcugaggggcaggagagcugccuugcuugccugucuucugagaggaugguuguggacaccugaggucagagacagaucaccuguggacuccaguccugcugcuggcugcuccuguuuauugagagcuuugcaggcccagagaaacccagucauuuaucuacagucccacagcaggaagcugcagggcugagauuugcucccaguccugucugaccucaaaauccccugcucuugaucgugaggccacacucccucagccuggugagccugugggcccagcugcucuagggguaacgcaccaccucccagccccuaguucacccaggggccuuauaagaugcagcaggacugagccagaagccgaagggaaugacagccuggggcugagguuccugggucccugacacucacaaacugcuccagcucucagaagccaaucagagacuccguaguuuccugcucggcugaauucuccucucuggaggcagagaaaggaggugcuuugccaucucugguuguggggcuuuaucucuggaaacucugcagugcgugugaaaaccuguggaccaaagaacgaggaagaaagauuaaagagggaaaggauuaagaucuacagggcuucccaugcucugcacagccgcucucagaagcugcucugcgaucucucuauuagaugaccgacagcugccagcucuggaggugagaagggcugagccccucaccccagccaggagccacugagaaagcagcauagucaggacaaaaagacaggaagggcgggggcgggggugucgggguguugggagguggcagaacacagaaguggauuucacuggaauaaaagggcagaugggagggcagagccguggauguguuccaugagugccaugcugcagggugaagggacccuggcccucccaucugucucccuucccaccuggauuagugagcuaccccaaacuuagcagcuuaagacaacaauaaacaucucuauauuccaguuucugugggucaggaaccugugggcagcugaguucagggucucuccugaggucaccgucgucaggggucuugcuggggcuggaggacccaccuccaagauagaacucacauggugcuaggcuccuucagcacaggccuccccacguguuggcacuccccagagugggugauacagaagagaaagaaccaggccaaagccgccaugguuguuuuuuuuuuuuuuuuugagauagggucucacucugucacccaggcuggagugcaguggugggaucauagcccacugcagccucgaacucuugggcucaagcacuccuuccaccucagccucccaaguagcugggacuauaggcgggcaccaccacaccuagcucauuuuuaguuuuuucuuugguagagaugggggucucacuauguuacccaggcuggucucgaacugaccucaagugauccuccuaccucaaccucccaaagugcugggauuacaggcaugaggccacugugcccagcccccuaccauggcuuuuuuaugaacuggucucagaagucucauaccauccuuaaggucacccauuauuguucccagcuuccccugcacucuagacaaucacugcugacagccaggcugccagggguuccugcaguggcugugucugaugccaacauggccagccccuaaagguugugauaucuguguccccaggaccccuuuucagauaucaugaugggcaacaucagucuaggaagguagacccuccaaacugugcaccaucccacacccuucacccaccuccacccucuccuuguugccccgcuuauagccacaucuuccaucuccaaagaagaugcucucagcagugacuggagcauggggaggcuggaaacaguagggguccacuuuuauggagugcuugcuaugugugaaguugguacugagcacggcaaaaguacuaacuccuuacagccucucugcaggauaggugccucccauuuuauagauggggaaacugaggcacagggaggguaaguggcuugcugaagacacacagcucucaaguggcagagcuaggaacugaacccuaguacucugccuccagagcccaugcuguuaaccuuauauuuauagcauuugugacauuaggcaacauuuccuuuccgcaagagagccgcauucaucaggcagggauuggaguucaggguacagcaagaaagacacagguuagauaccuggagggcuuuccaggccacaggucaugaggccucagugcaacuuuguccccugaggauguucagaaaaugaggucuucccaggcugcguugagcacagccaaaggcuaaggggcgguggucauuguuuuuaaauuaaaaauugugauaauuuauacauaauacaaaauguuccauuuuaaucuuuuucuuuuuucuuuuuuuugagauagggucuugcucugucacccaggcuugagugcaguggcgcgaucuuggcucacugcaaccuccgccucccagguucaagcgauucuccugccucagccuccugaguagcugggauuacagguguguaccaccaugcccagcuaauuuuuguauuuuuagcagagaugggguuucaccauguuggccaggcuggucucgaacuccugaccucaagugaucugcccgccucggccucccaaagugcugggauuacagacaugaggcaccacaccuggcccaauguaaccauguuucaguguaccaugcaguggcauuaaguaccuucacauuguuguguagcugucaccacuguccaucuucacaacucuuccauauggucuuuucuggaagugucugcuggccccaaggccuuuggccagccuggacucccuuccucccugccucccugaacguggauggggcugcuggcaggggcaggacgagcacacagagggaggaagaaggcgcagcacagacuuuccucuucagaagggagguauuaaaacgauccacuuuugaggcucacugucugcuucaaagacccacggcagcucugcggaggacgagccguagcaaccgugugagaggguuuaucaauaguaccuggagcucaguaacucauaaaccuuucauuagguuuacaucgaugauggcccaaguccuaggaaguagauuuaggcuggaagacggaugucuccauaaaucaucaucucagcaaauuagggaguuggagggagccuuuuuaucggauuucccagcagcucacuugggaagcucugcuucuuugcucccauucugagcugaugccagauucugagccucacgugcuuggauggaaaaugcagucagcggcucagagaagggccugcccaggacuaggaggaagagagcacuacgcugcucucccuguucuuggguuccuccaggcccggcugcugauuuuauggccuuaucugcccaucuuguuaucuacagagggagcagcuuucuagaaggcauuucuucgagagaaagaaauggagacagcagcagcagcagcagcacaggcagagcaguuuuaagaucucucaccaggccaggcacggaggcucaugccuguaaucccagcacuuugggaggcugaggcgggcggaucacuugaggucaggaguucgagaccagccuggccaacauggugaaaccccaucucuacuaaaaguacaaaaauuagccagguguggugaugugugccuguaaucccagcuacuuaggaggcugaggcaggagaaucacuugaacccaggagguggagguugcagugaguggagaucgcgccacugcacuccagccugggcgacagagcaagacucugucucaaaaaaaaaaaaaaaaaaaaaaaaagauaucucagcagacaugagaaaaaacaagaggggagcuucuguuugcuaaugagaacaauaauaauaauaauaacagcacucuuggugccugccgcauagcccauugucaguauggaucagcuguuauuuugaaucuuucuuaucugccacaugcuuuauuaaggauuuaucuuuacguuauuauuaucaucacccucucauuuuacagauaagaaagcugaggucugagagguuaagugaugugucucugagaucagcccaggagcagccucuuauugacuugaccuuccuacccugccuuccccucugagucuguuucuucccaucucugaaauagagaaucaacuucagugcuccccauuccucagaaaugaagcuggagaggagucagccgggaagcacuaagccuagagcuccuggggaagaagacgcaccugcucgaagggcagggaaggcuguucauuucaggacgacguccacagcuucuauuucacggagccaucucagaggcagggaaggcuguccauuucaggacgauguccacaucgauggccuuggcagauguugcuuauucccauuuuacagaugaggaaauugaucccuugccucugccuccccgaguuucagucccacagcuaguaaaugguccaggcuggcuggaaccagguccugacuagugcuguggugucagaggccagugggcaguucagcuagugccgccaggcucuccgaaggccaugucuccagacaggaugucagggcaugggucccugcugcucccuucccccuggacagggguccucucagguggcuccccucugcuuugcucugcagccccagccucaggugcuccuacgccagcuccuccugcccacccuuucuguuccccagggcugcccuaaaugcucagacagacuaauuacaagcacgggcagagaacugggcugcugauuuggcagguggggcuuuaggacuccgugaugcucaccagcggccggcaggcucccugacacaucagagacuuuuccauuuccuuuccucucuccuucucuugccccuggaggaugagccagccugccagcaagugagcgagugagccagaggugggcugcugaagucugugcagcaugcuggcuguggaaugagagggcucugagcaagccaugucccaggagaacuuuuacucaggaauaaugugcaugaggauuuauuuccucauugcugggcuuccagcugaaguacaggcaugucucugcuuggcuccggcaggggaacucggcucaaagguuucaacaaagcagccaaagauuccgauucaaugaacacugagcacauucuguaugggaggcuccgugccgauagcucugcccacucaccccauuuaacuuccuuuacuuuuuuuuuuuuuuuuuuuuugauauugggccucccugugucauccaggcuggagugcaguggcaugaucauggcucacugcagccucaaacuccuggacucaagcaauccucccgccucagccucucuccugaguagcugggacuacaggcacaaguccccaugccuggcgaauuuucaagcuuuuuguagagauggagucucacuauguugcccaagccaagucucaaacuccuggccucaagucauccuucugccuuggauucccaaagugcuggaacuacagaugugagccacugcacccaauggcccccauuaagcuuuauuuauuuauuuauuuauucgagauggagucuugcucuguugcccaggcuggagugcuguggcacaaucuuggcucgccgcaaccucugccucccggguuuaagugauucuccugccucagccuucugaguagcugggauuacaggcacccuccaccacgcccagcuaauuuuuauauuuuuaguagagaugggguuucaccauguuggccaggcuggucucgaacuccugaccucaagugauccaacugccucggccucccaaaguguugggauuacaggcaucagccaccacgccuggcccccauuuagcuuucauaacaaccuucugaguucagaauucuuauucccauuuuacagauaaggaaagugauuucuucaagaguccacaguuaguaauaacacuccaaguggguauuuacuuacuacauuaacuugccacgugccagguacuacucaauauuauacauauuaacucauuuaauucccucaacaaccaaugaagucaauacugcuauuacccucauuuugcaggugaggaaacaggcccacugggauuaaguaaaugccccagguuauaggggccguagaugguggaucugggauuccauuccaggccagcaggcuccagggacuauguggcaggacuagaaauaagguccuguucuuuggauucgagcccaguuccuguaaaccauaacguuacuguugguucgucaugcccaugaaagggauggguuuggagggaccucagagucucaggaacuguaaggucgagacuugguugugugccuugaucaggacacgucaucagugggaagcuauagaaacccaacguuaguagcugaagcagaaaagggaauuuauuggcucauaugacaggaagcccaggcguggauauagggauuuuuuuuuuuuuuuugagacagaguuuugcuccaggcuggagugcaguggugcaaucucugcucacugcaggcuccgccucccggguucacgccauucuccugccucagccucccgaguaccugggacuacaggcgcccaccaccacgcccggcuaaguuuuuggauuuuuaguagagacgggguuucaccguguuagccaggauggucucuaucuucugaccucgugauccacccaccucggccucccaaagugcugggauuacaggcgugagccacugcgcccggcuggauauagggacugaaugauacucugaggacuccaucugucugucucucucucucagccucauacacccacaguucugucuucauggaagggaaggugggguccauguauguugguagucugggcacugcucaaaggccccagcaaagggccaggugggagcugaaauacauucaaugcucugcuuacaaagcucuguguccugguauaaggcagcauugccccagagagacauuuuuccuaauucaucugccugggggagucaccuauugcuaauacacauaagaugccguguaagcuagugguaacccugacaccuucuccuggccaccaagaccagccccacaccagcacccucaucccucacucggcaacuccaucagacucaccugcucaaucagcacguauuuauggagccccuaccuacugaguacugcuggcaaaacucccugcccuccugcaacuuacguucuacugaaggaugggauugacuuugcuugggucacaugugcacauuuagaccaaucacuguuaccaaaggaacgagagcccgcccuccugcaacuuacauccuacggaaggaugggauuggcuuugcuucggucacauguacacacuuagcccaaucacuguuaccaaaggaacgacagcacgcugugguugaucccgcugagccagaugcccucccuuuuggagagacacggcacuugcuugacagccucaccaggacuacacaaaugggggugguuucucaggaaauaggagggcugggccgcagaaauagcugacauccacccaacuuugggguucugggacaaucauaguccuuccuuuccuuauuucuuuauuccucccuaaugacuuucccaccggcauuaggaggacccugggcccugauacucugagaacugggggguugggggagacaggguuucccagaagggcucagccauuggcuuaucacaggugaaaauuccccauaguccucggagagaaggggcaggggucagggcuguuuacccagcaaugugauugugaugugacucucaguuuugggaagaggaaaaaugagggggaugggggugcaucgguggggaauccaacucagagagcagggacugagugggggcucuggucccauuguugauggguugguggggagggcugguuggguacccaaagcauugaaaagcauuuguuauaugccaggagcuucacccacuucaucucauuuaggccccacaccugccagguaggugucauuaucccauuuuauuggugaagaaacugaggcucaaaguguugaagaaacagaaagaugcugacucaccugugcuagucccaaaggcucugcauggaguccacggugcccugagccacagaggcaugccccaagcagagugccugccccaugccaccucucacacgcccagcaaggggccucacagggaccguuuccaccuccugaucccuggcccacucgccccuagagacccagcaagcccuccuacagccucaccuguaccagguccccugcuuccacucccuguggaagcacuccacucccacuccggcggccuguuccaguuuccggagcacuugcaugcauucuuaccgucaaagagugaaucccacccacucccugaggccacuucaucaucccggacaccugccugcccaccgcgggcacaaggucaaccuugagcagacccucggggccugucugccacuagagggagcucccagugcggccauauaugccuucugggaugccgaggggcuggggcccaggcagagggacccguccuggggaugcccuaccaaggggcguucagaggcagagcucuugugacagguugaucuuccccuccacuccccaaagacccaggaggcucugguuugugagaucagcaucuucauuauuaaagcacaggugccaggagauucaaggugccuggaagaggaccuuuggcauccaggggcaugggcuccggauccaccuucccuccucugcccaugccugcagcucacagcccacuggaagucagaggagagcaggugccacucacagcaggccggcagcuggcuuccugcuccuuauuuauugauuuacugacucacuaauucaacaaaucuuuauugagcaccuucuauaugccaagcacugggcucagccuugggacuaccauggugagcccauagccccuguccucauguagcguucagucuuguggagguagagaugcauaaaccagcuguaauauuguguacuaaauucuacauggccagguguggugguacacaccuguaaccccagcacuuugggaggccaaagcaagaggauuacuugaggccaggaguucaagaccaaccugagcaacauagcaagaccccaucucuacaaaaauuaaaaaauuagccaggcauggugguggacugguuaguccaccugguuaguccaccuggacugguuaauccuccugguuagucaggaggcugaggcaggaggaucgcuugagcccaggaguuuaaguuugcggugagccaugauggugccacugcacuccagccugggugacaaagugagacccugccucaaaaaacaaaacaaggccggguguggugguucacaccuguaaucccagcacuuuggcaggcugaggcggguggaucauuugaggucaggaguuuaagaccagccuggccaacauggugaaacccugucucuacuaaaaaauacaaaaauuagccugguguggugguacgcuccuguaaucccagcuacuugggaggcugaggcaggagaaucccuugaaccugggaggaagagguugcagugagcugagaucaugucacugcacucuagccuggcugacggagugagacuccaucuuaaaaaaacaaaaaaacaaaaaaacccaaaaccaaaaaacaaaacaaaacacacaccucaguaaauucuacaacagguauaagccugggagacuccaggugcaaaagaggauguaguuaaccucuaccuggggggacuggaaggcuuucuggggggauggcaucuaaccugagaccugaggaguuagccaggcaacgugaagcauuccaggcagagugaucaguuuguacaaaugccuggaggugagagagcauuagccucucucucucucucucucucuucacuuuuccagcacuccugugacugugcacucuucuggaugcuggacugacugugucaccaaacaagacaggcaagcucccugcuucguggugcucacaugcuagggaauguggccauucaggugacccaaagacguauugaagcuggagggagacauguggaagggacgguggccccugcccugcccagagcacccaggccccauccuccauccuucugcugagccuggcagcuagccccaagcccuccugcaccagccagcuguggggagaucacccaggccauggcaggagccugugccaauguuuuaauagccaggcugaaggccugcugggcagcucugcuaauuacagugauuaauguuuuuaaauuccuuagaaagaguaaugugucaucacucuguugucacagcccagcuccagagucugcuuccuccccucuccccgcagaggugucccccaagcuccugcgggcuccccacuguggcccagccgcccuugagcccagacaccuggcccucccauucccaugccugucuggagccugacuacugucucugccccgguggugcaggaaggagcucucuuauccauccccacugcuagagaacugugcagccgcaguggucagggaagguggacccccucaucccccaagucacuucugcacggggcagagagagccccugaucucuagcuccccugaucccuccccgcagccccacuucguccccauguggcacacaccucuagcugaagucauuuuuguuuuguuuuguuuuuguuuuuguuuuuguuuuugagauguagucucgaucugucacccaggcuggagugcaguggugcgaccucggcucacugcaaacuccgccuccuggguucacgccauucuccugccucagccuuccgaguagcugagacuacaggcgccaaccaccacgcccggcuaauuuuuguauuuuuaguaaagacgggguuucaccauguuagccaggauggucucaaccuccugaccucgugauccgcccgucucgcccucccaaagugcugggauuacaggugugaaccaccgcacccggccuagcugaagucauuuuauguggcuuccuguuucacggccaccuuccggcucuggagugggacagggaccuuuccaggugcucuguuuguugaauggaggaaugaaugaaagggucaaauccccacucugugugccuccauccuuauaacaggauaaguuuggaucuggugcuuuucuccuccaaaucucaugugucucccuugcuagcuccccucccagguaaugucuauaggggacagguggcccagugucuuccuccuacaaccagagaaauguaagaccacaccgcacagaguugaggccugauuaucugaauccauugcuauguuagcuggagcagggauaucaagaccaguaugcuucuguguaugugagacggagucucgcucugucacccaggcuggagugcaguggcaccuucuuggcucacugcaaccuccgccucccggguucgagcaauucucccaucucagccucccaaauagcugggacuauaggugagcgccaccacgccuggcuaauuuuuguauuuuuaguagagauaggguuuggccauguuggucaggcugaucucgaacuccugaccucaggugaucugccugccuuggccucccaaaguucugggacaggugugagccaucgagcccugccaagaccagcacacuccugccccagcggccagaggagccgggucuugacuucuaugggauagcuucaagccuccaacuugagcuuccuuugacugcugucauuuuccugguguccccagggaaggcagaacuuccucaugccuggcagucuucuccugaggucuaaccucacucucccuuugcacccacucugaucuccaucaguggaauuggguggggagccugagggagaggggucucuucucaggggcaaucuaagaacuuuguuccaccugccaggcccagccugggccaucuccaggcccucuggucccuccuggcacugggacugccucauugccuaggaagguguguuuguuuugcuugcuuauucacugccacgcuugccccaguaggcagccagcuggcaggaagccccugggagcccuucucucaccugugccuggcacagcuggggcugggucagggcaggguuaggugggguaggcugugucuucacuuacucucccugaggggguaagagaugucaccugccaguccuucagcccaauuaggacaggacaaggacaaugcagagagagggauugcagccacacugaaaaccaaaacacaccucggaagggaugcaaguuagagaaccugaaugccacccuaggaaccacagcccccgccuugccauuagaugucugugacugaggcuggucgcaucuugcucggccucaguuccuccgccuguaaugugagaagggaaaaacaggaggaucccuugagcccaggaguucaagguugcagugagcugugaucacaucacuauacuacagccugggugacagagugagacccugucucaaaaacaaacaaacaaaacaaaaaaccuaaauaaauucuacaacagguauaagccugggagacuccaggugcaagaaaaggauguacuuaaccucuaccuggggggacaggaaggcuuccugggggguggcagcuaaccugggaccugaaggaucugaggaauuagccaggcaaagugaaaaguguugcaggcagagcgaucaauuuguacaaaugccuggagguguuugaugagcugaaaacuaaggucucuucuaguucugggauucaacacaggcaguuccugccccaagacacagcugagaauggagcaggguagaucuuugaccccucaggguggcccggcacuucccggaggaggcgcugggacccggcaccuaaugaccgccgcccccacacaggagaacuguugggucucugaaggccaggcaggaggccagauggguaauugacuccugccguaggggagcuggcccggcuucaucaguaugcagggccugugcagagugcuuaagaaaaacuuauuaauuucccuuccacaaagacugagaguuugacgguaaucacaguaucaagucguaauaauaauaaaaaaaaucccuccguugaaaaucacaguugggacucuggagaguucaacaggaaaagauuguauuaagauaaaggagauuauaacagggcggacauuaaagguugucauugucggguaaaucacaucagggaggccccaggacugcuguaucccagggagggagcgaggaccccgucacugaccuggcaaccccacuccguccgccucccgcccacccuggaacucugccuccuccugcccucgaaggcuaagauacacagguggcuccggagcaaacuugggaaucagaugucccggccugaggacccucauuaugggcagaggguggagcacuguacagguucuggaggacagagaucucugcucuagguuaggcucuuacagucuagccugacaguggucuucagaauaugugcccagucaugcaggggccuggggguggggcgguguuucugggucaccuguccuauuggcauuuuccugguaaggaugagaaaggaggaugagcuugcggaaaggaggugauggggcugggcaugguggcucaugucuguaauccaagcacuuuggaagaccgaggugggcggaucacuuguggccaggaguucgagaccagccuggccaacauggcagaacccugucucuauaaaaaaauaaaaaaauuagccggguguggugugguggugugcaccuguagucccaacuacuugggaggcugaggcaggagaaucccuugaaccugggaggcugaaguugcacugagccaagauugcgucacugcacuccagcuugggcugcagagcgagacucucuuucaaaaaaaaaaaaaaaaaaaaaaaacuggugagaauaccagggccucuggacacugcccugcccugccucuuggacauaggcugaaucagaaagggugucccaaccugucaacagggagucccaaucccaguggaaaagcccgaagaauucuagugagauauuaccaagaugaggcuauacuugcucaggugccaggugaccacugcccccggggcuggggcugggugcagugcagggccaagcugggguuggugauccuucucuuggacaucuucacuugggccaaaugagaggguucucugggucuaaagaugcaguuggaucugaaaguuauacuagacuugggacgagaagcuacaagcuguuaacgacuggggcgggggccacauggaagaaaggaguugaucaugggcuucucuggucauuaccaaggggcccuauaauguggaggcuuugaguccuggcucaaaacguuuuagcucugcauccuugggcagguuacuuaaccucucugugcaucaacuuuuuuaucuauagaauggugguuauagcauccacuuaaugcugugaugaggauucaauguaugauuauagugaagaauuauaaauaauaaaggccugcuuuuaucucuuaauugcccuugccugaggucacacagucaguagguggccaagaccaucuccugcccaucaccuacuuuuuuuuuuuuuuuuagacagagucucgcucugucgcccaggcuggaaugcaugggggugaucucagcucacugcaaacucuaccucccagguucaagugauucuucugccucagccucccaaguagcugggacuacaggcgugugccaccaccaaauuagaaggaaugcuaauuucagagggagagauacauucugggaaggagaacuuacagaacgcccagcuaauuuuuguauuuuuaguagagacgggguuucaccauguuggccaggcuggucuugaacucuugaucucaagugaucugcccaccugggccucccaaagugcugggauuacaggcgugagccaccgcucucggccucaucaccuccuuucugcaagcuucuccuuggggagugcaguguggcagccaagggcuugggcuuuggacccagagugccugggguucacauccuggcuuuugcuugggccagggacuucaguucucauacucagcuuucucccuuaggaaaggugaaagucacccuccuaaggucaaggugaugcugcuggugcagcgaguagcucagaaaggggcagcugaggcaggcagcuuucccuggggucucuggcccuaagccccccgaccuguggccguuaggcccagugggacagugguuccucccccuggcccuccagguggcauccggcccucugcggcugcaagccaugggcaccaaggacgguucugaagucgcccugaguuuaugaggcugagcggagaggacgaggcauguuaaguguaauaggguugugugagauuaaugugaggccgggugaagcagcuaaggcaagucauuuuggcaguuaauacauacauuuaaggaaugauuugagagugugaaaacauuuaaaaggaaugcuaauuucagagggagagauacauucugggaaggagaacuugcagaggacagagcugggguggagccaggauggaggugccaggugacccugcucagaauucagcccccuacagaguuuguccagguccuuccagggccucucugugcccaccugucuccaggagcacaggccucucggaagaccugaagcgggcacugagugggaagagcugggcuggaaccuuguggaagcaggguccuugucugcccgcauuauggagcacagggaguggagagggugcagcucagggggcuuugugaaaaggguauugcuugaacugagcuuugaaaauggguugggaggagaggguggaagcaaguggauuuggacuuuucauccaggagagaaaggugcuccgugacugagccugugauccggguaggauagggcggcccauauaauaggggagacucagcuucuucaggccugcgugcaggcuucacuaggguccuggagagcaggaggccaggaagagcagccuccuccuccucagggagcucucccucuccuggacccucuggaugggaaagguggagucucucugcucugaagugguuuuuuuuuuuuuuuuuuuuuuuuuuuugagacagggucucgcugugucucccaggcuggagugcaguggcacaaucacagcucacugcaucuucgcagcuucgacuucccgggcucaguugauccuccugccuuagccucucaaguagcugggacuacagguauacaccaccacgcccggcgaauuuuuguauuuuuuuguagagaugggguuuugccauguuacccaggcuggucucgaucucccggacucaagugauccgcccgccuuggccucccaaagugcugggauuacaggcaugaaccaccgcgcccggccccacaugcuccuugacggcacaagccuccucagcccugcuagugagauuggaggcaggcccuuccuuccuggaguuugaucuuucagcaccagaaagugugugauccgggaaucuccugggaaccccucggcucuaagaccucagcccucccauccacugauccagccuaaaaguggaaugagcugauccucagcuugcccgucccaucuccacuagaggcccaagagccaaggaguuagugccgucacagcuggcugcgaugaaggccuuuaaaagugccuggugugguuauuaauaaugucucccggcucugaaugccucuuuaauuccucugcuuaaaccacucuggaauccauaacacuugccccuuagccugugguaauuccgcucccuuaauggccuuuuauggagggagcuuauugaaagcuuuuccccaccgugaguaaaucauguccucugggucauccuugccugcaauuuuauuaacuucuuaugagaagucagagggaccagaggcaggccaauguuuccuccguguucuguccugcccgggcccggcacugucccuuuccuggcugggaucucagaggaggagauggcuggggacguuggaaaucaauaauguuuggaaugucucaacccagugccccugacuccuucacucucaucugucaauccuuccagguggguaggagcugggagaccaggcacugugaaugggagaagcaggggacacugggaagcagggacaagugccaggagggacaggauacgcaucaguuaccugauucacugguuaccuggugcaucagcuaccugguucauuggcugguuaccuggugcauugcuuaucuggcgcaucaguuaccuggugcauuggcuaccuugugcauugguuaccuugugcauugguuaccuggggcguugauuaccuggugcaccaguuacuugacucauagguuaccuggugcauugguuaacugguguauagguuaacuggugcgucaguuaccugauucauuacuuaccuggggcauuggugcacagguugauuaccugguucaucagugauguggcaagcaccagauuugguagcaggaagugggagacugaaccagagccagacacuggcgccaacaacugggaacuggaaaaggccaaggaccacgcuaaugugagacaauaacugaggaagcuguguucgggggaaagggagcguauggaaacucuuuucuuuuuccuagaacuagaaaaccuagagcugcucuaaaaaauauaaauauaaauuuuuaaaaaaggcaauugagacccuaggaaauggagaugccuggaaaaaaacccaggagguucccccuggacaucugggaaugaaaggguuuguggcuuuggaauggcuuucaaggggcccaugugccucucuccuggcccaggagaaagacgggaggggcgcaggggaaauaaugggagagguggaagagggcacuggggcuggggacugggugucccuggggugugggacaggacuucuuuuuuuuuuuuuuuuugagaaggaaucucgcucuguugcccaggcuggagugcagugaugccaucucggcucacugcaaacucugccuccuggguucacaccauucucuugccucagccuccccagcagcugggacuacaggugcccgccgccaugccaggcuaauuuuuguauuuuuaguagagacgggguuuuaccguguuagccaggauggucuugaucuucugacauugugauccacccaccucggccucccaaagugcugggauuacaggcgugagccaccaugcccggcugggaugggacuucuuaagggagcauaaacccaucucugcugucugcucccugggccauaggcaggggcauuccucagagaaggaccaugucagacugacauucagcugcccccucuuacgccaacucugaacuuccccgcaaccgcuagcuccucccucuggccuaagagaaagucaggacagccacccggcccagcuucggagcuccacugaacuucuccccacagagaguguuagaaaucaucucugugacuacagcagaagggaggcuggggcaggggcggccagggguggggcuggaucccaaaccuggaggggccagugucuucagccguccccaggaagggucauagagggguuuccagcccugacugaccacuggcagcagagguuuugcaaauucuaccuggagccuaggaagguggguuggcaugagcagcucugugaggauccccugucccuggugucaccaucugggccagccaguucauuggaggagggucuggugagucuccucuccucccacuccaggaaguagagugagcaccagaccugaagucaggaauugggcuauucccaccucucaccaagaggcugcaguccuggccaggcacgggguaaucccagcacuuugggaggccggggcaggcagaucacuugaggucaggaguucgagaccagccuggccaacaugaugaaaccccgucucuaaaaaaauacaaaaaagaaaaaaaaaauuagccaggcgugguggcgggcaccuguaaucccagcuccuugggaggcugaggcaggagaaucccuugaacccgggaggcagagauuguagugagccggggucacgccacugcccuccagccugggugacagacuacaucucaaauaaacuaaaaaaaaaaaaagagagagagagguugcaguccugauucugaccuuuggcaggggaaauagcuggcucuggcugccccagccccuccuccguucagcuccgggcuuggagcuggaagccaguugaugcccuccccucucccugcuuccccgagccgcuggcaggcacugguacuuccccugugccaggcucugugucgagggcuuuacacguauuaucucauuuaauccucucacccacccagacuacauagucucuccucaaugacuaccuuccauucauucgcccuguucuccgcuuccuagcccugaugacaaaucaugauaugcuuuugcuuguuuacuuguugucugucuucccacuuagacuguaaauuccuuuuguucucugcagcaucccgagcacuuguagaaggccuggcucacuacauuuuuucuuuuuaaauaaaugagggacuuaaucaagugacuaggcucagagucauuuucucaggaucacccagcuugugucuguagagcuggaauccacacccauguugcugagggaaccugcuccccugugaugacaggagcugcugggaggaguuugaguuucaggcccagcacagaagccaagaauaacugaaaccccagugccuuuacauucaccucugcacaaugaaucgagcuucccaguggugcugggagcagagccggauucuccccuaaacuggaggcuggccaucggacacccuuccuggccugaacucucuuuccuucccugcagggaaccccagccauggcugcaugcucuggcugggaguaacagugagccucaggcuggggaggcagagggacagcagagcacacaccccuagauggauguagaggauaugggaauaaagaccacauuccucaccccuguuuggaaacggggaagcgggagaggcacagcucaucugccggcacugucagcuuggccugcggaauagacccuaaguccgaugacuucauccccaccacuaccuaccgcuccauuccccucgccucacagcugcaugaccgaaggauccucucccucccacucaacuccuaccaucuauuuuccacccagcagccagagugguuuuuaaaagaacaaacuaggcuggacgugguggcucacgccugugaucccaacacuuuaggaggcugagucaggaggacugcuugaggccaggaguuucaagacaagccugggcaaaacagcaagacccuguuucuaaaaaaaaagaaaaaaaauuaucugggcuugguagugcacuuguguagucccagcuacuugguaggcugaggugggaggaugauuugagacgaagagguggaggcugcagcgagcugugaucacgcuacugcacuccagccugggcaauagagcgagacccugucucaaaacaauaaaaauaaaagaacaaaccagauuauguuguugcuggcuuaaaacuuugaauagcuuccuauucuacuuacaaaauaauccaggcugggcacgguggcucaugccuguaaucccagcacuuugggaggccaauguguguggauugcuuaagcccaggaguugaagaccggucugggcaacauggcgaaacccugucucuacaaaaaauacaaagauuagcugagcaugguggcacgugccuauagucccagcuaguagggagguggacauaagaggaucccuugagcccaguaggccaaggcugcagugagccaugaucaggccauuggacuccagccugggugacagagugagacccugccugugucaaaaaaaaaaaaaaaaaaaaaaaaaaagccugggcucaguggcucacaccuguaaucccagcacuuugggaggccgaggcgggggaucauuugaggucaggaguucgagaccagccuggccaacauggugaaaccccgucucuacuaaaaauacaaagaauuagcagggugugguggugcgcgucuguaaucccagcuacacgggaggcugaggcaggagaaucacuugaacccaggagguagagguugcagugagccgagauugugccacugcacuccagccugggugacagagcgagacuccaucuuggaaaaaaaaagacaaaaaauccaagcuucucuuugugucccaugccugaccuaaccuucucuucuuuuuccagccucuucucaccccaagaucuccuccacugcccuaccacacugacccuuucugccccuguaccgccagaacucggucucucuccacaccuuugcccuuccauucucucugccuggcaugcucucgucucagaucuaagggcugacugcuucuuaucauucaggucucagcacagaugucaccucugugcagagccuucuccugaccacccccgaacccagcacauccuaucuccuuuuccuguuuuauugcuucauugcauuugacauugugagucuaaaaucuaagauuuugucauuuauuuauaguuuauucuuuucauaucugucucccccacuggaaugucaguuagcuccaugagggcagggacugugucuggucauugcucugacucuggggcccugaacagugugcgccucauaauagguguucaauaaauguuugcugaaugcaugaaugcaugaacauuucauguuggagggaggcuugcuuggggcaucccugcugggcagcuuagcuccuuccugccccaggaccuugcuaugccaacacuagaaggugaggaggggggcagggagggaaguggggaugaggucagagcucccagccugagugccacuccucgggugcugagccguggggggugacggccgcucugagggagauggaugaccuguacuggguggcugccccgggaagcugcuuccuauuaauaacagcaguagcacugccaggaggggaaggggagggaggcagaggcagcggagaugggauaaugccccucaccccucaccaagccaggaaaauggcaucguauuuucuagaagacaagaaugccacuuuuaaagaaaauuaggccaggcacgguggcucacgccuguaaucccagcacuuugggaggccgaggcgggcggaucaccaggucaggagaucgagaccauccuggugaacacggugaaaccccgccucuacuaaaaaaaaaauacaaaaaauuagccgggcaugguggcgggcgucuguagucccagcuacuugggaggcugaggcaggagaacggugugaacccuggaggcggagcuugcagugagccgagaucgcgccacugcauucuagccugggcgacagagugaaacucugucucaaaaaaaaaaaaaaaaaaaaaaauuuggccugguuuguaaaugggucucugucugcucugcagcccucccuguggacaacuccuccgugcguggaggcuucuuccccggcuggguggacccuacaggcagccagagggaugucccccuuaccccuccccuugucugggccagccccaaacagaggccguggcugagagggaagugucugcacccuggggcuggggaggaugaacuuuguccaaacuccucugacuccuuucuccgagggugguuauugggaaacaggagugaaggugaguaugggagggaggaggaggaggagaagcagagagagaacagagaugguguaggcugcuugguggcagaccggggcgugggcaggaaggcccaaucuggucccaccagauaccuggcuuugcccuuguccuggggcaggcagggggcauugaggagcuggcagaacuguggacagaaggagagcggagccgcuuucucucccagcgagaaaagagcccagucacucucauuuucaggggaagcaacaugccacaccccccgagacaccucuguccccagcacaguagcuccugauggcugcccggugaggaugcugcgggcaggucccacuguccccccaggcucuggcgugcuccccccaaccaagaugccccagcagggccccuaguggcccaggucuguggccauccugguuccugucuccacugucuaucuggagccccucuccaagccuccaucccccaccagcccccuccccgccucaccgggccacagccccagcuuggucucuaucuucucacccagcccugccucucacuaggccucacugccgccuagcccuaucccuucuuugggcccugauccucuguccugaguccucuggccccggacacguuauacuuccaugaccaagggucuuuguaaauucuucaggcgcucuccagaagccccaguccccucauacucacagcucugaacacagcccggcccugucccuaaaacccagacaggacccgcaugugccgugaccucccacucuccaguguggccccuaagaacucagggucgggcuuggcauuagccuggaggccuggagccugcucauucaguccugagcugacagagaaggucauuagcaaguuccuaacugggccacaccuccugggcugugaggacggcuugugccagagaaacaucacacuccguguaucucacuucuuggggugguggcacuugguggugccggggacucccacauguacuugugagaagucucaguuccccaucuccuucuagccaccucucugucaccucccucugcuggguuguggaggggugggguaugucucggggugucccuguguggccucaggcaucauuuguagcucuccuguggguugagguuucuucucggggcucauucaccccggcucccauaacccuaccccaccauuuccuaagcaauaaccccguaucaagcacugggcuaagcaggaucuucauggccucacaaggugggaccugucacuauuucugugcucagcagaggaaauggagguucagaguugucaagccacuugccuaaggucacagagcuaaacccugguggagcugugauuaggcuauaggucuggguggcuccugccugaguuccuggggcucaaguuaccccauaucaaacugggagacccuguguggucauuucuuggugccagagucugguugaggggcacaggcagggaagcugggucuggaacagucugucagguuggacacugugaucaccucccauugaagcaggaggaggugcagccacaggccguuaagugauuguuuauucaaaaugaaaggaaaucucccgaacaaagcaagaaacucaaagauugaagcgcagggccugggugggaaagaagaaauuauccgguuccugcccuuccccagcaaagcaggcauggcuagagcuguccuagccagcaccagagugggccccuggccaggcgcaauggcucacgccuguaauccuagcgcuucaggaggccaaggaggaucacuuaaggccaggaguuugagaccagccugggaaacuuggugaaacaccccguuucuacaaaaaguagccaggugccuauagccccagcuacucgggaggcugaggugggaggaucacuugagcccaggaguucaaggccauagugagcuaugaucaugccacuguacuucagccgaggcagcagagugauaccauaucucaaaacaaaacaaaacaaagcaaaaacccaacaacaaaacagcaggccccaaggaagccuguggcaggggccugagggguggugcagguaggguuggugggguuuuccugggucaugccucuaacuagauaauaaugaugccugucucauugcggugcggugggaauacaaugugccuauaguauauauguagcgcauacuguauaugcaguguauacagugcacauauagugcauuuacaguggacaucuagugcauauaugguguauacguagcguauauauagugcacgugcuguaguguauauaucgugcauauguaguguacguguagugaauauacagcgcauauauaguacauauguggugcacauauagugugcauauaugguacauagugcacauaguguacaugaaacauauguacacgaaacauauacacacgugcacuacauuacacgugugaauuacauuacacaucuaucauauaugugguguacauguaguggacauauagugccuauguagcauaugaauauguagugaauauauagugcauauagaguaucuaugcagugcauauacaugcacuauauauaacuauacgugcauuuacacauacacuauaugugcacuauauauucacuacauaggcaaucuauaugcacuuuauauucacauauauacacuauaugugcauuacauguacacuacauuacacuacgccacauuacauuacacgugcauuacauuacacauauauauggucuaugugguguacauguagugcacauauaguguauauauagugcauauguauauauaguauauauacuauauauacauagugcauauguaguuuacauguagugaguaaacugcauauauaguacauauguaaugcauauauauagugcauguauaguaccuauaucguacaugugguggacauguagggcacauauggcauauauagcguguauauauagugcacguguggcgcauauguggugcauacacugcauauguaguauauauacauacagugcucagggacgaugcgccuccugccuggguuccaggggcaggcacucucaucuccucucaggcccccagggggcgcaccuccccccggccggacguguucaggcagcggcuucccuucagcccccaugcaagcaggugcuuuuuauuuagacugauuuauuauuggaacaacuugaaucagcuucaaaguaaguuaaaugagaagagaucuucaccccuagucucauaaaucaagggguauucaaagaaaagggaaaacaaaucacagaagccuggaaacagaugggcuuucguggccuuguauuccuggccucucuccuagggcgcgcugggaaccagucuuucuuuccuuccuucaccugaagagccugggucgaaagcugugcuccuuccccccuccucccccucuuucaccuccuccuccuccucccucuccucccccuccucccucuccucccccuccuuccccuccccuccuccuccccuaccuccuccuccucccccaccuccuccuccucccccuucuccucuucuccccccccuucuccuccuucuccccuccuccuccucccucucccccucuuucaccucccccuucuccucuuccuccuccucguccucccuuucacggucgccagggagaggcugguguccccauagcgagggcuggauuuaaguugagacaaauuauccuucucccuuacgcagugcacaugcccagagccccuuucuagccucagggcuccuggugcccuguggggcaggggaaugucuccgggcagugugguuugggguugggaguuggaaggacugugguuccuggaugacuguggagagaugugaauuugggagucugguugugaggccaucugaggcugcccaguguguggcuguugugcuuugugucccuguguguauguccuuguguguauguguguccccuuguguguccccguguaugugugugucccuguguguguccccauaugugucuguguguguauguguguguguccccguguggguaugcgugcguguaugugugugucuccguguguguguguaugcacacaaaagcagcugagcauuccucaggccuggccuggaauuucagauccacucuggaugaaaguugcugcuggcugccucuucuguuccccuaacuaugggcacugccuuuuccuuaugccaagcugcccgcagcugagagcaaugcagggucucccucucugcacagcaaauucuggcuggggacuccacucuccugcuccacaggccaccuggacgcacugcccagggccacgggagggacaccugcagcggauggacaucaaaaacuaaggucaauggccgggugcaguggcucaugccuguaaucccagcacuuagggaggcugaggcaggaggaucaccugaggucaggaguucaagaccagccuggccaacacggugaaacccgucucuacuaacaaugcaaaaauuagccagguguggugguggacaccuguaaucccagcuacucaggaggcugaggcaggagaaucacuugaaccugagagguggagguugcagugagccgagacugagccacuacacuccagccugggugagagggagagacugucucaaaaaaaaaaaaaaaagaaacuaaggucaaucgccaaugaacaaugagacagcgugggggugagacgggaggacacaccgggaggggcgcaagaaaugccagaggcaggagacagauggguccaagggccagagagccugcuccaguggcuccucggagugagaugggucagagagggaggcaggagaccagaaaauaccaaggaagaaaaaucuaagguaagggagaccaagaaagaaagaagaaggagucagacgugcagcugcagggacaaagacacauaaaccgggggugagagagacagagugagaguugccuccagcuggggcuggguggggaacuuaguucccaccaggguuguggacuugggagcuugcuugcggggaggagggcuaauuggcgauuucauccagguccuccagaacgucugcagaaaaacaaacccgcuaaacaucucucaccgucugucaucuucauuuugcuuuugucuucagaauaaagagaaucugaaacucccuaggagaagcggcuccagcggcucucaggcugucucccguucugcuccuucuucaugcuuuucugguuggagucuuuguuccgcagcuucuugcccugguucaggcuggcggcugcucugacccggcgugcuggggucuccauccccaucucugucacacuguggucugga

SEQ ID NO: 14228 - RNA, 6631 nt, Homo sapiens
uucgggcuuggaaggaaagcuauaggcuacccauucagcuccccugucagagacucaagcuuugagaaaggcuagcaaagagcaaggaaagagagaaaacaacaaaguggcgaggcccucagagugaaagcguaagguucagucagccugcugcagcuuugcagaccucagcugggcaucuccagacuccccugaaggaagagccuuccucacccaaacccacaaaagaugcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagguaaggagaccaguccccugagggagcguggagugccuccccaucuacagcacugcuucuacauauccuggucaucagaaccacuacuggggccucuuuuguggguacacuuucccuuuaguaaaggcuuaugcaguauuuccuuugacuucuaaugcuauguaaguuuaccuaacaccuucacgggucucuuuuauccacacaguguuucagccuaccaucuuggagugcugagauacuacaugguuugcccaaagucacccagcaagucuuagaagcaggguucaagucuuccugauugguguagcucugcuacuuccucaccaagagcugacaggcuauaucucaagaaauuccaaggaagcaccaaacuguaacagcuguuccucuggaagcaaaguuuugccagaaacaguucucugguguuccuaagauuuaccaggaaugagcauuaauggaauuuuguguccucucucuguaaacguaacucuucucauuggcucagaguuaaguguagagacacauaaccaugugaagagucccuuuguguucaggaaggaugcggcuccuuaagguuccucaauugugauacgucuauuuuuuuccauggucuuaaaugaauuucuccgaauacaggauuuuuuaaaugcaaugcugaaauauagacuuaauaggccaaaaauaagauaaauuuaaucuuucuuuugcaaaauaacuuuuauuucugguuagcucagcucaggugggccaacaugaauuuacgguuuagagauaaaaauuugguuuucugaaauuaucaggaaaauauuaguuguaaggagcauauccuauagacaugucauuucuugcugauauaaaaaccauuggucccauuauaaacuacaugaagaacaaagacaugaucagcuucuacugacuaagucaaugguuaaccucagcucaaauuaagaaaaaguuuuaacaugaaaccaagcuugaaaauucuguuaccugaaccaacauguaucaaucacuuucuaagcauggacuuccgggcccucaguuugggauuagaaagguauucucaggccauuuuccagacaagugaguccugauuuggucugugagaugaaaccagacaugcggaagaccaggccagacagaggaaucugaccgugccacuuccugcucauccaaacaggaggcuuucucaccauccugcaaggagguucuuggggucaagugcagcucucccaccaggucucuugcucuucuugcccaggacaucauuccuuauuuuucuucucuaugaccaagugcucaguuacccuuauauucuauaaguagguagucccuuagaggaagcaguaaguuggugcuuucaccacuaagacgaaaugaagaauagugauggcgaaggcacacguacucuaccucccuuucccaaggugcucugcaagagaaccuaugugccucagacaacucccaucugccaucuuggugcuccucucuaaggucccagugcaguggucaccaagaaaagcaccccgagacauagcaggcaggaagcuucucuuggauaguaagggccgcagucucugaauccuaucagaaaaggcugucucuuccacuaugcucuuugauauuuagaauacagagcuuaaauccugcauaaaguagcagcuccauggcccuagaguaaaaaaacuggccagucugaugcucucauuucauuguuuuaacaaaacuucugggaggaaggccucaaagguucuucugaguguuuugaggugcuagcuggauggaaggggaaaauaugugauaauaaaaucuaucucccuuaauuauggucucagguggcaguagccaccaucucugaacaacaacaaaaacaaccaaccaggaaacaucaacaaaaccagacucuaugagauauucacgacugauuuguuauaguggcggcugucuaagaagucugaaucuaucugacaggaguaucuguuacguggcccucauacacuguaacauuucuagaauucauggcccagcuauagcagaauaauuuauuucagaguuaaccugaaaccaccuguuggaacgucccacuaaugcuauccaggugaagggcuucccuaccccucugcuccaccgcuaguaaagccaaaauacacccccucuggaucuccccauauccaccucucccaaaugcagacacugauggguaauuaacaccacugagaaucccaggguagaaauaaaggcucagucucuaaacacucaacucagauggagccacugggucuaaaugcucacccugugguuuguucucuuguagaugccaucuacgacugcucuucccucuaccagaagaacuaccgcaucucuggaguguauaagcuuccuccugaugacuuccugggcagcccugaacuggaggugaggucauuacagucacuggccaugcccuaauaccuguccuucacccccucaaggggacuacaacaacagggccauucacaguuuaaagaaaggaaaauucggcugggcgcaguggcucacaccuguaaucccagcacuaugggaggccgaggcagguggaucacuucaggucaggaguuuaagaccagccuggccaacauggugaaacccugucucuacuaaaaauacaaaaaaauuagccaggcaugguggugggcaccuguaaucccugcuacacaggaggauugcuugaacucaggaggcagagguugcagugagccgagaucacgccacugcacuauaaucugggagacaaagugagacuccauuucaauuaaaaaaaaaaaaaaaaaaaaggaaaacucaaacacaagcaaacacaccaaacaccacagagcuaugcaaacacucaguuuaugcccugcacuccaaacccaggcaucuguuuggccccuucaaaucauuaucagucaaacaacaagccuucuaacauagaucagaucauucuuauaaccaccacauaacuuaguuuaaaucucuugccauguccuagaacagcuauuccuugggggaggagaaaagaaaacacgaaggcagcaucaaauuaucuggauuuucacccaggcaugguggcucacaccuguaaucccaaguuuuuugggaggugaggugggcggaacaaucaccugaggucaggacuuugagaccagccuggccaacaugcugaaacccagucucuacuaaaaauacaaaaauuagcccaguguggugacaggcacucuggucccagcuacuaggaaggcaggagaaucacuggaacucaggagguggagguugcagugagccgagauugcaccacuguacucuagccugggcaacaagagugaaauucugcuucaaaaaaaaaaaaaguaucuggauuuuucccuccaagcuucaugugcacucacccccgggcccaauuugcaucguucuuccagagcaaugcaccacccaccccagcucaccagcaguggggcagcaucacugcccgagugagccagugugacugcgggagugcacacaucuacuggcucugcagggacaggaacagguugggaagccugcccucuugcuccugccuucugccccugcaagucccucaccagaguauccccucugcuucagguguucugugacauggagacuucaggcggaggcuggaccaucauccagagacgaaaaaguggccuugucuccuucuaccgggacuggaagcaguacaagcagggcuuuggcagcauccguggggacuucuggcuggggaacgaacacauccaccggcucuccagacagccaacccggcugcguguagagauggagguaagcacaaggccaggggccccaugacuggaccagugccaccacacaugaccgcguacaacuccgggggugccauuccuauucugauucaagacaaaucuguauauucauugugaugguuuuccugcaaguuguaauggaguugaggaaaaauagguauuuuuccuuucugcaacccccccaaccccccgacaaaaguggggcugcaggugggacaggaagaggccagacccaggccagaguagagcaaauucaacagucagcugugccgaacacuagucucugcucuggccgagcaugagguccuuuaggugcaaaucuuacugauacuguuuggggacccuugcugaaggucugaaagcacucacuauauccucauguuucucuuacagcagcucugugugggauucagcaaaaacauagcugcaccuuauaagcaggaaagugaggaauauagaaagagagacuaaucaaggccauauggugaaucaggaaagaaguucgagccuuguuuucugauucccagguuaacacaguaaacuggagguaaacaaguaauaaagucuuauuagauucacaccuauaaaaagauguuuggcuaugggacugucaggagagaagggguauagagacagcaugaaauggagccugcugcacuuucuuuaaggcucugcuccuccugacaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaaggugagauuuggggggaccggaaaggagaaguucagguacaagcucauaaucccacuugaggagaaagagugaauuauaacuguacaguugauauuccgguuuugguauucuuucugacccuggcucuaacuccuuaccugaugucuggucuaucacagucaacuuacuagcacugggucuguuucucaugccagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaaaaggaggcugccguggagcacggauacagaaacugagacacguggagacuggaugagggcagaugaggacaggaagagaguguuagaaaggguaggacugagaaacagccuauaaucuccaaagaaagaauaagucuccaaggagcacaaaaaaaucauauguaccaaggauguuacaguaaacaggaugaacuauuuaaacccacuggguccugccacauccuucucaaggugguagacugaguggggucucucugcccaagaucccugacauagcaguagcuugucuuuuccacaugauuugucugugaaagaaaauaauuuugagaucguuuuaucuauuuucucuacggcuuaggcuaugugagggcaaaacacaaaucccuuugcuaaaaagaaccauauuauuuugauucucaaaggauaggccuuugaguguuagagaaaggagugaaggaggcaggugggaaaugguauuucuauuuuuaaauccagugaaauuaucuugagucuacacauuauuuuuaaaacacaaaaauuguucggcuggaacugacccaggcuggacuugcggggaggaaacuccagggcacugcaucuggcgaucagacucugagcacugccccugcucgccuuggucauguacagcacugaaaggaaugaagcaccagcaggagguggacagagucucucauggaugccggcacaaaacugccuuaaaauauucauaguuaauacagguauaucuauuuuuauuuacuuuguaagaaacaagcucaaggagcuuccuuuuaaauuuugucuguaggaaaugguugaaaacugaagguagaugguguuauaguuaauaauaaaugcuguaaauaagcaucucacuuuguaaaaauaaaauauugugguuuuguuuuaaacauucaacguuucuuuuccuucuacaauaaacacuuucaaaaugugag

SEQ ID NO: 14229 - RNA, 874 nt, Homo sapiens
cucugagaaaacaccaaauggcagaugaugucgguggaggggguggggcgggggcagaggccccgggggcccugggaugggaaaccgugguggcuuccauggaggggcugggguugcagcuguggacagggcugaggccacggagcucguggaggcaaggccaaggauaaggaguggaugccugucaccaagcugggcugcuugguuaaggacauaaagaucaagucccuggagaacuaccucuucuuccugcccaucaaggaaucugagaucacugacuuuuuccugggggccucucucaaggaugagguguugaagauuaugccagugcagaagcagacccacacuggccaguugaaaagguucaaggcguuuguugccaucggggacuacaauggccacgucggucuggguguuaagugcuccaaggagguggccacugccaccugcggggccaucauccuggccaagcucuccauucucccugugcacagaggcuacugggggaacaagauccacaagccccacaccguuccuugcaaggugacaggcuacugcggcucugugcuggugcaccucaucccugcgcccaagggcacuggcaucgucucagcccgugcccaagaagcugcucaugauggcugguauugaugacugcuacaccucagccaggggcugcacugccacccugggcaacuucgccaaggccaccuuugaugccaucucuaagaccuacagcuaccugacccccgaccucuggaaggagacaggauucaccaagucucccuaucaggaauucacugaccaccucaucaagacacacaccagagucucugugcagaggacguaggcuccagcuguggcuacaacauag

SEQ ID NO: 14230 - RNA, 6079 nt, Homo sapiens
cgcgcccggguuagguugcggcgcgggcggcgggcggagcuggucccguugugcugcggcgccgcgcggccugcagucccgggcccgcgccccgcgccgcccgcccgcccgccauggagcccggccccgacggccccgccgccuccggccccgccgccauccgcgagggcugguuccgcgagaccugcagccuguggcccggccaggcccugucacugcagguggagcagcugcuccaccaccggcgcucgcgcuaccaggacauccucgucuuccgcagguaccgccgcugcccgcaggcgccugcccccuaggcucagcccgggccgccugcugcccgccucacgggccucuccacgccgggacccaagcgggcuggaccucguccugcccuggcccccucgccaccccucacaccgccucccugggcuggggcugggacugcgggcuggccucuugggugggggagucggagucugcgccccgcuccacgugucagcccucaggacacgucagagcccgaggagaccccgggucccaccccggccuccacccggcggcccgccugccguuccucgccacgugucaccaucgcuccucaucccugggaccccuaggcgggauggggagacccuccucacccagggcggcuugggguacguuuuccccaccccagagaacccagguccccgacugucacuccgcccgcaguaagaccuauggcaacgugcugguguuggacggugucauccagugcacggagagagacgaguucuccuaccaggagaugaucgccaaccugccucucugcagccaccccaacccgcgaaagguaccccaguguccccuggaacagugccggacgaggggcggccccaggugugcuccgggcucuucccagaugcugccugcaugguugucagagaaagugcuagcgaggccaggggcgucccgcggaggggugggggccgacacugacgcggccucggaauccuagggcagcccuggaaggaacuuccaggaaaggggacaccggcacgaaagcguuuccgaggguagaaaaagaugaggcccguggguccgaggggucagggggucugcuucaggggccugggggcucccaguccugccagggccccugccuugacugcccccuccucccaggugcugaucaucgggggcggagauggagguguccugcgggagguggugaagcaccccuccguggaguccgugguccagugugagaucgacgaggugagugccggcguagagccagguuugaguccugguucucccagcggccagcugugcccugaaauggcugcacacccccgagcaaggcagguagggccuguuucuccaucuggaaaacaccuggucggggaggguucaguaggaaaaccagauggcagagggccuggcagguggugagggcaccugcguggcgagcucuuacuaaaacugagcugauuuuuuuuuuuuuuuuuuuuuugagacagaguuucgcucuuguugcccaggcuggagugugauggugcgaucucggcucacugcaaccuccaccuccugggcucaaguaguucuucugccucagccuccggaguagcugggauuacagacaugcgcuaccaugcccggcuaauuuuguauuuuuaguagagacaggguuucuccauguuggucaggcuggucucggaccuggcgaccacaggugauccgccagccucguccucccaaaguacugggauuacaggcgugagccaccacgcccagccgacuaagcugauuuuuaaucugagccccaggcagggccccaagacagcucaacuauuuguacguuaccccuuacacucaguagcugcucacuaaaaucaugcuacgugccagguguugcccggguauggggacagugguagacgacagaucagucccugcccucuaggagcugauguccuaguuaaaggagacaucagauggccagacgugguggcucacaccuguaaucccagcacuuugggacgccaaggcgggcagaucaccugaggucaggaguucaagagcagccuggccaaccuggugaaaccccauuucuacuaaaaauacaaaaauuagccgggcaugguagugcaugucuguaaacccagcuacuagggaggcugagguggaagaauuacuugagcccgggaggcggaaguugcaaugaaccgagaucucgccacugcacuccagccugggugacagaggaagaaucugucucaaaaaaaacaaacaacaaaaauagagacaucaaaggauggucugaugaaggcaagacaggggcugggggacaggagaaggcaggguuccugugaaugcaugggggguggucagggcaggccuccaggagguggcguuugagcugagaccucagugaaaagcagguggccgugugcagggagggggagguucuccuggccagagguuggaauugcauccuucuaaaauaggaaacaggccaagcgcugguggcucacaccuguaaucucagcacucugggaggcugaggcgggcagaucacaaggucucuacuaaaaauaaaaaaaaaaaaaaaaaaauggcccagcuugguggcgugcgccuguaaucccaacuacucgggaggcugaggcaggagggugcagugagcugagaucgugccacugcacuccagccugggcagcagagcaagacugucucgaaaaauaaauaaaauaggaagcgacaagaaagccacucagauggggcgauuuggucuggaaggaggggguagggaugggagagaggagcccaagccgccggcaggagccagcucucaaggagaaauggagguaccagaguucuccccgcuuuacacauuauaaacugagguucccaaaaggggccaggugugguggcucacagcuguaauccuagcacuuuuggaggccgaggugggaggaucgaggaguucgaggcaacauagggagacucuaucucuaccaaaaauuuaaaaaguagccaaguaugauugaacacacuugucccagcuacucaggaggcugaugggggaggaucaccugagccccggaggccgaggguguagugagccaugaucgaugccacugcacuccagccugggccacaaagugagacccugucucaaaaaaaaauaauaaaaaaaagggaagggguuggccaaggcggcuugccugugaggcacuuggagagucccacguggcugugcuggcuccaggucccccagccccuuggcccagacuggucccucccauccccuccaggaugucauccaagucuccaagaaguuccugccaggcauggccauuggcuacucuagcucgaagcugacccuacaugugggugacgguuuugaguucaugaaacagaaucaggaugccuucgacgugaucaucacugacuccucagaccccauggguaagcaguggaugggccccaggguuuucuggcagcugcaggucuggaggucagccucccccaggccuucagaguaaaggauagagcggccucccaccccccgaacuagagcuguacuuuucccuucucauuuguuaccugcccucugaaacauggcucaggacaguaggcaggagccaggcgacugcccagauucacaagcuggugaccaaggagaguggggaucuggcauugggacacugaggacccuguguccucuucagccuccccucugcucugaaguggucagcacuggagugggggcagguucuagucuugaacgaaggccuagguuagagguuccucugcuguggugccaaugagacucccccaagaaugggauucagguguggaucccccacagaccuggguucagauccuggcucuggccaccugguagcugugugggugacaguggcccuggaggucacagccagacuguucagugugucucccucugucuuccccaggccccgccgaaagucucuucaaggaguccuauuaccagcucaugaagacagcccucaaggaagaugguguccucugcugccagggugagccacaggccuggagcacuggggcggggcgggguggggcagggcaggcccugccggaugcugaugcuuaggggcccccaggcgagugccaguggcugcaccuggaccucaucaaggagaugcggcaguucugccagucccuguuccccgugguggccuaugccuacugcaccauccccaccuaccccagcggccagaucggcuucaugcugugcagcaagaacccggugagaugggggugucuggggguggggguuggggggaaggugggcauaaauagagaucccugccccugccgggcgcgguggcucacaccuguaaucccagcacuuugggaggcugaggcgggcagaucacaaggucaggagaucgagaccaucuuggcuaacacggugaaaccccgucucuacuaaaaauacaaaaaaauuagccaggcauggcagcgcgcgccuguagucccagcugcuggggaggcugaggcaggagaauggcgugaacccgggaggcggagcuugcagugagccgagauugcgccacuacauuccagccuggguaacagaggaagauuccgacucaaaaaaaaaaaaaaacccuccccaggccaggugcggugucucaugccuguaauuccagcauuuugggagaccaaggugggcggaucacuugaggucaggaguacaagaccagccugaccaacauggagaaaccccaucacuacucaaaauacaaaaaaaaaaaaaauuagccgggcgugguggcgcguaccugaggcugaggcaggagaaucacuugaaccugggagacagagguugcagugagcugagaugacgccacugcacuccagcguggcaacagugagacuccgucucaaaaaaaaaaaaaaaaaagugcccccccugaugugccccuggcccgguccccagagcacgaacuuccaggagccggugcagccgcugacacagcagcagguggcgcagaugcagcugaaguacuacaacuccgacgugcaccgcgccgccuuugugcugcccgaguuugcccgcaagguggguggccugcggggcuggguggugggacccagggacccagagcgcccuccugacuggccucaugucccuccaggcccugaaugaugugagcugagcccaggcgccaccacugaugccacccaggaccucggaccuuggagccugcggggugccucggccccuccagccccgggccggaccuccugcuggcucucgcccaccaaccaaguguuacaagccccagaaugcugcccggccugcccugcugggcggacugucugugugucugucucucuggcguuccaccuccaagccuauaccagcuguguacagcgccaucucucugccuucuguugccccucacucaccaaacacguguauuuauagcaaagauuggaguccugugucuccugaccuuggcugggcccaggcagggccacauucaccauugggugccucuggggugagggucugcagaggccuugcuggcugacccccaagugucugcugcagggcugaggcugcaggcgggccaucguggauagccuggggcacagagggucaccgcagucgucacgugggacccagagcuguccugggaagcugacuuagcuguccuuuuaccaagcccuucacaaggccacuggugacagccccccagggcaguggggugggugagaucaggguggggcugcccgggagcauucucagaaaaauuggggacacucacagguguaagucaggucccauccagguacuccagggcaaauacaggaagggguggcggggcugguuaccuucggccuuuuuaagcacaucaggagcuuaacacuggcccagugacugugcccugacuccacccggcauucagacuuggguucaaauucccaccaugccccgcccccuauguggacaaauugagaaagcaagugugggcaccccaccagggacugcgaggaccagggcuguccccucuccaaggugcugaacucccgccuucca

SEQ ID NO: 14231 - RNA, 6079 nt, Homo sapiens
uggaaggcgggaguucagcaccuuggagaggggacagcccugguccucgcagucccugguggggugcccacacuugcuuucucaauuuguccacauagggggcggggcauggugggaauuugaacccaagucugaaugccggguggagucagggcacagucacugggccaguguuaagcuccugaugugcuuaaaaaggccgaagguaaccagccccgccaccccuuccuguauuugcccuggaguaccuggaugggaccugacuuacaccugugaguguccccaauuuuucugagaaugcucccgggcagccccacccugaucucacccaccccacugcccuggggggcugucaccaguggccuugugaagggcuugguaaaaggacagcuaagucagcuucccaggacagcucugggucccacgugacgacugcggugacccucugugccccaggcuauccacgauggcccgccugcagccucagcccugcagcagacacuugggggucagccagcaaggccucugcagacccucaccccagaggcacccaauggugaauguggcccugccugggcccagccaaggucaggagacacaggacuccaaucuuugcuauaaauacacguguuuggugagugaggggcaacagaaggcagagagauggcgcuguacacagcugguauaggcuuggagguggaacgccagagagacagacacacagacaguccgcccagcagggcaggccgggcagcauucuggggcuuguaacacuugguuggugggcgagagccagcaggagguccggcccggggcuggaggggccgaggcaccccgcaggcuccaagguccgagguccuggguggcaucagugguggcgccugggcucagcucacaucauucagggccuggagggacaugaggccagucaggagggcgcucugggucccugggucccaccacccagccccgcaggccacccaccuugcgggcaaacucgggcagcacaaaggcggcgcggugcacgucggaguuguaguacuucagcugcaucugcgccaccugcugcugugucagcggcugcaccggcuccuggaaguucgugcucuggggaccgggccaggggcacaucagggggggcacuuuuuuuuuuuuuuuuuugagacggagucucacuguugccacgcuggagugcaguggcgucaucucagcucacugcaaccucugucucccagguucaagugauucuccugccucagccucagguacgcgccaccacgcccggcuaauuuuuuuuuuuuuuguauuuugaguagugaugggguuucuccauguuggucaggcuggucuuguacuccugaccucaagugauccgcccaccuuggucucccaaaaugcuggaauuacaggcaugagacaccgcaccuggccuggggaggguuuuuuuuuuuuuuugagucggaaucuuccucuguuacccaggcuggaauguaguggcgcaaucucggcucacugcaagcuccgccucccggguucacgccauucuccugccucagccuccccagcagcugggacuacaggcgcgcgcugccaugccuggcuaauuuuuuuguauuuuuaguagagacgggguuucaccguguuagccaagauggucucgaucuccugaccuugugaucugcccgccucagccucccaaagugcugggauuacaggugugagccaccgcgcccggcaggggcagggaucucuauuuaugcccaccuuccccccaacccccacccccagacacccccaucucaccggguucuugcugcacagcaugaagccgaucuggccgcugggguagguggggauggugcaguaggcauaggccaccacggggaacagggacuggcagaacugccgcaucuccuugaugagguccaggugcagccacuggcacucgccugggggccccuaagcaucagcauccggcagggccugcccugccccaccccgccccgccccagugcuccaggccuguggcucacccuggcagcagaggacaccaucuuccuugagggcugucuucaugagcugguaauaggacuccuugaagagacuuucggcggggccuggggaagacagagggagacacacugaacagucuggcugugaccuccagggccacugucacccacacagcuaccagguggccagagccaggaucugaacccaggucugugggggauccacaccugaaucccauucuugggggagucucauuggcaccacagcagaggaaccucuaaccuaggccuucguucaagacuagaaccugcccccacuccagugcugaccacuucagagcagaggggaggcugaagaggacacaggguccucagugucccaaugccagauccccacucuccuuggucaccagcuugugaaucugggcagucgccuggcuccugccuacuguccugagccauguuucagagggcagguaacaaaugagaagggaaaaguacagcucuaguucggggggugggaggccgcucuauccuuuacucugaaggccugggggaggcugaccuccagaccugcagcugccagaaaacccuggggcccauccacugcuuacccauggggucugaggagucagugaugaucacgucgaaggcauccugauucuguuucaugaacucaaaaccgucacccacauguagggucagcuucgagcuagaguagccaauggccaugccuggcaggaacuucuuggagacuuggaugacauccuggaggggaugggagggaccagucugggccaaggggcugggggaccuggagccagcacagccacgugggacucuccaagugccucacaggcaagccgccuuggccaaccccuucccuuuuuuuuauuauuuuuuuuugagacagggucucacuuuguggcccaggcuggagugcaguggcaucgaucauggcucacuacacccucggccuccggggcucaggugauccucccccaucagccuccugaguagcugggacaaguguguucaaucauacuuggcuacuuuuuaaauuuuugguagagauagagucucccuauguugccucgaacuccucgauccucccaccucggccuccaaaagugcuaggauuacagcugugagccaccacaccuggccccuuuugggaaccucaguuuauaauguguaaagcggggagaacucugguaccuccauuucuccuugagagcuggcuccugccggcggcuugggcuccucucucccaucccuacccccuccuuccagaccaaaucgccccaucugaguggcuuucuugucgcuuccuauuuuauuuauuuuucgagacagucuugcucugcugcccaggcuggagugcaguggcacgaucucagcucacugcacccuccugccucagccucccgaguaguugggauuacaggcgcacgccaccaagcugggccauuuuuuuuuuuuuuuuuuuauuuuuaguagagaccuugugaucugcccgccucagccucccagagugcugagauuacaggugugagccaccagcgcuuggccuguuuccuauuuuagaaggaugcaauuccaaccucuggccaggagaaccucccccucccugcacacggccaccugcuuuucacugaggucucagcucaaacgccaccuccuggaggccugcccugaccaccccccaugcauucacaggaacccugccuucuccugucccccagccccugucuugccuucaucagaccauccuuugaugucucuauuuuuguuguuuguuuuuuuugagacagauucuuccucugucacccaggcuggagugcaguggcgagaucucgguucauugcaacuuccgccucccgggcucaaguaauucuuccaccucagccucccuaguagcuggguuuacagacaugcacuaccaugcccggcuaauuuuuguauuuuuaguagaaaugggguuucaccagguuggccaggcugcucuugaacuccugaccucaggugaucugcccgccuuggcgucccaaagugcugggauuacaggugugagccaccacgucuggccaucugaugucuccuuuaacuaggacaucagcuccuagagggcagggacugaucugucgucuaccacuguccccauacccgggcaacaccuggcacguagcaugauuuuagugagcagcuacugaguguaagggguaacguacaaauaguugagcugucuuggggcccugccuggggcucagauuaaaaaucagcuuagucggcugggcgugguggcucacgccuguaaucccaguacuuugggaggacgaggcuggcggaucaccuguggucgccagguccgagaccagccugaccaacauggagaaacccugucucuacuaaaaauacaaaauuagccgggcaugguagcgcaugucuguaaucccagcuacuccggaggcugaggcagaagaacuacuugagcccaggagguggagguugcagugagccgagaucgcaccaucacacuccagccugggcaacaagagcgaaacucugucucaaaaaaaaaaaaaaaaaaaaaaucagcucaguuuuaguaagagcucgccacgcaggugcccucaccaccugccaggcccucugccaucugguuuuccuacugaacccuccccgaccagguguuuuccagauggagaaacaggcccuaccugccuugcucgggggugugcagccauuucagggcacagcuggccgcugggagaaccaggacucaaaccuggcucuacgccggcacucaccucgucgaucucacacuggaccacggacuccacggaggggugcuucaccaccucccgcaggacaccuccaucuccgcccccgaugaucagcaccugggaggagggggcagucaaggcaggggcccuggcaggacugggagcccccaggccccugaagcagacccccugaccccucggacccacgggccucaucuuuuucuacccucggaaacgcuuucgugccgguguccccuuuccuggaaguuccuuccagggcugcccuaggauuccgaggccgcgucagugucggcccccaccccuccgcgggacgccccuggccucgcuagcacuuucucugacaaccaugcaggcagcaucugggaagagcccggagcacaccuggggccgccccucguccggcacuguuccaggggacacugggguaccuuucgcggguugggguggcugcagagaggcagguuggcgaucaucuccugguaggagaacucgucucucuccgugcacuggaugacaccguccaacaccagcacguugccauaggucuuacugcgggcggagugacagucggggaccuggguucucugggguggggaaaacguaccccaagccgcccugggugaggagggucuccccaucccgccuaggggucccagggaugaggagcgauggugacacguggcgaggaacggcaggcgggccgccggguggaggccggggugggacccggggucuccucgggcucugacguguccugagggcugacacguggagcggggcgcagacuccgacucccccacccaagaggccagcccgcagucccagccccagcccagggaggcggugugagggguggcgagggggccagggcaggacgagguccagcccgcuugggucccggcguggagaggcccgugaggcgggcagcaggcggcccgggcugagccuagggggcaggcgccugcgggcagcggcgguaccugcggaagacgaggauguccugguagcgcgagcgccggugguggagcagcugcuccaccugcagugacagggccuggccgggccacaggcugcaggucucgcggaaccagcccucgcggauggcggcggggccggaggcggcggggccgucggggccgggcuccauggcgggcgggcgggcggcgcggggcgcgggcccgggacugcaggccgcgcggcgccgcagcacaacgggaccagcuccgcccgccgcccgcgccgcaaccuaacccgggcgcg

SEQ ID NO: 14232 - RNA, 563 nt, Homo sapiens
ucagcauacggcugggagccggguagggaccccgagucuccgaagcuggggaccccgaccucuugcccccuccugagccccgccccuccccagguccuccccacccggccccuccccccggugaccccucuuugaccacauuccggagcccgggcucugguguuuggcugugcccccggguccccacuucccgccugccagcaccucuggucccacuugagcuuguuggggagggugacgggacccuugggaaguccccagccuugagcugcgagggcuugagaaggagaggauagaucgaucguucccggcuguccccuccggggaggggccuguuuccauuaggguucccacucccucacggccucagccuccuggagcggcugccagccucuucaucuguggucaccuuugcgcuucucucgucaaguuggauagucagaaauaaucuagucgagcccucucagugcguugauaggaaagggacgcacugugacuaacagacgccaccaagcuuuuggcugaggacccauccucgcuucccuggguuugguuuuguuggc

SEQ ID NO: 14233 - RNA, 1053 nt, Homo sapiens
cuuuuuuuuuuuuuuuuaagaaacugauguuuauuuuccgccaaucauuuuuccguguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaaggcua

SEQ ID NO: 14234 - RNA, 2638 nt, Homo sapiens
caucgcuuuccucuuaauggugaaaggcguuaaggagagauccuucuguucucgagaccacggcgggaggaaggagaguggaaggugucuaucaggcugucuggucccccgaaugggggagguuucagaauugcauagucagagguuaaaaaauaagaacacgagaggcacuaaacugccuuggcuucggucacuccagucgccccacagacuacuacagccgcuuguucccugagcagccuccuuuggccgccacugcugcugcuacaggguugucuuaaggcgccacuuauuacccucugcuucccagguuacccagcuaggcagcgcggucuccaguucgucucgugccccgagccugcuguuucuucgugauaguggcgcgguagcugcguuccuacagcagauccugcucuccuuccuacccuuugcuccuggcgggaacuggucgacugcagaguggauaccccgagguaaggcgaccccacagccguccuggcagagcccagcacuguaagggaagccccuccccucccaaagcaggccggccacgccccgccuccacgccggagcccggguaggggggagggggaggaugggaugcgcguagcucucgcuggaagaguaaauccuccuaccccuccaccccuacucuuucccccucgccccaccaaguauuauucaucaaaacaacagggcggccaucuuugaaagggaucacgugacccccgucagggaggcggggcuucuggcgccgggacguggcagccaauaggccgcgggcgccgcgccgccgaguuccucucgccugcguccucuccccgccuccgucccaccccgucccgcgcagccgcgccggacguggggaggggcaaagggaggcuggcggcugggcggggcguugccacggcgaccgcgcuggggcugcgggcgcggcgggccugagccagguaggcuggcaaggggagggacgacucccagacucgcgucggggaagauccaccagaagguggcgcuggcccgcggcccgggggcccgccgcgccuccguuguucccaaucgccugcuuuucugugacuugggggccuagaaacaccucaucgcucccacuggacugugcgcgcccgccgccuaagcgagggaaaagaaaacggaaaacgucuccuugaccccgggagcgugaucuaccguauugagcgcucauuuucugaaacaucugccacacacucuuccaccuccuccaggaaagcccaguuggaagaaaacucgaacacaagaacucccauucauuuuauuuuaccuuggccuuuuagagauacuuccuggguuuuuuuuuuuuuaaguguguucaaaaaguauugguaaaauuugaaaguauaaauggaugagagacccaaaucacugaauuguacacagcaaaugcaaggaagacguuuggagucagugggggaaaaccauccuccggugcacaagaauacaaauauuuggccgggcgcgguggcucacgccuguaaucccagcacuuugggaggccgaggcgggcggaucacgaggucaggagaucgagaccauccuggcuaacacggugaaaccccgucucuacuaaaaaauacaaaaaaucagccagauguggcggcgggcgccuguagucccggcuacucgggaggcugaggcaggagaauggcgugaacccgggaggcggagcuugcagugagccgagaucgcgccacugcacuccagccugggcgacagagcgcgacuccaucucaaaaaauauauauauauguauguauauauauauuuauaaaauauaaaucuaaguugagcgaucaaaguaacaguaccaugaaauuccagauuuugccgcugacgaagacuauaaguggauuggauggcucacuaagccauaaagacugcauuccagaauuaagaguuacaauguauuugcuacaugcuuaaaauaggaaccugacuacuagauauguaaggaauuugugaguaaaaauauguaaggaauuugugaguaaaaauaaaucacugcuggcuuugcauauuaucugcucuccaggaaaggaauucuguguaagccagaacuugaaccccuggugacauugauguuaaaaguuuacuuuuuuuaaccucauuauugccaucuaauuuacauaccauacaauucacccaauuaagguguacagugguuuuauuauguucacaguucagucauccucacuguccaauuucagaacauuuucaucaucccaaaaagaaacccucaaagccauuaacagucacucccgggcugggcgcaguggcucacgccuguaaucccagcccuuugggaggccaaggcggguggaucaagagguccggaguuuaagaccagccuggccaagauggugaaauacaaaauacaaaaauuagaagggcgugguggcgggcaccuguaaucccagcuacuugggagucugaggcaaagaauugcuugaacccgggaggcagaaguugcaaggagccgagaucgugccacugcacuccagccugggcaacagagcgagacuccgucacaaaaaaaaaagacuccugcaggauaacuaccuucugucuuggugaauuugccuauucuggacauuucacauca

SEQ ID NO: 14235 - RNA, 2638 nt, Homo sapiens
ugaugugaaauguccagaauaggcaaauucaccaagacagaagguaguuauccugcaggagucuuuuuuuuuugugacggagucucgcucuguugcccaggcuggagugcaguggcacgaucucggcuccuugcaacuucugccucccggguucaagcaauucuuugccucagacucccaaguagcugggauuacaggugcccgccaccacgcccuucuaauuuuuguauuuuguauuucaccaucuuggccaggcuggucuuaaacuccggaccucuugauccacccgccuuggccucccaaagggcugggauuacaggcgugagccacugcgcccagcccgggagugacuguuaauggcuuugaggguuucuuuuugggaugaugaaaauguucugaaauuggacagugaggaugacugaacugugaacauaauaaaaccacuguacaccuuaauugggugaauuguaugguauguaaauuagauggcaauaaugagguuaaaaaaaguaaacuuuuaacaucaaugucaccagggguucaaguucuggcuuacacagaauuccuuuccuggagagcagauaauaugcaaagccagcagugauuuauuuuuacucacaaauuccuuacauauuuuuacucacaaauuccuuacauaucuaguagucagguuccuauuuuaagcauguagcaaauacauuguaacucuuaauucuggaaugcagucuuuauggcuuagugagccauccaauccacuuauagucuucgucagcggcaaaaucuggaauuucaugguacuguuacuuugaucgcucaacuuagauuuauauuuuauaaauauauauauacauacauauauauauauuuuuugagauggagucgcgcucugucgcccaggcuggagugcaguggcgcgaucucggcucacugcaagcuccgccucccggguucacgccauucuccugccucagccucccgaguagccgggacuacaggcgcccgccgccacaucuggcugauuuuuuguauuuuuuaguagagacgggguuucaccguguuagccaggauggucucgaucuccugaccucgugauccgcccgccucggccucccaaagugcugggauuacaggcgugagccaccgcgcccggccaaauauuuguauucuugugcaccggaggaugguuuucccccacugacuccaaacgucuuccuugcauuugcuguguacaauucagugauuugggucucucauccauuuauacuuucaaauuuuaccaauacuuuuugaacacacuuaaaaaaaaaaaaacccaggaaguaucucuaaaaggccaagguaaaauaaaaugaaugggaguucuuguguucgaguuuucuuccaacugggcuuuccuggaggagguggaagaguguguggcagauguuucagaaaaugagcgcucaauacgguagaucacgcucccggggucaaggagacguuuuccguuuucuuuucccucgcuuaggcggcgggcgcgcacaguccagugggagcgaugagguguuucuaggcccccaagucacagaaaagcaggcgauugggaacaacggaggcgcggcgggcccccgggccgcgggccagcgccaccuucugguggaucuuccccgacgcgagucugggagucgucccuccccuugccagccuaccuggcucaggcccgccgcgcccgcagccccagcgcggucgccguggcaacgccccgcccagccgccagccucccuuugccccuccccacguccggcgcggcugcgcgggacggggugggacggaggcggggagaggacgcaggcgagaggaacucggcggcgcggcgcccgcggccuauuggcugccacgucccggcgccagaagccccgccucccugacgggggucacgugaucccuuucaaagauggccgcccuguuguuuugaugaauaauacuugguggggcgagggggaaagaguagggguggagggguaggaggauuuacucuuccagcgagagcuacgcgcaucccauccucccccuccccccuacccgggcuccggcguggaggcggggcguggccggccugcuuugggaggggaggggcuucccuuacagugcugggcucugccaggacggcuguggggucgccuuaccucgggguauccacucugcagucgaccaguucccgccaggagcaaaggguaggaaggagagcaggaucugcuguaggaacgcagcuaccgcgccacuaucacgaagaaacagcaggcucggggcacgagacgaacuggagaccgcgcugccuagcuggguaaccugggaagcagaggguaauaaguggcgccuuaagacaacccuguagcagcagcaguggcggccaaaggaggcugcucagggaacaagcggcuguaguagucuguggggcgacuggagugaccgaagccaaggcaguuuagugccucucguguucuuauuuuuuaaccucugacuaugcaauucugaaaccucccccauucgggggaccagacagccugauagacaccuuccacucuccuuccucccgccguggucucgagaacagaaggaucucuccuuaacgccuuucaccauuaagaggaaagcgaug

SEQ ID NO: 14236 - RNA, 589 nt, Homo sapiens
uguggcgacaugaaacugcucacccacaaucugcugagcucgcaugugcgggggauggggucccguggcuucccccugugccuccaggccaccgagguccguaucugcccuguggaguucaacccccaauuuauguggcaucauacguggcacguaucauacgugguacauaugauaccuaagguggaguggucggcguuccuggaggcggccgauagcuugcgccugauccagaugccuaaagggccaguugagggauaugaggagaaugaagaguuucugaggaccaugcaccaccugcugcuggagguggaagugauagagggcacccugcagugcccggaaucuggacguauguuccccaucagccgcgggauccccaacaugcugcugagugaagaggaaacugagaguugauugugccaggcgccaguuuuucuuguuaugauuguguguauuuuuguugacauauaccguuuccgaauucugccguguguauccccaacccuugacccaaugacaccaaacacacaguguucuugagcucgauauuauauauuuuuuucucauuaaagguucaaaaccaaaa

SEQ ID NO: 14237 - RNA, 1230 nt, Homo sapiens
aaauucaugaauaaaaaaauaaaacaggaaaacgggaguguguuacagaguggaaagcaaggcugggcgcggugucucaugcccguaaucccagcacuuugggaggccgaggcagauggauccacuugaggucaggaguucaagaccagccuggccaacauggcgaaaccccaucucuacuaacaauacaaaaauuagccaggcacagugguaccugccuguagucccacuuacucgggaggcugaggcaggagaaucgcuugaacccaggagguggggguugcagugagccgagaucaugccacugcacuccagccugggugacagucaaaaaaagaguggaaagcaaaauaggguggucagggugaacacucugagggggugacauuggagcugacaucugaacauggagaaggauucagccauagaggaagaacauuccaggcaaaggaacagcagguaccaaagccccaaggugggagaagcucagcaucugaggaacaaaaggaggcugguggcuggagugggaagaacagggggacgacagagaugaggucggauuaacaggagcccuaucaccacggccuugggcugcgcaugccaagaagggcagauugaguccuaagagcaaaaggcaggucugccuugcaggguccaggguggggaccaggacagccuuacuugugaugccaaagaugccagaaaaagcaaguggcucucagucaugaccuuuugggggaacccuuggacugggaacagaacagcaagagcuggcaccacaugaccucaggggcuccagagaucgcuggugcaaccugaguggucaggagaggcagguucugcugcagaaacaagcaggcccaagaugcccaaggcaugaaacaacaugcuuccucuguugcucguggccaggacucaggcugauggggcagcugcuucuggaacauuauaaaauggcucucacuucugcccacauuucauuggcuaaagcaaguuagggccacacucaaacuaaaguggguggggaaauacaaucccauuaagggccuggaaggcaaagagcugggaauuucuggggaacaacauuaaugacucccacagcccccuggaggcucagacacacacgauggaguuacccagggugaguggcagagugggcuguagacccaccugggcuccuggacaagcacugucugccgugccgcccuccccuccccacacugcccagcc

SEQ ID NO: 14238 - RNA, 1687 nt, Homo sapiens
gaccuaugaggaccagcacagcagugaggaggaggaggaagaggaagaggaagaggaaagcgaggacggcgaagaagaggaugacaucaccagcgccgagucggagagcagcgaggaggaggagggggagcagggcgacccccagaacgcaacccggcagcagcagcuggagugggaugacuccacccucagcuacugacccgugcccccggccaccucgguuucugcuuucgaagacucugcugccauccguucucccagucccaaggguccacgauguacaaagucauuucggccaguaggugugcagaccccuccccgccacgaucgucgcugugcuugguguguaggacccuaggcuccccgcccacccucugccuggucgcgcucuucagucccacgaggagcugacacguccucucuggccgccauccggcucgcacaggggccucccagcgccucaggccccgcguuugugucuggagucuccccccggggagaggacacuggccccucgcacuccagaaaagccaugccagcugggcucguugacaaaggguaaaacaugcucacucccacccgguaaucauuuuuuucuuuuuuuaaaaaaaguuuuuauuuuuuccaaacuagugcauguauaaauaauggcaggaugggggguacuguguagaugauuaacugacuuuuuaauauuuuguaaauaaaucggauuccuuguguccuuugugcuaguguaacccgggacuggaauguaaagugaaguucggagcucugagcacgggcucuucccgccggguccucccuccccagaccccagagggagaggcccaccccgcccagccccgccccagccccugcucaggucugaguauggcugggagucgggggccacaggccucuagcugugcugcucaagagacuggaucaggguagcuacaaguggccgggccuugccuuugggauucuaccuguuccuaauuugguguggggugcggggucccuggccccuuuuccacacuccuccuccgacagcagcucccugggcaguggccuggucucaccgugugcagccuugugguuuaugcuuaaauguacauuuuccugcugguaaaaggagaaacugagagguguccugcagaccggcugaccacuccuuuuggagacggcaggaggccugagcgauccguacucagaacguccaggagagacgcauggcccgaagucaaagugcuggaauuuuccaaaacagccuguucucuccucucuccuccccagagcacccccugccaucagggggguugaaaucccucucccccaggagcccugcugcuuugcuuggugguagggcaggagagcaaacaaacagucauggucuaaaacccacauagcacuuugcucuuaguuacauguaaaauuuuagauuucuaaaacaggugggcaaucauuuugaauacuguucugugacccugacugcuaguucugaggacacugguggcugugcuauguguggccauccuccaugucccgucccuguagcugcucuguuuagacagcggacagacgcucacgcccaggggauguccucacgcugucgccgcgcgguuucccuucgcagauguguauacucaugauaggucagaaaguguauccgcuacaauaaaguucugguucuaacuaacuccag

SEQ ID NO: 14239 - RNA, 1595 nt, Homo sapiens
agcuuccuugaaaacagcaaaaguucagcaacccaggaccugcguuucugcacaacaaguuuuggcuauaaucagcuggauuugaguaaggucgaguucccaccacucacgugaccucuguccaugcgguuagagcuguuucccucauacucacugaccuuaccugcagggauccugcgccucaaugugcgccucagaagucuagauauacccacaaacaacaaacgugacagcuguuuuacugcucuggaagaacaaaagcaaaacauaccguguggauaagcaaugcaggaggcacagcccuuagaaagagcagcagcugccauaaguccaaaaaaacuuguggaauuuuucucagucccauuugcagaagaggcuaauggagcuucuuucagauacuucuuuaaacuuucauaaauagcaaagcagauuauaguuucggaaauuccagcauacgaggcaguuaauccucuauagaagccacgaaugccuucggucugguaaacguaacgagcacacuggaguguauucaucugcuuagagccccucacucugcauaaaagagaccaacacaggcuguuaaggagacauaucaugguggaacacagacaucacacaguaggagaacagguacgggucuuccuuaugguguuaggauacuuguuuccuggcuccuaacucucauagcccuugucuuucguuauguggggugugugaggccgcaggggcagccucugacagucccuugaucuccuuucaccugccccaaggccauccucuaauguccuuaccuuguuggucuuacuccaugagaguccccuccuaucucugggagaaggaaugcugcugacaugaagcuuccagaaaaacccaagaggacaggguucagggagcuuccagagcugaucgcauggaggcuccuggaggguggcccccggggaggguaugaaagcuccacgccccuuacucuguaccuggcccuaccugucucuucuucuguauccuugcgauguccucuauaacaaaccaguaaacauuaaguguuucccugaguucugugagccacuccagcacauuaauagaauccaaagagagggucaugggaaccccaacuugaagcuggucguucagaagcucuggaggcccagacauacaacugguguguggguaagugggugggcggggggugggcaguccuggggacugagcccccaaucuguggggcugucuccugguagacagugucggaagugaaugagaggacacccagcugguguccgcuguuugguguguguggggaaaacccccuacacauuuggucacagaagucaucuucugugucaaugacuguuguggugugacaguggaggaaaaacaugguuugaggagaguuuuucccacauaucuuuguacuguugucagcugaccuccagcccacugugaggccagaccaaguagcuggcacaccugacaggcccacagaacacuagcuacaucuguaucaagagucauagaaacauguucauaaaaacauuagcauuugaccuaauuuuagaaagagcugcagggagcaguaaggcucaucacagaggaac

SEQ ID NO: 14240 - RNA, 16857 nt, Homo sapiens
cucuccucuccuugccggcuccucugggcgucccccugccucagggaagccccucgccuugccaugcucaccccucgccuggcaucucuuccaugaccuucucuucccaguccaugcuugaaaaccggccucuggggcuaucucuauggcuuugacaccugccuucauugaggccccucuuagaguuauggucccccaggaaaggagaaccgggcugagagcauccaaccuggagacucuaaaggacgccccacagugggggcaaguggggugggggacccugacucuuagguauuugaggggucaggggguccuacagagaaacgugcuucccuccugcuugugaagcauucaggaugcacccgacgcagggucagaggugcggggugaggagagagucaccaagcagaggcccgugggugggguguuggcaaggagggacaaggccugguggcaagagccaggggcugacaguauuccaugcccaaguuccaagccugguucauucugacgacuucaccgagccuuacguuuccucaccuguaaaacggggcuaauggccccugccucgugguuggugcgugaggcuuguaugagaggcaucuauaaagcaccuggcauacggcgcgugcucaacaggcagcuguggcucuuacugccuggcugcuaccuggugaggagccagccucucccagaaagcccugggucucuggaacugcccagaggacagcccuggcauggcacuuggccgcuggaagugucuccagcuguggccaggcaaaaggcuugcggccucacuggggagacccuaugaggcaggaaccaggucugucugagccucgcacgacaaacccuugggaagcaucugggacugaacuggggcugacacgaggccauggccauugggauguccuucgcccugagggcaccaccagcuggccugccacuuuaggcugguaggaggccagggagacaggggaaugccauccuugccuccgagcacccugggggaaaucccaccucaaguccccuccacuccacccaagggcgucugcauuuggaaagcugcucccggcgaagugggcagcccagugccccaugcccagccccagggcccaccugcgaaggucggcgucaggcuguggaagcugucuggcuucugcagcucucugcgcaccugcucacuguaagacugguacuggcccacgacggcacugccccucugcaggccccgcagcgccuggaagaccugaagcuugugccgcagcacagccuccgcacugcugacauuguggggcagcuccauggccacgagggugaggaccuccgucagaugguucuggaggacgucgcgaaugacaccguacuccucauagaagcuggugcggccugguggagggagguggagaaguggggaggaucuaaagagaggccagaacaucagaucuccccgaggugcaccaaaaccccagcccgcacauucauccugcauccucuucccccaguccacagggccuauaaaaauggugcacaccaaagccaaccucaccacgagaagggagggaggaagucuugaagccaccucugucaaugagaacuacuguaagagaaggcgucaaauccgugagccucuacagaaauccacaugaagaaagcucuauucccagcaaaggccagauugccucuguagauacuggccagccccucgccccgcccugccuggccacugccaguaggaggcucggcacugugggggcuauggcaccauggcgggggcugcagcaccccagaguaugacugccacuuacuagcaugugaucuuggguaaguuacuugacuuuuguuccugcauccugcccuuggaugagacuaacaagugccaccucacuaccgggcgcacaccugugccaggcaaugugcaggggagugggagggagggaaagugggaagaagagaaaaggaaguaaacaaaauuacagagcaguugugacagaggguaaugaaaaggccccuccgagaccugaagagccagccucgcaaaaagccagggagaaagcaucucagcugcagggacccucaggugccaaagccccgaggcaggaaggaacuuggugugcugggggccagauggaggugagcaaagaguggggacagcggugaggcuggagaggagaucaggggucuugcaggauaaggcgaagaggcuggacuuuuuucuaagaucaguuguaggggggacacuggaggaucugaggcaggagaagacgagaccugaccuauauuggggaucgaccccuggucuuggggggagaaugggugcagaugcagggaaggcaaggaagaggcugcacagcugcccagcagagacgacagggccuggacuaaugggcaguacaggagcuggaggggagggagaggcaccccagagucaggauugacuggaccugcugacagauggggugggugugagcaaaauggaggcccccaacaugagcccuggaaguggggccugagcagagggaugggcaguggaggcgcucacagacacggggaggcggaagcagagggguuugguggaggguuuagguguguuuaggcugaagacccccaggcgcagauguccaguugucagguguacgggguaacugugacgauaaaagggaagaacaccuggagaacauggagcagcacgaccagcauaacaacagcaacauaacaacaccagccuaacaacacaacaccagcauaacagcagugcagcaacaccagcguaacaacaacauaacaacaccaauguaacaacagcaacauaacaacauuggcguaacauaacaacaucagaauaacagcagugcaacaccaguguaacaacaacauaacaacagcagaguaacaacggcaacauaacagcagcaacguaacaacacugguguaacaacagcaacguaacaacacuggcguaacagcaacauaacacugguguaacaacauaacaccagcauaacaacaacaaaacaacaccagcauaacaacauaacaccaccguaacaacagcaacauaacaacacugguguaacaacaaugcaacaccaguguaacaacagcaacauaacacugguguaacaacaauauaacaacacuggcguaacaacagcaacauaacagcacuggcguaacgacaacauaacagcacugguguaacgacauaacacuggcguaacaacagcaacaccagugucaacagcaauguaacaacaccagcauaacaacaacauaacaccagcuuaacaacagcaauauaacaccagcuaacagcaacguaacaacacuggcguaacaacauaacgacaccggcguaacaacagcaacguaacaacaccggaguaacaacauaacaccagcauaacagcagugcaacaacaccagcauaacaacauaacaacaguaacauaauaccaguguaacaacaacauaacagcagaguaacaacagcaacauaacaccaccagcauaacaacaacguaacaacacuggcguaacaacagcaacauaacacugguguaacaacaacauaacaccggcguaacaccagcauaacaacaacaaaacaacaccagcauaacaacauaacaccaccguaacaacagcaacauaacaacacugguguaacaacaauguaacaccaguguaacaacagcaacauaacaccgguguaacaacaauauaacaacacuggcguaacaacagcaacauaacaccgguguuaagagcaauguaacaacaccagcauaacaacaacguaacaccagcuuaauaacagcaauauaacaccauuguaacagcaacguaacaacacuggugugacaauguaacaacacuggaauaacagcaacauaauacuaguguaacaaccacauaacaccagcauaacagcaacguaacaacacuggcguaacaacaauauaacaacaccagcauaacaacauaacaacacuggcuuaacagcaacauaacacugguguaacaacaaguuguuguaacaccaccaccaguguaacaacaacacaacacuggcgcaacaaugguguaaccauacaacaccaguguaacaacaacauaacaacacugguguaacaacagcaacauaacaacaccgguguggccaggcaugguggcucacgcccauaaucccagcacuuugggaggccaaggcaggcggaucacgaggucaggagaucgagaccauccuaacauggugaaaccccgucucuacuaaaaaauacaaaaaauuagcugggcgugguggcgggcgccuguagucccagcuacuugggaggcugaggcaggagaauggcgugaacccaggaggcagagcuugcagugagcugagaucgcaccacuacacuccagccugggcgacagagcgagacucugccucaaaaacaaaaacaaacaaacaaaaaacaucaguguaacaacagcaacauaacaccaucaucguaacagcaauguaacacuggcauaacaacauaacaccgauguaacaacagcaacauaacaacaccagcguaacaacaacauaacaacaguaacacaacaccagcauaacaacaacauaacaacaccagaguaacaacagcaauguaacaacacugguguaacaacaacauaacaacaccagcauaacaauguaacaacaccgauguaacagcagcaacauaacaacaccgguguaacaacaacauaacacugguguaacaauguaacaccagcguaacaacaacaaaacaacaccggcauaacacuggcacaacaccggcauaacagcaacauaacaacgguguuaacagcaauguuacaacaccagcauaacaauauaacaccagcuuaacagcaauguaacaacacugguguaacagcaacauaacaccaguguaacaacacaacaccggcauaacaaugguguacaacaccgguguaacaacaacauaacacugguguaacaacagcauaacaacagcaacauuaacacugacauaacaacauaacaacacugggauaagaaugacaacaccaguguaacaacaacauaacacugguguaacaacaauguaacaacccuggcguaacaauaucgguauaacaacguaacaacacggguguaacaacagcaacguaacaacacugauguaacaacaccaacauaacaccaccagcguaacaacagcaacauaacaacacuggcguaacaacaccgguguaacaauagcaacguaacaacaccagcauaacaacaccaacgcugacagcagccccggcccgcgccgcuccuccccauacucacaaagacccugcacgcaggcaccgugaucacuccugcuccgcgagugaggaaggaggcaggugaccaggcgcgggggcagaagcagacacugcuuaaccacgagcuccgcuccacucccuccucugaggcugaaccccggugagcacugauuaucggugacucgaauauacaggacagucccagagaucaggguuccaacgcauaccaccucgcaggagaguuccaaugcccaagucuccucacacccucaccuacagagagagccuggccucagacacgaggagccaucauuucucaaaggcuucugcacguaggaccccuaaccugggauuuguuuguucacccagcaaacucccagucauccuuaagggcucagcuucuaggagcuuuggccuaccccuucugaggggcccuggcuucuucuagcccagcugacuguaauucaggccuguuucucuuucuuccccacuacgagggaggcuccaucugaguggcaucugcccucugcugcaucccuagccccuaacacagcacuacguucagacaguggacagcagagaaaaugaagauccacacauugucacggauaaaccuccaagacguaauguggugagaaagcaacaugauuacuuugauaaaauaaaaauuaacuugaaaauaggauauaggccaggcggacuggcucaugcugguaaucccagcacuuugggaggccaaggcaggaggaucacuugagcccagaguccaggaguucaagaccaucuugggcaacaaagugagacccuguuucuacaaaaaauuaaaaaaaaaaaauuagccaaguguggucccaacuauuugggaggcuggggugggaggauugcuugagcccaggaggucaaggcugcagugagcugugaaccugccacugcaccccaucuggacaacaccgcaugagacccugucucaaaaaaaaaaaagaaagaaaaagaaaacaggauauaaagugaccaaaauaaacagaacuucaauaaaugaaaaauauaauuggaaacuagaaauucaguagaugggccuuacagaugagaaacagcuguaaagagucagcuagcagaagacagagcugaggcgauucucccaaaugcuggacacagagacaaaaagauccaugcucggacacauacaggaugacucuuguucaaaauuaaacaacagguuguuuagggaaccaggcgugcauggaaacagaaagagaagcgagggaauaaucuauccacaauuuggaaguguaagaugaggaaauaggucagaacguggggagggacacgcaggagaaucaaauucuuuuuuaaaaacgggugguaggugcauccccguuucuuauaccauaguucuguaucucuuccaugcauucuguaaacuuuaaauuuaccuaguaucuaguuaacauuuaauuccaacagacaaaaagcagcagauccuaaguucaggccugcugagcccagcaugcuccccucccagcagccacucuggguccauggcgccaguccugggcaccugcccugaccagguugguggugugcacucucgggccaaccagacagcaagcauguccaggucauggcugggggaacaaccugcccugaauccagcccgauaugccauucccgacagcagcaccaguguuggggggcaagaaaugaagccggcagccacucguaggaaggcacucuguccccggccauaacaaccaggagcuagagggugcagcucuguccagggauacuaaaccuugaaaugagcaggaaguccagcccaacugugccaaccaaaaugccaagaguggucuccacugggaaaacaauggcugagaucccccagcucuguaguguuguggccuucaaguucuugugcuauuguugagaagacauccagaaaaagagaaacugaugccagcaauguuuguggaucaguccauuuauccucagaauaacaacauauaaggaggccccucuauuuccccuauuuuaaaauauaaggaaccugaaguucagagagguuggauaacuuacccaaggucacacacagcugguaaagagguaaaaauagcuucaaacccaggcaguucgacccagagccugcaauucuuaccaccaaaacauuucccuuuuaauuacccacucuucaacccuacaacagaacggugugaaguugaguggcgugggcaccacuggccuuuagaaacagagcacaaugaagaagccggcugagcuucuggaaggaggggucuagggcaaagcucagagauuccaaugccuaccggggccagcaaaagcgaaaaggauggaguaaggcuggugucccucagagguacaguuaaguaccucaggugcauucagguggugccucacaggagugugggcccagggugaccaaaucuuccaauucuccuuuucgggagaauguaaaaagacaauucuucccuuccccugcaauaauagaacaggaaaaucaggaauaucuugcauuugaaagggaccuaaggccuggcacaguggcuuaugcuuguaaucccagcacuuugggaggcugaggugggcagaucuccugaguccaggaguucaagaccagccuaggcaacauggcaaaaccccaucucuacaaaaaauacaaaaauuagcugggcauggugaaauacaccuguggucccagcuacuugggaggcugaggugggaggaucacuuaagccuaggaggucgaggcugcagugggcuaugauugcaccacugcacuccagccagggcgacagauaaagacccugucuccaaaaauaaaaaauaaaaaauaaauaaauaaauaagaguuauuggccucaaacaguuaaacagagucaugauccuccagcaaccccacuccuggguuuauacucaagagaaauaaaaaugcagguccacacaaaagcuuguacaugaaugcucauugcagcauuauauauaacagccaaaaaguagaggcaacccaaauguccacuaacuggugacuggauaaauuaugguauaucuauacaauaagauauuauucagcaguaaaaagaaaugaagugcugguacaugcuagaacaugggugaacucugaacucaggaugcuaacugauggaaaccacacaccguaugauccuauauguacaaaauauccagaacaggcaaccccgcagagagaaugcauuucugugguugccaggagcuggggagagggggaaauugugggaugacaacgaagggguacagggcuuccuuugccgugaugaacauguccuaaaauugauugugguacugacacacaacucugugaauacacgaaagcucacuggccuguccaccuuaacuggguaaaguguaguaggauuugugaguuacagcucaauaaaacuuuuuaaaaaagguuuuagaacagggaagcagaagcacgaaagagguacuucaggaagaugaagcugucugcgaccuccaagaugaacaggaugggacuggugguagugaaaucagugaggcagccuuugcugccaucaaaggaaguaacaaagguaggagggaacgaagucacagugaacugcaaagaaguuauuauagcagaugaauacaaacuacuuggugacuggcuggauccuugaauggugguacagagcugugaucuggaguguggucucuggagccaggcugcuccaguuuauuuuaucuuauuuuaucuuaucuuauuuuguuuuauuuuauuggagauggagucuccccauuacccaggcugcagugcaguggcgcgaucuuggcucacuguaaccuucgccuccuggguucaagcaauucuccugccucagccucccgaguagcugggauuacaggcacaaacuaccaugccuggauaauuuuuguauuuuuaguggagaugggguuucaccauuugaccaggcuggucuugaacgccugaccucaagugauccacccgucucggccucccaaagugcugggauuacagguauaagcccccgugcccagccugccccgguuuaaauaccggcucugccaucuuucagcccugugaucuccagcaacugacaucaccucacauacgaacaagcaacaauccccgcaccucccuuacagggcuucugugggccugaaggaguuaauauccacacagggcuuggaacaguggcuagcacacaggaaacacugauaaagacugguuggaauuuuucuuaugacagaugcuguaagagaagggcuaccagccuggucacucagagagcacuguucccauuugaaauaaagagguuagaaaacacaguugguauuucaugagaaaaaugcagugaugguuuucauucuaaaucugcugaaucugaagggauggugcaacaccccaugaaaugaucuaaaaggcggcuggagguauaaacuagggccuggggagacaacgcacacuggagauaaacuggauuucaucaaaccugaaaugccaucaguggcggaagcaucgcuguuuuauaaccccuaagaaagaaaaggguuuccaguuccacuaugucacccuauuaaggauaaacccaacuucagagacguccaaauaugaaaaaaaugucuuccaaucaaugaauuacaguggauuuauaugucaacagcauacuuaaagcuuuaaaaacagaugaauuuuugaugaagggaacacaacagagucccuaaaagcccuguuaucugcuuacuauucauuaauguagcgaaucccuaagcggccccuuuccuauuuuuauccucucucaauucucaaaaagaaugcauuccacggguuuacuaccugcuggguaaaagagagcuuccuuuauuccuuaauuucaagcuucagggggugcgccuguguuuaacacggccuguagauuuauggacuuugccugguuggcuccgucuuuucagaguuuaaugcagugacugggacuguggccuggcaccucccugggaagaggccaugcagcugagugcaaggacaggaggcgaggggcuggcccuccugcugauguugaucuuuucuaguuacugcccguuauuguggacugauuucuccuaaaaaugaucuauauuggcuccuaguguauuuucccggguugaaaguugaggguugaaacccaucaguauaugaaaaggauagagaaaagcacaaccaggguggacacugggaggaaagacccccuguaaacuuggcucccaccugugcacauccagagcucguccaaggucagaggaugacaaagcaggggggccauggcugugcccgccagcugugcugcucagacucauaacagagaguaacagcuagaaagcacuucuccccuuuggccccgucauucuacugccgaaguauauacuuaaagggaauauguuuuuuaaaaugcucauaaauguucucgaauuagauaguaguugcauaacuuuguaaauauacuaaaaaccacuuaauuuuauauuuuaaaagcguaaauuuugugguaugugcauuguaucucaauuuuaaaaaaagcucacaaaguaccaucuaagauagaagccggggagguggggcacuccuguagucucagcuauuugggagguuaaagcaagagaggaucacuugagaccaggcguucaagaccagccuggguaacauaacaagacuccaagauaauaauaauaaaauagcaaaaaacuagaaacaaccaaaaagcuuaauaaaagaguuuauaacacauauucugugguaugaacagaacugaacagaaauauaaauauuaaaagguauauguugugcagacugcuaauacauagagauuuaaguauguauacaacuguguauguauaugugagagagaaauaugacauaaagaauggacauaaaaguaugacagaucaauuacaggauuuauauaauaauccaauauaagucacguggaacucagacacacugcaagaacacugccgcugccucuccuugcaaacuuggaagaacaacaacacuuccauuuguaacguauuuccgugugcauuaucugauuuaauccuuagaacuacccgagagagagaggugccggggcuaucagcauuguauagaugugcgcugaaggucacagccuucagaaccgggaccagaaaccccuuccucguugcuuccacauugugggaaauccagguuuucucaacaaaaauagauuaaaaaaaaaaaaaaaagacaacuaagagccagcugcaauccccaucaacaccuucugggauuacuaaaaauaaaaagaggugagggccaaggagagcacagugugcuugcuggugcucucucuggacaggagauccggcagcugcccugggcucaccuugcagacagcucugcagagggggcgggaaggggaaccggcccugcugagugagcuccuggccccuucuggcacaccaggcuggaaggcgggacagcuggugugugccuggaaggacccuggaugcccuggucccucggugagaggcacugaacggucacuccagcccucagaggugggcaagcaucaggcuccuuucccccaugucaggacagggacccucccagcagugauguccucaggaagucucccuccuucuuucuaacaacaacaacaacaacaacaacaacaacaacaacagcaggccuucuacacagaggggaaacuagggcagcaaggagacuggcccugagugcguuccagcagggaggccaacugcugagggccuggccagcuggggaggcuguggagcucagugguuagaggcucaggcucugaggugccaagaccucaguuccaauuccagcacucccgacagaaaaggcagccggacccagacagcugaacacagcccauuaaucacaugggcccgccugucugcagagcccucccgaugccaugaugagggccagccagggucaucucugggaugaaggaggcucagugacucuccuuuuauggcccaugcugcuucgagaccccagccaggguacccaggggggcugugacucucaggggcucacggacugggacgcacaggaggagcaccccaggucaggcugagagggagcugggaaccagaucgcgucuuccuuuccuccuccccacccccuccggccugugcagcagccuugacucugcagcaaacuccucugggccagaggcugcagcaggaaaaaaaaacaacacucacccagcauggaggauggaggggagggagccggggaagccggcuuccacccacuuagaugugugugaugcgggugggggaagacauccaaacgaccuugcagcucagaagucccuuucccggggccugcagcagcucuggaccgggaaugcuccauuucccaggccuggcuugcagccccucccuucccagcacucagggugcuggcuucgguuacgcaggugccacuccugccuaggagucagcuaggguugcaccacugcagggguggagagcagcugggauccaccagaacccuuggcagggcagaggacaggguagggagugagggagaauggccugugguaugugugggguggggagugggagagaauggccuguggugugugugggguggggagugggggagaauggccugcgguguguguaggguggggagugggggagaauggccugcggugugugugggguagggagugggggagaauggccugcggugugugugggguggggagugggggagaauggccugccgugcacuuugaccccucugauuagcagucagaccgcgggcuccgaauccugccuuggaaacauucugcccaugcugagccccacugcagcagcacucgccugccaaguccaccaagcuccaguaggaggcagcauuuacuccugccuguuucccgcccucacccgggacagcaguggcagccuaggccuugcugugcugggcacagggcuccuggccaugcuggggugugcugcaggucugcggugccuguccccucuuuccagucugaaccacaggugggaggccccugaaggacuggcuccaaagcaggacucagagaggacagcacagagcagugcuugggccagcagggcuguaccaggccaccuuccuggaaugcagaaagaauguguccccuggcacgcaggcacacaaaauugagagaggcagcaagcaagcucauucuguugccaaagcacccuguguccaaggcccacuugcuggggggcugggcucagcagcaggcugucccucccugcuacgagcuaucaaggaccuguuuguaaauggcagguaaacaagccaaccagugagggccaaaccccaggacaguugcaguccugcuggccaccucugacaaggaacguggacugaacuagccccacucuggucucaccgcgacaggcugcaagccuccaggacuaguggaucucccacugccuguccugcgcugaggcucccuuugccccugggcugaagguacagggcccagcuguacuaaaggccuuggacucuggagcuuaggagcggcggacccuccccuagagccccauauggcaggcaaggcugggccuccuuuagucccugcagcugugacaacagggcuccaggugccucucccuccuggaccuugaggacagccagcccaggcuguuguguugcuguucaaacccaacauccucagacugucccggcaaacagaccugcccagagcuccaccugucugucuuucauaucuuccguguuucuuucuucaaaauccaaaaguaccuuugcuaggauaaucgggccugcaaucugccuggucccuggcuccaugggaccuacaaacaacccacaaaugacaccacauaccaagaaggaaacagggugggagggcuggaagaacuaagaggcaacaguaccaacagguaacuccagacaucauggcucuuccccagcccagggcggagauaggaaggaguugccagaaaggggagaggagucucccagccucgcuggggauggggccaaguccagguagagaagggcaagcgccggcccgcuggcuucagcaggggcaggacccccuccaauucugcucuaggcucucugcaccaggugcagcucacuucucugaagaugaagcaggcauaggcccagcacacgugccugcugggagaucaggcacagacaggcacggggggcaacccacggccagcgcccuggcugaggacugggagggaaauuuggaagggcuggaggacgauucccugagacccaugaaggcucacugcaggggguagggccucuuuucugcuguggguucugaaguagagaaacccagugccuucucgaacccagcaauguccuucaaggccuggcuugggaaguccugccuggccucccgcccaccccccacauuguccccccaccacgcugccugccugcaacacccaucacccauuuuguuuucuuuuucagagacggaggcucacuaugcuccccaggcugguguccaacuacugagcucaaaugauccucccgccucugcccccgaguagcugggacuacggguguaccacugcgcccagcuccauuuuggaguuugucccaccagccagugugaugagaucaucaccccccacagcacccgugaaucugggcaguauuagggagccauaucugagaggcugaguuuuguaccucacuguggcaccucggccccgcagagagcuucuggcacuaaauacacauucagagaggaagggagaagcagcugaagagaaaccaaggggcgggggaaagaaaaagagaaaauggcccagagaaagagcaagggagagagaaaaagaggagaaaccuccuggcccaucccuggguccagggcucugggcccugcccuguggcgggcacgcacugcgggggcugggggggcaguggccucgggugcucccgcugcagcugcagaaagcggccgcggggaugagcuggccacugacgcagcgcuggcagcacagcgcagcggcgccaggccugagugcuggggccagacuguugcccccaggaucaggcuccaccgccuucuacuguggggcugugggcucgccaccaucuucaucuguaaggaggcuaguaacagcgcccaccucaccuggcggcuggggacuggggacacaguaaacuucagcucuuaucguuacugggcaagagccagugcuuuacaucuucacggucaaugcuccaaaacuuugcuaccaucacagaaugccagcuaagggaccuuagcuguccucaccgacaggacaugcucaucucacagcugcaaggagugacaugcugaggccacccagcugaaggcagcggugggcaugacgcagggcccccgccucccggguguauacucagugugucugagguguguggcagugcgggagaggcgguguccuccuggagccuacaggcuggcagaagagacaggguggacaaggacgaggcaaggguaacacugugcagggcaggggagggagguguguggcgccgugagggugaggggagugggccugcagggcucagaaagucuuccuggagggccauggagcugagaacuaacaagcgagagaggggucagaaggugagggggacgcgagggggagugccccaggcagggggcgccacggcugcaagcaccacagucggggaagcccucacgcaguucccauggucuccacgcacucaaaaacuugggggaccucagggagacuccagccucuaccgcgugccagugguuucccgccucugugccaggccuacuucucuggaccauacgcuccucaugggcagcaauggcuacuugggcuuugcagccggcacccugggguuuagcccgguucagagcuaggcacacggcaggcucgaagggagaccacacacccacagaaaaccucccucugagaagcgccccaugccucaccgcagacagcgggcaggcagaggcugggggaccgagugcgcagggccacucacacaccuucagcauccacggucucuuucaugaugaucuccacccgcuccacauggugccgguuccagaggccguccaaagccuugcgguucuggucucggaaaggcaggaucugcgccacagccugucggggggggaagacugggcgugcugcaggauacucucacgaugaaggaggaacccugacucccgggaagggcucugaccuuucuauucccugcucagagcagaagaugcccucugagcaguaguucuggacuucacgaucucacaggccaguaaagguuccaaaaacuugcaagugaccuccaaaggguuaccagauuuguauuuugccaagaaaaaaaguuagaauuaccuaucuucuauuacaaucaauuuuuaauaaaauaaagauagguuuaacaccaaaaauguagcaaagaaaagcucugaauugagcacauucuguauuucuucucaucuugccauaaacaagugaaaaccuccccaggacugg

SEQ ID NO: 14241 - RNA, 679 nt, Homo sapiens
uauauuuuaaaaaucccccacaaaagaugcuauucucuaauuuccccaucuucuuuuucuuucuuuuuuuuuaagacagagucuuccucugucacccaggcuggagugcaguagugugaucuccacugcaaacucugccuccuggguucaagcgauucuccugccuuagccucuugaguagcuggaauuacaggcaugugccaccacacccggcuaauuuuuguauuuuuguagagaugggguuucaccuuguuggccaagcuggucuugaacuccugaccucaagugauucacccgccucagccucccaaucauuucuccaucuucuuccucuucuuccacaccucugauauaaaggacauuauuacaccuuauuaaaacuucacccagauguccagacaaugcuccaucuauguauucuucuguauuugcaagcugcauguucauguagccaucuacagauaccagguagcccuaguacuccauuccccgcuuaaguuucaccauccuuggcuuuccuguuacuccacugaggaaagaucugggauugagacauaaacucaucaucguaaccacaggcaaaugcuaugggcaaaugcugcaggccgcugaccaggcugaccaggcuacugacuacagcagcuaccacagguccugagccacugagcaucaggagaaa

SEQ ID NO: 14242 - RNA, 3443 nt, Homo sapiens
uguaacacaaagcaacaaucuccuugccauaaauauuuauuuauauuuggaucucaccuggcuauggggguacacaaacagaaaaggacuuguuuuauguuuccaaggagcagcaccuaguuggguugguugggcaugaacacaccagagaaacaagugccaacaucucaagacgcucaguucgugcgucugagagugggcaggcuaugagcuggggagcauaaacagcagagcugcccagcgcuggcagcaguggccaagucagugacuugccuucuauauuuccuuccuccuuuacccuuggcauccugcuauucuaauaucuauacacugggagugauagaaaaacuaauggacacagaaauaauucaugagaccuugaauuucagcacuggaaaugccgaauuucagcucaacaacuagaagacucuuaagaaacagacugucuccaugaacuugcauuuagaggcuuauagggccuguugauuuauaagucaauaguguuaauuguuaaagucuuaaaaacuucggggucuucauuugaagagcgaugaauuuauagagggaaaggagacagccgcaacagaagucucuuucacgugugaccccuuccaaucauugacuacugugaguggucgucuuuguuucgauuuucagggcuacucuacauuucugguaaaccacaagcuaaaggcuggucucugagaagcagauguuuugcugguuuugaggccuuguggcuuuccauagagaaguaacaguacaggccacaugaagcuuuuacuuccuuuuuuuuuuuuuuuuuuuuuuaaaguggggccaagggugcuuuugcucuugauagcauuauauugacauacauugacagcugugguaggucuguguucaccaccagaugucaaauuccuauuucuggaaguaauuaguuugagauaccugugaaacguucaaguugaguguucccaguggacuuggaccauagauuuagucuuagaaauaccagugacaaucucgaaagauauuuagagccaagggaacaguggagaucauauggggagaggauauauauagcagaaagcccuaggacaaagcuuuggggagacuccagcauuuagagguugaguagagaauuaggccaagugguaugagcaaaacuaggagaguuuggcaucauggagcaagaggucagcucuguuaggagaguucaaaauggaccuucuggcuuucaacaguccauuuccacugugaccacccuagcccaggcccucagcaucucaugguugguuucacuuguccgggugcggugacucacaccuguaaucucaacacuuugggaggucaaagcgggaggauugcuugaggccaggaguuugagaccagccugggcaauauagugagaccucaucguuaauaaauaaauaauuuuuaaaggagacaaaaaauguggugagcaucaacugccuaguguuauauggaggcacuagguguaagauguaauuauuuuaagaguuuauggacuuuuuggguaagcaggccuuauacaaauaaauaaacuaaugagagaguaacuggacaucugguuucauuugggaguaggagagauuuugaggugaacguggagaugccuuacccagauucuggaguugagacagaggucccccagugugggccaguuggcauuacuggacaucuggcuggaaaggugggcagggccaggauccuggagggccuugaauucagggcuaaggaguguaaacacuguccugcagagaccaccaugcuguucuuagguaggggcuaagggccagauaaagugggacucaggaugaaaucuauaguugggaaaaauuccuuggcagaggcuuuuaaauggcuggaugggggagaugguuaauagccuaguuauuaggaaagagagauaaaggucuggccugggacugccacuagcaugagcaggaaaggagggcguugaaagacacuuuuuuuuuuuuuuuuuuugagacagagucucugucgcccaggcuggagugcaguggcgcaauuucggcucacugcaagcugcgccucccggguugacgccauucuccugccucagccuccccaguagcugggacuacaggcgcccaccaccaugcccagcuaauuuuuuguauuuuuaguagagacgggguuucacuguguuagccaggauggucucgaucuccuggccuuguggucugcccgccucagccucccaaagugcuaggauuacaggcaugagccaccgcgcccggcugaaagacacuucuuaggaagaauacugaggacuuuaugauuugacauuggacccgagaagaggaaaguacagacucauagaaaaugguaacagaaaauaguuaccacuguagacgccugccugcauuuuacagaguguggcucugaggauuugagggggcuuaaguuugaauucuggcuuugucucugaggaguugaucuaguuaccuaucugugccucagcuuccuugucuguaaaauggggauaauaauuguacuucuucuuagguuguaaagauuucgaauuaauauauaugaggcuccuggcauauaguagguacuuaguaacuauugguugaauggaugauguucaaaggauugcaucacaauaaauggaagaaacaggaucugaauuuguuuguccaacucugccaccuuacccugauguuccagagucagccuuucucacaugcugccuuuauuguguaggccucuuuuacuggaccuguuagaugucacuugguaucaagcccacguuccgauugcaugguccuggcguuccacagccuggcucacuccagauugcccgccccaagucuguguagacuguccccuguaacccaccucccauucuccaccucugaccuucacggagggcccggucaccaagccaccucccaccccugcaauaguugcccaccccuugugaucucgcugaugucacugccuuggcgaaggcauucugaacuacuacagaccacugcagucuagccuucuugggucccuugcugcacugaugagcugcaccucacuucuuuaugcuuggccagaugacaucucagaauguucuguaaugacuucacacauacuuaucuuacgugcaaaaaugaaucacaguucaguaaagguccauggcaaccuuuauuaucuuccuagaccccucucagcuaggugcucaguaaauaccugaauacuugaagaauggauuaagcggcaggaauucugauuacugagguggagugugccaguaguugagguccucaucucauaccugaacugugucagcagccucuuuaacuggucugucccuaaucuacacuuaggccacacugccacuggcacaguccucauccagucuuuucauggaaagcuccagcuucagccuuucugccagccuacaauuaggaacu

SEQ ID NO: 14243 - RNA, 2723 nt, Homo sapiens
aucacuggauuguaacauuucuuuuacuguggucuugaauuaaccuucaaaucuuauaccauggguguccaaucuuuuggcuucccugggccacacuggaagaagaauaauugucuuaggccacacauaaaauacacuaauacuaaucauaacugacgaacuaaaaaaaaaaaaaaaucacacaaaaaaaucucauaacguuuuaagaaaguuuacauacuuguguugggcugcacucaaagcuguccugugccacaugcagccugugggccauggguuggagaagcuugccuuacaccauuuaauuuugacaaaauuaggucuugucuucugaacuauaccacaguuccuucaaagaaggaaugcaucuucuagcuuuuugugccuucugaaauguucagcguauguguuaggcacgccauaaacgucuacugauuuauagugaaaaaccaagucagagcagcuauuaaaaauucuaugaagucucuacaguggcaguguaugcuuccggaacagacuuacaugguauccaaacuugcggucucauaccugaugacacugucgauacaguugaucuguugauaggaugggcugugcucaucguuccucaaauccucacagggcucaguguacacacuauuguuuuucaguguuugguggaaggaaguaaaggucuuacauucaccugaaacagaauaaagggaugugcaauuaaaaguacccagcauguaauuaagaacauauacuuucuuaccaaaauuaaaucauggcacuuuaucauguauauaucaacagaauaucaugcggcuauuaaaaaugagugcagaucuaaaaugcacuaauagaaagauauccacaacacguaaugaauaaaauaaggugcagagcacauuacacauagaauggcuacgauuguauuuagaaaaauaaggaaugaaacaaaaauuuccaacaaagauuaucaaggaaugaaaccauagguuuaagguugauggggagcuuuccaauguuaagcugacgcuuccuguacaacugaucaacccuggcaaucacuaaggguggaaugugggaagaccugugcaucuuacgugaugcugugugaaguacacagcaucucccagguggagccuguguccaacagaacuuucugugaugacugauggauuauuugugcugacuaguauuauaugugcuaacguaacuauuaaacacuuggaauauggcuaaagcaacugagaaacuaaauguuaauuguauuacauuuaauuguauugaauuugaauuuaaauugccacauguggcaaguggccaccauuguagauguaguaguuuagagagaagaaaaaaccuccaggcuuaagcacuaaaaacuuccuauaaaggacaaugagccaauaaaggagacugaaaaaggguagcuggaaagauaacagaaaauccugcaagguuuggccucacagcgaccaagaaugaaaacuuucuuaaggaaggaguaacuaauuaugucauguacuacugagaaguuuuguagaaguguuagaugcuggucauuuuuagcuggcuuggaagaggcuucucuauuuucagagcauauuauggaaaaaugacuguauuaccuuucacucauuaaugauuuuuaacuuuuaauuuugaaauaauuuuagacuugaagaguugcaaaaauaguacaauagaguuccuauaugcccaucacccagcuuccacuaauguuaccauggucuacaaccauaauaaaaugaccccaacuaggaaaugaacagugguaccauucuacuaacuggaaaacagaccuucuuuggauuuuaucaguuuaccacucaauguuguuuuccguucagggucagaacuuuagugggauggccuucgauuugaguuucucugaugucuucucaugauuagauugagguuaugcauuuggggagagaaugcggcggaggugcaguguccuuccuugugcaucaucccaggguacaugaugucaguauguuuuguuaccuuguucauugguuaacauggugucucucagguuuguuuguccuguguaaaguuacuauuuuacaauguaauaaauaauauguuuuggaggaauacuuugagaucacgcaaguauucuguuucuuuuaaacuucucaaaguuuaaguucuccauuaaccuuucaccucuauuucauuccuugauaaucuuugccugaaccaucuguuuuauucuuuauuugguauaauauacuaacccgugucuauccaucccucuguauauuaaacaaaaggggcaugaguccacacugaaacuguucgcgccaauccagcaccauggaguuccuucccuucugcuuuguguggcuuuccugauagugaggagucuggucaucguuaucuauagcggcuuccacaauuuguucaacccuaguauaaagucgcuuuagaauugcuaacccauacucuggugggaaacgaauacaccaacuugcguacaguguuugugcacauucauaauuuuguauuuagcccuaggagauacaguugaagcacuguuuuccaaagcuacugagcuccguucuuccccaccccuuccguguguuuaggccugucaucuguaaugcaguuggacucaguugucaaugccugcaucucaucuuggguucucucugcauuuuggggugagauggagugcacaaaucuguggguuuuggcaaaugcacgga

SEQ ID NO: 14244 - RNA, 2723 nt, Homo sapiens
uccgugcauuugccaaaacccacagauuugugcacuccaucucaccccaaaaugcagagagaacccaagaugagaugcaggcauugacaacugaguccaacugcauuacagaugacaggccuaaacacacggaagggguggggaagaacggagcucaguagcuuuggaaaacagugcuucaacuguaucuccuagggcuaaauacaaaauuaugaaugugcacaaacacuguacgcaaguugguguauucguuucccaccagaguauggguuagcaauucuaaagcgacuuuauacuaggguugaacaaauuguggaagccgcuauagauaacgaugaccagacuccucacuaucaggaaagccacacaaagcagaagggaaggaacuccauggugcuggauuggcgcgaacaguuucaguguggacucaugccccuuuuguuuaauauacagagggauggauagacacggguuaguauauuauaccaaauaaagaauaaaacagaugguucaggcaaagauuaucaaggaaugaaauagaggugaaagguuaauggagaacuuaaacuuugagaaguuuaaaagaaacagaauacuugcgugaucucaaaguauuccuccaaaacauauuauuuauuacauuguaaaauaguaacuuuacacaggacaaacaaaccugagagacaccauguuaaccaaugaacaagguaacaaaacauacugacaucauguacccugggaugaugcacaaggaaggacacugcaccuccgccgcauucucuccccaaaugcauaaccucaaucuaaucaugagaagacaucagagaaacucaaaucgaaggccaucccacuaaaguucugacccugaacggaaaacaacauugagugguaaacugauaaaauccaaagaaggucuguuuuccaguuaguagaaugguaccacuguucauuuccuaguuggggucauuuuauuaugguuguagaccaugguaacauuaguggaagcugggugaugggcauauaggaacucuauuguacuauuuuugcaacucuucaagucuaaaauuauuucaaaauuaaaaguuaaaaaucauuaaugagugaaagguaauacagucauuuuuccauaauaugcucugaaaauagagaagccucuuccaagccagcuaaaaaugaccagcaucuaacacuucuacaaaacuucucaguaguacaugacauaauuaguuacuccuuccuuaagaaaguuuucauucuuggucgcugugaggccaaaccuugcaggauuuucuguuaucuuuccagcuacccuuuuucagucuccuuuauuggcucauuguccuuuauaggaaguuuuuagugcuuaagccuggagguuuuuucuucucucuaaacuacuacaucuacaaugguggccacuugccacauguggcaauuuaaauucaaauucaauacaauuaaauguaauacaauuaacauuuaguuucucaguugcuuuagccauauuccaaguguuuaauaguuacguuagcacauauaauacuagucagcacaaauaauccaucagucaucacagaaaguucuguuggacacaggcuccaccugggagaugcuguguacuucacacagcaucacguaagaugcacaggucuucccacauuccacccuuagugauugccaggguugaucaguuguacaggaagcgucagcuuaacauuggaaagcuccccaucaaccuuaaaccuaugguuucauuccuugauaaucuuuguuggaaauuuuuguuucauuccuuauuuuucuaaauacaaucguagccauucuauguguaaugugcucugcaccuuauuuuauucauuacguguuguggauaucuuucuauuagugcauuuuagaucugcacucauuuuuaauagccgcaugauauucuguugauauauacaugauaaagugccaugauuuaauuuugguaagaaaguauauguucuuaauuacaugcuggguacuuuuaauugcacaucccuuuauucuguuucaggugaauguaagaccuuuacuuccuuccaccaaacacugaaaaacaauaguguguacacugagcccugugaggauuugaggaacgaugagcacagcccauccuaucaacagaucaacuguaucgacagugucaucagguaugagaccgcaaguuuggauaccauguaagucuguuccggaagcauacacugccacuguagagacuucauagaauuuuuaauagcugcucugacuugguuuuucacuauaaaucaguagacguuuauggcgugccuaacacauacgcugaacauuucagaaggcacaaaaagcuagaagaugcauuccuucuuugaaggaacugugguauaguucagaagacaagaccuaauuuugucaaaauuaaaugguguaaggcaagcuucuccaacccauggcccacaggcugcauguggcacaggacagcuuugagugcagcccaacacaaguauguaaacuuucuuaaaacguuaugagauuuuuuugugugauuuuuuuuuuuuuuuaguucgucaguuaugauuaguauuaguguauuuuauguguggccuaagacaauuauucuucuuccaguguggcccagggaagccaaaagauuggacacccaugguauaagauuugaagguuaauucaagaccacaguaaaagaaauguuacaauccagugau

SEQ ID NO: 14245 - RNA, 10159 nt, Homo sapiens
aucauguuuauaaacacuuuauuuaggugauuacaguggguaaguucccagcuaagugcacagauagaagcgagguauuucuggguuaaugcaggagccaguggguuacaugggucugggcacuguggccaaggggcgaguaccaagguuucugagucagacccggccagagacccugcgcugaagguggacuaauguccuaacacugccagcugcuuucuccucacagcuggccacaccgcaaggcaucucuucaacaguaaaucauuucagcgauguuaagggaacagacguuaaagaaauggaagcuguguccuggugcgccucagcuguugcugcuuuauaagucauaauagcaugugaacaagaguuuuagaauauuccaguaacaaugagccacagagcgauaaagucugugucuuucucccucagugccuccuugccuguuuucuuucauaccugaauucccaucuuuaagcuguggauccugauguugagucucaugcauacaagaaaaguuuuuccgaugacaaaguuucugcuuccagcauucccaucaacagcauucucugcaguugaugauaucaaagcaaaggucucugguuggcuacucucugugaaaagagccauucaccccugaccaaugccuaauugcaggcauaauuuagaaaacugauuuaggaagcagaaugugaauacaaauaggaaacaaacuccaaaguuauaguuuaucuucauauuugggccagauaaugaucaaguucacagguggucuuacuugaggcuacagaauuguugcuugcauaauuaucagaaacaugcuggaguccacagcugauaaucugccaacugcuggguagaacucuuuuaugagacggucagagucuaccucaaaccuucucuaacccccaugcaaaauacugaaucagaaggggagccacacugucuacagccuuucaaaaggaagaaaggccuaugaagauguagaagguucacacacaagguaaugauuuuaauucugaaggggcaccuugaguuccauuuggcacguuucugaauuuaacugucaggaauacacuuaaggccauuuuaucgguauuuaacuuuuuggcaaaauagaagcuuuggucauagccauaguucuuuaaaaauuuuuuuaaagagguuaucucugauuaaaacaauauuuuuagcaagugauacauaacaauaacaacaauguaaacaucuucaaaucuaaugcaagagcaaaagcucuucaccagcaucuuaaauacagcgagagucaguagugcuuacaaaaaguagaggguucucuucuagggaaucagaaaauuaucaaaauaaggcacagccuguuguuaucacagauuuguguuaggcaguaguguuuuuuucuggaaggcauaaguuggaaaucugauuacccaaagguuuaaaaugugguucugaaaauaaugccaaaugacaaggguaacuaacugggaguaauggcaauuaauuagugacaacauuacaucuagauuauagcacucuggaacuuaagaaggccucuucaucagcccauacguaaaucuguaaaggcacugugcaaaauguggacggggccggccuucuaauuuggagugcauauuaaaaaacaaaggcacguuuccuagaaauucaacuuuacauuaacacaaaaaaaauuuuagagauaacaguagguaagcuugauaauauagcagguucuaagucaaaagucuugaagagguuucuugaacagcaguuuugaguuccgcugguucuucaugaagagacaacccacacuaagaaggaggagagaugcaaaaaggcaggggaaacagcagguuagucucucagugugaaucccaagccaacauccaaugcugcagucuaaaugugaucagaaauuagacugggcugauuuccuacuacuggcuucucuccauucuauagagggcuagaggaaggagacuagagucaaaaggauccaaguaacuguaccuuccugcuaaaaggaaacauccacuaacauccaucuaucaaugaaagaagucauguuucgguucucauauacugggcuaccgauggcagugaguuguuugaauauuauauaauaauaguuguguguguguuuguguauacauauauauuauuuauauagcuauuauuuuuauuauuauaugccaggcaccaaccuaagcaauuuuuauuuauuuuauuuauuuauuuuuuugagacggagacuugcucugucaccuaggcuggagugcaguggcaugaucuuggcucacugcaagcuccgccucccggguucaugccauucuccugccucagccuccccaguagcugggacuacaggcgcccgcgaccacacccggcuaauuuuuuguauuuuuaguagagacgggguuucaccguguuagccaggauggucuugaucuccugaccucgugaucugcccgccucagccucccaaagugcugggauuacaggcgugcgccaccaagcccggccaauuuuuauauauuuaccagaucuguccuuuaacaaacaaacaaacaaacaagacagggacuauuauuauccccauuuuacaaaugaggaaacagaaacccagagauauuaaauugcuuguccacggccauacagcuggauggugguggagccaggauggaucacaggcacuccaugcuuuuaaccacuacauuacauaaaaggaaauaugugaaaaaaauauauucagagaaaagaaguggaaaugaauagauuuucucuaacuucaaaggauuaauguuuguaucaaaucucagacuuauacaaaacucaaguacuuaaaacauuuauuaaagaaaacugaaaaccuuggaauaaaugaaccuuucuuuuuuuuuuuugagaaaaggucucacucugucacccagacuagagggcaguggcaugaucauggcucacugcagccuugaauuccugggcucaagcaauccuccugucucagccuccugaguagcugggacuuacaggugugcacuaccaugccugguuaauuauuaacaauuguuuguagagacgcuauguugcccaggcuggucucaaacuccuggccucccaaagcuuugggauuacaggcaugagucaccgcaccuagccaaaacuaacauuucggagggaaauuuuaaucugaguucuuguacacaaaaucaauggucugugaacacauggagaagacuuuuccaaucaguuuagaaaaggguaacucaccgaugaugaugaugaugaagauaaccagaacaguaaucccgauugcccacaucuguaacaaaacauauguccauaucacauuucaaaugcagacauaaugugcuuguugaagaguauuauauaauauucaucuagucacugaaagggaaauucaggugcauacagucuggaguaauuaauaauuucuaaagccuaaauuaaauguucucaauuagggccugaagguaacuuaucugcuuuuaaaagauguucaaaugauguguggccucuagcuaggcauuuguuuguguauacaaguuuuccacauauggaaaggcugcucagcuugcccugugucucaaagugucacuuguaaacaaggcagaggacaggauacaucuggaucugauugcagcacgcuaacuguauaaaaucugcuuuggcucgugcuccugggagagcugcuuucuacucuucuguugggcacacuguggcuuucuagcauuucuuucccuugaccuuggaaccauucacagaacuacgagaaaacugaccaauuccagcccucuccuaucuguuuggggcccugcugggguagaggguugggaggggcugaugacugugagugauuuuggauauuccuguucuaccugcaucuucugaagaucagccacagcacauagaggauuccuaguguggggcuaggaaaggguaugcagucaguguuucggauucacaguggacccacauuuccauguggaggaagucaaacccaccucccagagucgugaaaguccauuaucuguagccuguuaauucucugagaauggagaagggggguuaaauguaaaggucaguuaaaagauaauuaccuugcaauucuuccaccaauauuuccucuucaacuuggcugcgcucguuucaaauugagaagcgccugccugcagugcgucugcacggucgucuaacucagagagcuucuggucucuuuccagaaccuuguccacguuaacucgcauuauguccaccaccuagaugagugugaucacagcaaguaaugcacaaagaauggaggaacagggccaggugcgguggcucacgccuguaauccuagcacuuugggaggccgagguggguggaucaccuguggucaggaguucgagaccaaccuggccaacauggggaaacccugucucaguacuaaaaacauaagaaaaucagccgggaggggugcugggcgcuuguaaucccaacuacucaggaggcugaggcaggagacucgcuugaacccaggaggaggagguugcaaugaggugagacugcgucauugcacuucaaccugggugacagagugagacuccgucucaaaaaaaauggaggcacagagacuucaaagacaaucuacaggcacauuguucuuucaggucagcacuuuauuacuuugagccaaacuuucacuuuagaaaaaaugggcucacucuuucaugaucaaaacaaucagcauauuaaggauagaagggaauuuccuuaauaugauaaagggcauuuaugggaaaauccacaacuaauaucaugcuccauggugaaagacuuccccccuaagaucaggaacgaggcaaggaugcucacuuucacacugccacucaauacuguacuggaaguucugaacagagcaauuagucaagagaaagaaaaggcauccaaauuggaaaagaagaauaaaccuaucuguauuugcagaugauucucucuauauaaaaaauaccaaagaauccacaacaaacugcuagagcuaacaaauucagcaaaguugcaggguacaacaacaacacauagaaaucaguuguguuucuauacaccagcaacaaauaaucugaaaaggaaauuaaggaaacaauuguguuuacaauagcaucuaacagaauaaaauaccuaggaauaaauuuaaccaaaaggugaacgacuuggacaaugaaacuagaaaacauugcuaagagaaauuguuaagagacaucauuaaaugggaaaacauccuauguucacacacuggaagacuuaauauugcuaagagggcaguacuccccaaagucacuucccaauuucaaaacuuacuacaaagcuacaguaaucaaaacagugugauacuggcauaaggacaaacauauagacugauggaauagaacugagagucuagaagucaaccuaagcaucuauggccaauugauuuuugacaagagugcgaaggccauccaacagucuuuucaauaaacagugcugggccaauugaagagccaacaugcaaaagaaugaaguugaauccccaccucacccuauauacaaaaaguaacucaaaauggaucaauaaucuaaguguaagagcuaaagccauaaaacucuuagaagaaaacauaaggguaaaucuucauuacuuuggauuugacuguggauucuuauauaccaaaaucaagaacaacaaaaggaaaaacagauacauuggacuucauaaaaauuaaaaacuuuugugcaucaaagaacauuaucaggccaggugcgguggcucaugccuauauucccagcacuuugggaggcccaggcagguggaucaccugagaucaggaguuugagaccagccugaccaaaauggugaaccacugucucuacuaaaaauacaaaaaauuagccgggcaagguggcgggcgccuguaaucccagcuacucugggggcugaggcaggagaaucacuugaaccuggggcuuggaggcugcagugagcugagauugcaccacugcacuccagccucggcaacagagcaaaacuccgucucaaaaaaaauaaauaaaaauaaaaaaaauaaaaaaaauguaaaagacaagccacagaaugggagaaaguauuugcaaaucacaugucugauaaagaaagauuuaauauccagaauacauaaaaaacucucacaacucaaacaacccaauuaaaaaaugggcaaagccugaacagacauuucuucaaagacauacaaauggccaauaagcacaugaaaagaugcuuaacaucacuaaucauuagagaaacgcaaaugaaaacccaaagagcucaguaggaugguuauaaucaaaauggaaaacaaguguuggcaaggauguggagaaacaggaacucuuggacauugcuggugggaaaauaaaauggugcagcuauuguggaaaacaauuuggcaguuccucguaaaauuaaacauacagcuacuaugaccuagcaaugcuacuccuagguauacauucaagagaaaugaaagccuaugucuaaacaaaaucuuuccugugaauauuuauaacagcauuauucauaauugcugaaagguggaaacaacucgaagacucauuaacaaauggauggcucaacaaauuguguauacacauacaauggaauauuacucaaccguaaaaaggaacacgguacaacacguuacaacuugaaugaaugcaaaaaacuuugugcuaagugaaagaaggcagaugcaaaaggccacacauuguaugauuccuuuuauaugacauacccagaacaggcaaauccacagaaagagagagcugauuagagguaaccagagaaugggaggaaggggaaauagugaaugauuacuaaaugggcaugagguguucuggggugaugaaaaaguucugaaaauggaaagagguaaugguugcaaaauauuaucaauauacuaaauaacacucaauuauauacaguuuaaaauguuuaguuguauguuaugguaauuuugccucaauaaaaaaacaacucuccuuaaaauuccuuuggcuaaaaaaaaaaauccaauuugauuuuguaaguaaacagaauuuccaggcaggacagaauuacaauggguuucuuacugugaaaaucuaaaauuguauaaguucaugaacaaaaccaucagaucaaaacauuacuauauuauuuaacaacaguaucugacauaacuuuaacuguuuuuucagggcagcuaaaugcagaaagaccgaaauauauuugucggacagugacggcuuuuaggaauguggaaacacuagucugaauuucucaaucuucugcugugguucuccacauacggcgcagaacaaaagauggagguccucuagcucaagaauucuacaaacagagauuugcugagcuaauggaguuugacaguaucuacuuugugugugucaauggacaaccauuagagaugaauucuacagagaggcuugcucaggcuggacaauuaguaagaagacaaagcauuuugauaaaaaaaucugaucagaagaacuggucuuggcuugagcaaucuaaagaccuaauccuuaacauuguauuauccgauuuuauaaagugcuucuuggggaaugcacucagggagugauguucauguuuuaggcauaugauuuuuuauuucuccugagcuaaauguuaugagcagguuucuaucacaggaaaacaagcgugaaaccuagaaagucugacuuuugcuuagauuagaucuuccagcacagcagggagcaaaguuucguuacaauuaugauacagucagaauuugcuuuacauucacacuuugaugauacuuuuucuaaacagauuuccagaguacucauauuuguuuaaaauucauauuuccaacauuucagagcaauaccucaucuacuugauuuugugucugcugaagucuucgauuacugccaguggcagcaguuggaccuguagaccuggaacauguaaaggcaugagcaugaguacauuacgauuccaaauacauuuucuuaaguauaaagauguuacuccgggacucucacuguuaacaaucucuuacauuagaacuaaaacagaaaaagaaauucuuccugaagcaaugaacgaaaguuuuaauugcauuucuucuaauuucucuauaauuuccaagacugucccaccuacuaaagggacaaauguuaagcuuuaauaggaccuacuuuguaucccugaaguaucugaucccacgauagguaagcucuacuguccuuuuuugaaacuuguucuaaggcacacaucugcuugaauguacucaguacuuuccugaucuuuucauuguggaaggaacuguuuucauaguuacaaacaguuacagaaugcccuuuuuccaauauggaaaaauagauuaauuuacagaaacagagucaggaacacugggaugcagggaguggguggugugaguggaaagguguguugaagaaaugccuccucuuuuaggaagguacucuuucuuuuucccccucuuuugagagacggaguuucgcuccuguugcccgggcuggagugcaauggcgcgaucucggcucacuguaaccuccgcuuccuggguccaagcaauucucuugccucagucucccaagcagcugggauuacaggcaugugccaccacgcccggcuaauuuuguauuuuuuaguagagacgggguuucaccauguuggucaagcuggucucgaacuccugaccucaagugauccguccaccucggccucccaaagugcugggauuacaggcaugagccaccgcgcccggcccaggaagguacucaucuuuuaaaaucuucaucaaaggcuuuauuucuccccaugcagaucuuucuuaaccacucugacucugaagucauuauuggcuccauuacuuggaaaguaucacuuugguuuuucagguauaaagucccgccuccucgaauagaucacagguuccugggucuucuuacucucuucucuguauccuagauagcaccuagcaugugccuugguauacaacagucugaugggcuguuugaacagucacuuuacaucugucaugugucaaugaccagggcuacaacagaucucaucaccguccucacggaguuuaguaucugguagauaaguaaggaccaugccguggcgcuagacucuuuccaugcuuuuccuccuuuaacccucauaacucucugaggggaauauuacuccuauuuuacaaaugaguaaagugagguuuagagagucaacacagcuggcugcaggacagcuuguuuuuagaucagguccuguguaccuuggcucuagaucuuaaccacugugaucuauuggcacagcagccucagcaggaacauucgagggggguccccagcuccuggaagaaacccggggcuuccuccgacggugagcaaugagcagaauggagguggaagagggaguccuugugauucuuaaccauuagcauucucugagucuuaccacuggaagcagggguuugcaacgugcuuucgcuuaagagagcgaaggcccacgguuaagugaucuuuccagugcagaugccccuagcuaggcaaggagcucuucggcccacaggggcucaggacagggccgagguccuuucuuucgcaacuucuggggcccagcgcagcaccgggccgagagcgggcgcucccgaaccagggcugucguccccauuccucucagggacgucggggacuagaaagggaaggggcgaggagcgggcugcgggcgggcagcucacuuccuccgggaagcgucucgccgccccgcccuugccccuuccgcguccgcccgauggccgcgggacccgcccggcccgucugcagcccgcgacccaagggccaccgcccacccccaggccucgggauccccgcgcagccccggccugcguccgaguggcggccggcggcaacugggcaguauggcggucccagcgcgagcugccgccugcggggcccgaagccgcccgcgucgcguagcgucacucacauuuuggcagcugcggcggcggcagcggcgacgagagagggucagcagagaagcgaaguugggaccggaggccagggagaugggugggacggcgcggcgcggggcaaagac

SEQ ID NO: 14246 - RNA, 5335 nt, Homo sapiens
ucucaaagagcaaguaagagcaacacuacucuuuugaaaaggaaaagcugacccaaucugaccuugaguagagguugcucuguguaugucaacacuuugaauccacucaaugaugagauggagaaacccaacauuugcagaagcaggauaaguaagguuuccaagaagacaaaggaggaagaggucacccaaccuagucccaaaaacuggagguaaggggugaaggagaggaaagagucauguccuaacagaaagucgaacagaaagauuaaacuaugugguucagagaacccgucuagucugcccaacugcaacagagcauucugcacuacaagguaaaaggaaaaagcuaauuuccaaucaucuguggcgaccagugacacagaaacacaaccacaucaaacucaagaaaaagggcccagcuucagacaauaaccucaagugucuucuuccaaccaaucuuuaccacuuuuccuuccacugcgccuugcacggagcccccugcuuaccagggaaaacucccaaagucuccauggggccauggaggaaacgguaggaagaaccaccacuggaaacgggaugacuccgcugagucuacaccaucuacagcagguauucgacucuucguuuuuccgaaguucccuaauaacacccccuaaaaauacacaaucccaucaagcugacuacagacacagaauacgaacagcauaaaaacauuuaaaaccaaaaacaagaaaaugagcucaaaagcucuacuuucugacauugggaaucaggcccacuggacgacucaaugcuaacugaaaggcaaaguccagaagucacagaacuagcgcugacccaaucuccgaugagccacuucuccuuacacaguaaacugaggcaaagcgagccucugagcuagaacaguuuuaaaggccaaagccccagagcccaacggaacuuguuggggaggaugagucuccacacuaagccugucaaagaguaagacuucccugcugagugacagcggcuagcagccauucugaauuucgugaaagagggagaaagggagggagggagggagggagggagaccugaggaggcaaagcaccugacuagagccgacagggcucaaaucauuccccuguccaagagaaaagaacuugaagaauaacguuccccauccucucaugaagcgucgagggccuuuccacagguacauuuugcuaauuucacaaccucucucaauuauuuaaauggccaaaauacaaaagggacauauuuacggucauucguuccuaguucugucacaggaaaacauauucuucucacccaucuccugucguuuguccaaacacacgaaaucucuuuccccuacacugcaguaaagaaaucaagaacuuuucacucuaugcagaaucaagcaacgaauaccaccccuaaauucagaccgccaaaguugcgaugcguaugggcaggcacuguacgcuucgcacauucagggacuuggugaacacgcaggaugucguucugcuuauucaguacaguacacauuacaaaccaaagaauagucagaauuggccauuuauccgugauucuucugcugcugcuucuaagccugaagaguuaccaacaacguuaauaucuaucuguaucauuacacauaaagguccccauaugcacccaaaauguagagcuagucaucugacccuuccaacuuccugugcacuguauauguaaugaaugugauuucaucuguguauaccuacauguauguauauguaaacaaaugaauauagcaucaugaucugguucuccaaagcagaaccggaacagcaaaaaacagaaagcauucaaauucccccuucugaaagcuacaagaucuaaagaaaugucuggaucccacaagagacaacaccagagccaaaggaagguucuaguacaacaaggagcacacaagcaaccucuuccaggauggcaugugggcgacacgggugucuacacucccuuuucugaauggaaaggcauauggcuucuccuuacccagccaacaugaauacaauuugagaaaauuagaaaaagucaaaguaacaggcucacuaaauauggcugacugcgaagcagaagccacagaggaggauaugaguucucucaaaaaacaaucgggaaguuuauauccaggaaagguucaaggacucuugagugugggacggacaaagucugguucucacugcacagaagacaguaaucaaaacaucaaaaaacaaggccacaugacccuuuucccagugagguagugucaacugaugaagguugcccccuccugagacacaagagucaaguggaggcaaaaauauaccccggucuuccucagacacaggagcaacuaguguggccccuuuucacucaagcacuaggcacaauggaagcccugcccuacaucuuauuggggcgcccacucucacccagacaaggaacuccgagaagagagaacaagucaguguagacacacaaauggcgaaaggagcacggugaacguccaguugucuccauaagaaaaggagggcaacucaaaggguauuuaggaaaugagcucgcccuaacccagcaaaguguaagaguaugcaugaucuggaagaagugucugcuuuccuauuuagaaaugacuucagagcugcacaagcccccacuauccacugggugaggaaagaagaacaugggcagccugaguccccuuguccuggcaaaaagggucaacggagagugugcagaggccccaaaagaauccaaagaagaugagcagaucagacggaccccugugccaaggaaggaucggggucacggaagguaaagggcaagggaguguggagauccucacuugccauagaaacggagaccccacccuccuggcugugagggugcaagggcaagaguaggaugugaacgacugcgaggggcggggaugcugcgcaggcccccuucccuucccgggaagcgaagggggaggggucacacgaggcccuucggccgagggacgcucggcaggacggggucccccuggcggggagaagcucggggaccccccgcccgcucagggagguguccacggggcugaagagggugccggagagaguacaucuggcccugcccgccggagagcagggggccggcgagggcugagcgccggccgcugccgcccgacggggaccggcccggagcaguggggcgcggggccaggaggacccgaggcggauaaacuuuccgccccgcggcccccaccguggacccagcgccgggggugcgggggccgcgcagcgggcucgggagcggcggggaugcccgguccgggugggggaggcgccggcccuccgccggcuccuccuccucgcugggcccgguccccgccccgcgagccccccgcccccuccggccccagcccgcccccgggggugggguguggggcgccgcgcuccgccggccccgcgagucaccucaggacucggccgcgcuccgcccccccaccccgccggcccccuccccggccgggucgcccgcccgcccgcccgccgcgcccccgcgcucccgcccggcgccgccgaugcccgggauguccggcggggccgggucccgccgcccgccgcgccgccccccagccccucgcgcuccggcucuuaccuuccggcuuguuuucggcagccauuuccccuccgcgcgccacauccuccuccuccucgcgaccgggaccccgagcgcgcgccucguaccgccgccgccgccggcccagccaccccgccgccgccgcgcacccgcccuggccccgccccgcggcccacgcacagcucccguugggccgugcggcugccacucaucgcucccgccgccaaucgccccgcaccaggggucucacuacucuccgggaggagcguccuauccauccggcccauuggcuggucaccacccaacggacugaaaggauuggucaagaaucaacgcccccuccccacccacucccaggaaagcccgccuuccggaccuaaacaaagcuuccuaguggccagaacccgaaagaacuguccaaucaggacgggcccgacacggaauauuuccucgaggccgagacguggcguuuugauugggcgucacuacaguguuucccaggccguccagaccaaucaaaggggguucccggaacucgggagcggcgaagggaagccccgcccccgagcgugaccgucaugaggaaggcgcucccucauuggcacgcuggggcuuuucccgcgugcucccggggcugaaggacguucccggggaagccgcugcuggcgcguggggucccgguggcugugggggacgcgccgggaucuccgggaucccgcagcccgccgccgcugccgguggggagccggacgcggggggccucggggcugagguccgcaggggugccgcgcccuggaguccgacugccuaggaguccgggcgucgcugccggccgugggggaggggcgagccucccgccaggccccgcccccucggcgccgcguccccacggccccggcgccgcccgccugcgcccgccuccugugcccgcccccggugagcuccguuguccccuuuucuggcggcuuaaaauaccgaaacuuuauuuuggucacguugcccaugugacccgcggagcggaugacucaugguugccugucccaggaugaggccgccggccgaaagcagagaagcgccagccccggccgcccggguggagcgcugggcagccgaguuucccacccuccucaauccggagaguccgcgcggggcuuuuccuaauaaauagccaggcacccgcugcccucgcgcugcguacgggagcacgugccccccgggaggugggcgcccgccaggugccccgggaacgagccuaggaaccggguccgccgagugcggcucucggggcggcuaggcgugcggguggcugggcagcgcucccagggaccggccucucuccggagaaaguaaggaauucugcuccugggcagguaauaccggaaacaaaaggagaggcugcaaucgcaaauuguuuaaaaagaagaaaaaggaaagaaaaguugaauguaagagcuccagccccucaaugugaucuuguacgguuugcaguaagaacauuucauucuuccgcauuuuauuuuuccuuuugcuacuguuggugacaacuagcaaaauaagugaaaaauccucguucaaguguucuggcauuaagauugacugucacacugaauucugugccaauccuaacaacauguguucuuuuucuggucuucacaaguaagaaugucuuagguuuuccagaaauaaagauguccca

SEQ ID NO: 14247 - RNA, 9284 nt, Homo sapiens
uugacgucacguccggcgcggagacgguggagucuccgcacugucggcgggguacgcauagccgggcacuagguucgugggcuguggaggcgacggagcagggggccaguggggccagcucagggaggaccugccugggugaggagggcgcggggugagggagggaggggcugcgggccgccguggcugccuuccgcucggccgcucgggaccugugggcgcggcgugggcuucgcucaccuguccccggcugccgcccuccgccguccgggauccucucacugugccgggccaguccguucgcucucaucccaugucuccuuuccccaaacuuggauuuuucucaccaggcccuucuucacgacccuggccccccauccagcauccccccuggccaauccaauauggcccccggcccccgggaggcugucaguguguuccagcccuccgcgugcaccccucacccugacccaagcccucgugcugauaaauaugauuauuugaguagaggccaacuucccguuucucucucuugacuccaggagcuuucucuugcauacccucgcuuaggcuggccggggugucacuucugccucccugcccuccagaccauggacggcuccuucguccagcacagugugaggguucugcaggagcucaacaagcagcgggagaagggccaguacugcgacgccacucuggacguggggggccugguguuuaaggcacacuggaguguccuugccugcugcagucacuuuuuccagagccucuacggggauggcucagggggcagugucguccucccugcuggcuucgcugagaucuuuggccucuuguuggacuuuuucuacacuggucaccucgcucucaccucagggaaccgggaucaggugcuccuggcagccagggaguugcgagugccagaggccguagagcugugccagagcuucaagcccaaaacuucagugggacaggcagcagguggccagagugggcuggggcccccugccucccagaaugugaacagccacgucaaggagccggcaggcuuggaagaagaggaaguuucgaggacucugggucuaguccccagggaucaggagcccagaggcagucauaguccucagaggccccagcuccauuccccagcucagagugagggccccuccucccucugugggaaacugaagcaggccuugaagccuuguccccuugaggacaagaaacccgaggacugcaaagugcccccaaggcccuuagaggcugaaggugcccagcugcagggcggcaguaaugagguacugugcccaggguguugggacuggggagacaaauagagggaauagacacuuuuuugguauaauagggacccugggcugggugugauggcucacucacgccuguaauccuagcacuuugggaggccaagggggguggaucacuuuagcuugggaguucgagaccagccugggcaacauggcgaggccucauuuguacaaagacuauacaaaaauuagccgggugugguggcacacaccuguaguccuagcuacucaggagggugaggugggaggaucacuugagcccaggaaguggagguugcagugagcugagauggugccacuacccuccagccuaggcgacagagcaagauccugucucaaaaaaaaaaaaaaaauauguggaccuuaagacaaucucuguuaauguggguuuggaacaggcuuucuccaaaggaagcuggugaccucaggcugaccuuucugcaagccccagcuguucacgguugccaccuuccugagaggagugggcagcaucaggguuacagguguuuccccagggcaguguuuccagcugagcuuccaguuccccacaaacacagccacuuuccucugaauccaagauucagaugcucugccuugggccccugaaggaacuugucugaugaagggacuugucaggguuggggcuugggauggaacuggagcugggucccuacaacuccugcugauucauuuggugacgccacccccuccugcugccuauugugcucuagugggaaguggugguucaaguggaggaugauggggauggcgauuacaugucugagccugaggcugugcugaccaggaggaagucaaauguaauccgaaagcccugugcagcugagccagcccugagcgcgggcucccuagcagcugagccugcugagaacagaaaagguacagcggugccggucgaaugccccacaugucauaaaaaguuccucagcaaauauuaucuaaaaguccacaacagguaaacguucuguuuuucuauuuucuuuuccugucugccauucccacguugggggagggguccugcacuucccacuucugggugagguaggggcugggggauccaucucagacccacauagugucuggccuugguacaccucugauaaucaggaagugagagccugcuuuggguuggauucuucuuccuugcuguccugugaguacucugguuggagauggguuuguguacaucuugucaacagguuccacccacuguggaccuugaccuccagcuggucucugcuaacagaaugagaaaccuguggccccugugcuagagcuggggcccaaccuuagguguuucugaagccuggcagugugggcuugaagccuggcagugugggcuuugggccacagugccaagccuugguucagugcuaccugcguuuccagggaaguguucacucuggggugucaguggggcauucaagucuauuugucuaaaccuucagcguccaauaaaguaaccaggaacuccaggagcuauuacaauuuuuauuuuuacauuuaauggagacaagguuuugcucuguugcccaggcuggucucaaacuccugggcucaaucgauccacccacccuggccucccaaagugcuggaauuauaggugugagccaccaugcccagcccccaggggcuauuuuauguuuuuuguuuguuuuuguuuuugaguuggagucuugcucugucaccaggcuagagugcaguagcgugaucucagcucagugcaaccucugccuccuggguucaagugauuccucugcuucagccucccaaauagcugggauuacaggcacaugccaccacacccggcuaauuuuuuguauuuuaguagagacgggguuucaccaugauggccaugauggucucaaucuccugaccuugugauccacccgccuuggccucccaaagugcugggauuacaggugugagccaccaugcucagccuauguuguuuuucauuuuauuuuauuuuuuugagacggagucucacucuguugccaggcuggagugcaguggcaugagaucggcucacugcaaccuccgccuccuggguucaagcgauucuccugucucagccucccgaguagcugggauuacaggugccugccaccacgccuggcuaauauuuguauuuuuaguagagauggggcuucacuaucuuggccaggcuggucuugaacuccugaccuugugauccaccugccucggccucccaaagugcugggacuacaggcaugagccacugcgcccagccuguuauuuuuuuuuuuuuuuuugagacagucucacugugucgcccagguuggagugcaguggcaugaucuuggcucacugcaacuucugucucccagguuuaagcgauucuccugccucagccuccucaguagcugggacuacaggugcgcaccacuacgcccagcuaauuguuuuacuuuuuuuuuuuuuuuuuuuugagauggagucuccccucugucgcccaggcuggagugugguggcuccgucuaagcucacuacaaccucugccucccagguucaagcgauucuccugccucagccuccugaguagcugggauuacaggcacgcgccaccacaccuggcuaauuuuuuuguguguguuuaguagagacaggguuucagcauguuggucaggcugguuucgaacuccugaccuugugauccaccugccucagccucccaaagugcugggauuacaggcgugagccaccgugcccagccauuuuuuuacuuuuuaguagugauggguuucaccauauuggccaggcugaucucaaacuccugaccuugcgauccaccugccuuagcuucccaaagugcugggauuacaggcgagagccaccgugcccagcccccagggacuauuuuaacuuaaaauuuaaaauuaaauaaaaauucaguuccucagauacguuagccaaaucugaaguggugaggaaccacgugucuccugguggcugaaucgggcagugcugacauagcacauuuccaucaucguggagaauccccuugggcggcacugcuuuggagucccugcaaggccuguggggauggcggcccaguggcaugccuuccaguccugccacucccagccaagacaucacuagucuaucaugguguguuuucuugccaugccagguugggcggcacacuaguaaucaccuagaaugggagccagggggaaacccguucgcugucccugugcaccguguucagggcagcugcugccaguggaaugcugggauaaccccagugucggggguccuggggcagccuguguacugcuggaugcuugcuuucaaguacucugcugggguaagacucuggggcaguuuccaucccuuccuugggcuucagcuugcuggacuggcccugagaacugggaggggauggcuucaugaagucauuuugaugggggaugaagauaguugcuguagaggaagaggaugagagagcugcuuggccucuggaaggugggaggagcugucgcaggcugcacaggggcucugaggucgaguucguuuaguucauugauuaagcagucuaccagguggccagcaaggcuuugugggugcuugggaugcauuuaagggaacuaaacaaaggugcuugugcagccgaccugcuugccaggcaaugcagauaacagauaaguccaucugccugcaguagacggugaggaagugcugccgaagaagaaaaagcagaggcgggccaagggguuggggaguugugagugggguucgauugcgauuuuaaguagccagggucucuagagucuuacugagaaggugagauuuaagcaaagacucaaaggaggugaggaaguugaccaagugggugacuggggagcaucugggcagagagaagagccagggcgcugggguaggaggauccugggggcgugacaggcagcaaggaggcacaugccugauccagguggccagacgacacccugggagagaagcaggcaaggggagggcugccugcgccuugauaggccucccgggcccuuucucugaauggggaagcacuggggauacgugagccaagagguacugaggucugacuuaaagguccuucuggcuccugaacugaaaccugugggggaggcagucacggagcggggagaccagaugggcagcuccccuggcuaccugggagaagcuguugccagccuuggugggccaguggagucaggugaggaucuggccauggguuugaagcucugggaagacugaguugcuucuccaauagucaggacccaagaucuguuucugccuucagacagaaugcggucagcugggccucccugucggccucugugcuggccagauccauggcagccucuuaggaccugugugagcuucuugccacugcacucucccuugcagagucuccaugcugggggaggcuucugggcuugucccugcaccuuaaccagccggugucaccugagaacacuuguuccccuuagaagggacccagagggggcccugggugagggagagaugggaaacccucucagcccccccaccccuguggcuucuccuggcaggaaacauacuggggagaaacccuuugagugucccaaaugugggaaguguuacuuucggaaggagaaccuccuggagcaugaagcccggaauugcaugaaccgcucggaacagguacuugggagcuggcccagguacuugugggcagggcacacuggccucucugucuucgugccauccgggaagggccccaggagacugucugagagggguacuguaaacucaggaaagcugugggguccuuggaugucaugagguccaugcccugguacagguggggacacagguccugagggcggaagggacaggcauaggagggacucugugggaggcauuugggguuggcuuuccuaggccccuggcccaccuccaccuuggcuuuggagaaggggagccgcuacaggggauggcagcugggaaaggcccccuggccacccccagcaaccccacugcuggcuucugugucagggcccgccgaaacccaggcccacucuuccuagaggccugucagcagccacuagggccagggacugugggugaggccacucggacccugcccccagucugucugggccugagaagggccuggugugcggugggcuugcagcacucagugauggucaggccaggcagguuauguguugcccucucccacccuagcguccccacccuccccaggcagacucuucccagcagcaagcggaagcccgggcagaggcugcugucauaggcagaggcccccgcugaugccggcccugcuugccccucacacugccaggucuucacgugcucugugugccaggagacauuccgccgaaggauggagcugcgggugcacauggugucucacacaggggagaugcccuacaaggucaggcuuggccugucuccagggccaggguuggguggccccaggauccuuccugcugagcccuuuacguggggugcugucaggcaccucccucacaguagcugucagggagccugccuucccugccuucccugccuuuccagugcccccuuaucuaggcagggcuacugucugcagccucaccuccaagguccuuauuaggcccuuguuucuuuccauggaggacaggcuuggcauccucugggcagcugagcccugagggcccuccuuugcaccauccuucacaccagaucagggguccucccagaaucaucucaccggggccucccucuaguuccugcccuauagcccaaggguggguggcaggguuucaugggugcaggccgcccuggaggugacugugggccucuuuuucaguguuccuccugcucccagcaguucaugcagaagaaggacuugcagagccacaugaucaaacuucauggagcccccaagccccaugcaguaagugacagggagggcugggcaugcuuugaugcuggcaugagcaagagugagcugugcccagagugggcagccggccauguacuuucuguuguucgggggggugcuugugggucucccaggcagcccuucccugcucucacccuggcccuggucccucccucugccugccuggucugccugcagugccccaccugugccaagugcuuccugucucggacagagcugcagcugcaugaagcuuucaagcaccguggugagaagcuguuugugugugaggagugugggcaccgggccucgagccggaauggccugcagaugcacaucaaggccaagcacaggugcgugucgcccguucucucuuggggcccaguccugcugccagcccaggcuugcaccggcagggaagacagaguuugcugacuuuuacacagaugagugugcccuuggccuccacccugaaucuagugccuacagccucucugggauagugggaccugaggggcaagcagcuaugccaggcagagaggcugggggcagauguuucaggcucagacaagccucugugcccccggggcagauucugagcuuccuuaguuuccugugacuccugcucauagauuguccuucugcucucgggguggagguggugccccuuuccuagcacugcccaagcccucuuuccaccaggcaugcuccuagcuguagcagagcaagggggucacuucccuuggugauggccucugccccauguccccaccuuaacaggaaugagaggccacacguaugugaguucugcagccacgccuucacccaaaaggccaaucucaacaugcaccugcgcacacacacgggugagaagcccuuccagugccaccucuguggcaagaccuuccgaacccaaggugagguacgcccugccccuccccucgccuccccauccugaggccaaggccacaggcugagcucuugccuugugccugcagccagccuggacaagcacaaccgcacccacaccggggaaaggcccuucaguugcgaguucugugaacagcgcuucacugagaaggggccccuccugaggcacguggccagccgccaucaggagggccggccccacuucugccagauaugcggcaagaccuucaaagguaccugggcggcccugggagagccauuuccugcucauccgaguuggagggucucugaggaggaaacgcuccuuucuugccugugaaccucuuuugugccccacaugguuagaguugagaguggaccugcuuugaaggcagggguguccugugcaguagugacccuggguggcacuggagagccuggcagggccugugcagcacuuguaaaccacugguccccucccuugcugccugucccaaccuccugcuggguuuccucgagggucccggggcuccugcaugaucccccacgguguucucccucuugcagccguggagcaacugcgugugcacgucagacggcacaagggggugaggaaguuugagugcaccgaguguggcuacaaguuuacccgacagguaggccagggccugggccccuuccccuacccuaggaucccccaaaguucugagcucacccuccccgccaggcccaccugcggaggcacauggagauccacgaccggguagagaacuacaacccgcggcagcgcaagcuccgcaaccugaucaucgaggacgagaagaugguggugguggcgcugcagccgccugcagagcuggaggugggcucggcggaggucauuguggagucccuggcccagggcggccuggccucccagcuccccggccagagacugugugcagaggagagcuucaccggcccagguguccuggagcccucccucaucaucacagcugcuguccccgaggacugugacacauagcccauucuggccaccagagcccacuuggccccaccccucaauaaaccguguggcuuuggacucucguauu

SEQ ID NO: 14248 - RNA, 5700 nt, Homo sapiens
augugaccggaagggcuccucacggacgccgucccuccucggcgcggccugagcgcccggcccgaccccggccauggggugcugcuacagcagcgagaacgaggacucggaccaggugcggccgcggcaggcggggcucgggaaugagggcuaagacacuggggcauggggcccagaaagaaaccugcggaggacgggcagccggacugcagggcucacugaauacggaggccuggaggggacagauuacagaggagacgccaagccgggcuccuaccccuguuaaagccccagauuucuacacaguccccgccucggggugugcaggcagccgccuguccggcucgcucccaccacuuccguuugcuccuaccuucaaaacuuuucagauucaaggauccucagucuagguccccgggaaacacucccuuccccagcuuccugugucuucuguguauuagugggcuuugcgaauccauuuuagggguggguaagcugaggcccugaguuagucuguccugagaugaaucaggaauucguguaucgucuuagucccugggguugcagaaggaaggucgcugcuagucuagggccaggggacgacucuggaaguugguggccuuugaauuggccaaugaaggauuuaaucgauacagugaggacaucgggacaugugggaaauugucugggaagcaacaaagaggauuuagcuuuggcuagauugugggaaaagagaaauggagcgggaaguucauuugguucugaguuuggcuugccucagugcagucugccuggggccugaggguuccuuuagcuggagacaugccuauucugagaauuuggcuguagaucugauaccuuuggagaaaggguuaggcuggggagaccuguacaguuuuaaauucucccucuuccucuuagugcauucucacuucuccccacacucuaaucccugcccugccuggccugacauucaaggaugaagucucaaguugcugucuacucuccuuuuuugaucgucucuaagcccggauucuacauuugaacauauaguagaccugagagaguagaaagguuucagguagcucacggucuaauggggaagauggucacaaaaauagauuauaucacugguacuugggaaguaguucguucuucagugaacguauuuuggauuaagggcuuaagccuaggaaaaugucguuuguaugggaagcaaggguggcuucugguucucaauucuccauacacccaaugaacacauauuuccuuugcccuguguuaggcauguguugugccuaauaccucucacuucacuuccaccuuuuugagaaagagacaacaauaacccugccuacugggagagcuguagccuagugggaaauugucccuuaaagcauaauauggacucuugcagggaaugagucaagaaggauuaaugccguaugagaaaggauacaagcuucuacuuggaagggagagcugggccugcugcucuccugaaucucuaccuucuccuuggggggcucucauuucuguuccuaacacccagagaaggugcuuaaucacugcugggugauuugaggccucauguagcaagggccauaaccauccaccaucccacagucccucuuugaguucuugggcaggccccucuccgacucucaucucugucucuuuaucauaauaaaaaauauacaacacguuacaguuuacaaagggccuucacaguuaucuaauuugacucuugccagacauccgucauauuaguguggguuaugucuauugaaaggugaggaagaaguucagagaagcuaagugauuuggccaagcugagaagugcuagugcccagguguucugacgcuaggccauguacuuuauccauggggccaagcugucucagccaugccccuagaccagguggccagucacgggcaggcugcuaugucugugcuaagguagacagugaaacccugccucuuggguuacacuaaugcagagacaaaccuugaugugacaaaccuaacccaugcuccacucgcacuuugggaguggggugauguuugucugcucugaaguagguagcauggccucuucuuuaagucuggguuucaagaaaauaaccuuguuguucacuugaucuuagcugaaggcugagaagugaucagccaaccuucuucuugaagaaccccugauagggaagagacuacccuguccugcaggaagaucugucugaaguggagcugggaggacagacacauaggaagcuaacuugggccucauuauggagccagcuuuccuuagaaauacauaguuuuaucuuuggcaaacauuuugucuuuuuagcucuuuaauacugagccuauguauuuagggaggaagggugucugggaguuuauagaggugauggggcaaagcccacagcuucugucucuugcuguugggaacuggaucaaauugccugaggacacuugggcaaccuagccuugagaaagaagaguaaggugaaaaggcugggccucccuaagcagggcaggaggaaguagcccucuacaaggagaguuguggaguugugggcaggggagcugcggccugcagcaggaaagacugaggaacugagauaggccuggaggggagcauugaggagucuggcacugaagguuggugagucagcauuagccaggaugucccccugggcccauccuuggcuuuguucagggcacucuugcucuuuauggguuggauagauacccagcaggucuguuuuucucauuuacugcugauacagcaagcaaggauuugcagcugauggucucaaggcagggucaaauccagaaauauuacaguagauagaacaggggacugaaagaggacaaggaggaagaccaaaccaaugaggaagcuugguuuggucuuacauuaguucagggguugugauuaucagcacaggccagcaggaacagggcugcugaaaauuuacaugggcuacucaggugguuuagcaagggagggaacagcgccauuguuguuuguuuugagauggggucuugcucucuugcccagacuggaguacaguggcacaguccuagcucacugcagccucaaacccuggguucauacagucguugcacuucagccucccaaguaggugggacugcagggcucacacuaccaaguccagcuaauuuuuuuuuuuugcaaagacgaggucuugcuuuguugcccaggcuggucucaaacuccuggacucaagcaauccuucugccuugggcucccaaaguguugggauuacuggugugaaucaccauacauggcuacagcuguacugcucagaucaggauacaccauguacacucaguuugguucugggagucacguacaaaaagagcaccagagcacaggagggugaacaccuucgaagggaccugccuucaagaagggaacacacuuguacugugugacccagagcugggcugggauuccugcccugacauaauuugagaaauggccauggagagguugggcuugcuuucucuuggggccuagggcuuugucuggacucgccagggcuuccaucuuggaagcgaacagcuuugcuggggaaggccugguccuaggggaugaggaaggcuguucuugggcucuugacuugcacugauuuccccuuuagaucccagugcuugcuaugucucagcuccacugucuuccagccucuaguauccuuucuuugccagguccuagaauguuuuucaagcuccagggcuguugcugacuaccugcuuugugccucuguccauuuuuucagggccucuaggacugccugguuccacucucauuuauccuagaacaccaacucaguugagcucccaaggauaggcaggaacugagucuuaucuggcauuccauaaagcugggcacuuuagauauuccuuauagaaacauuuuugguguuuaaggucagagcugggcuaaggguagcacccgugaaaggcaggaucuacggguccuggggcugacuucucucccaugaccacuucuaggaccgagaggagcggaagcugcugcuggacccuagcagccccccuaccaaagcucucaauggagccgagcccaacuaccacagccugccuuccgcucgcacugaugagcaggcccugcucucuuccauccuugccaagacagccagguaagugucagaggaccaggccugggucagagcuccucuauccauauuaaaggcuaggauagaaggagccaggcucaggacaugggggaugggacaaggucacuggggagaggugccuccauguccagcccugcuccaguaggcaggagggaaacuggugucagauagcccuggaguugguaccuggcacugaguccuguuuguccuucucggaagcaccugucaugucaucucugucuccucuccccauagcaacaucauugaugugucugcugcagacucacagggcauggagcagcaugaguacauggaccgugccaggcaguacaggugagcaccuggccagcgugggucccucaggcuacuugggcucccacccuccaucacuguuccagcuuuggagccuggccccuaguccaagcuucucauuuggugcagcccuggagacugaccacagaucacuugggugcuucaguaguuauucaugucagcccuguuuacccugugacacucuugagggcgcugaggccaagggagaugggccuagauugagucugugaugagcugagaccuucccucccagauaccccuccucgacacccugcuucucuggccugaggggaugaggcuuaccugggcugggcagggcagacuguggcuuaacugccuacccccacccccucucucuuggucagcacccgcuuggcugugcugagcagcagccugacccauuggaagaagcugccaccgcugccgucucuuaccagccagccccaccaagugcuggccagugagcccaucccguucucugauuugcagcaggugagacaccccucaccugccccugcccacccuucucacacugcccaggguauggcagaggguucacccacucugccucagaggagguagggaagguggaguuagggagccugguagccuuguaggccccagcucccucccaccucguucucuuaacuuuuuaugucuuuccuaucuccuuccugcaaccuuuauuguuucacuccccuuuguucuuuuccuucugucucucccaucccugucuuucucuuugccuuccuguuccccuucauucccuccuucuccaucaccaucuaaucuccccuccccauuuuuccugauugcccuccucaccugucucuguuccucuccuccccggccccucucugucucaggucuccaggauagcugcuuaugccuacagugcacuuucucagauccguguggacgcaaaagaggagcugguuguacaguuugggaucccaugaagagagggguccuuggacagcucuucuccucucuucaucccaucucuaccccacccccuuggcccccagccucacugcggcuuauacaguacccuaaccugcuacuaaucacagagaaaaaugugaagaaggaggagaagaggaaggcuagaagccugagcaagugaggguagaaccuuuugggacuggccuuugaagcucuggccagggauggggugggggcc

SEQ ID NO: 14249 - RNA, 5485 nt, Homo sapiens
cauggggugcugcuacagcagcgagaacgaggacucggaccaggugcggccgcggcaggcggggcucgggaaugagggcuaagacacuggggcauggggcccagaaagaaaccugcggaggacgggcagccggacugcagggcucacugaauacggaggccuggaggggacagauuacagaggagacgccaagccgggcuccuaccccuguuaaagccccagauuucuacacaguccccgccucggggugugcaggcagccgccuguccggcucgcucccaccacuuccguuugcuccuaccuucaaaacuuuucagauucaaggauccucagucuagguccccgggaaacacucccuuccccagcuuccugugucuucuguguauuagugggcuuugcgaauccauuuuagggguggguaagcugaggcccugaguuagucuguccugagaugaaucaggaauucguguaucgucuuagucccugggguugcagaaggaaggucgcugcuagucuagggccaggggacgacucuggaaguugguggccuuugaauuggccaaugaaggauuuaaucgauacagugaggacaucgggacaugugggaaauugucugggaagcaacaaagaggauuuagcuuuggcuagauugugggaaaagagaaauggagcgggaaguucauuugguucugaguuuggcuugccucagugcagucugccuggggccugaggguuccuuuagcuggagacaugccuauucugagaauuuggcuguagaucugauaccuuuggagaaaggguuaggcuggggagaccuguacaguuuuaaauucucccucuuccucuuagugcauucucacuucuccccacacucuaaucccugcccugccuggccugacauucaaggaugaagucucaaguugcugucuacucuccuuuuuugaucgucucuaagcccggauucuacauuugaacauauaguagaccugagagaguagaaagguuucagguagcucacggucuaauggggaagauggucacaaaaauagauuauaucacugguacuugggaaguaguucguucuucagugaacguauuuuggauuaagggcuuaagccuaggaaaaugucguuuguaugggaagcaaggguggcuucugguucucaauucuccauacacccaaugaacacauauuuccuuugcccuguguuaggcauguguugugccuaauaccucucacuucacuuccaccuuuuugagaaagagacaacaauaacccugccuacugggagagcuguagccuagugggaaauugucccuuaaagcauaauauggacucuugcagggaaugagucaagaaggauuaaugccguaugagaaaggauacaagcuucuacuuggaagggagagcugggccugcugcucuccugaaucucuaccuucuccuuggggggcucucauuucuguuccuaacacccagagaaggugcuuaaucacugcugggugauuugaggccucauguagcaagggccauaaccauccaccaucccacagucccucuuugaguucuugggcaggccccucuccgacucucaucucugucucuuuaucauaauaaaaaauauacaacacguuacaguuuacaaagggccuucacaguuaucuaauuugacucuugccagacauccgucauauuaguguggguuaugucuauugaaaggugaggaagaaguucagagaagcuaagugauuuggccaagcugagaagugcuagugcccagguguucugacgcuaggccauguacuuuauccauggggccaagcugucucagccaugccccuagaccagguggccagucacgggcaggcugcuaugucugugcuaagguagacagugaaacccugccucuuggguuacacuaaugcagagacaaaccuugaugugacaaaccuaacccaugcuccacucgcacuuugggaguggggugauguuugucugcucugaaguagguagcauggccucuucuuuaagucuggguuucaagaaaauaaccuuguuguucacuugaucuuagcugaaggcugagaagugaucagccaaccuucuucuugaagaaccccugauagggaagagacuacccuguccugcaggaagaucugucugaaguggagcugggaggacagacacauaggaagcuaacuugggccucauuauggagccagcuuuccuuagaaauacauaguuuuaucuuuggcaaacauuuugucuuuuuagcucuuuaauacugagccuauguauuuagggaggaagggugucugggaguuuauagaggugauggggcaaagcccacagcuucugucucuugcuguugggaacuggaucaaauugccugaggacacuugggcaaccuagccuugagaaagaagaguaaggugaaaaggcugggccucccuaagcagggcaggaggaaguagcccucuacaaggagaguuguggaguugugggcaggggagcugcggccugcagcaggaaagacugaggaacugagauaggccuggaggggagcauugaggagucuggcacugaagguuggugagucagcauuagccaggaugucccccugggcccauccuuggcuuuguucagggcacucuugcucuuuauggguuggauagauacccagcaggucuguuuuucucauuuacugcugauacagcaagcaaggauuugcagcugauggucucaaggcagggucaaauccagaaauauuacaguagauagaacaggggacugaaagaggacaaggaggaagaccaaaccaaugaggaagcuugguuuggucuuacauuaguucagggguugugauuaucagcacaggccagcaggaacagggcugcugaaaauuuacaugggcuacucaggugguuuagcaagggagggaacagcgccauuguuguuuguuuugagauggggucuugcucucuugcccagacuggaguacaguggcacaguccuagcucacugcagccucaaacccuggguucauacagucguugcacuucagccucccaaguaggugggacugcagggcucacacuaccaaguccagcuaauuuuuuuuuuuugcaaagacgaggucuugcuuuguugcccaggcuggucucaaacuccuggacucaagcaauccuucugccuugggcucccaaaguguugggauuacuggugugaaucaccauacauggcuacagcuguacugcucagaucaggauacaccauguacacucaguuugguucugggagucacguacaaaaagagcaccagagcacaggagggugaacaccuucgaagggaccugccuucaagaagggaacacacuuguacugugugacccagagcugggcugggauuccugcccugacauaauuugagaaauggccauggagagguugggcuugcuuucucuuggggccuagggcuuugucuggacucgccagggcuuccaucuuggaagcgaacagcuuugcuggggaaggccugguccuaggggaugaggaaggcuguucuugggcucuugacuugcacugauuuccccuuuagaucccagugcuugcuaugucucagcuccacugucuuccagccucuaguauccuuucuuugccagguccuagaauguuuuucaagcuccagggcuguugcugacuaccugcuuugugccucuguccauuuuuucagggccucuaggacugccugguuccacucucauuuauccuagaacaccaacucaguugagcucccaaggauaggcaggaacugagucuuaucuggcauuccauaaagcugggcacuuuagauauuccuuauagaaacauuuuugguguuuaaggucagagcugggcuaaggguagcacccgugaaaggcaggaucuacggguccuggggcugacuucucucccaugaccacuucuaggaccgagaggagcggaagcugcugcuggacccuagcagccccccuaccaaagcucucaauggagccgagcccaacuaccacagccugccuuccgcucgcacugaugagcaggcccugcucucuuccauccuugccaagacagccagguaagugucagaggaccaggccugggucagagcuccucuauccauauuaaaggcuaggauagaaggagccaggcucaggacaugggggaugggacaaggucacuggggagaggugccuccauguccagcccugcuccaguaggcaggagggaaacuggugucagauagcccuggaguugguaccuggcacugaguccuguuuguccuucucggaagcaccugucaugucaucucugucuccucuccccauagcaacaucauugaugugucugcugcagacucacagggcauggagcagcaugaguacauggaccgugccaggcaguacaggugagcaccuggccagcgugggucccucaggcuacuugggcucccacccuccaucacuguuccagcuuuggagccuggccccuaguccaagcuucucauuuggugcagcccuggagacugaccacagaucacuugggugcuucaguaguuauucaugucagcccuguuuacccugugacacucuugagggcgcugaggccaagggagaugggccuagauugagucugugaugagcugagaccuucccucccagauaccccuccucgacacccugcuucucuggccugaggggaugaggcuuaccugggcugggcagggcagacuguggcuuaacugccuacccccacccccucucucuuggucagcacccgcuuggcugugcugagcagcagccugacccauuggaagaagcugccaccgcugccgucucuuaccagccagccccaccaagugcuggccagugagcccaucccguucucugauuugcagcaggugagacaccccucaccugccccugcccacccuucucacacugcccaggguauggcagaggguucacccacucugccucagaggagguagggaagguggaguuagggagccugguagccuuguaggccccagcucccucccaccucguucucuuaacuuuuuaugucuuuccuaucuccuuccugcaaccuuuauuguuucacuccccuuuguucuuuuccuucugucucucccaucccugucuuucucuuugccuuccuguuccccuucauucccuccuucuccaucaccaucuaaucuccccuccccauuuuuccugauugcccuccucaccugucucuguuccucuccuccccggccccucucugucucaggucuccaggauagcugcuuaugccuacagugcacuuucucagauccguguggacgcaaaagaggagcugguuguacaguuugggaucccaugaagagagggguccuuggacagcucuucuccucucuucaucccaucucuaccccacccccuuggcccccagccucacugcggc

SEQ ID NO: 14250 - RNA, 3942 nt, Homo sapiens
ugcgggcgagaacccggaccccuagccggugggaaugaaaacgagcuccgagggcuccagggcugccucugcuucucuaggauuccguuuccccacccaaagccuggagugggguaaccaaaagacucuuaacuaggcaagccgccgaaggguucuacgggcuccuuagagccgggcguccagcgacuggggcccuuguccaggcucggccuguucccagcgucgaggacuggagcaagucacgaccuuucuccggaacucggauuucccguccagcucagcccuucacccgauaaagcagcugggggugcaagucccucccgcugcugucccucaugggagcucccguaaccgcuggguccccugcugcggcccagggcggggcucagagaagacgcugaacccgagccuggggaaugaaugaagggcagcauuggagaggagggaccguagcuccagucaggcaaggccuggccccaccuggcccuccugcccucggggucacgcagcgaaggcccccgauggcgccuuuaccacucucccgcaggugcucggggaaaacugggggccgccaccccgcgguagacaggacgcaaaggcggggagcgggauccccgggggcgucgcggucuccccucccggcuccacccugcgcaggaacaaaggcaggaggugggaccagcgggcggccggacuccgcggggcggggcggggcgggcgagccgcucccuuaaagcucggccgcgggcggggcgcgcacucgucuggcaccagcccgggccgcgcccgggaccucauuucggaccucgguuucccuuugcguggggcucgcagcugccaccgcuuccccgcggagcauggggcugccucgccgggcaggggacgcggcggagcugcgcaagguggguaccggggacugggggcggggcuggggacuccggggacccgucuaaccaccgcgccgcccguccgcagagccugaagccgcugcuggagaagcgccggcgcgcgcgcaucaaccagagccugagccagcuuaaggggcucauccugccgcugcugggccgggaggugagcgcgcccgggcggagggcagaggguccuggggcgcggagcgggggcagggggacggggugcuccugcgggaggaacccaccaggggguuccgcgcggcgcccgaggcggagccuggguggggugggcgcgucggagcggacccccagcaggccacggcgcgccccacacccagcucccgacuagagcgagggugcgcacgguagccggccaaaguucugucuuggugguucucugucgcucuuccucguggccgggcgcagaacuccaacugcucgaagcuagagaaggcagacguccuggaaaugaccgugcgcuuccugcaggagcugccugcguccucauggcccacggcagcgccccgugagugagcccucccugcccugccgcgcgcucugcaccccgcacccggcacccuaccccgcgccucacgcggcucuccgcccgcagugccuugcgacagcuaccgcgagggcuacagcgccuguguggcgcgccuggcccgcgugcugcccgccugccguguccuggagcccgccgugagcgcgcgccugcuggagcaccuguggcggagagcggccagcgccacccuggacggcgggcgcgcuggggauuccaguggcccgucugcccccgccccagcgcccgcgucugccccagagcccgcauccgcuccggugcccucgccgcccucgccucccugcggcccuggccucuggcggccgugguagccccucggccgauccacagacccugccgacugcuugggaccuuggggcacuggacagguugaagcucuugguggcggcugcuguucccaucauuaggggccagcccaguacccacacccaggccggaagccggcuguuugugacuggcguggcagacugaaagcccuggggcuggggcucggcucagggaauaaaaggagcgucccugcuucacccccaacuuggcuggagaagaaaggacaagaggcagcagggugaagaagaagccccccaucccagcugguggagauaguucuggaacuggaccccgcagcugcgugggcagccgacacacccaccccagcacuggcaccagaccagagccagagccaggaccugggcaaagugcagccgugcacccugccuggucacugcucucccagcccugccugggccuaccuccugcccagcucugcuugggacccucugggcaugcagcagcaguagccuaagggcucuggucacuuccagggcucuacagggcagcagagcagagcaaaagggugcauaugcugggagcugucaccuccacuccuaggcuuuucugccuagagcagaauuauaggggcaguauacauccaggggucugugcgguggggcugggggauuccuuaagugacuuugggaaggauuuguuuucccgagcaucaauuucacaccugggcauugcaccccaggcuaugcagucuuucagugugaggaaggggcagaacaagaaugaggcggccccguggccucaaggaagcuuguggcuuuggaggaucugacuccagcagagucugugccaauguggggugagcagggccccugccauggagcagcaggaauuugagggauggagcagguuaaagaaugggaaacaucuucacuuguuuuuuuuucuugcaaacuacucccugcuacucauugagacugguuacuggaagcaacuuguuaagauuuuucuuucugggcgggcgcgguggcucacgccuguaaucccagcacuuugggaggccaaggcggguggaucaccugaggucaggaguucgagaccagcuuagccaauauggugaaaccccgucucuacuaaaaauacaaaaauuagccgggugugguggcaugugccagcuacucgggaggcugaggcaagagaaucacuugaaccucggaggcugaaguugcagugagccaagauugagccauugcucuccagccugggugacacagcaagacucugucucaaaaaaaauuuuuuauuucuuucuuuuccauggaggccuagagucccugugaaggcuaggaaggggcugcugaucccaggagugcccacgaggaguggggggcacuguuggcccauaaucaggcaaacacccaucauuucaugggggauucaugaaaucauagucaggcaaacacccgucauuucauggcuaagcauuugcagaagguggaggauucucccccgaguccccaaaucagcagccugugcuagggaccagagcaccgggggcaagaagacagaaccaaugugggaguggggauggucacuaaaucugacugugccacacaagcccaugaugaccuuggcacugguuuggguggcaggauaugaaggaagcuguaggcauuauugaaaaaaucauuguucagccaacagggugaggcucccagcaaggccgugccaucuucccaccucccugugcccagaggguuagacuguaagcucccggagggcgaggcuggggcugagcgugccuccacguccccaaggcacagggugcacagugggugcucacugaauauaguggacuagugagcagaggaugagaggacuacccuguaaugagccuuggacagucuggcauuugccuuaacucccacucccaugcccugggaucacuguuggauauuuacuccaugaggacaaauacuggggagguguggagaggagggagggcagguuccucuuacuuucacccauugcugagaaugagcgccuguuggcacugccuuugugagccuccgggagcagguaaccugcggcccaagcccgccuaggacuccacaucaggcaggcacaggacuggccccuuguccucauaaaaacucucaguac

SEQ ID NO: 14251 - RNA, 4809 nt, Homo sapiens
cuccguuuuuaggagaugcggugcgugugcggagcaucgggccuagagggaagggagauggaggugggaggccucugccaagaaacaucugcggagcugggaaggaggaaggguggcgggacuguccauugggauccccagggcugcgaccacaugcugugcccucagcagggugggggcucagagcagagaccccuccugccugccccugccuccuggcacacauaggcugggcauaacauucaaggcagcuuugcagguggaguucauguggggacuccacauccacuaagauucuucugcuagcugguagggcguccccuguagucacgccuaaggcugcugcagccgaaaggucagugccaaggucgaaggccaacugucaucuguaucuucaugccugcagugugguuugauggcccucaaaccuuaggguuggguugguucgggggcuuaguuagggacuuauuggucugcgucucugucuccuccccugcacguggcuuggucuacgagccucucaguauguuuugagauacugaacugugaaucugccucugguucuugaucguuucuuuccuucuugccgcuggaugaugcuccgucccuccagguccugcucaugggccacugcucugcuagguguuuucagaacuauuugcagcuuucucugcaaggagagauuuuggaaaaacaccacaaaaaggaggccuaguucuagaaugucaaaacagcuggaugcaggguucugcccugcacccccacccucggccagccccugguaggggaggaggguucaggugauaucuggugcaggugggaggcccagcugugcgggcuccaugugguggaggcagggcagaggcucagggcaggggaggcagguggggacuugggcgucagacccuucucaucgacugggcuuuccccagugcagguggauggaggagggagagaagugcaccugcuuccaagaaaugagggcuuugcuggcuugccugagccccagugggugacagcagggaaggggccacagaugggcaacagacaugccugacguugucugagcccauucugugcugagggucugugcccuccugcucugccacuuaacccugagcggacgcugggcgagcccugucagugcugggcucauggccuucugccagcccuacucucccaagguggcaugcgcugcugcuccugccagacaguggaggcugcuggaggugccuuccccucccuaucccucccuccuuccggcucucccugggccgccacuccuggucuccccugcaggucgccgaggggacugcuugccaucagaugcuggguuggcuccccguagauguugccacagcagccccuucuuguccagguccugcucccucuguaccgcgucucgccccagcugcuggcagccucugugcaguuggcuggagcccaaucccgacagcaaaaaugugggggugagcuugguguguccccuccagcuugucguccuggcuguaucuuuggcuuccaugcagagcuggggucaucauggguuguuugggcauuuucugggcauuaucagaaucccagcggccucuggugucuacauguggucgugguggugucagggggaaagggucauucugacugcagccugcucuggcuuggccgaguccccugcccaggacacagcaaggcggcccagcccuggagaccugggugcacgucccaucccuccccuccacccuggcucagagcccugcuucucugugcuuagguuucucccgggucacagauguucaaggcauuuucuuuucuuucuuuucuuuucuuuuuuuuuuugagauggaguuuggcucuuauuacccaggcuggaguacaauggugcgaucucggcucacugcaaccuccgccucccagguucaagcgauucuccugccucagccuccugaguagcugggauugcaggcauguaccaccaugcccagcuaauuuuguauuuuuuuuucaguagagaaaguguuucuccaaguuggucaggcuagucuugagcucccaaccuuaggugaucugcccgccucggccucccaaagugcugggauuucaagcgugagucaccgcgcccagccucaaggcauuuucuuacagucucccugguucuauccuuucuggcauucccaguucacagacgaugaagcugagguuuagcucgcuacagugacuuggccaagucucaggcuugcaaggggcagagccucccuggggagcccgggacucacuggcaggccacguaggauuaaccgugggucccucaacuucauccucgguagguuugugggguuugcucucuagcagcugaaggccacccagggccccuuccuccggccagccccagccucuguccguggugcugaaguucauggcggccucucuuguccuuaccuuugcuggggugagggcucagggagagcgugucucucagaucuccugaagggcggucucuugaagcuggccaaacucugacacccucaacgggacguggacaucacugucucaucuccaccuccccaaaggaccgaggccgagcuugggagccguggcuccagggcccagcaucuccuccagccuugagagcaggcucccagccaguggcugugucaguauucccggaaacacccggguuccggaaaagcaaagagcacagaggcccugcugccuggcagcuggcagcgccgcugacucuggaggcuuaaugggcuaagagguuugggagcagggaggcuggugggcaggggagagggagcggggcuuccaggagaggagggaagugcaggcagccuguuggaaggggugcuucccagcuggaugucagagggggcccccaccuccccugucagugaccgucucccccuccacgaacuguuggaugugacuguuuggagccacucuccugggaaaaggcaggucauccccucuugacaguguggccugaaagggcagaguugggcugggggccucccaagacuauccagggaggccccccgccuuugcugccuccucauucucuuuccuucugccacccuuuccuuuccuucucccucccucccucuuuccuucauccucccuccuggccacugcuguuuccugagcucauuuuuuaucucuccgguucugucuuaaucucaucccaugccucuccuugcucaccccgaaaacaguuaacagcaguccugcgcauggcaagccccgcaugccccggggaucauggcagugcugcccggccccucccugggaaggggcuguggagggcuucgccaguugacuugugucucuaaaggccacaaguaaaccacuuucuccgaggggcagcaccucucugguggggugcucugguuguaaacgcccuuaucuccauauaaaugggccauuuucugccuguacagacaggaaacuaaaucaaggaagccaagcuuaagagcugccuaaauuaccuugucucauauggagaggaagcggccaggauggggugggagagggggaaggugggcuugugccauccauagcagugucugcagaguccgcacauggagaaaacugugaugugccugcugcauuaauuacagguuucaccugacgaacgcaguuccaugggaugugaacuuaagcagagagcuguggcgcuggggccugagaugcagcggcccuucccuggcuggggcucuccuucucuggcuggggcccuucccuggcuggggcucuccuucucuggcuggggcccuucccuggcuggggcucuccuucucuggcuggggcccuucucuggcuggggcccuucccuggcuagggcucuucuucucuggcuggggcccuucccuggcuggggcucuucccuugcuggggcccuucccuggcuggggcccuucccuggcugggguucuucuucucuggcuggggcccuucccuggcuggggcucuccuucucuggcuggggcccuucucuggcuggggcccuucccuggcuagggcucuucuucucuggcuggggcccuucccuggcuggggcucuucccuugcuggggcccuucccuggcuggggcccuucccuggcuggggcccuucccuggcugggguucuucuucucuggcuggggcccuucccuggcuguggcucuucuucucuggcugaggcccuucccuggcuggggcuuuucuucucuggcuggggcccuucccuggcuggggcucuuccugugcacuuugcuuuuugacucugggaccacauccuccaccgccagcuccuggguccaugccucaucauguaaaacuaauucagcccccaaaguccauagaagcccaaugaugacugaagcggagccugaguucacccgcagggcugcuggagugggcugagccgagcuugcagauggagaagccugcucucacgagagccucaccucgccucaccugcagguucuacugcuuccuguggcguagacccuggggacaagacuuggcucaggcuggcuugggguugccccuuuggcugggcuuuggggcugagcugugagcaguggccucugaugaugaguggagugauggggaucggucgauccccagcgugggccaggagguagcucucagggccguccugccacccaggacucuggauguuccuggggccucuguugcccucacugucccccuucuuuuccaggggagcaaugaugagcuaucagagaaugaagaggaucuggaagagaagucggagagugaaggcagugacuacuccccgaauaaaaagaagaagaagaaacuc

SEQ ID NO: 14252 - RNA, 8979 nt, Homo sapiens
uggaggccccaagggcgagccgucugggggcagaaagugcagcccucugcagacccugcccggccccccugcaccuccuggccccggggcugggcggccuagagccccggccccuuccggacgaggcgucucccggccccacucgccccgcccccagccccuucuggaccaggcgccuccccgcugcggcccuagcccuuccccgcauggccccgccccccucucgccccgcccccucucgccccgcccccggccccuucuggaccaggcgccuccccgcuacuggccccagaccuuccccgcauggccccgcccaccacucuagccccgccaccuuccggaccagacaccuccccgcugcuggcuccagcccuuccccgcguggccccgcccccgcccucgcccccugcccaggcccggccccugcggagcccagagacgcggggacacaggugaggcgcgcgggguccgggcugcggcuucccggugcggccgcagugggcaggugcgacugugcgcggccucgcuggcugagaacuggcgggggugggggcgugcccuggacugacccccaccggccuaacccgcggugcggggccagggccggaacugcccgcccggcuccuugcccggcuccuuguggcugcuggggacccccgacaccagccacuuucccuucccggcccuuagcaagaucggcuucuccggucaccuuuauuuuuuuaggcucgaggcgucugccgcaccucagcccacgaccugccccgcugggaggugcgggccgcuggccaggcccugaccgcaaccuggcccagaggccccagcccucaggcaagguucuccggguaaguguggggcccugaggcgcuguggggugaagaggucuauggaggggcgccuguguaccuagggccuuccugcacucacaagcccccaggaggugccaggauccgggagccucccagggccuggaggggagucccugauggguuccugccgccacaccugugaccaucacaugaguguggagagacguuuacugagcaagugagggaggccagccucaagggccggcucugguggcugugcaccggggugacuugggaacaacguguucuacgucagcaagacaggaacccaugaucccagaguugaacacacugggcuugaccccucccaccgggaggcccauggugggcugcugcuguggacuuggagccucagcacucccgagacuaaugcugcguggaugucggguugcaaggcggcugcugcagcuccagcagcuccagccaucacgucgagucuggaagaaggagguggcugcugcugcuuucacagaagcaaacucucccauccccugcugcacccuggcuccuggaccccagcugggugacuugggaaagcagggguggugguauuaagcuugucuuacccgggucauggcuguuaccuggggcuggcacauugcugcugggaccagaaugggauucugcacaccaggcaagagggcgugaaccucggguaggcagcugaccgcuccacaugcuccgggaaaacagcacccauacuccaguagaggcugggccucuccgggccugagugccaggcugcacugagccagggcucccaccgaaggcacacuuuauggcuuugagacagcuccuucugccucucugggcuuugggggaaggcagacauggaagugccgggagucucagaacugccuggggccugaguuucugagcuggcuucuugcaggggaguggcugcugugccuuuaggccucugugccgaugaccugggaggaaggucagccuuccccgcuggagggggcccagcaaagccucagcuccuagaagugaggggccugccauugccugcccgaggaccccacuccugggggccagaugcugagaggggacacugggggcccagcagaccagagagcugaccccagucccacagccuggguggguugucaacuucucgugcccccuccaacuccuccacccccacacccccuuagguaaauaggaggucgaaacagaggccagaggguaaaggaggugcuuagaguccgggcuggcucaggccggccgggcagcugugcuagugcuuggaguuccugcucaguccccguggucuccucgccccucugggcacuugggcugccaggcaccgagcugagugccgagaugcaaagaugagucccaggucugcaggaguuggagcccagcagggagcuggccuuggggccgggccccuccugcucugggcagccacccagcccuacgacccuccugucucuguagggccuccccaaggccuugaauccaccccggccccgugcucagugcaucaugccccccaagccccagcccuccuagaggugugggugggggaggggcugcaacccacacaggcugaggacacagcugcugccacugccuggggccagccacgcauccuccccagacagggaccggucuagcuguaccagccgcugccccggaccugcugcccugccccaccccccccuccccuggccagccuccccagaggccagaaggcgccuuaucgggcaggguuaaggagggggacaguuaucaggggcugcagccuagauugggccacaauguccucgucucuugaggguggcaggcugugcaggcucccugauaaaagcaccggggaagggaggcuccuggagugugcuggaaggaaacacuggccucccacaugccugaggucagggcuuggccugagauggaauucucgcuuggucccauccucccggccugacccugggcaaaugacucuaccacuuugugucuaggucaccuguuaagucaggcgacagacccggugagggagucagcccccgacccuuagugccccucuccuaacagcagccucagagggggucuugacugccgcccuccauccgcuuguuuuacagugaagccacagccuggccaccugucuugaucuccccaccgagaaggccccgccccucccgcugcagccccacagcaugcagccccaggagagccacguccacuauaguaggugggaggacggcagcagggacggagucagccuaggggcuguguccagcacagaagaggccucacgcugccgcaggugaggggccugagggcagccugccagccauagcaggcuggugucucccuccagagacgccugcccuaaccccugcuaccggccccaucacccuccaccccauccuggcugggagcccacgguccagcagcucagcaaaccgcagccuuuggccuucccucugguuggcugugggcggggagagcuuccucuugacuccagcagagcgcccaggccccucccccugacccagaccaacggccacaguccacuuagggggccccucaugcggcccuggccuggggcucaccuccaguugguucucaccccaggaucucccagaggcugugcacgggcaagcugggcaucgccaugaaggugcugggcggcguggcccucuucuggaucaucuucauccugggcuaccucacaggcuacuaugugcacaagugcaaauaaaugcugccccgcaugcacgcggggggcuggccgcacacgugagagcacaggccuggagacacaccccuuguacacauggacccccccacagacacggacccugcggcacacacagcgcacagggcacacgcgcuggcagccaggcacacgaagacaccaggugcacagcugucaucggccccacacgggggcgcacaaacaccuggcacacagcccuucaaaggaccuacaaacagcugggcacacguggcugggaggccugggcccagccucagcaggagcugcaggacacacccaggcugggcccugcggccuggagcccccagcuacagccuccucucucccagggcccagccccuucccuugugaaggccaggaugagggguuccuucagcggacaaaccgagcccaccucccuggcagccccccggggugggauccucccggcugcuuuccuccgugggagcagugugcagagcuguguggcccugggcaggccccuguccucucugggccuuucugacuccugguuuuguaaggguggcuaugugucccccgcccuugucucagaugcaccauaucuuccuuaguaagugggcacaguucuuccuaggcagcccaccacgcgcagaggcugggugugucccucuuggggccggcggcugccagggaggacccgggucuacccucccuccccagggaugggccuggucccuccaaguacuccuugugggccaagagccuguguacagaggcauuaagugucuguugaaugaacgguggaugacagcccuugccauaguuaccuggccaggcgugacauccaggaaggcugugggaagggcuuguuuccccggggcaggccccccucccauguggcucuaggaaugcaccccuaccaauugggcccucuggcgaggacagccggcaggccuggggacccggauguggcuggaccucagcugugucccagggacuucggucccauuccccccaccccgauccuggccuccagucccagcccccggucccaaccuccauucucuugguaggugcuuuccugggucuuguguuuggcccucaccuaccacaaaagaucccaaaaagccuugccagaaacauccccuuagggaagggguccucaccccagggcugggggugggagacacgggcagccacuauccucacgggcacagagaagggaggccacagggccagaugagguuauuggagggcugaggcugcgccugccccaggccaggucccgccgaaagcaucaagucagguaaacaggaggggcugcgccagucuugguagggaggcagacuccacaucauccgccuuuggggcgagcaggcucacuugagaucugccugggccagccgguggcagguggagcugcauggcugauugcacacugccccaaggcuccuggcuccaaacccaaggagggagcccaagggccuguccugggcugcggucugaagcaaugaugcuuuccugggagccuguuguugggugggcugcugccugccccagccccaugacagccuggaucuucaaaaagagaucccuaccucugaccugccacucccaaggagggaaaggaguagccagcugguacccucccugaagcccagcuucacaggacagcacugccuuggggcugcuguaaggaaguggcagaggccgcugggcccagcaguuuggcugcaugggccccagaaggcagcacuccgaccuggggguccuggggcugggccuccccaagaacuggugcggcccaggagacaggcgagggcacaggauggggaugggagcugucccaguucuacagucagaggggaaguggcccuggugcuucugccacgggucccgcaugccagugaugcccacgcacccccacaaaugcuccuucccaccugucaggggcuggcaucagauggcacaggcgcaugucgggucugcccuggaucugucuggcugcaucuggguccgcccuggcaggggcccagcaucuucagccaggggcuccaccagcagcccugccagccccagcaggggaggcuacaggcagacacccacgggugcucauugggccaggcacucaaguaacccacagccgccucucgggcacaccacuuguccccuaagugaccaugguggagacagcagcuccagccccaguacccccagggucauggaccuaggcugagcugagcaguguccuuacagcucugggaggguuggggagaggaugggacaggacccugcugaguggccgccuggccuacccucccagagacucacgaacaggaggaucugcuguggaugcgucuggggccugggcuccucugacugugcaccugggguauccaggcagcccgacaccucugguccaccuugugcuccaggcaggggcccagcagggugaggccaguucccaggaccccuggucaagggcaccagcuuccccaugacaguggcaggugccucuugcucccugcuggcaagaucuggguggggacaggaggcccucagccuccccacauagaagccaccacugggcuagagugagcuuugugacacuucgagcaacaaccucuggcagugccggugggaaaggaucugcugggccaggugcggagcuguuuuuauuagugagucggggggugggguggggugaagaaaacaucagagacaccugugcugcgaguuaaauacauuuccagcaucucacgcaucacaagcugcaucaggaaagggcacagcauguggcagccucauccacacccacgcagugacagauguguuacagcauggacaccaaguccccgggagccaagauggcagcuccagcaucccucccuuccucccuuccuccuucccgggcugggccgggccaugcagagaaagggcagccucugccauggcagccccaaaucaccucucagagcaacugucugggguccccagccccagaacuccagcagaguccuggccuggggaagcccccgugccgccucaagccuccagcagggcaggccccuggccaacuguggcaucugccuugacugcccagagcagcaggaaucagguuuugggaggacacaaggcaaggcagucaucugacacacccacggcaguccagcuggcacugagugugugggccucguccugucuggaguccccucccucccacagugggcgagacgggaaggccuggcggugaccagacaaguggguccaggucucaaggcagccuggcccauguccugcaaggcucugaagagccacccagcuguuagucugcccacugcacagggccccgggccucucagguugacaacuaaaggugugugggcuguggggcucuugcagaugcuucccaaaaucaccagucauuucuacagacacagaaaucgagacacugaacagagaacaaauggugucauucgauaaagcugaugagucugcuucucacauggcacccagaucguaaggcaguggggucuguaaaaucaucgcgguggcuggccguguccucaugagccaagcacacugacucccgggaguggugugcacgcacauguggugccuggacauacacgaagacacauggacgugggggucugaccuggacauucacaacggaaacgucuacaacagaaggcgcccaggacccaccuuucuggcgcauaaaugaagauuuuuggcucaaaaaccuaagcauccuccagcuuuugcuaccaucugucccucggcuggcugaggacugccgaugcuucccaagcagaggcgucugguccacuccuggggcuccaccugccugucacugcagcaccagcgugcacacgauggaaaccccaccgaugccgcucuccuccgcuuggccccgcugagccagggugaggugcugccacugccuucagccuacaggcugcuugccugaaggggucuccacaucuccacccccacaaagcaauccaacagcaguaugaagagacgcaauucugccaauucuaaggucacauuaaaacuuuuccccccaagauuaugaucacugccagcuggagaacccaacgcccuugcacaugccaagcugcauccuggcaugauaugguuuuacaagaugcugcgucauagaaagugaccgugccguucaaggaaacgcacaucgguuggcuucccaaguuuucgggucuccgaaccagugacagucacgugucgcucagugacacaugagaaacgugugcuuagccgcugcugugugaucacagagucuuuacacaagccucgauggugcauguaguuuuauuuauguguuuucaucuggaaaaccaagugucccagcagcaugacugaacaucacucacuuccccuacuugaucuacaaggccaacgacgagagcccagaccaggauuccaaacacacugcacgagaauauuguggauccgcugucagguaaguguccgucacugacccagacgcuguuacguggcacaugacuguacagugccacguaacagcacuguacuuuucucccauaaacaguuaccugccauguaucuacaugauucagaacauuuugaacaguuaauucugacacuugaauaaucccaucaaaaaccguaaaaucacuuugauguuguaacgacaacauagcaucacuuuacgacagaaucaucuggaaaaacagaacaacgaauacauacaucuuaaaaaaugcuggggugggccaggcacagcucacgccuguaaucccagcacuuugggaggcugaggcggguggaucacguaaucccagcacuuugaggggcagagguggacagaucaugaggucaagagaucaagaccauccuggucaaaauggugaaaccccgucucuacuaaaaauacaaaaauuagcugagcuuaguggcacacaccuguagucccagcuacuugggaggcugaggcaggagaaucgcuugaacccaggagacacaggcugcagugacucgagaucacgccacugcacuccagccuggcgacagagcgagacuccaucucaaaaaaaaaaaccaacaaaaaaacuggggugaaaaucuaacggauaauucagcauugccgcauagaaaccuccgcaaaaccggccaaacaaacgcggacaggcggcccuggcgucagcgcacgacagucacguggggaggggcaguggccaggucggccuuggacggguacaccaccuucaggcucccuuccagauccaccacccggaccugcuccaccaccagaagggagggcccguccuuuccagcacugggauucguugugggaucuggaaguuguccagagacugcaucggcuucaguaucugagagugauccuuccucuuuauuuucuaaagugua

SEQ ID NO: 14253 - RNA, 1497 nt, Homo sapiens
uggcccaucgcuccaccucccuaggucuucguuuucucaucugcagaguggggaugaaaucaacauguacuggccaggcgugguggcucaugccugucaucccagcaauuugggaggacgaggcaggcggaucaccugagguccggaguucaagacuggccuagccaauauggugaaaccccgucucuacuaaaacuacaaaaaaaaauuagcugggcgugguggugggcaccuguaaucccagcuacuugggaggaugagcaaggagaauugcuugaacccgggaggcagagguugcagugagcugagaucacgccacagcacuccagccugggugacagagcaagacucugucucgaaaaaaaccaaaaaagaaaucaacguggacuucguaggaugguuguggggaucaagaggguccagaaguaugguaaccugagacuucaucggaagugacucucgcccgggagcccuccuggaaccaauguccaggaagcucccaugcacgaggcaugaccuccacgccuuggcacaaaaacccagccaggaggaacgacggcugggcaggcuccgccgaggaacagggacgggaauccagauucacuacgcagaggacagucgcuaagcccugggcacagggacggauggggaagagcaggugcucucgggggcaggugcucacaggggucggggucucuccuguuccccgagguguccagauagccaguaccgacaggacgcucagaaacucuugguuggaugaaacagacccugaaauccacgcgggccauccaacugggggaaguggccacggugugccacugcccgccaugucggccacagccccaagcccagacagugcccaggguccaggcugccuuccucagaauguggagggcggggacagccccuugaaagacucuuuguccucaccggccaggagcuggaggggagcugggccccaucaucacccucccgccgcauggguucuguucuauuucagauuaaguuggauuuugugguuuuguuaaaagauucccauugcaccuguugacuguuuaaaauguguaaaccgucucaagugacuuuuuuuuuuuuugagacgaagucucacugugucgcccaggcuggagugcaguggugggaucucggcucacugcaacuuccaccuccuggguucaagcgauuaucuugccucagccuccccaguagcugggauuacagacgcuaauuuuuguauuuuuaguagagacggggguuucaccauguuggccaggcuggucucgaacuccugaccucaggugaucugcccaccucagccucccaaagugcugggauuacaggcguggggcauuugagugauuuuuuuuacaaguagaugggaaauaaaucuuuuucaaguuugugucccuguuccccccuaguccacuccucucgcuucccgguauccacagugccuuuuaucagagccuaggauauuuaagacacaaugcaaag

SEQ ID NO: 14254 - RNA, 1497 nt, Homo sapiens
cuuugcauugugucuuaaauauccuaggcucugauaaaaggcacuguggauaccgggaagcgagaggaguggacuaggggggaacagggacacaaacuugaaaaagauuuauuucccaucuacuuguaaaaaaaaucacucaaaugccccacgccuguaaucccagcacuuugggaggcugaggugggcagaucaccugaggucaggaguucgagaccagccuggccaacauggugaaacccccgucucuacuaaaaauacaaaaauuagcgucuguaaucccagcuacuggggaggcugaggcaagauaaucgcuugaacccaggagguggaaguugcagugagccgagaucccaccacugcacuccagccugggcgacacagugagacuucgucucaaaaaaaaaaaaagucacuugagacgguuuacacauuuuaaacagucaacaggugcaaugggaaucuuuuaacaaaaccacaaaauccaacuuaaucugaaauagaacagaacccaugcggcgggagggugaugauggggcccagcuccccuccagcuccuggccggugaggacaaagagucuuucaaggggcuguccccgcccuccacauucugaggaaggcagccuggacccugggcacugucugggcuuggggcuguggccgacauggcgggcaguggcacaccguggccacuucccccaguuggauggcccgcguggauuucagggucuguuucauccaaccaagaguuucugagcguccugucgguacuggcuaucuggacaccucggggaacaggagagaccccgaccccugugagcaccugcccccgagagcaccugcucuuccccauccgucccugugcccagggcuuagcgacuguccucugcguagugaaucuggauucccgucccuguuccucggcggagccugcccagccgucguuccuccuggcuggguuuuugugccaaggcguggaggucaugccucgugcaugggagcuuccuggacauugguuccaggagggcucccgggcgagagucacuuccgaugaagucucagguuaccauacuucuggacccucuugauccccacaaccauccuacgaaguccacguugauuucuuuuuugguuuuuuucgagacagagucuugcucugucacccaggcuggagugcuguggcgugaucucagcucacugcaaccucugccucccggguucaagcaauucuccuugcucauccucccaaguagcugggauuacaggugcccaccaccacgcccagcuaauuuuuuuuuguaguuuuaguagagacgggguuucaccauauuggcuaggccagucuugaacuccggaccucaggugauccgccugccucguccucccaaauugcugggaugacaggcaugagccaccacgccuggccaguacauguugauuucauccccacucugcagaugagaaaacgaagaccuagggagguggagcgaugggcca

SEQ ID NO: 14255 - RNA, 5878 nt, Homo sapiens
cggcccggcgaggggcgggagcgauugugaacggcggcggggcagagccaaucgcggaaaacggcaggaggagagccaaucccgagggucggcggacgcgggaaggggcggagccagaggcggggccggcaaggcggagccaaucgcggcgguccgcggggcggggccgggggcgcggccgggugguggcgguggcugcggcgacggcggucgcgucggcgucagggucggggucgguaaggggugcggcaaugcugcaacugcgggacucgguggacucggccgguacgagccccacggcggugcuggcggccggcgaggaggugggggcaggcggcggcccgggcggggggcggccgggggcggggacgccgcugcgccagacacucuggccucucagcauccacgaccccacgcgccgcgcccgcgucaaggaguacuucguguuccgggugaggcaggggccagggccggggcgggggccgagggcgcggggcgggaugggggcggguggggucggaggcgggcgccgggcggucccgcagggagcgagcugugaccugugaucuuugcccccgucccccaccccgcaacccgcccagcccggcagcaucgagcaggcaguggaggagauccgcgugguggugcggcccguggaggacggcgagauccagggaguguggcugcuuaccgaguaagccggggcugcgcucuccuugguggggggacucgccccgagccgccgcgcagcaccuugcgaggacuucccggggugcucgugccacgcucaggcgccccgugccgccccugcugcccuuccaggcgggcuggccuuggcuaagucgagacagccgcguccaguguggacugaggccccuccucugccuacaggguggaucacuggaacaaugagaaggagcggcuggugcuggucacggagcagucccugcuuaucuguaaauacgacuucaucagucuccagugccagcagguggugcggauagcgcucaacgcaguagacaccauuuccuacggagaauuccaguuucccccuaaaucgcucaacaaguaagccuguucagaguccaguaucacuggaccuaagcaccagaguggaccuuacaauucagcccuuuuaaaucagccccccaagcggugugucuucucugucauuaauuauaagcacaaaggcuccagcuccaaauaucaaugggaaguuccuuaaaaagaagcgacuucugggcaauugagugcauuaaaaggaauucuggcacagaaggcagcuauuaggcugguaguaaaaagacuuacaugaguucaggaugcauugaaguagagcccagcguguuaaaaaggaacuuggauguucuucaggaaaaguccaaacucugcauuuuucuccagccagggacagauugcauaugacacaucaagucuugcucuggcuaauuuuuuaaagagaaauggagggucccguuguaauuuauagauaccacuaaaagacaaauuuggaaauauuuaaugaccagcuuucaggaguugaucuuuuugcuguaggauaauuuucugacgugaggaaccuaaacauuacuacagucaguuaagcuguagaacuuggguuuuugauggagagauuuggaugggggauucaggaagcuaaaauaaaaauuuuaccuuuugguuaaaacauuuaauaugacauaaggaaaaggaagauuacacuuccuuuucacucauuuggcuagccuaucuauaauuauucccuuuuuuuuuuuuuuuugagacggagucccacucugucacccaggcaccaguggugcagucuugguucacugcauccuccaccuccuaggcuuaagugauccucucaccucagccucccaaguagcuaggacuacaggugcccgccaccacacccagcuaauuuuuguauuuuuuguagagaugggguuuugcuagguugcccaggcuguucucaaacuccugggcucaagagauccgcccauuuuggccucccaaagcgcugggauuauagaugucagccaccgugcccagccaguauuccuguuuauuaauuuuuaaucauguaaagauuaccaaaauaauacauuuaauaaccaaaauauaccuaauuugucauauuuauacccacaguauuuaaagcaauuguuaguggagauugaaguuacuacuaaaaaccacaggccggccaggcacgguggcucacgccuguaaucccagcaccuugggaggcugaggcgggcggaucaccugaggucaggaguuugagaccagccugaccaaaauggauaaacccugucucuacuaaaaauacaaaauuagcugggugugguggugcaugccuguaaucccagcuacuccggaggcugaguugggagaaucgcuugaacccaggagguggaggaugcagcgagccaacaucaggccacuacacucaagccugggcaacaagagcaaaacuccaucucaaaaaauaaaaauaaauaaaaacaaaaauaaaaacuacaagccguuuuccauugugauaugucauaggucuuuucuguaaacgugugcuuuuugcugucauauucuccuaacugaugagacugucagauuguccaugagagcacuguggccugccaugcuaagucuggcuauuucuucugacuuuucaggcgagaagguuuugggauucgaauucagugggacaagcaaagucguccuuccuucauaaacagauggaaucccuggucuaccaacgugcccuaugccacuuucacagaacacccgauggcuggcgcagaugagaagacagcaucucugugucagguaagaagacaggcacauaaauagccgcgccccccgcagugauggaaacaccccccgcagucacggagacacuucaggucugcacuguccggcggccacgcggagcugccgagcacuugagacguggcuagaaaugagagaggaagcucucauuuuagaguugauucccuaaguugucagaaauucugguuaauuuauguuaaaguagccgcauguggccaguggcugcugguuagcauagcuccauaauguggccuccugauggugaucuggguggggaagggccccagcugggcuucagagaguggcagcagacccagccgugccagaugaccagugcggaugcgcaccaggagaggaggccucggggcugggguuagagcagagcccagagcccagagccuggcggggguccugcacuuccccagcugugugccucggccugguuacugaccugguagguugggugacggcaaagccacucagcccuguauacaggaaggguucugcaggugcuggcugccauuggccacaggagagcaugguggcaagauuuccacacaccuagagagcuccguggggacgagaguugagagacccccaggauguggcagaggcagcccuuucaagugaagggacgaagagauaggcggcauuuggagggauuuaagugucucagaaugcuaauuuuuucaaguaauagacauucuuaucuugccugacaguuaaagcuccauguuuuucucucuuuaaaguuggaaagcuucaaggcucuguuaauccaagcugucaaaaaagcccaaaaagaaagcccuuugccaggacaggcgaauggcgugcugauccuggagcgcccccugcucaucgagaccuacgugggacucauguccuucauuaacaacgaggcgaaacugggcuacuccaugaccaggggcaaaauaggcuuuuagccgcugcguucugggagcuccucccccuucugggagcuccucccccuccccagaaggccaagggaugugggggcugggggacugggaggccuggcagucuucaugcugcccugcugcugcuggaaggauggggaucuuucaccuuuagggaucucagcacaauuagaaucguaaagugaauucuaucuauuuaauuggauauuggacucugcucauauaagcuacagacaaaagccaaaagacucucgcugucccugugcugcugguauuucauucucuguaacuucaguucugguguuuuccuugaguaucuacuuggcuucucgugguuuuucccaccccagcugccccagcacgcgggacccauagcacaccccuuagcgcuugccuagguugcugaaaacagggaggcaccugguaucucgagugccugcaguugcaaguauguuuacaccugguguccaauuuuguauuuuaaaauguaauccauuuuuacuucagcucauccaaaagcagccagcagaccgguugacugagaccggucuguggcugugggccccuuggugacccgcugcucuuuuggaaaugggugaccugaagugacacuuuuuccacaauuaacccaaguuguguuaauacuucaggucuguuucccagacccagaaagcuuuacagaaaaucauuguaagacaauuuauuaauuugagaaagucaccuugacaguucuuugcacacaaguuuuacaccucucuggauucgaaguuuguauuguauucauaguuaaagggaaucggguacuuugcuuguugaauaaugcacuuuaaaacaaggaaccguaucaggccagcaugguggcucaugccuguaaucccagcauuuugggaggcucaggcagacaaaucgcucuagcucagaaguugcagagcagccugggcaacauggugaaacccgucucuaccaaacagacaaaaagcagccaggcgugguggcacaucuguggucccagcuacuugagaggcugagccaggaggaucgcuugagcccaggaggcggagguugcagugagcugagauggcaccacuuauugcacuccagcccgggcgacagagcgagacuccaucuaccagauccuuaugacgcagcugaugccugccuugguuccuaccacucugguguagacagaggacuuuguccaagucucacacuaaacaugcccgggcuucgaugugccuggaggauuuccccacagggacccacgcaccucccuguaucugcgcagcuugcucguguggcuggaagcgcugucgauaagcuucacgcacuggcuugccaguucuucagcucuaggacuuguagcuuuaagcaaacgguguggcauggguugaguguggccaccugcaggaugugcagggcugccucagaagcuggcuggggacucuagccucuguguucauaaagacauuaagaaguggauggauguuguuccuuuuuugaaguugucauuaaaguaggugcaacaaccaagaaagugucucuucccucuuugaaagccugccccaucucugccggcucugcaccugugggccuguucugccuguaccaugcggacugccugucacagcagugccgaguaugguucucugcagaaagagaucacgauaugcaacaaccuagguuugcaacccugauccccccaccuguggugccaaccaagucuggcugccugccgagcaccagcuggagagauugauggaaugguucugggugguucuaggcacuuccugcaaauagccaggguggagacccacgcacacugguuccgaaaccagaguagacaugagacuuccugaggaacugacucagcuggucggggaccugcagcucccaucccgaggggacuggaccuggggguggcgcugcucucaggugccagggcucccugcccacacuucagacccacuguggggaggcuggaugugccccacagagaugcccccucguuguccuaacacauccaaacagagaacccagagcaggccgggugucuggcgggagcuaguggcccggggcucaguuacuguagggcuauccaucuu

SEQ ID NO: 14256 - RNA, 4667 nt, Homo sapiens
ugugagcagagggagguggggccggagugugggguugcucagcagaggccccgaggcaggagagcccugaggccccgagggcacagcugcagguggacagcagugaugcuggggugcagcgacccuggccgguaggggccaguucagacagcagggugguccuggcacucagaaugggagggggcacugauggagucucugcgggccccccguggaagccaggcacacaggugcgccagucuccauauucccucucagcucgucuugacugaggacagcucugggccguuuccagaugaggaugcugaggcugagucugucacagcaaacggagggggcagggagcuggggcccagugccaggaaacgggguggccucagguccagcaggcuggggucuggguguguggccacuacccaacucugugaccuggggcuggggugacuuggggguuagccugccuggcacagucugcccagccacuccugcccacccccaccacccccaucuccuugccacggcccccauggguggcugucagaagucaaggaacaucagacgggcaggaucggucuccaggccuggcucaugcugucucugguccccaggagugaccgggcacgguggaucguggcgcucacacacagugagagacaguggcagggccucuccagcaaaggaggugagugcgggcuggggccugcagggcuggcccucugccguggcuggcacuuuggcccccacuguagcccaagugagccuggcaccuggccuugugcuggggccuggcagucgggggauggggugccccggccccgggggaugugucugcuggaggccguuggggaguggagccuggcccaugccucccgacagcccugugauggccacugcccuaugcagaccugccccagguggagaucaccaaggccuucuucgcgaagcaagcagacgaggucacacugcagcaggcggacgugguccugguucugcagcaggaggauggugagugcaggggcguugggcacagaugggugggaacggacaggcgggcgugagucagcguccagccuggccagguccagagcaugccgggcugcaggcugaccaugugcucacccucucucgagggcuuccucaaagggagcacucccacauccccaaaccucagaaucaaaagcagguucauggucacugugucccacguggggaggaggaggugucucugcccucccaggggauccccgcucagccaggcccagcacgagccugcagagggcaggcagggcuccuccucaugccgggcagcgcuguguggggugugcucagcccagcacccuucucaguggcgagcaccugagcaggggcugggugcccggugaccaugagcaaggccucagcagcugucugcucugagcaggagcagguggucaguucuaggagaagccuggcccuggugugcucaggcauagcagcucagaggggccgggggacccacggccuuccccucaccucccucccaccccuauccggguucaggguggcucuauggcgagaggcuccgggacggagagacgggaugguuccccgaggacuuugcccgcuucaucaccagccguguggccguggagggcaauguccgcaggauggagcgucugcggguggagacggacguguagcccuggcgaggccagccggcggcagcacagccugucuccaaucagcaaguggucgugccuggcucuagagagcguggggagcuggucucaaggacccagcaugguucccuggggcuucccaagagccuguggcuguggugccgggcuccagacacuucacggaaggaagaucacauguccccagagaggcacccccaggcaagcucgagggggccacaccgugucccagggagcccagccuauucccguuggcuggcugggccccucagcugcugggccccaccuccccacugcacccagggggcaacuccaccuggacugaugggcacaggaggcaccaauagcgauuauugggggcaaugcgaggucuccuccuaugcccuuccuaccccugagugggacaagaagggcccugagugcccaggagugccccacguucugagaaggggccggccggagggaggggacccggcagggagauuucgguuuugagguuucuaaauacauuaaaguuauuucuuaagaaccuggauuuucacagugacucugagcccaggcaaagaccguggccacacauuuuccagggacauacucaggaugccgcgggccggcaccaggcccccugugcauggcccccuuguguugggugccgugucauguguggucgccccaagcucgccccugguguggccagucugcccaccggcuggagcacuggagcagggccagcggccccugaucguguacugagaagccaggggcggcacagcugcgccuugcagggcccaggcuggccagugguuuagaggacuccgggauucaguagagcuuuuggggaucccucugcaguguccccaggguuggagacaggccccaccucccucccaguuuuuccucccagccaucucguccugggagcugcaggcagaagaggcagucccugagccagucggcugaccugggguggcacagcaagaggaggacugguccucucugucccaggaagcccccaccagcccuccuguguccgacgccaaugcccguugccuuugugggcuuggguaaugcuguccucagggagggagcacccagcauacaccugagaaucugcccugauccuccugggucuggggcccuggcuucugcaggaaagucaggggugcaucuaccccauaugccaaccagaaauggugauaggagacugcccuccaccccucccaggcuuggggcagcugcaggaccuggugcaugagagguggggugggcugaaagaacacgcugcucccagcccccgccugcuggaccagggcuuaggggaggaggcgaggucuggagggccgugcagugcgaggagggccagcuccucucccggucaccuccauggccuugggcagcagcaauggcccaguccaggcucggagcccacgcaggacuguccugggcagggcuuuggucagcggccgccucgcagggcggggcacagccagggcucugggaaagaggaggcaccugggagcagaauccccugagauggggccagcuccuccacgcccagcguggcaucuccagccuccgcuguccugccugugaacugguuacucccugggcuuuuccuggagcuccugugggagcaaacuggcagccagggcagggcauguguguuggcagguggugugugcaugugugcuagcaugccugucucugugugugcguguguguuggggggcgggggggcggguagccagggggcagcaguuucguguaaacccagcugcccugcagccuccgggcgguucucacugccaaguucaugcucagcucacggagcaaggcggaucuggaaagccuggccucugacucugugaccucacucucacguaugugaccuggggcaggugacucagccucugcgccucaguuccgucugcaaguggcuacagcagccucugcguuuuagcgggcagugagaaugcucagccugcagggaggggguccgggcccaggcuggguggcuguccugcuauggcaguggccaggcuguuguugggggcaucuggggcaaccuggggagggcccaguucaggccugcucaggacgagagccccucccggcagagucaggaagcgcaggccugggcugccagugaggugugggcccaggcaggggcgagaccuaugggcaggaggggcgucaggagagggggccacaggcuuguguagccccguccccagcaccagugccagcucacgcccguccgagggccccugcucagccuggggugccgccuucacuggcccaggugcuauggcccccucagcaggacagagccagccuggacccccaggacgaucacccccuccccggggucuucuugcucacucuccucauggaaccucagccugucccguacuuccaguguugggguccagggacacuuccccgcccacagucagauaauagggcuccugcgggggcucugccacacgggcucagcuggagaggggucccaggagacagacagggcuuaccuugcucagcccuccugugcagccacauagccuggguagcucucuggcugcacagacccuccuguugcagggggugaaacugaggcccaaagacccucuucccacugcagggggcuaucagggcucuaaagacacccgucuagccaacaaggccugugccccgaguagguugccagggugcccacagugcuuggugucccagcccauccuucaggccauuguuggccuggggugcugugggggcuguguggaugcagggcagugggagggggcugcugcugaggccuugcgcccaagcccuguccccaaggccacccugggcaggauagcccaggccgagggcugggguucaucuuggcaaacuucagugcccagcccugggcgggcacagaguggacacugcuggguccagacaggcaccaccuaaccuuuccugcggccaggggagcaaggggggugu

SEQ ID NO: 14257 - RNA, 2066 nt, Homo sapiens
ggcgaaggcgauuaggggaaacaacaacaacacacaaaaacccccagccuuccuucauugacacagagaaggagggagggggggagagagaggagagagagagagaacgcucacacacauuuggcagaugaaguuugcuccuggauggagcaggauaacuauguggggaggcugggggacuuuguaaggugggaggguuucaggagcucuccuuguccccauccucaucguggccuuccucugaccugcagacugucuuugcuaccucauuagcuacacaaaaacaaauccuuccgauucgguacagagacaccaucucucucucccucuccuuuccaggaccgauuucagaaacagucuagggcacaccaggguugagaggagccacccagagugaugcagacugucccagcucucuaaacugccacccagacacaccgguccugucccuaaaggucgguccucccccaccacgugggagaaccuugucacgguccuggaaacccugcacucaggacucccugggccacuccagggcucaggcgguccgcuccuuaagggacagugacuuggguccauuuuauguucccgcccccccccccgguggggaaggacggcauucgggggcgagggucccaugccuggaccuuauuccuuggggucugacacugggugacucccuaauuacauuucauauucagaugaaugaaacucugcaaccaacugauguuuuccccacaaucggcaauaaaucgcagccagggcgcgaacaguguucacauucgcuccuauuaaugcuuccugucucuggacgcugggccggguccagauucgcugcacuacaaggcuuccugcuggaggagugaggccucuaggcugcguuccaguuacaacuggcagcuaaugccuucacacauucgcaaaucccaggcccgccggggcaggaggcggcgagguuugccuggggucagcaacugcggcacuggcggaagccccugggaggugguucuggcccccaggcggggugaguggagcgggguccgcacggccucgcaggcgcaggugaggggcugggagggaaggacucuugagcaggcccaaagggacuauuucaaauuuuggauacaaguuuccauucacaucugaauuccucuuuccagguuguuucucuccccuggaugccuguggggguggggacggcagagccucggacacugcccggggaucacucucaggcuacuuuucccacccugccaagcugcucgagacgucaaaggagaccaggccggucagcacacaggcuucugguaagugccgcccuccggucugggagcucagcucuccccuucugacucaccgcucggcgcugacucaucgugacggcgaguggggcuccagcuccgcggcauuucauagacagcgcggucacauuccuuuccaacagucgcucuggccucgaugucuaaggcuccgugggcagccggccuguggaugaggcggcggaaaccacauccucuucaucauccucucacgaggaaggacacugacagcuucggagaaggcugcccagugucugcgggugcccuugggagauggccuugggacacggugccugugccuguguguguacaccacgugugaacgccaacugggaacacggccccuucguaggcaaacccaggccuccuggaagucacaaguugauagcuguacucgccccuuuuggaagacgcacgcccaaggcacccgugugugcacacguauccguguguggaccucuguccacacguguguguuuugaaaagccuuucucaccacauguuaggaucacaaguguucaaaaucuaggcacacuuuucagaaguuauuucuggaaaaaauguugaaucucauaacagcaauaaaaggaaaauaccgccucagccaacauaaaugucuccuuggaacaugccugaaaagcggcggaguauuuguguaaguuucaauuccagcgucagagccugcagcuuggccgaggccggguucugcacaggagggugcacggucccuuuccgaaagccccucac

SEQ ID NO: 14258 - RNA, 18019 nt, Homo sapiens
cuggccgggcacuuucaaaauggcggaguguggagcgagcggcagcgggagcagcggggacagucuggacaagagcaucacgcugccccccgacgagaucuuccgcaaccuggagaacgccaagcgcuucgccaucgacauagguagccgcaggccgggcgccgggcgcgggcugcgggggcgggcggggcgccggcggugggccggcgagcgggggcggcgggaaggacgaagggcgggggcgcgggccucgcgcacagccucacgggccuuguaguccgcgggcccgcgcacagccucacgggccuuguaguccgcagggucgcugaugcgcgggcucggggcgacggccggacuacagcuaccggcaggcgccgcagggaccagagcggggccugccgggccugguaguucgcgcggccguccuggguggcugggggccgggguccagcguuacccgccgcgaggugggagggucggcggaauuuuaugucuucggccacaucggcaucugggcgccccggcuccgccgcuuggcugguggcuggccugagauuugggguccuuaguucuggucgagacgaggacgagcucggcgggaagcccuuggcagaguggccccgaaaaggccgcgcguucccgcggcguggccagcuguggcccgcgggccggacaguccgugcacaggccccgcucucuggagaguggacgccgggcgugaguucaggcggccguggacgugggaccugggaacucgugccucugguuuaaaagccacccgugccuuccguggccuuuaaggcggccugcacuucugcccuggccucuccaggguccgcugcagacccuccugccugauggcugugcucucaguaaugacggcgggccaggcucuguucuagaccuuuuucccacgcuccugacucccggacaccucccagccaccucuaggggaggaacgcgaauuacucccuuuucgcagaugaggauaccaagccccagaaaggugaacuaauuugcccagggucaucgggcuagaaaguggcagaaccaggauuugaaccagccacucccugcucuccuacucugcccauguuucaggcaugagggcuuccugggggcagcuucaccuggagaaaccccccuugaauagccgcugcggcuucacauaccucucccucuuagcacucaucucggucguaggcugagucugcuugugugugaaucccacaagagcagcggugugucuuguagccccagcccccgaaaaggaugcccaaccugucuuugccgcccaguaaauacugggaugaaugggccugccgcugacugcuucccaccucccuggaaaagcugggacucagagagacccaggccauucccucugagcugugugcuccuggugcaucugacauguuugcugcugugguguccucgggguuguuggugucaucaucucucugagauguccagccagggaaggguguccucuagggaaguggggggcgaugagaauggaaguagcuauagguccuggcucccaccuuucagugagcuuaugggaggcaaugcuucuuaggggguguggccuggugccagguaugagaacgugugaguagcaucuuuagggaccgcugauaggacuugggacugacugguuauugggcugcaggugcugagcuugcagcccuagccuaggggauugucuaccgcaggccucaccagaggcuccccagccaugcuucccagccuucugagaccuugaggcccgguagagcgugugcucugcaagguucugcugcccuuacacugggggauucuguuacuggaagcaagucgggauuaaauguuucugaaaugcaauugcaguugaccugcauaagucacuuggggaauggccaggagaacagggcucaccguggauguucuguguggccccgagaggccagugaagccgcagagcuggggcuguccaggaagggcugucgcagcccuagagggcccuggaguaccagccuguucuccaggcugagcccaggggguuucuugguagaaggauacucuaagaggucuguuuagugcugguauuuauuuccccucuucaaaguuucucccugcgucuggguccugugucucugguucuuaagaggaccuguugacugauacugagagaccuuuuguuuguuacuccugaccgagcugcugggaggccacgcucaggguggggugucuucaacccaggaacccucaaagccaaagugcuugucaacaguguuguuuaaaagcaggcuucucccauuuccucuucccuugccugugucuggaucuaggaaagcucaccugcccuguguucuggcaagcuguuuuccucucgaugggacgcugaugucugcugagcagauucaccucuuugaaagcagcagggacguuguauuucucaaaacauacugcagcuucgaucugauuuuagguuucugcgggcuguggggaggguuccucagaggcaggugagacaggaaggggccacggggcgguggugucugcuuggcuguccugcccuccauuggugcccaaagaggaaacacaggaccagagagaauggcagaggggauggggccugugggacagggagaacuagaaggccauggcucagaugugaagagcacaggugaccaaaccucugggaagcccccuucccccaccagcuguuggccucagggccgagcgcgggcagcccggagagccgccaggaggcacuccugucacugccuugccaggcgcgguuugcugugauuccgaggggucccugagcucagcccggaaggguccccgcccgcaggcgguucccucugcucuaacagaucucccugcugugcgugccccucgcgccucaggucccguuuuguccccccggguguggggaguaggcagacggaacacuggccuugcugggccucuccgugcaggggucucagggagggaggaugcguaucuugcagaaaccaacccacccccaccucugucccaaccccaguacauccuguuugggcauguauuuaacacaaagaacccagggccugaaacuggauuucugugaccugagaguuuguuuauacugacuuuugaugagucucuuaaaauagaucuucauccucuugcaucaucugucguuuuagaaaacgauuuauuuacugaggugagucggcggcauggugcauguuagugagacucuccgggcccggccagcacugggggcaggggaggggauaaggaggcuuaaagccacaggcuaggggaucagauugagccugugacgcguccaccagacuguacgccagccgucggggagccugcccucaccaccaggcaggaggugcccugggauggcuguuguggggccuggacacgguggguuuugcuacaugaacagcauuggcuguuugcuugguguuuccaaaucuuuuuacugaccugagugcuuguucucagacauccuuauaguauuuugucaaaaaacaauaauuugaaaauaacuuuagccucauuacucucaugaugugggauuuuugccucuuuuugucaggcccuguaagaaaugcacuguguuaagucacuauagcaccauccagugcccuccguuaagucacuauaacaccacacgguccccucuguuaagucacuauagcaccauacggugcccucuguuaagucacuauagcacacacagugcucuccguuaagucacuauagcaccacacgguccccuccguuaagucacuauagcaccauccagugcccuccguuaagucacuauagcaccauacgguccccuccguuaaguuacuauaacacacacggugcccuccguuaagucacuauaacacacacagugcccucuguuaagucacuguagcaccgcgcaaugcacucaaagucacauuuuguuucuuuuucuauuugucauucauguuguuucaaaucuaugaauacaacucuagccucaacaaugucuguuuuuuuuuuuaacuuagaagaauuuguccuugaaaaggccuucuucaagaaucuuuucacuuuucccugaaaucugguucagguacauagagccccuuccauuuccugauauuuauucaaccuuugaucacaggcggcauccuggaagccacagggcuucucgagagcaucagagagacuuuggccuguggggaaacggacuuugguggccucugacuucuggcuacuuuuggggcuggggcugcauuuucugccuggagccucucaagaguagccagcggcaccguuugccucuccaggguaggggagcugcucaggccccguuaccgcccugggcugugaggagagccuccuuuguaagcagggacggucgaggguguacuucuuaaaacgaaaacagccuggauuugucagcuuaucgcuuugggucauuagcaagaucacuugaaacugaauuuucuuaaagcagugaggauaaccaagguuacccaaagcaagacagcucucccuuuccucugcaggacuuggugccaaggggaagcgggaccucuugagcucaguuuggccagggagcugaggaggagcagaauuugagaaagaaaaguguagauuugauuguucguuuuccuguccucucuuuugugcccacaggguuuuuaaguuccaguagccccaaaccccucaucuacagagacuuuagucuccaggacacccagagaguguggggcauggacccccaggccccgcuguguccugguccugaauccugcccgguuugugucuccccugcaggcgggucguuaaccaagcuggccuacuauucaacgguacagcacaaagucgccaaggugcggucuuucgaccacuccggaaaggugagccugcacuguggccacccggggcagggcagccgcuucucugucgucuuggaccuggcacuugucucgcagucaucccucugcugcugcagaccucgacuuuaguguccugggaguuucuagcagggacagccuccccugccuuccgccgugucccuucaagacccuuuguaggaaccugcgcccgccugugcucccccgggagaggcuuccgcuccugcuggguggcccugaggucgccacgguccuaggcuccucccucuugcccaggauucugccucagagcgccgccugguugaaggcuggcgcgaacagccagcuccacuagggcagggugcgcacagcccagcccggcgcggugucccacacacaugcggccuccccuacucuguuuuccaggacacagaacgugaacaugagccgcccuaugagauuucaguucaagaagagaucacugcucgacugcacuucauuaaguuugagaauaccuacaucgaagccugccuggacuucaucaaagaccaucucgucaacacagagaccaaggucauccaggcgaccgggggcggggccuacaaguucaaagaccucaucgaagagaagcugcggcugaagugaguggggaucucaagggcgagaaaggaacaugugucugcccccgagucccugggugucccagagccgcgucccuggcgcucgugugucagauugcgcauggggcauggcugccccuucggaccaggcaggcuugcaugguugcaccugucuguggcccagacucuuuaagggguuggcgcuuccuuuucagagucgacaaggaggacgugaugacgugccugauuaaggggugcaacuucgugcucaagaacaucccccaugaggccuucguguaccagaaggauuccgacccugaguuccgguuccagaccaaccacccccacauuuuccccuaucuucuugucaauaucggcucuggagucuccaucgugaagguaagacccggcuucaugaaugaaugaguggaugguuuagccauaguuuguuaagcccucgcugugugcaggagccagggcugggcacauggauggggcccagugggcgggagggggguggcgaggcugugagcucagagccucugugggaggggcaucagcgcccccaggcuuggccaugagaguccucccacuggcgguuggggugggggcgggguucaccccagcgcagcacauggggcggggggcgggggagccuguguggcugagggcccacugagggcacaccugcccuggcucuguugcagguggagacggaggacagguucgagugggucggcggcagcuccauuggaggcggcaccuucugggggcuuggcgcucugcucaccaaaacgaagguaugcggcagcugccagagaccuuccaggggucugcggagaugucugcuuccuucccccgaaggccugcagcugggcggugcaaaagcugcuuccgggccucccuccugacucgcgucagugggucucuggccucugcggcuucacucuuugcgcccugaggguugggugucccagcaacccagagcuucuauccuggcuggguggcccgagggucccgcuugccgccuccugccuuuggucccacgcgaugagggcccauuuacccccugcccgcgcgugccuccugccaugggcuugguuucuggggucguggggauuccagcagcuccuggcgccucacccgcccccucgccguguccugcagaaguuugacgagcuccugcaccuggccucgaggggccagcacagcaauguggacaugcuggugcgggacgucuacggcggcgcccaccagacucucgggcugagcgggaaccucaucgccagcagcuucgggaagucggccaccgccgaccaaggugcucaccccggccucugccgccagagagcaggaugguggggacacuuggggucucacggacaggagcuucccccaccauugcuuucccacaacugcucccuggagagucggggucuugggugucagcccuguaaccucuuccugccgagucgcugcagcucaggcccacugcucagaacgucggcagauaaacgccacggucuugguuuuggaagaaaaaauaguuuccugauuggguuuuuuccuccuucaaaacaaagcuuaauccguccaggaaugauucacacaucacacgcagccucccgcacuugggcuccaguucccccacucagcucucucucccccuccccucccacucagcucucucucccccuccccucccacucagcucucucucccccuccccuccugcucgcucucaugucgugcacuugcuguacuuggagaugagugccuuuuccuucccuuccucagaguucuccaaagaagacauggcgaagagccugcugcacaugaucagcaacgacauugggcagcuggccugccuccacgcacggcugcacagccuggaccgcguguacuuuggaggcuucuuuauccggggccaccccgugaccaugcgcaccaucaccuauagcaucaacuucuucuccaagguaacggaugcgccgcccuccccagccucuaacgcagaccccccaggaucuucccaaucagucaugcugguuagacaccgcagcacccccagggaggccuggagggugggggccaagaagcccagcaccccucccuucugacugauucugggcagccuacauuuuguggcaccguggccaccugaguuugaguacaucaccagugaugagcauucuagagagcuccaggcaggccugcugaucugcgcuggggucagggugccccugcccccgcagaggcacgcccacccacaugccugacgcagagacuugugggccagggacucgcugcaugggagaagcuaucucacccuuagcuuucuucaaacagcagcccgcccucuggugccaggcgcgauuccacuggcaaguaugccgugggugccauggcgccucuucgaggguuugggccgcgcggugcgaggcccgcgcacguugagcugguuugcggaggcaccggguguuguguggggccaacagcagcacgugugcuuuggccacggcagggggaagugcaggcgcuguuucugaggcacgaaggcuaccugggagccaucggagcguuccugaaaggagcugagcaggacagugagucgcggugcuggcgccccugagcagcguggggccucagcuguggccugggccugugcuccaggccagggcggcccaggguggaggugggguggggagcgugaguccucagaaagugacagcagcaggcaugucuaacauuuuaacaauuuaguuaauaagcgauuuuauacccuuuccuccuccacucuccugcuuuugaaucaagggcaagguuaacacaagugaccuggcuucuugcuuuccagauccuaaccaguacagcuggggagagaacuaugcaggcagcuccgggcugaugagugcaucacccgagcucggcccggcgcagcgggcgcggaguggcacugugaguagugggcucuggccgccccgggccccaggggagcagccuaugccgcacucaccucgccugucccugagcgaagccucuuguggcugucccggcugaaaggcgccucugcccauggcgaauccucccauggaccugggguauaacuaggggcaagagaaggacacuguggcuugcuuucccaucucccucauugggugcuuucguauuuuggaaacauucagcaggaauuacggagucugugugauccggccuucuuguuugcagagagauugcuaaaguucaggggugacggggaccucuccccacgccagaaggcccguccacuuuggaguugaaacccgaaaccgcaggagccacccagggcccugccuaggacugcgcgcucugccgcacacugccgcgcacuguggcugauggucugucgguuacagucugcucuccucggggugucccggcucauuccuuggauccccaguggguuugcccuggccugagcuggguggcacuggcgggcuaggagacgcaccccaugucugccgaguuggagcugcuccggaagggucccccgccaggaccugcgucagccacgggaugcccccagcacagccccacauggcaggaaccgccccgugucacaggcugucaggguccucgaccgugcccccccgcggggcucauuccuucuguagcugugagcaguuaaccugaggucacgcacaaagcuagucggaccccucaggacaggccgcuggcauuguuggcaggaaguugcuugucauuuguagacaugggguucagugucaguauuuucaagaccgcgacuuguugaguuuuggcuucucaggagggcgccucccuuuuguguggguccugcaguucacaccaggccacggccucgcacagacgcaccacacuggccgcagcccuggucugccuuucccaccgccagcacuaggcaggggagugggggcgaggcucugggggccuggcagagccccaggcucucagcuuuugcccugcuguugggcagaggggcuuggugucuuccagccucaguuucugauuugccaagugugcauaauuugccaaauguccuggacuguaaccuggagugacugcguggacggccacagugcuucgggggccccguucaggaggcgcuuguuaccuauuugguaccccaccaguggcacagcccugccaggcaggaggggcccccaccuuacugaggaucaaacugacaugcagagagauggagucauuuauuucaguuuauauuguccaaaaaagucaaagcgaagauuugaacccauuugucaggauagaaggagccugcgaccuggcaaggcagcaccaggcgaucccggcugugguccgugguaguuaagguggggcuccugccgccuucugcacuggcuuugggaagucacuggcuuuuuccacguggagcuucugcccggcaugggcuucccaccuggaaggcguccccuuugcucuggaggucccugcccacccagaggcugcuucuccagccccagggguugccagcaggggugccccaguggagaagggcagagggccagcaugugaccugugggguagccaccggagggugggaagaggcggucagcuacacaguuccccucauagccccucuggucccagagcagcggcugcugcggugagcgugcagagagccgaguacugaugugugcgucggcucaguucaguucacuuccucccggcauaagguagaaaaagccagcagggcccgugagcgcgccugugcugggugcagguggccccggggugcccugggugcauaauggccuggcccugccauaguccuucauggacagaacgugcugggaggcccggcagccauggaggaagaagggugcauguggggcguggggacucccugcccggcacggaguggaacacugccuggugcuuagugaggacagaaccccaaaccucugugugcagacacggccaccuggaggaccagaggugggaacagugugacugcaggggucacgggaggaggugaaacuguaggggugacagggaggggugacugcagggagguggugaugggggagggaguuacuauagggaugguggaggaggggugaugggagggugacugcagcggugauuggggagguguggcugcagcggggaggugcugggggcaggaggcguguggugggagcagacgcaaccccagugucaaaccaggggguaagucaagguauccggcucaggccgccgggcagcugagggggcccagugggggucucgucuguggcccagagacguggcggaagaaggcaguacaucucccuucuuagagagagaguggaagcuucugaguguggcuugggucguucugaaccauggugacguuuccacccugccacugccugucuuccaguuugacuugcuggaaauggaccggcuggagaggccacugguugaccugccgcuccuccuggacccgcccuccuacgugcccgacacgguggaccucaccgaugacgcucuggcccgaaaauacuggcucaccugcuuugaggaggcccuggacggggugagggcuccgggugccgucuagacgauuccaaggccgcagccggguuaaccuuccaaggcuccgggggcaaagccaagguggcgaagggggacaggccaguguuguccagaaaccccuugaucugcgucugagugagggggcgauuuugguuucucaggcaaaaauaccgcuccuggccaccuggugggucagugaggacguggcgucugcgaggcacguugcuucuaagggcagcugauaguucugcuagcuagcacauuccuucaaaaagcaauuuaggagacgucucugcucuuuugaggugugacugaggugcgggaggcauugugggacccugacucuggggguggggugagacucagccccagcaagcucccggcgaggccaccuugggacuccugcgucccaccuucuccaaggcugggcuggucccguggagcaaaugccaggcccugggccacgcugccccucaggagcucagcucggggccagggagccccgguagcaacacgcacucuucacgaagcccucggagaggccgggucgugccaggguuuguccugagggaggagucccagcccugcccaggacccggagugagcucugagugcccagagccccucguccccggcacaggaugggggcucgagucugaggacgugggucuuggccucggguuuccuggggggugagggaccaaggucacuccugcuccugccucccagggcaacugggaggggcgaauggcaaagggaagccucgggugaccgugaacugucaccgucagccuuuccuguuccaguagaaacugcccugaccacagcccaggcagcccccacccugcccgagucccccacagcaggcccugacccugccccgggaagccccccauagcuagcccccacccugccccaaacagcccccgacagccggcucccacccugcaccaggccuccuacagccgcccccacccugccccagacagucccccacggccgacccccacccuuccccgagcccccugcugucacguggggauucgcaagcagcagggccagcgcuugacuaacccccuccuucugucgcuggcagguagugaagcgcgcaguggcgagccagccagacucuguggaugcagccgagagggcggagaaguuccggcagaaguacuggaacaagcuucagacccugaggcagcagcccuuguaagugcccagcaccccgguguguggccaccucuuccauccagagggccccugcaccucugagaaagugccgugauguuggcauucggaccccagcucgcugggggugggugugggcccuggcggcacagcccccuuggaccccgccucaagcagcguuugcacugccgggcuccugaggacguccguggcacagccgaggauggcagacgggcggguguucggccugcccugcucagcgcccucugccgugucuguccccagcgccuaugggacccugaccgugcgcagccugcuggacaccagggagcacugucugaacgaguucaacuucccggaucccuacuccaaaguaagugcagugugcccuggccuuccgcucgcucuuguccccgucccgcuggcaccgcguguccugucucugucccgcuggcucggggcauccuguccugucugaggccaugcagguuugguagcggccccaacuccagcccuggcaccacaauagccagggccucuguuggcagcaucugcugaggagcuguguuacccccacagaugcuggggccacuuagggguggggacugcugugacuagagaagaagggugugaaccccaguuuggauguguuccugacagacacaggcugccugccugcaggagccaagggccucccagcuucugugagggugggcgauugugguuggggacugcuuuccccucauggggaggggcuggaacccuggaccacccuggcucccuccuaggaggcuggacagugaccagaggccuccuaucccggcaacgugcagggccgugcaaggugggccuuuccgggcguccguuuugcuuccccaagucuggcggccagagcccuccuuggcccuuucugccaggaggcagcgggcagcagcggaggcauggacuccucccaccucuucugggaagggccagcgccaugccucccuccccucacacgccgagccuugugacagcggaagucugggugucgaggguuuugaggccagggcuguggguaccugugggggccguguccuccacucuuguccugcccuucacccacugcucagucacaugggggcugaaguuguccugggccucguccucagagccccgugcagcugugcgcuggccacugucccggaccgauaggcuugugccugguggggucccaguugggccugagucuucgauccugaggggcgugguauggaacaggcugcgccuggcagguguccagggugggcugaggccacgucuucacucaggccuggcaucuggcacucuccacaggugaagcagcgggagaauggcguggcgcugaggugcuuccccggggucgugcgcucccuggacgcgcugggcugggaggaacggcagcuggcgcuggugaaaggccuccuggcggggaaugucuucgacuggggggccaaagccgugucugcguaggugucugcgggcucggagcaggcucugcagccugugggugccuguccugccccaggcuugcgggcaaggagguggagcgggucccuugggggucacguggcgcuugguggcuugguggcucagggcuuuggggcccagggagugcacauggcagcagcgccaggggcugggcagggcgcagcgcccuugucuguccccucagguucugaggaggccccuuccuuaagcaugggugccgcagaggccuaaggguguggauuugaaaaucggggcuggcauuuucuauugucagaauccaaauucauguuuccuaugugugguaggaauuaaacauuucugaugugaugaucaaagggugcuuugcaaagcaguccccuagacuggccuguaggacacgcaggugucuagcaccuggcgccgucuccuggggcucugaaucuugaaaaugaacccccccaccaucauuuaccuucacucccaaagaagcugcuuccagucucugggccuccccaggcggccgcaccaccucucguggucccugcuuuuuuucauguggggcuggagggaaaugccuggguucucagcccucccugggucccacucgugucucgagacauagaugagaacgccgccuccaaccauggcugccccucugggacacaggccccucccgcagccugucaggagcauuggaggaggguccugacccaugggauuggccuuguggcugggggcuccccacaccgccugcaugggugccaagcacagggaccauacugcggcugccagucaccgagaggcuucccuggccccguggcuccgaguccaccuugagaaacagccugugcucucucagaccuuugcuugguggcccccugagccuucugcggaucgcagcauguuaagaacgcuguaucuguucugccugggagugauuuggggucuucacguugagcagcugccucugucccaccugggagggauuuggggucuuagcagcugccucuguccugccugggagugauuuggggucuucacguugagcagcugccccugucccaccugggagggauuugggaucuuuacauugagcagcugccucugucccgccugggagggauuuggggucuucacauugagcacuguggcugaagguuuuuguucuguugucuuaauuuucuuuucuccuccuccaugcaguguccuugaauccgaccccuacuuuggguuugaagaagcaaagaggaaguuacaagguacggauggccaaguaacuuggggccuugccuugugcuggggccaugccuggacguucucugcaacagcgaaugcaguugcggucgggguccaggcaccuccccugcucaaggcucugucagcugggcuucgggggcggggagaacuugcuuccuggagagacgaacaccugaagacgcgucucccugaccccugaccuggagcaccgggcuaaucaugugucccucucucugucucagaaagacccuggcucguggauuccuacagcgaguggcuucagagauuaaagguauguggaggggccucccaccucugcugcuggggacacagcggggcccggggggguggucacuggagggaggugggcaugggcugccucggguggcccuccccuccuguuagagucucaccauccugcgagccaagggucucagcauccccugccccacacuugcccuccugucgugacugcuucuuaggucaccugcucuaggcacaaagccuugccagaagagacaggcacuggccccugcaggccaauccgucccuggcgccucugggguccugaagccccagucucagccccugcaggcuggcccgucccggugccucugggguccugaagucccggucucagccccugcagcccagcccagucccggcaccucuggggcccugaagccccuggucucggccccugcaggacagcccaucccuggcaucucuggggcccugaagcccccagucucggccccugcagggcagcgugacgggcagcaggggugcggacugacucgcuuggaugcgccuguucccaacugaacguccugguuuugucuuacaggggcccccucauaaaugugccuuaauuuucgcagauaacaguggaauagacaucauuuugggagucuuccccuuugucagggagcuacuccuuagagggacagaggugaguguugaggugguggguggggcccuuccccugggcuucucugcucucggugggguuggcgccgcugugggccucuggcgguggucggggcuccuccggacgcagcagguaggugcaggcagcagcacgggggaggcggcccagagccgucaucugcugggguggaggcuccgagcccccugggcucaggcugaggguccaugugcugaagcccaggguugacgccaggcuccuggaagggugcucacagcaaggaggcuuuggggcugugacuucacagacaggcaggucccaggggcaggcucuaaacucagcucugccccucggcucagcucccucccaggggccacagaguggcaaggucaggcgaggucccugcuccucagcagcagguggcuggccaggcccgcugggcacagcacccucacccagcccagccacucgaaggccggggugcacgcaggcuccaugcugggccagcacagguuccuaaagagccugggcccuccuccugcaggucauccuggcgugcaacucaggccccgcccugaacgacgugacccacagcgagucccucaucguggcagagcguauugcgggcauggacccugucgugcagugaguguuggcgggcagugcugggggggccuugauggggaggggcaccagcugggcagagugggccauggggauugucacugaacugggagcuccugggggcacugaccaccuuguaucuggcagcucugcgcuccaggaagagaggcugcugcuggugcagacgggcuccagcuccccgugccucgaccucagguaaccccgcacccugcaccuguucucucccuccugggcucugugcccucugugccgugcaccugcacccaggugcaugcgggacaccgaccucaggacugccccugcggccucuccugaccccaggcccggauugaucucaggaggggacagauaugccauccccgaagguggccuggggagggugaauggauucagggucugaggugguuacacaugggcuggguuuggggacuuggggcaagaggggccaaugucccuguggccacucagcugagaccgagggcgaccugggcagcugcccggugucugucaccuccgugucccacauagaugccaggcucugcuucugugguucuggaggucauuagucaauuguauguggugcugucuguccuccugauugcagaggaggaaggaaccccuuaaaugagcggguucugagugcuggggccgcuggucugcucugccuggugggauucuccagugcuggcuucaucugugccccagccccacucucaccaacaaggagggcgugaaaaugacaaggaauccaucccuagaguucacaggagaucuagggcagaguuuccaagcugcagcugcucuggcccugugugagcugcugcucugaggaagccccaggcugaggcagcuaccaggcggaggcuggguuuggaggccuccacaucagggaauugagcgguagggguuucagccuucacguuggucgccgcacuguaugggaaguggggucuggggucugcuugcccagucucaccguccucuuccuccccaaagccgccuggauaaggggcuggccgcacuggugcgggagcguggcgcggaucugguggucaucgagggcaugggccgugcuguccacacaaacuaccacgcagcccugcgcugcgagagccucaagcuggccgucaucaagaacgcguggcuggccgagcggcugggcggccggcucuucagcgucaucuucaaguacgaggucccagccgagugaggcgcugcagcugccggacucuucugcuugucacuugucaggaauguguuuuuaccaccacagggaaacugcguucaaaucaacguauuuauaugguacugcugugacgcggcacauacaccccagccgcacagaugcgugugacccagaggcgagacgcagcuuuguccugggagacguucauauuggaaucuauuuaacugcuaaagaaccuuuuauauauauauauauauaaauagagagaucuauacagguaugu

SEQ ID NO: 14259 - RNA, 7248 nt, Homo sapiens
gcugaagcaacccgccagccuccgugccccaccccacccagcacgcacucauucaguccauugccuuaacacaagccugauggggcuguuuucucacaauauaaacgaauaaagugucuucuggccuacuucugaauuacuucucaacuguaugguuuggggaagggagggaaaccuaaaaucccguccaaauaagugaaauuccugaagaaguggcugaguccuaccagguugggguuagggaaauguucuggguucaggcgccccucccagggcugagaaagcgcagccagggacagcuuucuguucucucccaggguggcuagguuaguaucuuacaugacaaaaaacugagaguguucuaacuucugugcaagcaagguuaauccugagacuaaaucuuggcguucagacucccguagaggucaucuguguccaggcccacccgggcgccggcucagcgguagugccgaagguagaugagcuucuggggagggaacuucucccggcagaggggacacuccgccugcggagaggagaaagggggucacagcagcuggggccacugggccaugcccauccccaucggcauuucuuuuccuguccacauucucugcacaugacacacaacauaaauguuguauuuccuucaacuaaugaccaagaaagccagccuuuuuucagaaggccgagucccagugggggcuggggcggggcugggggcguagggcucaggguguggggcucggccgggagguucccuccugcucccgcagcugacacagcccacgaagcccagcuccugggaaagcgugcgcucucacccugccggcaucuucggugggugugagucagugugcuaggguuuucaaguguggugaggaccccgggaggaagggugugcugggaugcguggugcaagcguggggccuuucagggcuggccacuaccccaaccugcauucggcaaagccucaauacacgugaauuuggaacuuuaacccccucaacgaacccacaucugaccuaccugggagccuuuaaaaagaugcccaccucuguacccucaaaacuggagggugcucagagccagacuccccacuucugcugcagccaggugcaucuugccggcacagccgcugaccaccccaggacggcagcaggcucccaccucaccuugcugcugcaccacgcggugaugcacucccagcagaacagguggccgcagggcguggcuguugggugccugcgcuccuccaggcacagggugcacaggggguuucuggaaacggcucucuccuccaaggaggcccuggggaagguggggcagagcgucaaggugggugcaccuuacagguccuugugaagugcccaggacacccccagcccccauguguggcccccgcacgcaccugcggugagacaggccgcggugcagccuccacuccuuccuggcucgcugccgcugccugaaaccguacagcugcagccccauggacagcaccaggugcagcagugagaugacccccagcagccuguagcuaacacgggcccucagguccucuccgggcaggcugcggacacggagcuguaaggcagauggcgccacacucaucaggacccugaggggaucuggccucagcgccugcugggagggucacacguucaguuggcacagagcacguuagaaccaggccucucacuggcauggggagugcccggcagaaacgaucaagccagggggcagguucagggagucugaggugccugcuucguagccuagcaugacggagaggccugagcuccagaccagccuuggcauuaccagugcagaaagagucuuagcuaugaggcuggcagagcaggugaggauguggggauguccagggaccaccucucagaaaaggaggcggggagcggaaauguggggcugcagacgcugcccaccagcuacccugcuacagggaccgaagccccaguguaacaaggcacguggccccagggacacugcugccacccuccugcuggugacacagguagcuucugaccgugccacugaaggacagcuggcugcccucggcuucccgugucacuuuccacuggcugggaaauggagacagccagacagccucggcccagggccgggaaccacauacagagguggcaggucacaccgccagcaugggcccuggguguccagccacuuccuggcuguccuaggagagagggagccucccaucugguuugagccccacuuccaugccccugucacagcagcucaucaaaucccucaccaacauggacggggcaagaaaccacaucaaauacgcaagugaggcuggguacgcugaggacgaagaccugaccauuggcucugcgacgaggucacgguggccuccuguuuaggguguguguggaggcgggguugccuggcaaguaggggcugaggggaccagugcagcucuagggacaaaaggaaggggguuccucagagggcuguucuggaaggagcucaugcaguaguggcucuggugggccagggacuaacgcuguggcagguggacaugguggugggaccacgggggaggcuucguugcugaaucuggaagcaggggcaucagcugggggucaggauaggcagaggugccaacggcuguggaggggagaaggugggaacggccgucugauggggcagacugcugggccaggcaggggcgaggggugaggggcuggggccggggcugcaguccaugcucccacacugucugggagaagcuguuuguuccccacagcagugacauaggcagucacgggcccagguucagggaucuguggugaggcgugacccggggccccccggucaguaaagagcuaagcgcagggcccgguguccaugaggggcugcagcaggaguucauucuacacuuagggucuggacuuccuuggaucuuucagccaaguguaauuaaacaaaaucugcuuuuuuuccaagcagaggauuuggguuccugccuugacacagaugcuggauguagaacccuguuggcugagaggccuggagggccagcucugugcaugcacccaaguccagugggggugacaaggacggccuaagcagcugugcccucagcgccugcuacuuacguacgugauccccgugagccucuuggccaggugguagaagacaccguggauguaaaaccaggcaacauguagccgcuggaggcaggcgaggcccugucugaggacgaagaccgcccgcagcagcgcccuccucugcugcucagucaggguggccguguggugacgcauccagcgccgcgccccugagcagccacgcccaccuggccccaggcuccccugcaagggucgcccacugucggggucagccugcagcuccugcuccagggggagcagggccuuguccagcagguagggcaggacggcaugcagugucaccagcacgccacggcgcagcgaggagggcacauguauccgcgauggguccaccuggaugaugcugacguacuccucccccagggucugguagccugcgaggaagaggauggguauguggacccugagacugcugccgcggggacaggcucccggcgccccugccagccgacccucugcuggcuccugucaacagccccaucuugucgcccuugagcccacugucaccccgugcuggcugaggccaacaugaccuucugucgcuaagcccacugugagcucaggcagcacaugacaggcccggccaauggcugcccuuggcucccagggccuuggcuggccagugucccucccucucuuggcuucuccccaagagucucugcucuuuccccuuucucccuagcuguccccgccaccucccccagcccaagcacucggauccagucccauggcucuccaccaaccacacagcuggcaccacccgauuuaugcccagccuggaccuuacuugugagugccagccaugcagguccgccaccuaccugacaucgccauguaugcucagaugagcaccccaauuccaccccugccgagacagcuuucagcgcccccacccagaaaagccugcuccccguuuccaucucuguggauggcaacgccaggccuccgguuccugaggucaagcccaaggggcacccugcaugcaccuucccuguguguuccacccccucgcugccgccccugcucuguaccaccaccauccugugggggacugucacagccucuguagucucccugagcccaacuuuguccccugaggucuggucuuagcuaguggucggccucuccccugcccacgucccuggaaugccccaagccucgcacagggaaagcuaugggcuuacaaaacucacgagccccccggggucauucucccaaaccgccaaggacguguucuucucagggccuuucccggcugcuugcucugccggucuggaaaaugcucuucccuaagacguggucuuuaucucugagagccccucacuucccaagaugcucugugacgcagccacaucugucucccgcccaccgagcacacucuccauggcggcaggaugcccggggcgagccccucguagggaaccaggcuggcacucggugguccuugcuacaugcugagcugggguugggagccugagagcuucugucaacaacucccucuaaaggguggugaccagccugggccacagacccaccacugcuccaccagggcacugucacacgggcacugcacccuaugacauggcucagcacugugacucacuggugccaccagggcuggccacugagaaaugggucucaguggcacccgggguaaagucuuaaacaaagaaccccagggacacacaaaggcuggaaaagucggcucccugcugggagcagaugccucgccucccucggagcaguaccuccugcacuucccugaagcaaccucacccgggccagcuccaggagcuucucacacugccuggcagcccccuggccaccguccccagacuugguguguguggcugcccucaguccugaggucccgugggagcuucuaccugcaaguguggugaggccaaaguaggccacaucugagagcagcucaaccuccuuccuccacuccagccacuuccucgcaccugagaggagaaacaguauuaguccgggggagcuggugggcauccucugaggaugagggaccacaguccucccccaguugucuaggcccagauccagucccaccccuuccaugaagccaacacucacucccuggccucccucucugcuucugucuccggaggcaccaccuugacuugccuuagcgugagcugcagacagucugcgaagaaucucccaccugugcucaucucuugcuccgggauuccccugagcaacuguucuagggccuaugagggccacauggaaagauggucugggguauuaagauuacaggccagaggccaacugucuagcaucaaaaagcagcucuccaacuugcuggcugugaggucuuucuggaaucucaauuugcucaucuaucagaagaguaauaaguccuacuuggagggauguuugaagauucaauauuuguaaaacacugggaacagugucuggcacagggguaagugccaaguguacuguaaaacaaguaaguacacacacaaaaaauucucaucaugucacucuccuguucagaauccaccaauggcugcccaccugacacccaugggccucccggcacggagccuggcuguccucugauauuuacccaugcucuuccugucccauggcacuguuccuuuggccacgacacccccaccacugggcucuagugccacugcucccugaaacguucugcugggaguucaugccuuuaacgacugccugccccaccccccaaagacuugauggcuuugccuuuuuuuuuuuuuuuuuuuuuuugagauggagucucacucuguugcccagacuggagugcaguggcacgaucuuggcuuacugcaaccuccgccucccggguucaagugauucugucucagccucccaaguagcugggauuacacgcacgcgccaccacgcccugcugauuuuuguauuuuuaguagagacgggguuucaccauguuguguagacuggucucgaacuccugaccucaagugauccacccgccucggccucccaaagugcugggauuacaggcgugagccaccacacccggcaucuuuuuuuuuucguuuuuuaaucggugauggggucuggccccgucgcccaggcuggagugcagcggcacaaucauggcucacugcagccucaucccucgggcucaggcgauucucuugccucagccuccugaagagcugggauuacagacgccgccaccacguccggcuaauuuucagauuuuuuguagagacggggucuugccauguugcccaggcugguuucaaacuccugggcucaagcgauccucccgccucugccucccaaacugcugggaugacaggugcugcuucauugaguacacuggcuucuguacucagcucccggccuggugaggcaggcagggccuggcugagccuacacuggggucagcagggcgaggggccugggcugcugcucaggccuaggaaaggccggggucagugugaaccggaccgagguaugaggcguucgcgccgcgggcgcucugaccccucugcucacaggggaggaucggagggaggcuugaagcacuugccaaggccucacaccuggaggggacagagucuuccccagccgcuggcgucagcuggaccugcccugagcuggggacgggaagggcuugggcgggaacuggaggcccacgcaggucccccgcggugucugcggccugugccucuggggccaccuggccagggagggcaggaggugccccgcacaucccugaauggccgcagggcaggcgaaggagacugccgggucccagguugugggacgggcccaggcgaccgugaccacacacggcagacaccccgccuccaugaggggcaacacccccugggccgcucgcgaggacguccggccgcgcccggcccucacccgccaggcugugcagggcgccgcccgccgcgcuccgcagcccaccgcgguaguacucguccuucugcgccgcgcggaucaccuccggggggcuggcggcggccggggccauggccgcggguucggguggucccgagcagccacgccggccacgcccacgcccaga

SEQ ID NO: 14260 - RNA, 6296 nt, Homo sapiens
gggguccgcucgugcgcgccucuccggggucugugcgcguggcccuccgcucgcgccggagggcgugggcguggccucggcguggguguggccgcucggggaggggccucccgggggcggggccggccugguccgcgcggugacgcgcccugcagccccgagcgagcgagcgagcgagcgaguugccgagcgcgccccgucccucgcgcgcgaugcuccccuggacggcgcucggccuggcccugagcuugcggcuggcgcuggcgcggagcggcgcggagcgcggugagugcggcgggcggccgggccggggcuggggcuucuggugaccgcucugcgccgcugcccgcgcaaggccgucgcuguccccugcuccggacgggcgggcgggcugggaggcugcgggagccgggcgggggcgcgggcggagcguccugcucaccugaggcuggcggcccaggugcuccaggcgacaccguccgugagcgccggggcauaggggccgucccggcccgcaucucugcgggaucgcgggccuggacaggaagagggagaugucugucaagggggcaccccugccucaguuucccuacccuugcgagggcccuuaguggagggaugguagggaaguuggagucgccccaccgcacuggggaaaaccgcaaggccgggacuagaauugaggcacgcuggugcccuggcuugguggggaggggcgguguagggggcaucagccuccaccccggaggugcccggaggaagggggaagccugcgaggggcuguuccggcuuucaggcugcuggggguuauaucuuguugugugaguccaggugggcuggaggauggaggccaggggaggggccaccaucuaguaagcggggucugggcuccagccaggccauccggcguggucauugcugugccuccgacaccuuccccugcugcugugugcaugcccagggugccucaccugcaggcugagcugcguggcugaacuccagccucaggcugcuccucugaaagccaugccuggagggaacagccccacggcucaggccuguccugggggccuaggccaggacucuuggcuccaccugcuugcagggucugugaggaaugggaaggugugggggcuuggagcggagagucgcccucucacagaugggauaacacaagcccagagagagcccuagaucccauggccagugugcagugaaacccccaaaaguacaggccucuugcuuagaguuccucuuucccccaaccuaggaccuuugggagaaggcaagcauccacuuaaggaaagcuggggcccugggggacccugccuugcuguggggcugucuggggggcccacaccugaggcugagcauuccuccuuucccccagguccaccagcaucagccccccgaggggaccugauguuccugcuggacagcucagccagcgucucucacuacgaguucucccggguucgggaguuuguggggcagcugguggcuccacugccccugggcaccggggcccugcgugccagucuggugcacgugggcagucggccauacaccgaguuccccuucggccagcacagcucgggugaggcugcccaggaugcggugcgugcuucugcccagcgcaugggugacacccacacuggccuggcgcuggucuaugccaaggaacagcuguuugcugaagcaucaggugcccggccaggggugcccaaagugcuggugugggugacagauggcggcuccagcgacccugugggcccccccaugcaggagcucaaggaccugggcgucaccguguucauugucagcaccggccgaggcaacuuccuggagcugucagccgcugccucagccccugccgagaagcaccugcacuuuguggacguggaugaccugcacaucauuguccaagagcugaggggcuccauucucgguaugcgggaggaggcagggcccagggagcccuagcugggagccgcagaaggagaggcuggguugagacuuugggaagaucucauguccccagagcagcggccagggccuccggggcugugguaccccuagggugcagggcugagugaugcagcuugucuaugcacacucuucacugggcgacccguguacccugcugagacgggggcaggcuugaguagccaccuccagguguagcucccugcugauguguccagcccagaccucgaggccccagggagugcagagcccggguguaggcccaggaagaagcuuccaagucuggggacucugcagaugggcagcaugugcuccugagcaugcccaccauaccuggagaggggugagccagaaaggucagggacugcccccccagagagcacagggcaccucuccuggguggggacagccgccgagggcuuugaacuaguucggacugcaggcccacugugaggguuuccugagaggccggaccagggaaggccugaggcaggagcugagcagcucccauuggcuuuuuuucuggaccucccugccccagccaagcccugaaggagcuggggcuggagaugaggaaccggccacuggcucagccugcugcagccacugaaaaaugccaacccuggggaucucaccaagucuccgucuguggguuaaucauccacccagagccggaagggguuggacuguggguuggagagggguggacggcccuccccaagguuuccccagggacgucuggccccuaguggccccaggucacccagugcagcugcgccuggaggggaccaggaggaaaggcugccuuaagcagccaaaggaaaagccugaggcugcagugccgaggggccaggcagcagggugggggcuccugggaaagaggccgggucugagggugggggaugggaagaaaguggcccaggcacccagcacugcaggaggaagauccugauagcuuuaacccagcgcagacauuuaugagccucgccacagcagggucacucagagggcuauguggggcuuggugucacagguccaggagucccccucuggagaaccccaccccacacucuccuggggacccagggcaggcagcgccuccagaaccccagggccugccccuguggucucccaucuccuagcugcagcucagagagccgggcugaccucagaccccggccuggccacucaggcuggggcugguccucugcucucaggcaccaccguggacucugccgucuuugaggaccuuuguccuggucacugaucuggccacugcaccucuccacaaaggacuggguuuggggcuaagggaggcaggggcgcuucugacagggccugagggggcugcacccuuuccuccguccucccccagccaaggcacguucugagaauccccagcaucugcggggcauggcuccagcagcuccuuggccgcggggccccgucuuuccuaguggggccuccaaucuccagaucuuccccaucagccagggccgcccuccagcagcggaggaggaacugaccgcuguucccugacccccugcaccacccacagacgcgaugcggccgcagcagcuccaugccacggagaucacguccagcggcuuccgccuggccuggccaccccugcugaccgcagacucgggcuacuaugugcuggagcuggugcccagcgcccagccgggggcugcaagacgccagcagcugccagggaacgccacggacuggaucugggccggccucgacccggacacggacuacgacguggcgcuagugccugaguccaacgugcgccuccugaggccccagauccugcgggugcgcacgcggcccggugaggcagggccgggggcuucgggcccggagucgggggcugggccggcccccacgcagcucgccgcccuccccgccccagaggaggccgggccagagcgcaucgucaucucccacgcccggccgcgcagccuccgcgugaguugggccccagcgcugggcucagccgcggcgcucggcuaccacgugcaguucgggccgcugcggggcggggaggcgcagcggguggaggugcccgcgggccgcaacugcaccacgcugcagggccuggcgccgggcaccgccuaccuggugaccgugaccgccgccuuccgcucgggccgcgagagcgcgcuguccgccaaggccugcacgcccgacggcccgcgcccgcgcccacgccccgugccccgcgccccgaccccggggaccgccagccgugagccguaagccggcguccccgcccagccgagagggccggcgccuaccugagggccccugugucccgaacccggagcggaggcgcccaacccggcagacgggugcaggcccggccuuuccccacgcggacuccgcgcgaccccggcccucucccugcggccgcagggcuuccccgccuggcgccugcccuccagggcuggggccucgccuggcgggaccccgcagcagccccggccccauccccgcccagagccgggcgucguguggguccgugggugauaauugagagcgucagacccaggacuguucagggaggagccccggucagacucccacgugugaagaccgggccccaaguggcaagggcuggccuggggcgggcagcuuggguccuggacguugauaggaagcggaaggggaaucgcgggaagcuggcccaggucagguccgcaaaggcuucugaagaagaggaagggcgaguaggggcaccuggacgcugaugguggccaggaugcucagcuggccaggagggcagcaccugcuggggacgguggcccugccuucaugcccaggacaccagcuggguccagcuagcagccacugggaaucagaggaauggggcagagcugggcauucaggaccuugaggacacgugaccccacccgcccaccgccacuaucaggccccgggaccgcacugacaggaaaccuuccgucgugagggagcacuucccaggggccgcagggacgacacucuccagggaggccccagcaaccacaccaucuucuugcugugagaggucucaccccgggcuaccuccugucacuacucacugcccugggguccgugggcaaguugcccagggugggggugccuagccaggugcaguccccgccccgccuaguccucggcgucacgcaaugcucaccucgccucuuccccacuaacaucccagacuuuaaaauucaguaaaucagauguacaccgagccugcagucucgcuaggaugcuuuacuccuccacaaacagcagccgccgacaggacagcuugugaacgucuccgccuuuugggguguccggggagaggagguggagcuguccccucccagugucaggccuccuugguccucaugugcaccuuuuauucagagagcuugggcccccuuccuuuggagcugggcccagggcagguggcuggaaugcagaggacaagggggcuggggccucugcagggccauucccaccgcagucucugccacggcccggagcccugggcccagggccacgcgggcucccucugcuggcaaagccacacccugcaccgcaugggguccacugccccuuuccccacguggacucugcgugaccccaggaacugcagcauugagguggucucagucccucccucaggucuggugggcauugugccaggggccaccuucgggacagcuggccuuggcaccgucucccaagaacccagcucugugcaucccguggccccaccagaaacccaaggccacaccgcccaccagcuggguguggucaccauucauggagggccggcuggggccaggcucaccacgcagaguuugcccuccggugugaugaugcaugagacacaguaggccccccugccugugugugcagggggugucugugggggggcccugcuggcuggacuuuggguuucuccugagcuccccuuagcccccaagucaggccacggaggccugaguaggacccaugggcugugugugucacugcagguggcgugcucacaacugcacugcuggucggcagguggccaggguugcaggcccgggccucgggccccaccuccucuggagggguaggaucuccuucgugcagccccugcccccuacccuguucuccggaguguuggcagaucugagcccacggucacgugagaggagaugccucuugcacacugagcccaggcccagcucacggagcacccugcagguggcagcggggcaccaggggcucauuccugguggccucaguggcuucuguggacgacucagacucacaug

SEQ ID NO: 14261 - RNA, 4587 nt, Homo sapiens
gccucucgcagcguccagggaccaccccgguccggaagugaggcggggccugccacggccgucuccggggacagucgguggaaauguggggcgcggggagggcgcggggagggcgcgggcccgcccgcuccaaccaucccggccguugcgcaacucagggcguuugcaaaaaccacgucugggaggacuuggccgcaacgcggcgaacgggcgcgcucggggagugugggcggcggcgaaugaaugagcgagugaacgaaugcacgcccgcgagagcgcggggugaccgcgugguuggugcgcgccucccggggcgccgcgauagagguagagcgccugcgcucggcggcgggccggcacuuugcagccgcucccuaagcccggccccgccuccgcuccccgacucuggccgccguggcgcggugccaccgcgcaggcgcaagagcggccggggccgggggggagggggggggggcgugaccaggccgcguccgcgcgcgcgcaggauuccugcgcuggaggccgccucugacgccaccggcugggcuccgccaugaguucggcgccggccucaggcuccgugcgcgcgcgcuaucuuguguacuuccaguacgugggcaccgacuuuaaguagguuucccaggcgcagcggcgggcgccacgugggcccgggcggaggcgggaaggagggcgcgggcgggcaggcggaugucucuggacgcggguuccaaacguucggggaaggaagcggcccuggccucagacggcggcggagaccccagggcagggcgcccccgguaaccuccgcccgcuucugcccgcagcggggucgcggccgucaggggcacucagcgcgccgucgggguccagaacuaccuggaggugcgcucagccggucacgggacgcccggugagggguaagggggaggcucccgcccgcgcguccccgggguccggccucgcucacccgcccgccccgcggcucgguccugcaggaggccgccgagcggcugaauuccguggagccggucagguucaccaucuccagccgcacggacgccgggguccacgcccugagcaacgcggcgcaccuggacguccagcgccgcucaggccggccgcccuucccgcccgagguccuggccgaggcccucaacacacaccugcggcacccggccaucaggugagcccgcgaccuaagcagcccuggggcugugccuucccgacuccaucugucgcgggcggaggcuggagaucuggacagacuuccuugucuggucggagcucgagggggaaggagagccaaugugacaccgcgggcgggcggggucguuccuccggugagcuuuaccugccgccauaggguccugcgggccuuccgagugcccagcgacuuccacgcucgucacgcagccacgucccggaccuaccuguaccgccuggccacuggcugucaccggcgugaugagcugccgguguuugaacgcaaccuaugcuggacucucccggcagagugaguguggcccugacagcggggagggggcgggcaggccggccccacccuccugacggucacccuggucccugaagcugccuggauauggucgccaugcaggaagccgcccagcaccuccucggcacacacgacuucagcgccuuccaguccgcuggcagcccggugccgagccccgugcgaacgcugcgccgggucuccguuuccccaggccaagccagccccuuggucacccccgaggagagcaggugaggaagggccccugggcuguggcccugcccucaagucacgugcugauuuuagcuccagcaccucccccaguuuuaaggcaaggugaggcgggaggcaggcagccgggaguccucaggaccuggacagcuggaggggauucgcccggacgccccccagccuccagcugugcccuccccccaggcuggggagcggagaacagggaaggcugcuugucucugaaaaaccccugccaugccugauggaagaauguuggcagcuacuggaaaggucucacuggugccagugguucugguggggugguuucugcugcccccagcacugucccgagggccacccaccagguggcagcuucugaccagaaccuccccuauuggggugagcccugaaggggggaagaacuucugccagccccagacuucuguggcagagcagcagguacaggacugggggucucuggcacccgcaccagccacguucccagacccugcaccaggacccuaggugagggcccagggcaagccccucugggauggccaggcuaccugcccagccuccaggguccugcugccuccuugcccaagcauuguuucucugguuuuaagccccuccaaugggccucacugggggcaggagaucagccagggccccugguggccaagcuagugggaaccaggcucgucuuuaggcccacccugucacucucccguccaaggccacauaguaggcugaggauggcaaacacugccccacagacaccuacagguacguauuuuuccaggaagcugcgguucuggaaccuggaguuugagagccagucuuuccuguauagacagguaggcucuguucuggggccguccccaggggguggggcugagggugggcaggccccugugcagucuuggcucugggucgugggcggcucugggucacagguacggaggaugacggcugugcuggugggucacgggcggcucugggucacagguacggaggaugacggcugugcuggugggucacgggcggcucugggucacagguggcucugggucacagguacggaggaugacggcugugcugguggccguggggcugggggcuuuggcaccugcccaggugaagacgauucuggagagccaagauccccugggcaagcaccagacacguguagccccagcccacggcuuauuccucaagucagugcuguacgggaaccucgguaagaaaaacaggcacgagaagcuccugucaugugcccagugacuacuguggccgaggcaugggguggggggccaggggccacugacggcagcaacugggggugaagcagccccccgcccagggcugcagucccucaggccagcccguagcccguccugggcuggcccacucccuggucaugggaguggucucagcgguggggagggugcugggccggucuugccccaggcugacgcagggucugguccguccacaggugcugccuccugcacccugcaggggccacaguucgggagccacggaugacccuggacacucaagccaaaguuaggccacaccaggcccaacccugugcuggucaagccagggcagucacagcugcuuggggcccacagcacugcugccuggucuccacaguagccucccugcccgggucccagcacccuggaugcccgucucugucccaggcgggauggggcacagugcaggacacagccauguacaccaagaagagaguaccaaguagucuuuuguucagcuuuuacuggaaacugcugucuaggaccaccugcccuaaccaggaauaaaggcaagacagccuggagaccaguuuguuucuucagcugcaaacagcugccugggcaggcaggugacacaaggccucuguccccagggaugggaccugcagggucuguucacccagggcacccacaguccugaagugcaggcccagggucuguccagcugggagagggcagagguggcggcugggugaguugccggccucagcugggggccugggggaggcccuucuucagcagagaugugaggaagcuccccagcuccucguccuagggcagaggcaaaagcauuguggguggugcaggacagggaggaauguugauaccuguguugaccgcgguggggugggggucaccccuuaccugguagguccaggagaccagcagcaccuuggugccuggguccucagaaggggcggcggccuggaggaggacggacuccacagucacagagccgucugggaggugcugcacacagugguccuucaggacgcuguggggaggcucggugagacccugccuggccuccagggcccaagggaguggggggggggcggggccgggcgcccaccucuugagguggcuguagacgcgcaaugccgucuccugcuccuugcgugugucaugcaggugcacgcggcaggugaagcgcagcuggugcucagccagacccagcucuuugagggcuugcucugaggacaccagccggaaguucuguggggcagggacaggucagugagcgcagcagcggcccuccccccuccagagaccguccuggcacucacgcuguccuucaugaucagggugccgugcaggagccgaggcuucuuggccucagggagcagcccugcggaggagguggcaggagccaucaaugugagggccgcucccagccgccugccccgagcacccugcccugcccugcccagcccgcauacccugcgccaucucccgcuucagcagccccagcgagaugccuacggggaugcuggggcuugugggcagcgucaccgucucgccauu

SEQ ID NO: 14262 - RNA, 3216 nt, Homo sapiens
ggugaggacggggacggggcguguccaacuggcugugggcucuugaaacccgagcauggcacagcacggggcgaugggcgcguuucgggcccugugcggccuggcgcugcugugcgcgcucagccugggucagcgccccaccgggggucccgggugcggcccugggcgccuccugcuugggacgggaacggacgcgcgcugcugccggguucacacgacgcgcugcugccgcgauuacccggguaaguaaaccgcguuuacuuaacgcggaccggccaaggcgucccgcggaagccgggaugggugggcgccccccuucccgugcucagaccggcguugcugaggucuaaggagggugggcacagagccgccagcagcgggagccuuccggagggaggcaggaucccagagggaggcggaggugugccagcuccagccaguggccccggccgggagcaggggugagccaggugggagcgcccucaagaggggucuggggucuggagguggaggacggcuguuccagguccugcugggcgggucgugagcccuuggccaucgcccagcccccuccugcccaguugagggccccccugcaccaccgucuggccugcugccugccucugaccugcaccuggggaugaggguucagcugacacggcuggucuggagaggaagcuggcagggaagucaccccagagcuucuuccuccagggccuguggguugggaagggaggcucuguccggaggcccaguguggcuggugguggggacagcagcgcccagacaccaggcaggcggccucugaggugucgacgggccuccaggggacugugcacuguugggggccaccccuggguccugcaggggcagcuccugguugcauauggaguuagcaccugggcaggggcagcuguggggcgcaaagggggaguagccaggccacauggccccaggagaaagagacagcuggauaaacccaggguccagacucccagccaggagcccucugcucccuggagccaacuguggguggagaacggacaaccucacuccccuggagggccgaggggaggccuggggaggagggggccucagcccagcugcuggggggcuggccugucuccugcccaggcgaggagugcuguuccgagugggacugcauguguguccagccugaauuccacugcggagacccuugcugcacgaccugccggcaccacccuugucccccaggccaggggguacagucccaggguaaguccuggaggugccucugggaguccacacaggccagggguuccacuagggcccgaggcagagcucgugggcacagguguccggcgaggacauguggugugugggguccggaguccugugaggccgggcaggccaggccaugcucaggcaccacaggccaugaagcucuggggguguccugucccugcuuucucagccugggcuucuccauccagcacgagggcugugagaacccugcggggaggugggggcggguuccaggagcugucuggcucucaggcccgggacacccauccugucuguccucaccacauacugaaagagccugcccugugccccccggaguccugucuggggccuggggcugcacccuguucuggaaggagcagcucaaguccucuuagcggcuuguuuaccugacaggagaggucaggcugggcacaugagagcugggagaagguacaacuggggagguugugucagguuggacggggcagggucuggggucaacugggacccagccucacucucucugggacccucacuguucuccacccucuguucuacuggguccugccuggcuucugcccacccucagcccccaaugggcaggccuuuccccucccuggcaggcccacugcacucugcgcaccucccccaggugcccucacugggccccaccccagacgccccaccugggacgggcagacaugggccccaguccugggccaugaagaacucuguugaauggaugauggggggggcauucuacucagcacccagaccccagauggaccccugcacuggccugacgcccuccucauccaucccagcaacuccaccagccucccucccucccuccccccacaccccacaccagggaaauucaguuuuggcuuccaguguaucgacugugccucggggaccuucuccgggggccacgaaggccacugcaaaccuuggacagagugaguccugggugggcccugccgguggccgggugguccaggcccacucugaggaaggguccucuccugucccuugccccagacagcacggagggcagcagccgggggcugaucggaggccguguccgggggcugauaggaggccgcguccauguauuccagcugcacccaguucggguuucucacuguguucccugggaacaagacccacaacgcugugugcgucccaggguccccgccggcagagccgcuuggguggcugaccgucguccuccuggccguggccgccugcguccuccuccugaccucggcccagcuuggacugcacaucuggcagcugaggagucagugcauguggccccgaggucugucacagccuggugcggggaggugggagcauggcugccugcugaccguggccccccugcagagacccagcugcugcuggaggugccgccgucgaccgaagacgccagaagcugccaguuccccgaggaagagcggggcgagcgaucggcagaggagaaggggcggcugggagaccugugggugugagccuggccguccuccggggccaccgaccgcagccagccccuccccaggagcuccccaggccgcaggggcucugcguucugcucugggccgggcccugcuccccuggcagcagaagugggugcaggaagguggcagugaccagcgcccuggaccaugcaguucggcggccgcggcugggcccugcaggagggagagagagacacagucauggcccccuuccucccuugcuggcccugaugggguggggucuuaggacgggaggcuguguccgugggugugcagugcccagcacgggacccggcugcaggggaccuucaauaaacacuuguccagugaccugaguggaugcaugcugggugcugggggaggacggggcacccggggcugggcuuuggggcaccgugcucaugccuggccgugguccccuccacag

SEQ ID NO: 14263 - RNA, 521 nt, Homo sapiens
ucccaggguucuccaagcaaagccugucuguguuccaggcuggugcugacuagaggaggcaaagccaaaauuagccccaggcccucccucaaguagugaaggggccaccgggccuccccucaacccguagggggucacgggccccgccccgcucccggucaagacccugacauugcggagggucaggaggggggagcgaggauccggggccuggcacccuggguggggcaccguccccagggaggguugggcaggcgcccccagccuccagccaucccgcccgcugugggcgccccgguggccgaggagccaggagcggcucccggggcugugcgcggagaacccggaagaagcggaggagccccgggcggcgcugagcugugucccugccugaggggggccccagcccugagcccgcagcuccagaggcuccugggcccuccccuucuucccagcaccgucccagggggaagguagcccccggcgcaggcgggacccucggcagucuggcccaagaaacg

SEQ ID NO: 14264 - RNA, 1972 nt, Homo sapiens
cccaaccccugacugagaguccucauggaacuggcagggguccccccaacccccgacugagaguccucauggaacuggcagggguccggcccuuccugagcccaagucccugugcuccuccucgggguguugcccccuggccucugcaguccugguucccacuucccagcaucccuugggcuccaggaugcccgcggcagcccugggggagccucugggucccuacugaggggucggcgggcaccugcaugggaguugccugagggcagucugugggguggcccggccagcucucccacuagggugggucccucacucccagccccacccaguguggcacccccccaggcugguguguggagucccagcucagguccggcccaggccucauggcggggauggggcuguggcagccgggucggaccuccccuugcaugagguccacugggcugggagagagacgccucagugagguggggagcuggcagcuggacagccugggggugcagcucuacaccaggcccucgggcccacagcggggugugcgggggacggggcagcccaugccacuggcugcuccucugagacccacacauccuccaucccagcccugccagccucagcccccagacucucaaccagcuccagcccuggucuuugcacagaccaguccuguagucugcuagggcauguggacauggcauguguguguguguggacacagggcacgugugugagagcauguggacauggcaugugugugagaguguggacacggcgugugaguguggacacggcgugugugaguguggacauggcauaugugagcuuccggacacggcacgugugugagagccuguggacacgggggcauagagcgugugaacacauggcccaugugugagagcagccacguauguguauggaugaggcaggugagcacaugggugggugugggcagggaaguggcaggaaugggcugugagggcaggcagcagugagcaaagggcaggggcaggcugggcauagguuguggggggcucggggagggccccugcuaggaggcccacccaggagcucaggggccacagggaccuggaacugcggugagcagcuuccagcaggugcuccagccuccuggggcuauagggagagagggcuuuguccaagcacacaccccagcccagaccugcccaggcugcagcggcugugcugaccccuacccggcuccgacccucaccccucccucccugcccuccagcugccuggcccgccaaggagaggaugaagccagccaaucccugaggcuugcggccacacccuuggcccauaggguauaaauagaccugcuugggagcccacacccagcaacucacaccugccucagaccagagcucugugcgggugacggcgcacgcauuccuuguguccccgccugucuuggacagagcagaagccacaccugccagaccagugccaccgggacagcugcugguggccggccccggggagggauaccugcugggugaagcacaggccgggccgggcccggagaagaggaagcagacacugccacggcagggcagcccagggccuuggagcccaaccguggccggcgaggaggaccacgcccaggcccgcugacccccggccaccagguaaggccagcucagcccguguucaccccuuaccugcacaggcucaggguggggcaccaucguggagggguggggccucgugccaaggaaccgguucugugggguacacaggccgcagagcacaguccccaggucccggugccuggggcacucacggccucacagugacggcgugugacucagguggucacagugaccugugucaucccgccagccugucugggacucacuggcaagucagggguggggcggggcagugccaggagucacuucuggggcagccuccugggccccacggggacgcacggccaggc

SEQ ID NO: 14265 - RNA, 1972 nt, Homo sapiens
gccuggccgugcguccccguggggcccaggaggcugccccagaagugacuccuggcacugccccgccccaccccugacuugccagugagucccagacaggcuggcgggaugacacaggucacugugaccaccugagucacacgccgucacugugaggccgugagugccccaggcaccgggaccuggggacugugcucugcggccuguguaccccacagaaccgguuccuuggcacgaggccccaccccuccacgauggugccccacccugagccugugcagguaaggggugaacacgggcugagcuggccuuaccugguggccgggggucagcgggccugggcgugguccuccucgccggccacgguugggcuccaaggcccugggcugcccugccguggcagugucugcuuccucuucuccgggcccggcccggccugugcuucacccagcagguaucccuccccggggccggccaccagcagcugucccgguggcacuggucuggcagguguggcuucugcucuguccaagacaggcggggacacaaggaaugcgugcgccgucacccgcacagagcucuggucugaggcaggugugaguugcugggugugggcucccaagcaggucuauuuauacccuaugggccaaggguguggccgcaagccucagggauuggcuggcuucauccucuccuuggcgggccaggcagcuggagggcagggagggaggggugagggucggagccggguaggggucagcacagccgcugcagccugggcaggucugggcuggggugugugcuuggacaaagcccucucucccuauagccccaggaggcuggagcaccugcuggaagcugcucaccgcaguuccaggucccuguggccccugagcuccugggugggccuccuagcaggggcccuccccgagccccccacaaccuaugcccagccugccccugcccuuugcucacugcugccugcccucacagcccauuccugccacuucccugcccacacccacccaugugcucaccugccucauccauacacauacguggcugcucucacacaugggccauguguucacacgcucuaugcccccguguccacaggcucucacacacgugccguguccggaagcucacauaugccauguccacacucacacacgccguguccacacucacacgccguguccacacucucacacacaugccauguccacaugcucucacacacgugcccuguguccacacacacacacaugccauguccacaugcccuagcagacuacaggacuggucugugcaaagaccagggcuggagcugguugagagucugggggcugaggcuggcagggcugggauggaggaugugugggucucagaggagcagccaguggcaugggcugccccgucccccgcacaccccgcugugggcccgagggccugguguagagcugcacccccaggcuguccagcugccagcuccccaccucacugaggcgucucucucccagcccaguggaccucaugcaaggggagguccgacccggcugccacagccccauccccgccaugaggccugggccggaccugagcugggacuccacacaccagccugggggggugccacacuggguggggcugggagugagggacccacccuagugggagagcuggccgggccaccccacagacugcccucaggcaacucccaugcaggugcccgccgaccccucaguagggacccagaggcucccccagggcugccgcgggcauccuggagcccaagggaugcugggaagugggaaccaggacugcagaggccagggggcaacaccccgaggaggagcacagggacuugggcucaggaagggccggaccccugccaguuccaugaggacucucagucggggguuggggggaccccugccaguuccaugaggacucucagucagggguuggg

SEQ ID NO: 14266 - RNA, 1087 nt, Homo sapiens
uagggccggugcugccugccgaagccggcggcugagaggcagcgaacucaucuuugccaguacaggagcuugugccguggcccacagcccacagcccacagccaugguaaggcagaugucacagguggggggaggugggcucugugccagccaauuuucgucucccucccccagccaaggucucccaggggugcagggagagcggagcugcucagagcuuggccagguucuaagugugcuccugaaagcaggucaccccugagauccucaggguggggcacagaggggcacccuagcagguaaagggaggccacgggauggcggugggcagcuggccuucuaguaacgagcccucagugccuucugugccuggggucccugccggcgggauguagaggacagacaggagggagcacugucccuggguacaggagcucgcccugcagccagugccuuguguguggugggccuggggcuggcgccgcagucucugaaccugugugacgccugcagggcugggaccugacggugaagaugcuggcgggcaacgaauuccaggugucccugagcagcuccaugucggugucagagcugaaggcgcagaucacccagaagaucggcgugcacgccuuccagcagcgucuggcuguccacccgagcgguguggcgcugcaggacagggucccccuugccagccagggccugggccccggcagcacgguccugcuggugguggacaaaugcgacgaaccucugagcauccuggugaggaauaacaagggccgcagcagcaccuacgagguacggcugacgcagaccguggcccaccugaagcagcaagugagcgggcuggagggugugcaggacgaccuguucuggcugaccuucgaggggaagccccuggaggaccagcucccgcugggggaguacggccucaagccccugagcaccguguucaugaaucugcgccugcggggaggcggcacagagccuggcgggcggagcuaagggccuccaccagcauccgagcaggaucaagggccggaaauaaaggcuguuguaaagagaaauggccgccucugugucu

SEQ ID NO: 14267 - RNA, 2712 nt, Homo sapiens
uggcucuuagacgggcagguacgugcucucggaucccacagcccguccagaucccaggcacacacuguccagggaucuuggccaagcagggggccgcaggggccgggcaggccgggcuugggucauccccuagcaggggagccuggggaccagcccccagucaucccagcacacaguccagauggggcggcccaguccaagcacccggguuguucaggggguuggcucugcgccgccguugcccuguguucgggcccaugugacggcggcgucccucccccagccucuggcaggguucccgcccaggccuggcuaccuucagggucaggcacucuacgaggcccaucucacacugauguccucugggagaugcuuuacagaccagaacacggggccuccacuggcaguucccccaaacuggcccaacucaaccaggucacccaaaucucaggcagaagaagcacgggggcgaugugacuccgacagacgcguccagggcgggcgguucccggggcaggcgguucccggggcaaccaguucucaggaagacguguccaugacagagggguuucgggaagacguguccaggguagacguguccagcacaaauguaucuuaggacagacaugucccaugauggauguaucuggggcaggcgguucccggggcgggcgugugcggggcaggcaguucccaggccaagagugugcaggguuaggguggggcaggcgguuccugggguuggagggggaggcaggcgguucccggggcggccgugugcggggcaggugguucccgggguugcgggggaagcggcucccggggcaggcaguuccugggguugggggggguugggaggcgguuccugggguugggggggguugggaggcgguuccugggguuggggggauugggaggcgguucccgggguuggucggugggggcaggcgguucccgggguugcgggguggugggaggcgguucccgggguugcggggggagugggaggcgguucccgggguuggggguggugggaggcaguucccgggguuggggggauugggaggcgguucccgggguuggugggggugggaggcaguucccgggguuggggggauugggaggcgguucccgggguuggugggggugggaggcgguucccgggguuggucggugggggcaggcgguucccgggguugcggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugguggggggagcgggaggcgguucccgggguugcggggggagugggaggcgguucccgggguuggucggugggggcaggcgguucccgggguuggcgggguggugggaggcgguucccgggguugguggggggagcgggaggcgguucccgggguugguggggggagcgggaggcgguucccgggguugguggggggagcgggaggcgguucccgggguugguggggggagcgggaggcgguucccgggguugcggggggagcgggaggcgguucccgggguugguggggggagcgggaggcgguucccgggguugguggggggagcgggaggcgguucccgggguugcggggggagugggaggcgguucccgggguugcggggggagugggaggcgguucccgggguuggcggggggagugggaggcgguucccgggguuggcggggggagugggaggcgguucccgggguuggcggggggagugggaggcgguucccgggguuggcggggggagugggaggcgguucccgggguuggcggggggagugggaggcgguucccgggguuggcggggggagugggaggcgguucccgggguuggcggggggagugggaggcgguucccgggguuggugggggugggggcaggcgguucccggggcgggcgugugcggggccaucucugagugcagccguggggcugaaggugagcuucuguccuaggggagcuccgggggccugucccaucauuugccuucagccagaaugacaugugccugguguuuguagcuuuugccaccugggcugugaggacgucagauccgcauaccccagacgccuggaaaacagguuugggugccugggggcagagggagcugcgccuagaagccagaccgaggggcgcuggcaggacgaggggugcacgggggccccggggcucaccccugaccugcuccccccaggcugagcugcggcccuggccgcaccgaccuugcccgcccuuugagggcugggucuugcgggcagacggugccgacagccaggcuggcccucagaagagccugugcuucucuugcagccuugcuggccaacgucggcaccaucucugccauccgcuacuuccgccggcagguggggcaagggcgccgcagccacagcccc

SEQ ID NO: 14268 - RNA, 453 nt, Homo sapiens
gaggggcucccgcccggcuuauccggacuccgggcagccucgcgugcuucccgugucuccgcuuguggagaauuuucggacucggauucggacucggagucaaagcccgaagcuaggaacucguccaccgucagcuccgccaggcgccugcgggucacgcaggagucacagcugcccgcacgcccagcucgccccagccccgcugagaggagcaagaaaagcccccuuggauacagacacccaccgggaggccaaaucggcccucggacccgcggcuuaccucuugcggcuccccgcagcugccaugacaccaacccgaagcgugcaccccacuuccggccccagaaugccgcgcggcugcgcacuuccgccgcccaggccccgccccuuuccccgccccgccgcgccacgcccagccgaguggcucuaugguucuccgaccgcaacgccggc

SEQ ID NO: 14269 - RNA, 12752 nt, Homo sapiens
cuuaaaauaaggcuguauucagauuaaacuuuucuuuuuauguugcuagacuuuauuuugaauugagguagaaagauaagugugugccuucaugauaucuguguauuucugucaaccacucaaguggaaccuuacagacaguuugcaccugcaguuuuguuuacagugugucagggaagcaaagaaguguuccuccagcuagaaauauuaauaaagcagaaacaaguaauguaacuaaaacuagaccccaguauuggacacucuucuuagcaaaaacaauaccuucccuuuuggaaaugacuggucauugaauuuugcccaguuaucuuucuaggaaugauugccuuaaaaggauuaauuugauagguguauaagcccuuauuguuguguuuacaguacugugauaggcauuuacagauauaaacauagauuaaggcagggccauguccucaggaacaaaccauauuaugagcuauguuacaagguaugauuuucagauagcagcuggugcugcaacaggguggugcuggcaucuaggcuaggccuuguagaauaggugaaauuuacauauguggagaggagaaagaagaguugcccaggcuaggaaaaugauauaaacaaaagcauggagacaagagcgaugggauaugcuugcauaaucuagugguguucaaacauagccaagggugaggauuaguugaagaacucaaaaaaaaaaaaaaagaagaaagggggaggcgcaguggcucaugccuguaaucuuaucacuuugggaggcugaggcaggcagauugccugagcucaggaguucgagaccagccugagcaacauggugaaaccccgucucuacuaaaauacaaaaaaaauuagccgggugugguggcgugcgccuguagucccagcuacucaggaggcugaggcaggagaauugcuugaacccgggaggcggagguugcagugagcugagaucaugccacugcacuccagccugggcaacagagcaagacuccaucucaaaaagaaaaaaaaaaaggaaggaacaaaagaggaaaacuccaacccaaaaaguucagcccacagaaagucuaauucaguggcacaagauaagaccuauacaccuaaguuuuucuaaaaccccauggggauuuugaugaacaggcaggguuaaaaaccaguggugcaguauagaugugacuaggauauaaaggcuauggaaguucuaugggaggugaugcauugauggaaaauacucugggaggugaugcauugauagaaagauauguuggggccaaaugguaacuugaguaacauuguuucaguauugucaguuuuguguuuuguuuuuuauuucuauuauaucacaaccaucccuccauuagauaucaaccaguauuacuuaaacaaaacuugacccaugugugaauucaaagcaaaauauguuagaugagauauagagggggaaccugucaagaaucuuuuuccaauuugauguugccauauaaucaucuaaagacuuaaaacggucauuuuauuaucacucauaaucuugucaguugaccggacucagcuggcaguucugcucugugugacauugucugggacugcaguuauaugggaggucaguuggcuugaauguccaagauggcucauucgcaggcuuucagcugagagcucaacuggggcugucaaccagggcaucuucaugggcuucucacagcaugacagcuggguuccaagagguagcaucucaagagaaaaggccuaggcucaggcuucuuaugaccuaacauugguagucucagacauuacgucuaccauauucuguaggucaaguaagucacuaaggccaacucagauucaauggaagaugaauaaaauccaucccuugauacgagcaacagugugugcaaauaaggagagaaggaaauugauggcagccgccauuuauugagacuugcuacugcaaucuuagcacaccaaguaauauagcaucaaaauauauaaagcagaauuuuagaaaauuuagauagacauccauaauaauacaacuagacaaaacaauaaggauaaaagggaucugaauaauauaaaauucugacguaauagauuuauauucugaauuccuuaucugacaauaaagaaugcaccucccaggguauccauagacuaucugccccuucccccacaaaaggaaucacuugaacccccccuauguacucaaaucugcagccuuaacaugauaugcuuucuucagcccucaaccuggcaggaaaaauuguuguguuuguuucaucuauuacuauacgcugcucuguauuaaaugaguuucuugucuuuuuggaaucccuuccucugcuuggcuuuuucacacaucauaugaacaauuggguuacacauucucucuuaaguucuuccccacuuuuuacuuguuuucugaaaagagcaucauggagagggguuuuacuuugauuccccaagcugucacgguaagagcaguuuugacauguccuggguguuguguagacuucagggacaccauccagcagcccuggcaccaucuucauauauguguguguguguguguguguguguguguguguguguguguguguguguguguaugugucuguguguguguguguguauguguauauauauauauauauauauauauauguacagcuuuugggguacaagugguuuuggguuacauggaugaauuguauagugaugaagucugagauuuuagugcccccaucacccagguaguguacauuuuacccaguauguaguuuuuucuccuucaccccuuucucuacccucccccuuucugagucuccaaaguccauuacaccacucuguaugccaucaucuucuaaucugccaauaaugcuggccuggggauugagcuguaauuguugccaucaccuguuuuccauguauuauuuuuuaaaggcccuuaaagggggggagaaaaaaaacgguuucuaaguuuaaaaaaaauuuuuuuggucuuugcuuucugaaacucauguuauuaugccauccuaguuagacauagaguuggaggugggaacccaguuuguggggaugauguaauuuccuggccugucagugaugaguccuauuuaccuauugcuucuagcgcaguguccuuauaugauuuauaggaguucuuucugaacuacaucuugucauuaaaccaccagguuuagucaggagucuaagccaacagccaccuucucaguaacacuuggauccgcuugccauugcaggucgucacgcugugguacagagcacccgaagucuugcuccaguccagcuacgccacccccguggaucucuggaguguuggcugcauauuugcagaaauguuucguagaaaguaagaaauacauuuuguuucacucugcuuuccuugaaaagagacuguggaucuuugugaauuugaguggcagcauggcauuucuaucauuaggggucaugauggccagauccaucuaccccaggcuaccacuugcaagccuguccugaaaccgccuucucagugcuuacaguguuguuuuauaugacuguagcuugcagcuucuggaaacucugccugggaaggaauaccccacuguucuuauaaguuacauuguuuuacuggugaugauaggacauggugaaaauaacacauauuuucgcauuuuuuuagugaagaaauaucucaaaguggacuuuauccauaggaggagaaccaaggcuguuaaguguaugaaaacuuuuuugauggaauuuugauagugagaauaguugaaaaaaacaauauuuaggcugaaaaagaauaggcaguggggaugucagugcuacuucagagcacuuuaaaugcugccguguacaggagagauuagauauauucagguacuauagaggacagaaacaagaccaaggauacagaaauuacaaaaagaaagauuuuuguuaaaagggguagaaaucuaaugauuagacaguuaucugaagaguggauugggguuugugagaauagugaguuuucauugugugucuaagaagaggcuggaccuccacacauuggugauguuucaguagcauuuauaggguuggugcguaggcuagaugcccucuaaguucccucuaagagagcaugugauucguuuguuugauuuucaggucacaagaaauagccaaauaauauaauaaagaucugccaggaaaauaauccauaucuggguacuaaguucagccuagucuaaauuaaacagagaaccuaaucauaaucuaaucuuuuuuuucuuuucuauuuuuauuuccaugggaaaagguaaguuaggaaacaguauauucccauuguaucuuuaaaauguagcuccaugguagcucacaaggaaaagaaguggucagccauugcuugcuuguuguuugguugguuuuaaccaaacaaaguuuugugcauguaacaaauuuuuggaacuguugcuaguacucagcaaauucaucuguggcucauaggauaggagaucaucacaaggagaucagaguaaacagauguuuaaugcagccauaccaugugccaaguauagugucaaaccucuucuuuuaugcuaccuuucuuaguccuaccaauaagaacaaacugagauggagugguacauuuauuugucuaacauuaggcagcuaagaaguagcagggguaugaguccaaaggaagcuugcaaguucuauucugguguugcuuuuuucccaaggagcggggagaaaaaguaauacugaaaucagcugcaguguuugccaaacaggcuaaauuagugauuuugaaaguauggucccugaaccaggaaccucagcaucaccaggcaccuugcuggaaaugcaaauucucaggccccaccccagaccuauugguucagaaguucuugggcugggagccagcaaccuguguuucaacaaguccuccgauccuaauacagccuccaggauaagaaccccuggguuggaugacaguaugaccagggaugggcagucuuuaaaagucuggcucccaggccucucccuugagauucugauucauuacugggcuggggccaggaauucuuauuuuuaaaaguaccuucagcgauucuuuucauccaacaaguguagaagacauuggguuaaaggcuuaugguuagaaccaagaauaauuuacugucaauagagcagaguaggaguuaagacagucauucuacuucaucgcaggaauaacucgguacagccaagaguugauuacagaaaugcuuauuggaauuaucuuuaugugucuagaauagucucaacuguaaagacagaguccuucaacaauuacagacuugaauacuagucaugauugaugcuaaaagucaauuuuuuuaagauguuaaaagaaagauaaaauuuuauauauguagaauuaaguauucacuacuaaggaauuugcuguauaggcaaucuccauuuguggaacaaauuuuauuuuaaaauguuaaaagcauuuuccacugaagugauaaguggucacuggauuccaagccuagcuugcagaauccucuacgaccuggaacauauacaaaacacccauugugcuaauucaucaaaauuuuuucuucugugggaaaauucauucuauguuccaauccaagacuagaggaauacuuaucucuccaucucagcauugggacugagaaguaggacucaaauauuggaggcucaggggaggguuccuuugaugauaguggcagcagucugcuucaguuugcuggaaaagugagacauuggguagagauccuuuggcacuucaaaugugcacauaagaaaguacccuuucuccagaagccuugcacaaaaauaguaauuugagaaauaauugcuugaaggaggaagcaguaucagaaaccagguucauaugccuuuaaggcugaaaggagagugaaucaaggccaaucauaccaucccuccuaggguggcuacccuguguccuugguauuuccuaugauaccccccagauauccaugugucaugcuucuuacuuaugccagaugaguucugggguccaucaccagcuugaccugguucugacuugacuccugauucaguauugacccaguugagacuucacaagccauaggcucuuaaagcagacucauucauugcuuuaggcuaauccuaaaucagggaauccuagcaucuuuuauuuuuuguagagaugggggucucacugugcugcccugguugucuugaacuucuaaacucuggguacccacuugaugcuaaggcaguaguuaccaaauuuuguccuuucuuuaucaccuucauuguuuuugccauauucuuaugagacugguacuauuauuuacguagguuuuuuuuacuacucucugucaguuuacuuuuuuauuuagccucauccuaaacaaaaguacagucauguguugcuuaacgacaggguuauguucugagaaaugcauuguuagacaguuuugucauuuugcgaacauugucgaauguacuuacauaaaucuagaugguguagccuacuacacaccuagguuauaugguauagcuuauugcucuuaggcugccaaucuguaugacauauuaucauacugacuaccauaggcaauuguaacacaaugguaaguauuuguguaucuaaacauagaaaagauacaguagaaauaugguauaaaaaauaaaaaaugauuuaccuauauagaaugcuuaucaugaauaaggcuugcaggacuggaaguugcucugggugagucagugagugaguggugagugaauugaaggccuaggauguuacuguacacugcuguagacuuuauaaacacuguacacuuaggcuacacuaaauuuaucuaaaaauauuuuucuuucuucaauaauaacaaccuuggcuuacuguaacauuuuuacuucauaaacuuuuuaaauuuuuuggccgggugcaguggcucacgccuguaaugccagcacuuugggaggcugaagcagguggauugcuugagcucuggaguucgagaccagccuggguaacauggcgaaacccugucucuacaaaaaagacaaaaauuaaccagacaugguggugugugccuguaguuccaguuacuuggaagacugaguugggaggaucacuggagcccaagagaggcagagguugcagugagccaagaucacaccacugcacuccagccugggcaacagaaggaggcccugucucaaaaaaaaaaaaaaacuuuuuaaauuuuuuaacuuuuugauucuuuuguaaugacacaucuuaaaacacaagcaagccagaugcaguggcucacuguaacccaacacuuugggaaaccagggcaggaggaucacuugaguuuagaaguucaagaccaaccagggcaacauagugagacccccaucucugcaaaaaauaaaaaauuagcugaacaugguagcacacaucuguaguacuagcuacuccggaggcugaagugggaggaucacuggagcccaggaguucaagaugacagugagcuaggaucaugccacuacacccuagccuagauaaccuugugucuaaaaaaaauaaauaaauaaacacaaaaacauuauacaucuauacaaaaucuuuucuuuauauccucauucuauaagcuuuuuuauuuuuaaauuuuuuauuuuuuuacuuuuuaaacuuuuuuguuaaaaacuaagaaacacacagauuagcccagaccuacacagaaucaggauggucaauaucacugucuugccuguccacuucuugucccacuaggagggcuucaggggcaauaacaugcauggaacugucauccccugugauaacaaugccuucuucuaggauaccucgugaagggccuggcugagacuguuguacaguuaacuucuuuuuauaaguaguaguacacucuaaaauaaugauaaaaguauaauauaguaaauacauaaaccagcaacagagucuuguauuagcaaauauuauguacuguauauaauuauaugugcuauacuuuaauaugacuggcagcgcaauagguuuguuuacaccagcaucaccacagacaugugaagugaguaaugcacugcacuacaauaacguuaagauggcuaggagauaggaaucauucagcuucauuauaaucuuuuaggaccacccucacauaugugguucauucauuguugaccaaaacguuauuaugagggucauggcuguguauaaaaaucagagauuugaccgguuauuuauuugucugauacacauuagaauaaauauauaaccacuaaaacuauucagaaaguucaugcauguuuauccccuaaaucaucucacaugucaccaacaguaauaugucacauguuggaaacccuauaacaaguguuccauucaguccacaauuaacuuauggagugacuguuguaugccaggcccacuucuagaggggugacuuaaauccuaguagagaaaaaauccauugccugcacaauuaguuaauuaaccagaggugggauaaaugcugugaagaaguguagaguacugugaguggguauaaugacaagucuguuuuuggagagggaagauuucucaguggaaggccagcaguugggauuaaccuucuuuagaggucgcauccuaguuguuuauuuaaaaucuuugaggaauagucauuuaugugucagcgaggcucaccauccuccauaaccuagggagaagaaaagaagcaaagggaguuaccauuugucaugugacaggcccaugccuuggcaguuggggguugggggcaccuucaugugcauuaucugcuuaaaccccuauucugaagacuucuuuccagagcuuacagauaaugaacuagaccuuccacaaggagggugaauaacuugcccaugggcauacaacaaucaaaugacagagccaagaccccaugucugccugacucgaucgccuuugauuuuucuacucugcuggguuucugccauugcuguuguuugaccuacuaggccauauuuuuuucuguaaugauuuguguauuacugugauguagcagcaaugauauuuuagaguggucaagaagcaaaucacacauguauuuaauagcuuugauuuagaaucuguccuguauuggaaagguuggccaauucucugucauauuauuaagaggugcaugucuuuuguucaaaaaugaaauaccuaggaaauauaaacucaguaaagagagucauagggcagaugguugacaaagagccagagaguuuaaauaucaucugucacuguuaucuggguuuaauaacugcccacacuggcccacagaaguauucuacaaaauggguaagagcuacauuuuuuuaucuuucuccuuuaauucuucauccagaguaacccauccuuacuccacauugaauuguauuuuaauacuaaaaaaaaauuguuauaaauuugguuaguggccaacuagucagcuuaaaggaugagauuggauggauggauggauggauggauggauggauggauggaugauuggaugguugugauagauugauuuuuaacuauacagcaaaauaaauucacaguauuaacuccccagguaucuauugguugccuuguaauccuaguuagaacugucuguaguuugaaaguuaugggguuuuccagguuacagcaaagucacauaaaaugcacauuuagaaaauaaaacaugcggccaggcguggugacucacaccuguaaucccagcacuuugggagcccaagguggguggaucacgaggucaggagaucaagaccauccuggcuaauacagugaaaacccgucucuauuaaaaauacaaaaaauuagcugagcgugguggcaugcuccuguagucccaccuacucgggaggcugaggcaggagaaucgcuugaacccaggagguggagguugcagugagcugagaucgugccacugcacuccagccugggugacagagugagacucagucucaaaaaaaaaaaaaggaagaaaaaagaaaauaaaacauguuucuuugaauacgaagauuguggcaagcagauaguaauucuuagaaguucugaguugccagcucugccaauccauagcuaagaaaugccaaaugccaccaggaagaauauaacaaauagagucacuguuagaaggaaacaaacaaggcuuccugauuugucauauauugccucuugucugguggccucucuaggcuugucgucauugauuucuaugaauuaaacaccaguagcugagaaacugacagugaaacuguccuuugugggucaguggucagugagcaaaugucuuuaaaaugucacugacuaccuugccaauuuucccauugguuacuguguuggugccuccccauaguugagcacccucccuagugacauccaggaaaugagguccuucacaagcugaccugaacaccagggugccagaaggcacgcccuagccugugagaagaaacccaucauuucagguuaggucgaaacacgugcauggaaaccagggcacuuuagacuuucagauuucuuaccuuuuguuggauauuuuccuagacucuguuuuuguuuuuuuuuucuuccuuuaaagaaccagccaaaugggaagaucucuuuuuuuuuauuuuauuuuuuugaggcagagucucgcucugucacccaggcuggagugcaguggcacgaucuuggcucacugcaaguuccgccucccggguucacaccauucuccugccucagccuccugaguagcugggacuacaggcgccugcccccgugcccggcuaauuuuuuguauuuuuaguagagacgggguuucaccguggucuugaucuccugaccuccugauccgcccgccucggccucccaaaguguugggauuacaggcgugagccaccgugccuggcugggaagaucucuuuaaaaagcauuuuuaugagugaggaaauauccaagaugguacccaggaaaagguccaauuuugguugaguaaugcaaacaagguaguucuaaguaagaacaaauuaauacuuugguaauguuauuaauauugauuuuuuaaauucuuuuuuuuuuuuggagacagagucucgcucuguugcccaggcuggagugcaguggugcaaucucggcucacugcaaccuccgccuccuggguucaagcaauucuccugccucagccuccugaguagcugggacuacaggcacaugccgccacgcccagcuaauuuuuuguauuuuaguagauacgggguuucgcuguuguugccuaggcuggucucgaaauccugagcucaggaguucaccuuggccucccaaaguacuaagauuacaggcaugaggcaccgugccuggccugauuuuuuaaauucuugauguguacuuuaacaugaauuugaaaaauauauuuguuuucaugacauauauugagaagccaccaccagaccuggccuuucccuguggcggcaucucuugguccuccaccuucccacuccagggcaccuccauucucauauccuaggucugccuguucugugaucuuuaccacaaaccagauuuuaucugcuuagucuucuucuaaccauucuaucacauaucauauaccacucuaccauucuuucuucccucuuacuucccaagccauugcuucccucuuacuaacaacugcugguuuauuacuucuucccauguucccaucccuguucuuagcccccaauaccuccccucgcugacucucuacuucuguuacuccuuucaaaucugacucuuggaauccuugucacauaggaagaaguuccuuucuuccccaaacuuuuacucacaaucuucuucaagguaacuaaaacccggccuuuuucuguaggugcucuauccccucaagaagggaauugcaguguuuuuagcuaucugcuucuugggggcacaguuccgccaaagccucccaacuucucuuugcaauccucuuacacuccugucuccccaguccuaauggcaugaccuggagauuuucaggacccaugauuuuccagcaaagagucacuacagaguaagaguaaauguuacugacagaaguguuuugcaaauacguggagacagagcaguuugagggucuugauugacucagcagcugcaucacucagcuugcacucucccugucccccagccuauacacaagcauuuagugacccccgugagaauuaauguuuucuucucccuucucaugacauuguacauuagggacuucaucauccaaauguuccaccacugaaaagaaagcucuacuuagagacagaaauaagagcaacuagagcacacgugcuuguuuaacacuugcaucuaggcuuuuggugggcauguuuccuccccuccagcuccccuccuuuggucugagacccacuuccaugcuaggauucacuucucuucccauccccacgauccuuaagccccaaccuacuuccacacccccaacccaacauucagccccaucuccaguuaauuaagaugagugaagcccucgaagugaguuccuuuucucuuucaguucaaaaauuucucuuuaucuucaccuucuccuuccuucccuccaguuucugagaaggaugcauucucccugcuuacaaggcaaaucucccucaacccuugcucuuguuccuacccugcuucuagguucucacuucauccaucaucccuuucugacuugccucguaagagucaaaucaug

SEQ ID NO: 14270 - RNA, 1993 nt, Homo sapiens
auucucugcaaaacccauauuccaacuauggaacauucaacuaaagguaaauuuauguuucuauacaguuuuaccaaaguuguuuaaaaaauagcauuuuuuaagguggaaauuuugacauuguacuucuuuuaucacucauaaaaugucauaacaacuuccucauauaacuugccuggaguccacucgagagcagcauuccauguaaggccuccaauugggcauuguaaaguaaagcuuucagaucagcuccaguaaaggagucaguuacugaugcuacaugcugaaggucaacaucaucugccagagguagagagucacugaggacauuuaaaauuucaagacgugacaccugaaaggagaaaaauuuauuuaacaaauaaaaaauaaaauuaaaaauauuaucuuaaauuguguaucuuaugauuuucuucauaaauuaaccuuauauaucuaaaaagcuuuauaaguaaguugagaaauguaccaacagccuacuauuuaucuuccuuggaauuuuuuccccaacagaaauaauauauauaggaaaaugaaugaaaaucaaacacucuuaaggcugggcaugguggcucacgccuguaaucccaacacuuugggagguugaggugggaggaucacuugagcccuggaguucaagaaagccugggcaacacagggagaccccaucucuauacaaaaauuaauaauaaaauuaucugggcaugguagcgugugccuguggucccagcuacucgggaggcugagguggggagauugcuugagccugggccauagaggcugcagugaguugugaucguaccaguguacuccagccugggugacaaagugagaccuugucugaaaaacaaaaacccaaaaaccuacaaaauauucaguguaaauaauuucuuauucacacagugcuuauuuucuagauuuaggcaagugugccaagaagguauuucaaaaggaaaaucuaaauaauuuaaauaauagcuacauguaacauauauacagauacuuuauaccuuugacuauucauuugucuaucuguucuuucauucauuuauuuguuugcuucuaaauuggagaauaagaguuggaacaacacaggacaaggaagaguugaaaaauuaucucuaugaaaccugcuuacaugcuuacgauucacaugcuugauucuguaucagaguuuuuuuuuugacaggauaauggaaguauguaaucuuugaacagaagauaaugugaaaauauaauacauuagguuucuugcauuuuuuuuuccccaaucagccaacacagaaggauuacaaaguuuucagacuugcacugggccaaaaaaaggcuuugcaucuaauucagaaucuuuuuaugcuuugagcaaacaguggcuaaagcuuuucccuaagaaagcuggucuucuaaggacaauugccauuaccuggcagaaguaaagcucacaaggaaagaguguagcauuuguuggguuuuggacucuaaauaugaaauugucaccugaucaggaggaggacaguauacacauuuaucuagucgaccaggccuaagcagggcagggucaaucaagucagggcgacuaguagcagccaauacauaaacaccuagaggaaaaaagaacauuuuuuuaccaaaaucugaugacaugaugacauuuuguuauaacauucuauuucuguauuuauaauuauuacccuguaagccuucuacuccauccaacugagucagcaacugguuaacuacucggucuguaacuccuguauuaucaugaccccgccgaggagcaauggauucaaauucaucaaagaaaagaaugcagggcuuugcagccugugcucugggaaaaacaaacaacauuucauauuugaaucaggcuucauaguuggcaaagugauuucauauacauauaugaauguauuuauuuuauguauuuauauauauuuauauacuucuuuuaauuuuuacaacaaacccuuaa

SEQ ID NO: 14271 - RNA, 7125 nt, Homo sapiens
cuccuccuagccgcuccggaccccagaggcggaaguaaaagcgaacuacaguggaugggugcaguucagggugagauugggaagguggugaggcugugcuuuccuuucuuuuuguuaagaagugggugugggugacugcuguacagugcagcccuuugcagauuugucuuuggaggaggaagagggauggaaagagccuucgguguggaauuaccuugguuuugaguuaagaaagacccaccuggguucgaacccuaaugcuucagcuagcgaaggcaggcuaguaugggagcucggcgcuguuucagauuuuguaauuuuaaggcuuaugccuaccuuuuaaauuguuguggggaguaaagcgagacaauauauaugaagcacuuagcuuugguacaaaacguauucgugauuccgcuaccuuuucccaucauauguaggcauguacuugccguuuucuuuucuguaugucugagaaauguuguuugcaagagguaaugcaucucacgagaacauaaugcaacgagaacguuagcugggaucgaucucuuauuuuguauuaggaaggccugaaauauuuugccuuuuuuuugugugugugugucauuuccagagauagcuguucuccagccuuucuggagggaugcagagccuuuccuuaggacaaacaaggugagaaaugcauguaaagaucuccaaacuuagcuugcuguaucaaaagaagaccagcuggaaugugguauuuuagggccagugauuaguuauuuccauuaacagccuuuuuaacaggccaguuguggggcagaggcgaacguaaaucuuuuuuuagaccccucauacuacaagcauagaaauuuucaguguuuguuaaguuugaacauuagcccuuuggauaaugguuuugguuaauuaaaaagucaauuugagaaauagaucgaagucaauuuuugaauagguaccauuuuugaaauuuguacgugaggaaaguugcuaacuuucuuguauuaggcuauuuagauguucauuuacccuacuagauauuaugaguauuuugaauggagauccguugcuaagaguaaagcaucauggagaauuuugaagugugacuuuuuugguacuagaaaccgaaaaauagauaaagauaauuuguauuuuccauuguuuuucacaccaaaggccaguuuuacuuguuuaaauuuuuucaucugacugcaaaguaacacauauucauuaaauaaagucccaguauuucagaaguaguacauagccucuaauaaucuuucagaaauaagugucauuccacuuucccccucuguauauauuaacgucccccuccccgccuuuaauauacauggcauuauccauacuguuaagcaguuugucauguagaauaucugacaucuuuugauugcaguagaucggccuuuauuuuuggcaccuuuauaguauauugcauagauguaccacaauuuauuaauuauucuauugguggccauuuggguuucuucuucuuuguuauagcaaauaauguuaugauggucauccuuuuucuuucuuucuuuuucuucuauuuucuuuuuuuaugagacagauucuugcucuguugcccagacuggagugcaguggugcaaucucagcucacuacaaccuccgccucccagguuuaagcaguuauugugccuuagccaccugaguagcugggauuagagacauauaucaccaugccuggcuaauuuuaguauuuuuaguagagaugggguuucgucauguuggccaggcugaucucaaacuccuggccaacaucucaaaguggugagauuauaggugugaagccacugugcuuggccuagucauccuuuuucauaacaaacacauauugucuuuuuuucuuuuugagaugggcucacucugucauccaggcuggggugcaguggcuagauuauggcucacugcagucuggaucuccugggcucaagcaguccuccuaccucagccuucugagcagcugggacuauaggugugugcuguuacaguuggcuaauguuuugauuuuuuguagaauaagggucucacuuuguuguccaggcuggucucaaacuccuggguuuaagcaauccucccaccuuggcuuuccaaaaugcuggcauuacaggugugagccgcugccccuggcccuuuuuucccccuuuggauaaucuccaagaaguggaaaugcugaauuaaaggcuaugaacauuuaaaauuguggcagcuggugccaaauucugguccauuaacaauauuugagaauuuccucuguuuccucauauguucauuaacagucaauauuauuaauuacuguuucuaaguuuagcugagaccacacaugucauuuuuagaguaaauuuacugcauuuuaguauuguaaucaagaccaaauuucuagguuuagcugagaccacacaugucauuuuuagaugucauuuuuagaguaaauuuauugcauuuuaguauuguaaucaagaccaaauuucaguugccaguuguaaguccauuucagcucuuguuuucuauaaauagaaagcuuaguuuuagauuccuuaguaauaaauuaucauaaaacaaaugguugauuucagugguuaguauuuuaaaguaaguuaaggauuugagggaagauuauauuugaaugggaccuuguccuauggauaggcaucaggaggaugggccuuucuaaaagaaagaacagcuuaagcaaagguagggagacaggaaugggcaaggauguuugggaucagagguuugagaggcgauagugcuagguauugaggugguacaauagaagagauagcuagaaagguaguuagaaguagaugguaagguaguuagcuaacugaaaagguagcuagaaaaagaucacuuugaagauuuuguuuuuucggggagagcuacagaaggucuuuaaucagagaaugagggacauaaucacaucauuuuacaaaugucaguaugguggcaguuucgagugauggaugucagagaagcacaucagguggcuguuacaggcuggguaaaagagaaugaagacuuguaacagaaugagaauuacaaagaguagcgagguuggauuucagagagaugccaaagaaguugagucuacgugauuugaugacuggaguugaggaagaggaagaaagcaaagcucacuuuuagauuuuuaucacaaaugacucuuagauagugauugugauaaugauaucuuuagucagaagagggcaaauuuggggacugggaaagauacucaaguuuggggcauguuaaguuuguguggaagaaacuuccauggaggaugaguuauacacaagacaugaaauuuacuugugacagauuuagaagaaacguuuauagauuuguuacuuuuuguuaggaauuuuggcuuacauuuucaccuauuuuuaguuuguuauuaauagaauuucuguugaacauucuguggcuuauucagccuguuuaccaugaugcuaauaguccuaagaaagugcacugucuaguagucuucacacuuuuuugauuguguacauugucaauagaaauaugccuacaauauauguacauuuguuuauugauuauauaugucuuacaguacaaucauauuguuuauauuauaaaacauauguagaaagaauuuuucaaaggcuaagacaaauacaaauuguaguuuuaacuauuuucuuccuccaucccauuguaucaucuuggaccucucuagaaaguacugaucugauuuccagcugacgcauucugccccuuuauuccaguagaggucagucgagcaucuggaagagaaaacaggcuguugaacuaugcaagguagagccgucauucuucaguuagaaggauaauuauauuuuaaaguuucuaaauucaugcauuuuuggaagaguaauuacagaguaguaugugguauuacggagaagugaagaauagugagcucaguagaguauggaucaaucugaaaugugcuuuuguuguuugauguuuauguugugaguaccuugcauuuggcuuugaacauuacuugauucuguaguuuugggaucuuuucccaauucugugagaaucuguagauuaugugagccacaggaauguucccugccuguaggcauaaucaaguucuaguuaaaauuggaguaauugaaaggacagacacaaagaggcuuucuuugaaauugaucuugaaagcaguaucuuuagcccaaagagguuaguaguggguuggaauuaucuaucucuauuuucuguuuuaugcuuaauuaggagaaggagaaaaaagaaaugccuuuucuaaguaagagcccauuguaaguaauuagaaaucaagcacgaacuuguuacagcuauauauucuaaaaaggcaaaaguacaguuuaaaaaauauauauguacuguuauaugacucaggcacaaguagcuuagaaacaaaucaucagauagguugaauaacagaacacuuuuucuguugcuuuccucauaaaauauuucuuauaaauagagaugcucauuuuaguagggaccuaugguuaugauuauaaauaaguuuguauguuuugagccccauuuccaaaugaucaggaaaaugaguuauugagguuuuagucacaugcuagaagcugcaaguugaaaguguuguguaacagaugcaaacagcccagaauuagucuuguguaauauggugauggagaaggggagaaugguaaagguaacguuuuaauguuuacaugccaucuuucagcacaguuucacauguggcgggccauguggauuuaauaucacaacuagaucauuuugaagaugaaaauugguuuggaauuauuggguuacaacguagggaaugauaggguaaaccaaaugagauggagauugugaucaagagcuguugacuagaggucuauauaagcuaagaaaaauuaaggcuuuaaugguagcauggauauaaaggguagcaggaauuuaggaaaagauguucaagauggaaauuaaucugagguguugguuuucagggcuagauuuagaguuugaaaaccaggaggccagaggcaaagaaaucuaguaucuaugggcagggcaaggucgaagaccuggaaaauugaaauaugaggcagaaaugaaagugucauuauaagaaauaagccacgccuggcaugguggcucacaccuguaaucccagcacuuugggaggccaaggcaggcagaucacuugagcccaggaguuugagaccagucugggugacauagugaaacacugucucuacaaaaaauaaaaauaaaaaaucagcugggcguguggggcauuccuguggucccaacuacucaggugguugagguggaagcaucaccugagcccagggaggugaggcugcaacgagccaugauagugcugcugcacuccaagccugggugacagagugagacccugugucaaaaaaaaaaaguuuggaaaucaggaggacaaagcagagauggagagggucaacugauuuuagguagccaaggcaggcaaagguaaacaaaaagagcaagaaaaaagcaagaacaauucuggggcacuaauggugccccaccugcuuuucuuuagguuaacaauggaagcaguccugugcuuacagguaacagaagcagugagcuagggagagacaguuauauauguacauuuguuuauugauuauauaugucuuacaguacaaucauauuguuuauauuauaaaacauguagaauuuuucaaaggcuaagacaaauauaaauuguaguuuuacuauuuauuuaauaauucagcaguggcugaauuauuaacacaguucuggagagcuggagcugaagguauauucucauagaaaugaccaugaugcuuauaggauuguaauauggucauuuaguuguuuaacacaugcauuuguguaauauuuuauguguuguuuuacacagcauuucaaaagguuugaacuaccuaaccauuauggcaccaggaaaccucuggcauaugagaaauaacuuucucuuugguucaagauguuggaugacucgauuuucagcagaaaacaucuucaaaucaguuucauuuaggcuuuuuggugugaagugucauaauacagacagugagccuuugaaaaaugaggaccuacugaaaaacuuacuuacuaugggaguagauauugacauggcaaggaaacgacagccuggaguuuuucauaggaugauuaccaaugagcaggaccugaagauguuccuucuuuccaaaggagcuagcaaagaagugaucgcuagcaucauaucaagauauccacgagcaauaacacguacucccgagaaucuuucaaaacggugggaucuguggagaaagauugugacaucagaccuugaaauuguaaauauuuuggaacguucuccugaauccuuuuuucgguccaauaacaaccuaaacuuagagaauaauauaaaguuccucuacucaguuggauugacccguaaaugccuuugucgauuguugaccaaugccccucguaccuucuccaauagucuugaucugaauaaacagaugguugaauuuuugcaggcagccgguuugucauugggucacaaugaucccgcagauuuugucagaaagauaauuuuuaaaaacccuuuuaucuuaauucagagcaccaagcgggugaaagcuaacauugaauucuuacggucaacuuucaauuugaacagugaggaacugcugguucugauaugugguccaggagcugaaauccuagaccuuuccaaugacuaugccagaagaagcuacgcaaacaucaaagagaagcuguuuucucuuggauguacugaagaagagguacagaaguuugucuuaagcuauccagaugugaucuucuuggcagagaaaaaguuuaaugauaaaauagacugccucauggaagaaaacauuagcauuucacaaauaaucgaaaauccucggguucuggauucaagcauaaguacuuuaaaaagucgaaucaaagaauugguaaaugcuggcuguaacuugaguacuuuaaacaucacucuucuaucuuggaguaaaaaaagauaugaagcuaaauugaaaaaguuaagcagau

SEQ ID NO: 14272 - RNA, 4766 nt, Homo sapiens
ccgugcgcuccuuaagucaaaggcaucuguucuggaagcagaacccgguuugcuguugguaaccagcguuaagagcaggauuuuuaaacaugauaauggauaaaauaaaagaaaagcgaagucccgcgguccucugacuccuauucauuaucuccagcagcauaugggaccauucuccuacguauccucgccuuuuucuucugaaaaagcaaaagcaaccaagccugucccgcuucagagcaauccuacucuuugugccugaguagugccaccaccacuacuuccuccuccucccgccuccuccuaccccgcccuccugccgcuggcuuucgcucuggcgaggaggcggccggcucccuuugcgccgggaagccggagccgcgauugggcgacggucccugagccuccaguucugcgucgguuucaaggcuccucccuccuggugaaagacagacuacggggcgccuggaaaccgguccgagggcgcgcgaggcagaggagagggagcgaguugagggauugacacaaauggucaggcggcggcggcggagaaggaggcggaggcgcaggggggagccgagcccgcugggcugcggagaguugcgcucucuacggggccgcggccacuagcgcggcgccgccagccgggagccagcgagccgagggccaggaaggcgggacacgaccccggcgcgcccuagccacccggguucuccccgccgcccgcgcuucaugaaucgcaaguuuccgcggcggcggcggcugcgguacgcagaacaggagccgggggagcgggccgaaagcggcuugggcucgacggagggcacccgcgcagaggucucccuggccgcagggggagccgccgccggccgugccccuggcagccccagcggagcggcgccaagagaggagccgagaaaguauggcugaggaggaggcgccuaagaagucccgggccgccggcgguggcgcgagcugggaacuuugugccggggcgcucucggcccggcuggcggaggagggcagcggggacgccgguggccgccgccgcccgccaguugacccccggcgauuggcgcgccagcugcugcugcugcuuuggcugcuggaggcuccgcugcugcuggggguccgggcccaggcggcgggccaggggccaggccaggggcccgggccggggcagcaaccgccgccgccgccucagcagcaacagagcgggcagcaguacaacggcgagcggggcaucuccgucccggaccacggcuauugccagcccaucuccaucccgcugugcacggacaucgcguacaaccagaccaucaugcccaaccugcugggccacacgaaccaggaggacgcgggccuggaggugcaccaguucuacccucuagugaaagugcaguguuccgcugagcucaaguucuuccugugcuccauguacgcgcccgugugcaccgugcuagagcaggcgcugccgcccugccgcucccugugcgagcgcgcgcgccagggcugcgaggcgcucaugaacaaguucggcuuccaguggccagacacgcucaagugugagaaguucccggugcacggcgccggcgagcugugcgugggccagaacacguccgacaagggcaccccgacgcccucgcugcuuccagaguucuggaccagcaacccucagcacggcggcggagggcaccguggcggcuucccggggggcgccggcgcgucggagcgaggcaaguucuccugcccgcgcgcccucaaggugcccuccuaccucaacuaccacuuccugggggagaaggacugcggcgcaccuugugagccgaccaagguguaugggcucauguacuucgggcccgaggagcugcgcuucucgcgcaccuggauuggcauuuggucagugcugugcugcgccuccacgcucuucacggugcuuacguaccugguggacaugcggcgcuucagcuacccggagcggcccaucaucuucuuguccggcuguuacacggccguggccguggccuacaucgccggcuuccuccuggaagaccgagugguguguaaugacaaguucgccgaggacggggcacgcacuguggcgcagggcaccaagaaggagggcugcaccauccucuucaugaugcucuacuucuucagcauggccagcuccaucuggugggugauccugucgcucaccugguuccuggcggcuggcaugaaguggggccacgaggccaucgaagccaacucacaguauuuucaccuggccgccugggcugugccggccaucaagaccaucaccauccuggcgcugggccagguggacggcgaugugcugagcggagugugcuucguggggcuuaacaacguggacgcgcugcguggcuucgugcuggcgccccucuucguguaccuguuuaucggcacguccuuucugcuggccggcuuugugucgcucuuccgcauccgcaccaucaugaagcacgauggcaccaagaccgagaagcuggagaagcucauggugcgcauuggcgucuucagcgugcuguacacugugccagccaccaucgucaucgccugcuacuucuacgagcaggccuuccgggaccagugggaacgcagcuggguggcccagagcugcaagagcuacgcuauccccugcccucaccuccaggcgggcggaggcgccccgccgcacccgcccaugagcccggacuucacggucuucaugauuaaguaccuuaugacgcugaucgugggcaucacgucgggcuucuggaucugguccggcaagacccucaacuccuggaggaaguucuacacgaggcucaccaacagcaaacaaggggagacuacagucugagacccggggcucagcccaugcccaggccucggccggggcgcagcgaucccccaaagccagcgccguggaguucgugccaauccugacaucucgagguuuccucacuagacaacucucuuucgcaggcuccuuugaacaacucagcuccugcaaaagcuuccgucccugaggcaaaaggacacgagggcccgacugccagagggaggauggacagaccucuugcccucacacucugguaccaggacuguucgcuuuuaugauuguaaauagccuguguaagauuuuuguaaguauauuuguauuuaaaugacgaccgaucacgcguuuuucuuuuucaaaaguuuuuaauuauuuagggcgguuuaaccauuugaggcuuuuccuucuugcccuuuucggaguauugcaaaggagcuaaaacuggugugcaaccgcacagcgcuccuggucguccucgcgcgccucucccuaccacgggugcucgggacggcugggcgccagcuccggggcgaguucagcacugcggggugcgacuagggcugcgcugccagggucacuucccgccuccuccuuuugcccccucccccuccuucuguccccucccuuucuuuccuggcuugagguaggggcucuuaagguacagaacuccacaaaccuuccaaaucuggaggagggcccccauacauuacaauuccucccuugcucggcgguggauugcgaaggcccgucccuucgacuuccugaagcuggauuuuuaacuguccagaacuuuccuccaacuucaugggggcccacgggugugggcgcuggcagucucagccucccuccacggucaccuucaacgcccagacacucccuucucccaccuuaguugguuacagggugagugagauaaccaaugccaaacuuuuugaagucuaauuuuugaggggugagcucauuucauucucuagugucuaaaaccugguauggguuuggccagcgucauggaaagaugugguuacugagauuugggaagaagcaugaagcuuuguguggguuggaagagacugaagauauggguuauaaaauguuaauucuaauugcauacggaugccuggcaaccuugccuuugagaaugagacagccugcgcuuagauuuuaccggucuguaaaauggaaauguugaggucaccuggaaagcuuuguuaaggaguugauguuugcuuuccuuaacaagacagcaaaacguaaacagaaauugaaaacuugaaggauauuucagugucauggacuuccucaaaaugaagugcuauuuucuuauuuuuaaucaaauaacuagacauauaucagaaacuuuaaaauguaaaaguuguacacuuucaacauuuuauuacgauuauuauucagcagcacauucugaggggggaacaauucacaccaccaauaauaaccugguaagauuucaggagguaaagaagguggaauaauugacggggagauagcgccugaaauaaacaaaauaugggcaugcaugcuaaagggaaaaugugugcaggucuacugcauuaaauccugugugcuccucuuuuggauuuacagaaaugugucaaauguaaaucuuucaaagccauuuaaaaauauucacuuuaguucucugugaagaagaggagaaaagcaauccuccugauuguauuguuuuaaacuuuaagaauuuaucaaaaugccgguacuuaggaccuaaauuuaucuaugucugucauacgcuaaaaugauauuggucuuugaauuugguauacauuuauucuguucacuaucacaaaaucaucuauauuuauagaggaauagaaguuuauauauauauaauaccauauuuuuaauuucacaaauaaaaaauucaaaguuuuguacaaaauuauau

SEQ ID NO: 14273 - RNA, 41319 nt, Homo sapiens
aggggaugacguaaaaaggccgcgcuguacugcggcuugugccgcuuccgcaagaagguuuccuggccuguugcagccauggugcauugcaguugcguguuguucagaaagguccgugcggguccccucagccugguccccuuagcgcugacagcucugguucuucuuugcuccccugucucuccacuacugucuucguggcggccuuuuccuugcuugguuuucccauagacuucuccgccccuccuguaguggcgcuuugucaguaagcggugacagugguguguguaccuggcgugguuuggacgguuguuugggggcaggggcaggguuugaaguucuuuagagacauagugugcacgugguaugaggaacugggauaccugccugcuguggcccaaauguuguggugguuuuuuuuccuuuaauguccacagccuguuuuuauauauuucuccuugagugcgcuguuuaagguuuuucuaauggauuuuuaugaagacacgaaagcguguaauugaugugccuuccugcagaacauuuaggucgauuuuuguguggugucggucuuaagaaucguuuccguaaaaauuuacaacugcuuugaauuuuuauuuuuuaaaucuuauccuaucaguaaugcuuuuugaaacguugccugcgucauauuuggccauuacuuuauuucuaacgaccagaguaaaauacuccuuuuaaguaaggcuccuaaaccccugaaucugauuaaucuagagcaggaaaaaaguguuacauauuuaauggaacuguagaaacucuccucgaguauaucagaauggucaauauuucaacuuucuugaaaaaaaaaucccauuuguuuuuuauaauagcuauccuaaaugacuagagauguggauuaugaauuuaagaaauuacuccuuaaguuauuuugauuuuaauagccuaagagguuaauacguaaguccuuuaccuacaagaaguucuugauuuagugaaggaaacagguaaacacuaaaugcagcgugagauuuauaaagguguaauaauagagauauaaucaaauugcugggagagccagcaaagucagagaauugauuagaggaauuuggaaagacguuagaaaauaugacguuuagguggauuuaugauaggaaaaacaaaugacauucuaaguagaggaaaagcaugagcagaauggcauguagaaauggcgguauuucauguaguacagagcaaagaggaagagaggaaggguugagcaagugaaaaggauacaggaaggaacuaggcaugguaggugagccuauuguucuugcuacuugggaggcugaggugggaggaucccuuaaggccaggaguucaagaccagucugggcaacauagcaagaccccaucuuuaaaacagucggggugguguggugccuguagucccagccauuugggaggcugaagugggagaauugcuugagcccaggaguuugaggcugcagcaaugauagugcuaugauagugccacggcacucgagcccaggcaccagaaccagacccuguuucaaaaaaaagaaaauaaaagauaccagaaggguauuuuaguagcuuuggauauacaguugacccuucaagaacauggggguuagagaugcccccgccacagcugaaaaucuucauguaacuuucaacuccccccacaaaacaacuacuaauaaucuguuggcuggaagccucacugauaacauaagccgucaguugacacauauaaaauauauauauaguauauacuguauucuuaaauuaagcuagagaaaagaaacaguuacuaagaaagucagaaagaagggaaaauauauuuacuguucauuaaauggaagugaauuguaaaggucuucauccuuauagucuucauguugaauagacugaggaggaagaggaggaguuggucuugcucucuuggguggcagaggcagaagggguggggguggaggagguggaaggggaggcaagagaggcagacacacuauguguaacuuuauggaaguacaucauaauuucugucaugcuuuugcuuuucucuuucccccaaaaaaauguuucuauaggguaccaauaccucuuccaccauuugcuuugguuucagugccucuucacagaaggguccaugucauaaaagaagucaaaagcaguccugaacaauaggagcucuucugccagauuaucuaauguucguuuuucugguaguuuauucuguguuuucuuccuuguuaucuggcacuggaucugaagcacucaucaagcugucuucuguuaauuccucugguuugguggcuguuagcucuugaguuucuucaagauccauaucuugaaguccuuuacccacuuucccgccguuuuuggcauauucacagccucuuucaugauuuccuugauuggcucuuuuguaaauccugugaaauuauaacacaacacaacaccuggacaaaguuuucuccagcacgaacuuacuguuuggggcuuauggcuuucauggcuuuuucaauaauaauggcaucuucaauuauguaaacuucagauuuuccugaaguuuucucuauuaguguucuuuuccaugguugacaauccuuuucguagaaaaucauguuuaaugagccuuaaagguccuugcgaccccgugaucuagaggcugauuuacagacauuguguuugggggcaaggacaccacuucagugccuuugauguugaacucaugggguucuggguagcggggagguggggcacuguccauuagcagaggaacuuuacaagucagucucguauugggaagguacuuccugacuucagggagaaagcauccauggaaccaauccagagaaaagguuuuuguucucuaggccuucuuauccaacaaagacuggcagcugauguuuaucuuucccuuucaagauugagggguuagcagcuuuauagauaaggacaguccugauuacaaacacaacugcauuugcacaauacaguaggguuagccuaucccuuccuggcuuaaauccuggugcucccuucucuuccuuacuaaugucuuuuguagcauguuuuccagaauaggguacuuucaucagcauuaacaaccugauuugggagauauucuuucgucucagugauuuucuuaauggcaucugggaacucaucugcugccucuuaguuggcagaaccugcuucaccuguuaucuugauauuucuaaagccaaagccaaaccuauuucuucuuuuuuuuuuuuaaauuauacuuuaaguucuaggguacauguacacagcgugcagguuuguuacauagguauacaugugccauguugguuugcugcacccauuaacuugucauuuacauuggguauuucuccuaauguuaucucucacccagcccccaaccccaugacaggucccagugugugauguuccccccgugucccaaguguucucauuguucaguucccaccuaugagugagaacaugugguguuugguuuucuguccuugugauaguuuggucagaaugaugguuuccagcugcauccaugucacucauccuuuuuauggcugcauaguauuccaucguguauaugugccacauuuucuuaauccagucuaucauugauggacauuuggguugguuccaagucuuugcuguugugaauagugccacaauaaacauacgugugcaugugucuuuauaguggcaugauuuuuaauccuuuggguauauauccaguaaugggauggcugggucaaaugguauuucuaguucuagauucuugaggaaucuagaacugucuuccacagucaaaccuccuucuaaaauuaucaaaucauccuuugcuggcaauuaauucuuuagcuuuagauccuucacauuccuuuugcuuuuaaguugucauaugguaaccuuacuuuuucuuuuauuguauuagucuauguuuuuaaaauaggaauccugcaucuacauaaaaguugccuuuuuaauacaagauaaaaaguuaauucacaaaaagugcaagguuuucacaccuuuuggcauagcugcugcaguggcuucaugaauuuuugucuuuuuuuacacugauucuuauucuggauucauuuaucuugagauagcaggccaucgcagcuacagauuuuaaucugugguagauaucaagcaauucaucuuuuuaucguagugucaugacuuuacuucuugggagcacugccagcaucacuaguggcacuuuguauggguuccauggugguguucaagguuuacaguguagcgcugaacaugaugaaaaaugcaagagaacugugagagauuacuuuuuacugacuuauaaaauguacuggcaagaugaacugcucauggggagacgauuagcaucacauggccuuuuaaguggcaacuugggacacuugagaucccgggauaguuacaggagguaacuacgaaauuauuacaguauuccacgauguacuacaguuaauuuuaugcaguuaugauuuaauacugcauuuuuacauuugcuuacauuucucuugacugcaaaugcugccauguaagaucuguaaguguguguguaaguuuugauaaauuuuaaguuuuuauaauagauguguggccaggugcaguagcucaugccuguaauuccagcacuuugggaggccaaggcaagaggauuguuuguggccaggaguuugagaccagccugggcaacauagcaaaaccccaucucuaguuuuuaaaaauuaagauagauauguguauauuuuauggaaguaaaugacaaaauagauuagcaucuauauauuuuuugcacucauaacacacagcuuuucuuaauuuuuucaauauuuccaaucuauuugcuuuguaaguuuuuucaaauuguugcaaagcucaaaaaauuuuucuaauauauuuauugaaaaauaucuguauauaaguggacacacgcagcucaaaccaguguuguucaagggucaacuguaguacuaagaauuuuuuacuuuauuucauaagcauuuuuuuuuuugagacggagucucgcucugucgcccaggcuagagugcaguggcuugaucucggcccacugcaagcucugccucccagguucaugccauucuccugccucagccugcagaguagcugggacuacaggcgcccgccaccacgccuggcuaguuuuuuuguauuuuuaguagagacaggguuucuccauguuagccaggauggucucgaucuccugaacucgugauccgcccaccuuggccucccagagugcugggauuacaggcaugagccacugcacuuggcucauaagcauuuuuuuaaugcaugguuuuugaguaaaggagaaacaugauuagagaucagaucaauuucagaaaaauaguucaggcaacaaguuggagaaugcaauaaggaaaaaaugccuaaacacugaaaggagcucauguggugcagguacuagggcagugguacuggagagaagagaguagggcuuugggaaaagaagcagguguagucugaaagacuuccauuuguguagucucaaugaauauguaaaccaugguucuguuacuuuagagaacauuggaggaacagauuuuaccuggggaagaguuugguuuuguuauguuaacauuuauuuuugagguggcuauuauucaacugauauguaagaacaaguuucauauuggggaauuucaaauauaaguuaaauacacauucugcucacauuugcuuuauacuauuaaaagcuuucauccugguggaaaugucugacagauuggacauagaaaauaucucaccuaggugaugguuauugguacaagcagaaauuacccaggggagaaagucuagaaugaaaacagggccaagucagaaacccucaggauaggugggacaauaauugauaacugaaaaaacuaaaagggacuuaagagagauaaucaaaugggaaagggggucagaucggagauguggaggugagcuaagaaaauguuauagaauuggcaugugaaaagcuauuaacgacuuuuuuagaagaaguuuuaguggaagaaagaacuagaaaaagguucuaaggugauacacuuuugguauacaaauauucuuucucuuuuuuuuuuaaguauggaaauuucaucgauaagcuaagacucuucaccaggggaggauccgguggaauggguuauccucguuuagguggagaagguggaaaagguggugaugucuggguuguagcccagaacagaaugacuuuaaaacaacuuaaagacagguauccucggaaacgguuuguggcuggaguaggagcaaacagcaaguaaguaauuacugaaugacuuaaauuuuagaaaaucaaacccuucuggaaauuuuuuuuuuaguuacaaaauaaaaacuuaauuguuaauuugaaguaaauuauuuccuguauuuauaaccaagcaaaagccuaaaaugucucaacucauaaaagacugauacuaaagaauauuucagaguuuuaaaacuuucuguccguuucuuuucccaaugucuaucuguauucuuuuugcacuuccccuguagaaaccgauaauuaucugaauucccacuguuuucuucuaaaauuaucuuugacaaccuuuuagaaaacuuucagucuuaaccaugcuacucuaccccaccaccauuagaaggcaagauaaccacuauuaaccuuuucuugacuuuucuaagacuuuucuguguguuuacacaaaugcaauuaugugccuaaaaguuuagaauacaaaaaugagaguacaguauuuuacaaucugcuauuuuuacuuuuuuucacaugucaaaauuauucagaauaccugcauaauaaauaacuauuuugucauuugucuauuuagguuauuguugauuuuuuuuuccgauuauaaccacagugcagcauucuguguagauacuauuuuacauguuuguucaauuauuauuuugauaaauucccagaaguagaauuacuaaaacauuuguacuaauuuuuucuuuuaugagcaguuuaagaguagccagauuugccuucuauaauguaaguacucucauuugagguuaguuuuuuaaaagcuuugcuauuugguggauuuucuuuuuuuuuuuauagauucauuuuuucuuuuuuuuuugagacagagucucauucuguugccuagguugaguguagugggcacuaucauagcucacugcagccucuaccuuucaggcugaagugauccucccaccucugccucccaaguagcugagacuacggguaugugccaccaugcccagcuaauuuuuaaauuuuucuuuuuuuguagaaauggggucgugcuaugguguucaggcuugucuugaacuccuggacucaagagauccuccugccuccgccucccaaagugcugagauuacaggcgugagccaccacgccuggcuuuuucuacccuauuuguauuguagcaauaaucucuucauuucaugguugcaauauuuuaguuucggguuaaaaugaccuuuggugguuagcuuaguaacuuaaaucauuacuuaaugccauuuuagugggauauaauagucuaaaaugcaaagaaauaauuagggauaauuuuaguuuuuuuaaaccccguguuugaccauuuaacaucugcguuaaccagagaauugauugcuacucuucuuuguaaaccauuuuguguguauguguguguguguauauauacacacacacauacauacauauauauacuuuuuuuuugguagaauuagugcacugaaaggcuccaaaggaaaagacugugaaaucccugugccuguggguauuucaguaacugaugaaaaugguaaaauuauaggugaguguacuauaacuccaaaaguuguaaaaaugugcacguuuucuaaaaugaaacaauggaauagcuucucuugaguuucagaagauuuuuuaacuaacaauuuuagcuacuauucuauaagagagcauuuuuaaaacuuauaaaaguuaaauugacugcuagauuuaagauuguuuuaaagauguuacaguucuuacuuggucuuaaaauauauaacuaggcucuuuucaauuguuuacugaaguguuuuucuggggucaaacuuuuaauagauuuguaaauuggaauuuccuggacuguuuuucugaaagaacaauauuacauuaaugauucuacuuauuaauuauagauuuguaauugagaauuuccuggcauguauuuuugaaaguaaaauauuacauuaaugauuucacuuacuaaucuauagauuuguaauuuugcauuucuuugccuguauuucugaaagaaauauauugcauuagugauuucacuuauuaaucuuugcuguaaguauuucucucccucuuuuuaaggagaacucaauaaagaaaaugacagaauuuugguagcucaaggaggucuuggugguaaauuacuuacaaauuucuuaccauugaaaggccagaaacgaauaauucaccuugaucuaaaacuuauagcugauguaggccuaguaggguaaguaucguucauauuuuuauuauuauacuuucagagagagaguucuugaauagaaaauaaauguaaaugguaauuuggggccauaauuauuucuaauuuauggaauuuguguguuguguauguacuuggaaaauaugcugcuaaauauuauuuucaaauugccaacacagaguuucauaguuauugcuuauuuauaaaauuaagaccagagcaauugaauagaucagugggaauguuagagaaugcauaaagaaagaaaaaucaaucaaaugcaauauuacaagaugguuaaauaauguuaccagauauuaauaauaaauccaaacaaaccguauuauuauuaaaaauauauagaaggaaauaaacagggaaaaaugguugacauaacucuuuugggucuuaauagagacauuaaaguaucguuaaucaaauggcuaaagaccaguacagacaaucucaauccucagacuuacgcacuguugccgccaaauugaauccugcuaugacuguauauccuucuugccucugcuuaggaucuaucuagucucagcaauguaggccucacaagaguguccucuuccaccagccuccauucuuucauuaaauaaugcuguuuagcugugggguuugcagugcagcugcccacuggaaggggauagauaguaagauacagaauacauaaaggaagagaaaacuucaauuugcauuugcucucucucccccauccccccucccuccuauccucucccucuggcccuaucacaguauuacacaguuauucagauggaaagcuuaaggacaagauaaggaaaacugccuuauuacuguccuacuccaaauuccuaguucuauuuuuugcuuccccauagcuucuuucuaaguucuuuucauguuccucuucagucaucucacugcuucuuuaccagacucuuaagucuguaucccucgucuuuugcccugccugaccagccacuagagcuuaccaccauugguuuaggguucacagaggccccauuccugcuaaaauuauaacaaggaaagaugugauccuggcuugccauuuacauuuauuuuuuucaauaaagcacaguuacaagaguuauuagauguaaguucuauaauccucuauauuuuuaggaacauuaugggcuuaauagggucuuauggacaagacuggcaguccagccaaucacaguugcauuuugcauaaacauguguuucaaguucugaagagacaacuuuacagucuaagaggagccuagcacggcuuagucauaaaaguggaguggcauggaggacucagguuagacuauuuagguuaggaucucaaauccucuggaggcuggccagcuggucuuggguaaauuacacagccucucuaagccuuuguuuucucuucuuuuuuucuuuucuuuucucucauucuuccuucacuauaguuuuuugcuuuucaccacgucauuuguuuucucaucuuuaauaguguauggagauaagucuuuccuuaaaauguugguggguaagauaaugcauuuacagcagaauacaugcuuugcauuuuuguacguucaaugaauuguagcugcuaucuucaucaucauuauauugccaacuuacuggaaaacugcauauaaugaaauacuaggcuuuucagaaguagguuugaaauuugucuguaauuaaagcaucaagauucuuaagcauaucaaacaagaaugggggaaaaagauuuuuaaguggaauguuuaacauauuuucuaguguuuuuaaauuaggcaacuauucuugaagaguuacuacuaugaauacuagcauaaguagauauccuuuuagcugguuuuggaaauggacugaaucacagaagaaaguuauuguacaacuaacagauuugugcugcuguugucagaucugaucuuugcauagguuggauuuuagccuguaaaauuuucacuggguacuuuucaagaaaaauuucaaauaucuguuauucagucauuagcaucaucuuucuauucauacuuugaucuucuuggaaauaguugcuugcauuaugugcucaaucauuaugaaaauaugaggauguuggaaacaagcaaguccagcuagugauaauuauggauaaaaacagcugcaauuugcuuuucaaaagcuauaagaaccuggaugaaacaggguaugaaaaaacuauauguuccaggagaaacaagucauuaagaaaccucacauaauuuuauuuuaaauucaugacagaaagauuuuuuuaaugagggaaauuguugaaauaccuccagcuaauacgcuuuuauaaaauuccaaauuaauauuugcagaauauuccaccauuauuccaaaugaaaguuuggcagaguuuuugaaguaccgucuucaaauuugaauaagaacucugugaaggcgggaaucauuuugucucauugcucaguauguugccugauacgaagucagugcucaauaaauauuuguuggauaaauuuaaugaaaauauaugaaugagauuuagcaaugaauguuuuaaguaacccccauuccuaguacugucuuucauacauggugggccuuucuugagggaaauuuagcaguauaaucaaagccuuuaaaaugagcauguauuuuaucugguauuucuucauguagacauuuauuccaagaaagaaaucaaagaugugugcaaagagaagucuuagccagaacaaucaggcaagagaaaaaaagggcauucaaauuggaaagaaggaagucaaacuaucuguuugcccaccauaugaucuuauaccuugaaaacccuagagacuccuucaaaagacuccuagauuugauaaaugaauucaguauacucucagguuacaaaaucaguauacacaaaucaauagcacugcuauacaccaacaacaaccaagcugagaauuaaaucaagaacucaaucccuuuuacaauagcuacaaaaaauaaaauaccaaagaauauacguaaccaaggucgagaaagaucucuacaaggagaacuacagaacacugcugaaagaaaucauagaugacacaaacaaauggaaauacauccaaagcaauccuaagcaaaaugaacaaaucuagaggaaucauauuaccugacuucaaauuauauuacaagguuauaguaaccaaaacagcaugguauugacagagaaguagguacuuagaccaauggaacagaauagagaacccagaaauaaaaccaaauacuuaagaccaacugaucgucaacaaagcacacaaaaacauaaacuggggaaaggauacccuauucaaaaaaugaugcugagaaaauuggauauccaaauguagaauaaugaaacugcauucauaucucucauuauauacgaaaauuaagauagauuaaagauuuuaaucuaagaccugaaauuauaaaaauucuacaacacuuaggaaaaacccuucuggacauuggccuagacaaagaaucugugacuaagaucucaaaccaaaugcaacaaaaauacauaagugggaccuaauuaaaguaaaagucuugugcacagcaaaagaaagaaucaacagaguaaacagccuacagaaugggagaaaguauuugcaaacuacgcaucuaacagaggacuaauauacugagucugcaaggaacucagaucagcaaggaaaaaacaauuccguuaaaaaguggacaaaugacauggacauuucucaaaagaagauaugcauacaaauggccaauacgcauauaagaaaauguucaacaucacuaauacucagggaaaugcauauuaaaaccacaaugauuuaccaacuuagcuagaauggucauuauggaaaagucaaaaaacaauacgugcugacauagauguggggaaaagagaacucauacuuuuuuuuuuucuuuaacuuaaaaaaauuuuuuuuauuaugcuuuaaguucuaggguaugcacaacaugcagcuuucuuacauagguauacaugcgccaugucgguuugcugcacccaucaacucgucauuuacauuaggcauaucuccuaaugcuaucccucccccagacccccacccccugacaggcccuggugugauguuccccaccauguguccauguguuccuuguucagcucccacuuaagagugagaacaugcaauguuugguuuucuuuccuuaugguaguuugcugagaaugaugguuuccagcuucauccaugucccugcaaaggacaugaacucaucuuuuuuuauggcugcauaccauuccaugauguauaugugccacguuuucuuaauucagucuaucauugauggacauuuggguugguuccaagucuuugcuauugugaauagugccacaauaaacauacgugugcaucugucuuuauagcagcaugauuuauaaucguucggguauguacccaguaaugggauggcugggucaaaugguauuucuaguucuagauccuugaggaaucgccacgcugucuuccacaaugguugaacuaguuuacagucccaccaacaauguagaaguguuaacuauuucuccacauccucuccagcaccuguuguuuccugacuuuuuaaggaucgccauucuaacuggugugagaugguaucuccuugugguuuugauuugcauuugacggccagugaugaugagcauuuuuucauauguuuguuggaugcauaaaugucuucuuuugagaagugucuguucauauccuucgcccacuuuuugaugggguuguuuguuuuuuucuuguaaauuugcuugaguacuuuguagauucuggauauuagcccuuuaucagaugaguagauugcaaacauuuucucccauucuguagguugccuguucacuccgaugguaguuucuuuugcugugcagaagcucuuuaguuuaauuagaucccauuugucaauuuugucuuuuguugccauugcuuuugguguuuuagacaugaaguccuugcccaugccuauguccugaaugguguugccuggguuuccuucuaggguuuuuaugguuuuacgacuaucauuuaagucuuuaauccaucuugaauuaauuuuuauguaagguguaaggaagggauccaguuucagcuuucuacauauggcuagccaguuuucccagcaccauuuauuauauagagaauccuauccccauuucuuguuuuugucagguuugucaaagaucagaugguugaagauguguguuauuauuucugagggcucuggucuguccuauuggucuauaucucuguuuugguaccaguaccaugcuguuuugguuacuguagccuuguaguauaguuugaagucagguagcaugaugucuccagcuuugcuuuuuggcuuaggauugacuuggcaaugggggcucuuuuuuguuuccauacgaacuuuaaaguaguuuuuuccaauucuguaaagaaagucauugguagcuugauggggcuggcauugaaucuauaaauuaccuugggcaguauggccauuuucaugauacugauucuuccuaucgaugagcauggaauguucuuccauuuguuuguguccucuuuuauuucguugagcagugguuugugguucuugaagagguccuucacaucccuuguaaguuggauuccuagcuauuuuauucucuuugaagcaauugugaaugggcguucacucaugauuuggcucucuguuuaucuguuauugguguauaagaaugcuugugauuuuuggacauugauuuuguauccugagacuuugcugaaguugcuuaucagcuugagauucugggcugagacgaugguguuuucuaaauauacaaucuugucaucuucaaacagggacaauuugacuuccucuuuuccuaauugaauacccuuuauuucuuucuccuuccugauugcccuggccagaacuuccaauacuauguugaauagaaguggcgagagagggcaucccuguguugugcugguuuucaaagggagugcuuccaguuuuuguccauucaguaaugauauuggcuguggguuugucauaaauagcucucauuauuuugagauacguuccaucaaugcugaauuuauugaguuuuuagcaugaagagcuguugaauuuugucaaaggccuuuucugcaucuauugagauaaucaugugguuuuugucauugguucuguuuauaugcuggauuacauuuauugcuuugcguauguugaaccagccuugcaucccagggaugaagcccacuugaucaugguggauaagcuuuuugaugugcugcuggauucaguuugccaguauuuuauugaggauuuuugcaucaauguucaucagggauauuggucuaaaauucucuuuuuuguugugucucacaggcucugguaucaggaugaugcuggccucauaaaaugaguuagggaggauucccucuuuuucuauugauuggaaugguuucagaaggaaugguaccagcuccuccuuguaccucugguagaauuuggcugugaauccgucugguccuggacuuuuuuugguugguaggcuauuaauuauugccucaauuucagagccuguuauuggucuauucaggaaugcaacuucuuccugguuuagucuugggaggguauaugugucgaggaauuuauccguuucuucuagauuuucuaguuuauuugcauagagguguuuauaguauugucugaugguaguuuguauuucugugggaucaguggugauauccccuuuauaacuuuuuauugcgucuauuugauucuucucucuuuuccucuuuauuagucuugcuagcggucuaucaauuuuguugaucuuuucaaaaaaccagcuccuggauucauugauuuuuuuugaaggguuuuuugugucucuauuuccuucauuucugcucugaucuuaguuauuucuugcuuucugcuagcuuuugaauguguuuguucuugcuucucuaguucuuuuaacugugauguuagggugucaauuuuagaucuuuccugcuuucucuugugggcauuuagugcuauaaauuucccucuacacacugcuugaaaugugucccugagauacugguauguuguauguuuguucucauugguuucaaagaacaucuuuauuucugccuucauuucguuauguacccaguagucauucaggagcagguuauucaguuuccauguaguugagugauuuugagugaguuucugaauccugaguuccaauuugauugcacuguggucugagagacaguuccuuguaauuucuguucuuuuacauuugcuaaggagugcuuuacuuccaacuauguggucaauuuuggauuaagugcgguguggugcugagaagaauguauauucuguugauuugggguggagaguucuguagaugucuauuagguccucauggugcagagcugaguucaauuccuggauauccugguuaacuuucugucuuguugaucugucuaauguugacagugggguguuaaagucucccauuauuauuguuuuggagucuaagucucuuuguaggucucuaaggacuugcuuuaugaaucugguugcuccuguauugugugcauauguauuuaggauaguuagcucuucuuguugaauugaucccuuuaccauuauguaauggccuucuuugucucuuuugaucuuuguugguuuaaagucuguuuuaucacagacuaggguugcaaccccugccuuuuuuuuguuuuccauuugcuugauaaaucuuccucuaucccuuuauuuugagccuaugugugucucugcaugugagaugggucuccuaaauacagcacacucuugggucuugacucuuuauccaauuugccagucugugucuuuuaguuggagcauuuagcccauuuacauuuaagguuaauauuguuaugugugaauuugguccugucauuaugauguuagcugguuauuuugcucguuaguugaugcgguuuguuccuagcguugguggucuuuacaauuuggcauguuuuuacaguggcugguaccgguuguuccuuuccauguuuagugcuuccuucaggagcucuuguagggcagggcugguguugacaaaaucucucagcauuugcuugucuauaaaggauuuuauuucuccuucacuuaugaaucuuaguuuggcuggauaugaaauucuggguugaaaauucuuuucuuuaagaauguugaauauuggcccccacucucuucuggcuuuuagaguuucugccgagagaucagcuguuagugugaugagcuucccuuuguggguaacccgaccuuucucucuggcugcccuuaacauuuuuuccuucauuucaacuuuggugaaucugacaauuaugugucuuugaguugcucuuuuugaagaauaccuuugugguggucucuguauuuccugaauuugaauguuggccugccuugcuagguugaggaaguucuccuggauaauauccugcagaguguuuucugacuugguuccauucuccccaucacuuucagguacaccaaucagacguagauuuggucuuuucacauagucccauauuucuuggaggcuuuguucauuucguuuuacucuuuuuucucuaaaauucucuucuugcuucauuucauucauuuaaucuucagucacugauacccuuucuuccaguugaucaaaucagcuacugaagcuugugcauucgucacauaguucucaugccaugguuugcagcuccaucaggucauuuaagaacuucucugcauuggcuauucuaguuagccauucgucuaaucuuuugucaagguuuuuagcuucuuugugauggguuccaacuuccuccuuuagcucggagaauucugaucaucugaagccuucuucucucaacucaucaaagucauucucuguccagcuuuguuccauugcuggggaggagcugcauuccuuuggagggggagaggugcucugauuuuuagaauuuucagcuuuucugcucuguuuuuuuccccaucuuugugguuuuaucuaccuuuggucuuugaugauggugacguacagauggguuuuugguguggauguccuuucuguuuguuaguuuuccuucuaacagucaggacccucagcugcaggucuguaggaguuugcuggagguccacuccagaccguuugccuggguaucagcagcagaggcugcagaacagugaauauugcugaacagcaaauguugcugccugaucguuccucuggaagcuucaucucagggguaccuggcuauguaaggugucagccugcccuuacuggggguugccucccaguuaggcuacucggggaucagggacccacuugaggaggcagucuguccguucucaguucucaaacuccgugcugggagaacugcuacugucuucaaagcuaucagacagggacauuuaagucugcagagauuucugcugccuuuuguuuggcuaugcccugcccccggagguggauucuagaggcaagcaguccuugagcugugguggacuccaccuaguuugagcuuccagguggcuuuguuaccuacucaagccucagcaauggcgggcaccccucccccgccagccucacugccgccuugcaguucgaucucagacugcugugcuagcaaugagugaagcuccgugagcgugggacccuccaagccaggugcggaauauaaucucauguugugccauuugcuaaggccauuggaaaagugcaguauuagggugggagugacccgauuuuccaggugcuguuugucacagauucccuuggcuaggaaagggaauucccugaccccuugcauuucccaagugaggcaaugccuugcccugcuuuggcucacacucagugggcugcacccacuguccugcacccacuauccaacaagccccagugagaugaacccaguaccucaguuggaaaugcagaaaucacccaucuucugcaucgcucgcacugggagcuguagacuggagccauuucuauuuggccaucuuggaaccccaccccugauuuuugcucauugauuuuguguccugagacuuugcugaaguugcuuaucagcuuaaggagauuuuggacugagacuuugggguuuucuuuuuuuuuuuuuuuuuuuuuuuuugagacggagucucgcucugucacccaggcuggagugcaguggcgggaucucggcucacugcaagcuccgccucccagguucacgccauucuccugccucagccucccaaguagcugggacuacaggcgcccgccacuacgcccggcuaauuuuuuuguauuuuuaguagagacgggguuucaccguuuuagccgggauggucucgaucuccugaccucgugauccgcccaccucggccucccaaagugcugggauuacaggcgugagccaccgcgcccggccgggguuuucuaaauauacaaucaugucaucugccaacaggacaauuugacuuucucuuuuccuaauugaauacccuuuauuucucucucuugccugacggcccuggccaaaacuuccaacacuguguugaauaggagugguaagagagggcaucccugucuugugccaguuuucaaagggaaugcuuccaguuuuucuuauuccguaugagauuggcuguggguuugucauaaauagcccuuaauauuuugagauacauucuguugauaccuaguguuuugagaguuuuuagcaugaagcgcuguugaauuuucucgaaggccuuuucugcaucuauugagauaaucaugugguuuuugucguugcuucuguuuaugugauggauuagguuuauugauuuguguacauugaaccagccuugcaucccaaggaugaagccaacuugaucaugguggauaagcuuuuugaugugcugcuggguucgguuugccaguauuuuauugaggauuuucgcauugauguucgucagggauauuggccuagaauucucuuuuuguuguuguuguuguuguuguaucucugccaggcuuugguaucaggaugaugcuagcaucauggaaugaguuagagaggauucccucuuuuucuauugaauggaauuguuucagaaggaaugguaccagcuccucuuuguaccucugguagaauugagcugugaauccaccucguccuggacuuuuuuugguugguaagcaauuaauuauugccucauuuucaggaccuguuacuggucuauucagagauucaaauucuuccuguuuuagucuugggagcauguauguguccaggaauuuauccauuucuucuagauuuucuaguuuauuugcauagaauuguuuauaguauugucugaugguaauuuguauuucugugggaucaguagugauauccccuuuagcauuuuuuuauugcgucuauuugauucuucccucauuucuucuuuauugguuuugcuagcggucuauuuauauuguagauucuuucaaaaaaaaaaaaaccagcuccuggauucauugauuuuuuugaaggguauuuugugucucuaucucugucauuucugcucugaucuuaguuauuucuugccuugugcuagcucuugaauguguuugcuccugguucucuaguucuuuuuauugugauguuaggguguccauuuuagauccuuccugcuuucucuugugggcauuuagugcuauaaauuucccucuccacacuguuuuaagugugucccagagauucugauacauuaugucuguguucucauugguuucaaagaacaucuuuauuucugccuucauuucguuauguacccaguagucauucaggagcagguuuuucaguuuccauguaguugugugguuuugagcgaguuucuuaauccugaauucuaauuugauugcacuguggucugagagacaguuucuuguguuuucuguucuuuugcauuugcugaggaguguuuuacuucucauuauauggucaauuuuagaauaaguacgauaugcugagaagaauauauauucugucgauuugggguggagaguucuguugaugucuauuaggucugguugguccagagcugaguucaaguccuugauauccuuguuaaccuucugucucguugaucuaauauugacagugggguguuaaagucucccauuauuauugugugggagucuaagucucuuuguagcucucuaaggacuugcuuuaugaaucugggugcuuuuguauugggugcauaccuauuuaggauaguuagcucuucuuguugaauugaucccuuuaccauuauguaauggccuucuuugucucuuuugaucuuuguugguuuaaagucuauuuuaucagagacuaggauugcaaccccugccuuuuuuuguuuuccauuugcuugguagaucuuccucuaucccuuuauuuugagccugugugugucuuugcacaugagaugggucuccugaguacaguacaccaaugggucuugacucuuuauccaguuuggcaaucugugucuuuuaauuggggcauuuagcccauuuacauuuaagguugauauuguuauguguaaauuugauccugccauuaugacguuagcugguuauuuugcccguuaauugaugcaguuucuucauagcgucaaugguguuuacaauuugguauguuuuugcagugucuggugcuaguuguuccuuuccauguuuagugcuuccuuuagaagcucuuguaaggcaggccugguguugacaaaaucucucagcauuugcuugucuauaaaggauuuuauuucuccuucacuuacgaaucuuaauuuggcuggauaugaaauucuggauugaaaauucuuuucuuuaggaauguugaauauuggcccccacucucuucuggcuuguaggguuucugccaagagauccacuguuagucugaugggcuucccuuuguggguaaccguaccuuucucucuggcugcccuuaauauuuuuuucuucauuucaacuuuggugaaucugacaauuaugugucuugcgguugcucuucucgaggaguaucuuugugguguucuccguauuuccugaauuugaauguuggccgucuuugcuagguuggggaaguucuccucaauaauauccugaagaguguuuucuaacuuggauccauucucccagucacuuucagguacaguacacuaaucagacauagauuuggucuuuucacauagucccauauuucuuggaggcuuuguucauuucuuuucaguuuuuuuuccucuaauuuugucuucucgcuuuauuucauuaauuuaaucuucaaucacugauauccuuccuuucuuccacuugauccagucggcuauugaagcuugugcgugcgucacgaaguucucgugcugugguuuugaacuccaugaggucauuuaaggacuucucuacacuguuuauucuaauuagccauucgucuaaccuuuuuugaagguuuuuagcuucuuugcaauggauuagaacauucuccuuagcucagugaaguuuuuuauuaccaaccuucugaagucuacuucuguuaauuugucaaacucauucuccauccaguuuuguuccauugcuggcgaggagcugcaguccuuuggaggagaauaggcacucugguuuuuggaauuuucagcuuuucugcucugguuucuccccaucuuugugguuuuaucuaccuuuggucuuugauguuggugaccuacgaugagguuuuggugugcaugugcuuuuuguugauguugaugcuauuccuuucuguuuguuaguuuuccuucuaacagucgggcuucuucgcugcaggucuuuuggagguugcuggagguccacuucagacccuguuugccuaggaaucaccagcggaggcugcagaacagcaaauauugcugccugauuuuugcucuggaagcuuuguccuaaaggggcaacccccuguaugaggugucucuuggccccuacugggaggugucucccaguuaggcuacucgggggucagggacccacuugaggaggcagucugucccuucucagagcuugaacaccaugcugggagaacgacucucucuucagagcugucagacagggacguuaaggucugccaaagcugucugcugccauuuuuucugauaugcccugcccagagagguuggaucuagagaggcaguaggccuugcugagaugugguggacuccacccauuucgagcuuccaggccucuuuguuuacacugucagcacaaaaccgccuccucaagccucagcaauugcggauaccccuccaccugccaagcugcagcucauggcaggucaaucucagacugcugcgcuagcagugagcaaggcuccguuggcuugggaccugcucagccaggcacgggaggauauuuccuggucugccgauugcaaagacuuggggaaaagcgcaguauuuaggcaggaguguaccacuccuccagguacagacugucacgacuucccuuggcuaggaaaggaaaaucccccgaucccuugugcuucccgggugaagcaacgccccacccugcuuugguuugcccuccaugcacugcacccacugcccaacccgccacauugagaugaaccagguaccucaguuggaaaugcagaaaucacccaucuucugugucgaucuugcugggagcuguagaccagagcuguuccuauuuggccaucuuggaacuuaacucuuacaaagacguacagaguguuauaaugggcauuggagacucagagggaggaaggauaggagggcagugagggaugcaaaacuaccuauuggguacaauguacacugcuugggugauggguacacuaaaauucacuguugagugagaaugcaaauuaguacaaccuauauggaaacaguauggagauuucucaaagaacugaaaguagaaauaucauuucauccagcaaucccacuacaggauaucuacccaaaggaaaagaagucauuauauuaaaaagauaccugcacacauguuuaucacaguaucauucagaauugcaaagacauggaaucaaccuuagugcccaucaaccaaugaaugaagaaaauugaguguguguguguguguguguguguaucuauauauacacacacaccauagaauacuacucagccauaaaaaagaaugaggacaucuuccuaagugaaguaacucaggaacggaaauccaagugccacauauugucacuuauaagugggagcuaagcugugcguacacagaggcaugcagagugguauaauggacauuggagacucggagggaggacaggaggauggggagggaugaaaaacuaucuguuggguacaauguacacuacuugggugauggguacacuaaaauccuggacuucaccauuacacaauguauccauguaacaacaacaacaaaaaaaucacuuguaccccuaaagcuauugaaauaaaaacauuaaaagaaauaggucggacaugguggcucacaccuguaaucccagcacucugggaggccaaggugggcagaucacgaggucaggagauugagaccauccuggcuaauauggugaaaccccaucucuacugaaaauacaaaaaaaauuagccaggcauuguggcgggcgccuguagucccaucuacuugggaggcugaggcaggagaauggcgugaaccgggagguggagcuugcagugagccaagaucacgccacugcacuccagccugggcaacagagcgagacuccaucucaauagauaaauaaauaaauaaauaaauaaauaaauaaauaaauagauaugagcuauuaagcuaugaaaagaugaaaaaaguugcaaaaguuuaaagauagucauugcauuguuuaaaguuauuuuaaaaaaacaaauaauacacacuuguuugcauaaagaaaaaguugucuaugaauuccaccacccagagaugacuauuaacagugucugucuaccuguauacacauuuuuuacaauguuguuuagagugaaaaauuguagacaaccugaaagucugucaauaggaaauuaguuaaguaaauuacacuucaccauugaaaaguguucaccuuauaugauucaguuuaaagaguaggccaagcaacuauaaaguaguuuuccccuacuuccuucaaaaaaauaugaaaacuugaacauuaagacucuauaaaaacugccaauuuuuugcagacaauagagggaaaaagagcauguuaaguguccauguaggugcuaguagaaaaaugaagacuuuggaaaagaaacucuguaggacaacugacccaguuucuuuaaaaauaaaauugcagauaggaaacaagaugguagggggagcuugaaaauagauuugagacacaccggguauuuguaacguacagaccuuacuuggauuucuauucaaaccaaauuuuaagaaguauauugccaauguauuaauauuuguugaagcuaggugauagcuaaauggaauucauuacaccucucuacuuuuguauauguuugaaacugucuauaaaauuuuuuuuuaaagcaguuuacaaaacaagguaauguuuugucaguguauagcuggaguuagaaaguuacagguguuuuucuuuuuuuucuuuaauuucuguuuuuucuaugacuuccaauggguuuuuauuuuuaaaucauaauuggaauaauuauuauacacuuuaaauauugaaacaucuucaguguccagcaugaauuuaucuuuaccuuuuauguaaguguauguucucaaguuuuucaagauuauuuauaauacauuuauauucuacuuuuaaucccaaauauauucaugaagucuacuugaauuguuaggaauucagagauaauaauauugacauuuguguauaauuuuauauucuuguuucagauucccaaaugcuggaaaauccucuuugcuaaguuguguuucucaugcaaaaccugcaauugcagauuacgcauguaaguguaauuugauuguacauuuuaaugaguggagguaaacuuuuaaagacuaauauuucucugagaaugaauaaaaugauaacucggaggguauccuuaacugaaaaauuuuuggcagauagacuacuguugcacaggccaaagugcaguugcaugaucauggcucacugcagcccaggcucaagccaucccccugcaucagccucccauguagaugggacuacagguaugugccaccaugcuuggcuaacuuuuuuuuuuuuuuuguggggacagggguuucgccauguugcccaggcuggucuugaacuccuaggcucaagugaucucccaccuuggccuucuaaauugcuggguuauaggugugagccacccuccccagccauauuuuccauuaaucuuugaaaccucuauaccccucagcaaaguugcuuaaacagguuagacacuuacuuuauugcauuuauuuuucugucacagaaucguuuauuugguuuaguuaggauuuuaugaaccacuuaccuuuuaucaggcacugugauaaguaccaggaagguacuuaucauucauuuagcagauacuuauuuuuggagccacauuagguucugggauuacaaagacugauaaacagaaacagcuccuguuuugacuuguauugaguuuguagacuaguggaguaaggcguacauaucacuaauaaauauaagggaauaugaaaggguacuaugaaagaguauagaugacugcucuaggcuuccuuaaggaugugugauuuuuggacugggauaugaggaauaauuaugagguaauuaguaaaauagaguggagggugaagggucuuuaaucagaggaaauaguauguacacaaagccuuagugguggcagggaguagauuugugugucuagagaacaugaaauaagggaaagaaucgagaugagccuggagauguaagagagcaugucacauagaccauuuaggcuguauuugauuuuuauaucuuaagagcaauuggaagcauuuaagcaagggauaaaaugcuuagguuugcuccucacagagaucucggccuguaauguagaaaauggauuggugugggacaugaagggucugagacaaccaguuaguaggcucuugugguagcuagaugagauauaaaagaagcuuugguuaaaaguagugaguaugauaagaucucugccaucauuaaaaggacacagaaugccauuaacuuggaaaauaaaaucaagccauucuaaaauuagacugugacgaaguagagugaaguuuggacuaagugcuauaaaucacaaggccaauauuuguuauaauauauguaggacuugagaaggaagagcaaaaagucauaggaaagaggcuagcguaggauugaugaggcuuaaggauaacaaugagaaggaacuagaggauaacugaaugagaaggaacuagaaaaauuucagccacagauccagugauagaaacuuaauaucugacccuccugaacaucuaucacucaccuuaaagugcaauagaagaacguugagguucaguaauuacauuaggccuauacagauuauaaaaaucuguguuugucuuuuuccaaauacuauuuauucauuuauuuuagagacagggucuagcuaugucacccaggcaggaguacaguggcaugaucauaccucacuguaacuuugaacuccugggcucaagcaauccucccaccucagccucuggaguagcuaggacuacaggugcacugccaugucugccuaguuuuacauuuuuuguagaaacagggucucacuaugcugcccaggcucaucuugaacuccuagcuucaaaugauccuccugccuuggcuucccaaagcauugggauuacagacaugagccacaacauuuggcccuccaaguacauauuaaauagcaaagauaauaauaguuuccauuuuagcaaauuagaacaaaaucugaauugaaauauuguuuaugcauaauaccaagacaguuuugagaguaccagcccuaaaauaaauucuagccuuaauuuauugcuguguuuccuuuuaguuacaacauuaaagccugaacuuggaaagauaauguacagugauuucaaacagguagguauuuuuaaaguaaaacacuauauuagaagucaaaaguacuugguuuugguacguacuuggauauuauaguuuuugccuguuucugugguguuaggggagaaaaaguaacaagauuuuguuuaugcuaagugaaacuggucaaauuaauucugagcacuaucauaauauauuuaauuucuucuuccaaagauuagguccaguuuaucccuacaacauuaugucuucuucuuagccuuaguuucuucuuauugcaagucuuucuuuuacuacuauauuggauuauuuaucuucauuuuuuaaaaaugcucucuaaaguucaugguaaugauuuuauuccaacuuuucuuuuuuugagaaagaaaauguuuuaauggaguuuuggucucaaccagcuauuaaaauucauuuuuuccuucacaaguaacaacaguggaucuucuguauaauuagaaaaaaacuaaaaaaaggaaaguaacaauauuuaaaauauaauguacaaucuaguaguugugcuccuuagcauuuacccauguacauugaaaaguuaugcacacacagaagucugcacauggaugcuuauagcagcuuuauuuguaauuaccaaaccuuggccaagauaucuuucaguaggugaauggguaaauaaacugugauauauauuuagacaguggauuauuauucagcucuaaaaagaacugggcuaucaagccucaaaaagaccuaggggaaccuuaaaugcguaauacuaagugagagaagccaaucugaaaagacugugugauacuguaugauucuaacuauaugacauucuggauaaggcaaagcuguggagacaguaaaaaaaaaaaaugaaugauuuccaggguuagggaggaaggagagaugaauaagcagaguacagagaacuuuuaggguacacuauaaaguacaauacauauaguaaaguaugauacuauauaauauuacagcaacauuguguugcuguaaugguagacacaguauacauuuguuaaaauccauagaauguacagcaccaagaaugcaacaauguaaaguauagacuuugggugcuaacgaugcaucaauauggguucauacaguuuuaugacauaauuuaaagaaacauaaaaaaguauuugguuauaauagugauaauaacaguaaaagauaaaaccaguuauaauauagaauguuaacuguaaguaaaauuguauuaaauauaggauaauaugaauauauagaacaauauuuagaggaaaagagaacaucauuuauaccgaauuuuuaagggaaaucaguagaggaaauuucaggacaugagacuucuguugugcaugcugcuuugucagcuuccuuuaagacccugaauuauuuaucuacacugggcaagggaugucgaguacugccucucauucuuuauugcacuucagaauuaucuggguggucuaagaacagcaaugaugagugaugcuuaggccccagagauuugaaacuaaaucucuuggggguagggccugggcauuuguagcuucuaagaguucccuacgugauuaugaugcacagugagguuugaaaagcacaaguggccgggugugguggcuuacaccuguaaucccagcacuuugggaggccaaggcaggcagaucacgagguuaggagaucgagaccauccuggcuaacauggugaaacccugucucuacuaaaaauacaaaaaaaaaaaaaaauuagaugggugugguggugggugccuguagucccagcuacuccagaggcugaggcgggagaauggcgugaaccugggagguggagcuugcaguaagccaagauugccccacuccacuccaggcugggcgacagagcgagacucucucaaaaaaagaaaagaaaagcacaaguguaaaaugaugguuaauaaugauuauucccucuaaaaggagucuaggaaacuguauucuuuuauuauguugguacaaaaguaacugugguuuuggccauuaaaaguaauggccaaaaguaggagaaaguaggagagccacaacuacaacuuggguuugucgagugcuguuucaccugacugaucuuacuugaauacuggcacaaaaugagaugaugacaaggugacaaggaagcaugcucaggugaaugaacuucuagaugauagaacucugcuccucauguaaugccaugagauuugcuuaaguauaaacaauaaugaccuacaaaaaugugaagcauuaacaaacauggcacugcaaagaacaggugaggagaaucacaccucuauuaauguaguaaagucucuuaaaaguaaugccaaaaccacaguuacuuuuauaccaaccuaauacuuuguaagaauggucgauaauccugcuaguauaauaugaacagaaaaggaacaauuggugccaaauaaauaauuacaaauugaauuuaaaauacagagcuguaccugguaaaugucugcugaauuaauaaccucauagauuuuuacgaauuuggaguauaaagguugaaauucugugaaaaguucauauuggacaauaccauuuaggaaauuauaaauaaauuuuaaacuagggauuagugugguggcucacgccuguaaucccagcacuuugggaggcuaaggugagaggaucacuugaggauaggaguuugagagcagccugugcaagauagcgagacccugucucuacuaaaauuuuuuuaguuaacugggcauggcgguacgcaccuggagucuuagcuacuugggagacugaggugggaacauagcuugagcccaggaguuugaggcuacagugaucuauggucacaccacugcacuccagccugggugacagagcaagauccugucucuaaaauaauaauaauaaauaaauaaacaaauguuaaacuaaucuguaaaauuccuagauuauuagauuaauaguaaauaugggacucuaauaucugauaacaaaauuuuaauucuuaauacuguacauuaauuuuacucuuauacuuggcuuuucaaagauguagugguaaucauaaguuaggaacuguuuauauuugaaauaucuuaaaaauuuugggauguaauugaacuugcgguuuucauacauuuuccuuuuucauuaaccauuuaacuuuguauuagauaucaguagcugaucuuccggguuuaauagaaggagcacauaugaacaaaggaaugggccacaaauuccucaagcauauagaaagaacuagacaacuacuuuuuguuguaagucauauguauacuaaugugauauucaaauaaauugaaaaccagugaauuuaguuuuucuagaauuuuuuuauaaauaagaaagugguagcauauguuacuccacuaagucuuuuauaauauggggauggaagugacauuguuuacuauaucauauguaaguuuggccauacuugccaacauguauuuccuuaagauuuccagcauacuaccauauuauauaguaucauaguaucucuuucauucuucacugaugaugcuagaguuauauaugagauugucuucauacaaauugucuuauccuaguuuuuuauuuuauuaauaacuguaauuuuaucagaauaauuaaaguuaucuuaacaccucgauuucuguuacuuauuuugaauuacuaaguaacaaguagaguauagagaaauuguuuuuagcuugagagaguaaaacauuuuaaaacauagaaauguauagcuauucuucguauguuaaaggcugucucuuuccuucucuuuuuuuuagguugauauuucuggauuucagcuuucuucucacacucaauacaggacagcuuuugaaaccauaauacugcuuacaaaaguagguuuucuguuuuacuguguucuguauuuggucuaauacauaggaauguaagacuauaugaaauaacauaauuacagucuauacauacuccaccuuuaaagcuuugaugucaguuaaagaauuacuuaaacuuguugucuccauuuccucuacauucauuugcuccucaaacuacugcaguggauaaaacacuccugggcuuccaaauccccauuacauacuucccagguuuuuaucuugcuucagcuuuggcacauuguuuaauuccucuuguuucucauucuuaguuuugugaccgguaaucuucugguucuauuucuacucuuacacuauuucuccgucuacuuuuuaggcucuuuuuucucauccuuuaaguaacauuauucagaguucuguccuaaccuuauuuucuaucuuacucacucccguugcuuuaguuacaauuaauaauauugaugacugccagaucuguagcugauaccuaaaucuuuucauuguucuuucuuuuuuuuugagacagagucuugcucugucugccaggcuguagugcaguggcaugaucucggcucucucugucucccgggcucaagugauucuccugccucagccucccgaguagcugggauuacaagcgugugccaccacgcccggcuaauuuuuguauuuuuaguagagacaggguuucaccauguuggccaggcuggucucaaacaccugaccacagguaauccacccaccuuggccucccagaguguugggauuacaggugugggccauugcaccuggccuuuguuguucuuuagaccagaugcccaucggacaucuucuuugacuagaugucccauuagucacuuaaacuuaauauggauaaaaguaaacuuuuaaaaaacuuuucggccauccccauaacuuagugaauguguaagcuaugauauacugauucuucucaccaccuacacaagcccugucaguuuuuuauccuaaaucucucugaaauccauccucuugucuuuaucuacgcuguuauaaucaucagcccuucuuauuggaauauugaaucugguccuuuccauucucccuguguccugccuugcuucucuccaguccauuuuuuauauggcagcuagagugaucuuuguaaaagcaccaagcugaugcugauguucccugccuaaaacacuuugauagacccccauagcuguuagguuaaagucuaaccugagcaugauuuaugaaaucugcaaguuuaggccccuaccuagcaguccuccucuguaacccucuccccuagaugcuauauuucagccaugugauuucucucuaagacaacaugguauugccuuaccuccaggauuuuauagauccuauuucauuugccacuuuuugucuauaaugaauaauacugcugugaacauuuguaugcagguuuuuguauagacauguuuucauuucucuuggauguauacuuaggaguggaauugcuggaucagauaauaaugcuuuguuuaacauuuugaggaacugccaaacuauucugaauugguagcaccauugugccauuuuacagucccaccaucaauguauguuccaauuuuuccacaugaaugucaacacuuguuauugucugucguuuuuacuuuagucauccuagugggagugcagugguauuuuguuauaguucuuauuugcauuucucuuaagacuaaugaugcuaagaaucuuuuuaugugcuuauuaggcauuucugugucuuuggagaaaagucuguucagauucugugugcauuacuauuuguauuauuugucuuuuaauuguugaguuauaagcauguuuuguauuuuuggaaauaagucccuucucuuuuuuuuuuuuuuuuuuuuuugagauggagucucacucugucgccugggcuggagugcgguggcacagucucggcuuaaugcaacccccaccucccaaguucaagugauucuccagccucagccuccccaguagcugggauuacaggcaugugccaccacgcccaucuaauuuuuguauuuuuaguagaaacaggguuucaccauguuggccaggcuggucuugaacuccugaccucaggugauccgcccaccuggcuucccagagugcugggauuacagacgugagccaccaugcccagcuggaaauuaagucccuucuaagauacauaauuugaaaauauuuucuccccuucugugacuugucuuuucacuuuuucaguguauuuuuucuguauucuuuguggcacaaaacuauuauuuauuuauuuaauuuuccaguuuuauuaaaguguaauugacauaaaaauuguguguacuuaaaguguacaagugauauuuggauauauguuuaccuugugaaaugauugaaucaagcuaauuaacaugauccaucaucuuacauacuauuuuauguguguugagaauauuuaaaaucuguuuuagcaauuuucaaauauauaauacauuaacuauagucaucauacuguaaaauagaucuucagggcuuauucauccuauuuaauugaaucuuuguuccauuugaccaacaccccuccaucuuccucccccaagcacccuggcaaccaccauuuucucugcuacuaugaauucaaccuuuuaagauuccacauauaagugggauuaugcaguauuuuuuuuucugugcuuggcuuauuucacuuagcauaguguucuccagguucauccauguuguuauaaacgacaagauuuucuuuuuuuaaggcugaauaauauucaguuguguguguguauaccacauuuucguuauucauccauugauggacacugagguugauuccaugucucggcuauugugaauaauguuucaguaaaaaugggaaugcagagaucucuuugacauacugauuuuauuuccuuuggauauauacccagaagugggauugccggaucauaugguaguucuauuuuuaauuuuuugagaaaucuuuauacugcuuuuuacaauggcuguacuaauuuacauucccacucaacgguguucaagaguuccucuuucuccauauccuugacaacacuuguuaucuuuugucuuuuugauaauagccauccuuccaagugugaggagcuaucucauugugguuuuucuuuucauuucccuaaugaucagugauguugaacauuuuuucauacauauauuggucauuuguuuguuguugagaaaugucaauucagguucuuuauccauuuuuaaaucagguuuauauuacccaaagugaucuacggauucagcacaauccauaucaaaauucuaauggcauuuuucacagaaauagaaaacaaaucuuaaaauuuguauggaacaucaaaagacccugaauagccaaagcaaucuuaucuugagcaaaaggaacaaagcuggaagcuucacacuaccuaauuucaaaaccuacuacaaagcuaucauaaucaaaacagcgugguacuggcauaacaguagacacauaaaccaauggaacagaauccagagcucagaauuaaauccaugcauuuacaguuaauuuucgacaaagguaccuagaacacacaguaaggaaaggacaguuuucuucgucaauaagugauacugagaaaacugaauauccacaugcagagaaaugaaauuagauccuuacuucacaccauauaaaaaaucaguucaaaguugauuaaagacuuaaagccugaaaccauaaaaccacuagaagaaaacagagaaguuccaugacauuugucugagcaaugauuuuuuuuuaaugugaccccaaagcacaggcaacaaaaagaaaaauagacaaguaggauugcaucaaacuaaaaagcuucugcacagcaaaaggaacagucagcagagugaagaggcaaccaagggaaugggagaaaauauuuguaaaucauauaucugauaagugguugauauccaaaacauaaggaagcaaaacaacucucaauagcaagaaaacaacucaaaauuuuuaauuuucaugaaauuccauuuguuucauucuuuucuuuccuuuuuuaaaauuaaacuaaaauuuuguauagagauggggucucguuauguugucaaggcuugucuugaacuccugggcccaagcaaugcuccuaccucagccuccuaaagugcugagauuacaggcaugagccaccaugcccagucuuacauauuuauuuauuuuuauuacaaacagggcuucgcucugucauguaggcuagagugcagacaugauccuagcucauuguagccucaaacuccugguggccuuaagcagucuucugccuuuuaucuauuauuuuacuugugcuuuucauguuauaucuaagaaacaguuguuuaauccaagguaacaaagauuuauuccuaagugcauuuacuuuuuccaagaauacuacagguauaacauucagugaucauuacugacuucugaauuuuaucugugugaaguccagauacccauauuugacucuagacgcaaaauuacaacugucucuaggauaucauuuaagcuaaaacauacuaacacaugacuuaaccagagucauuuucugaaauucuuccuuuuguuuucuguuguugggauuuauugcauuucggugaugugaauggguuuuagaucaccugggucauuaauuaccaaauaaguaguuuauacagaaaccaguacuaaaauuauuggguuuucucuuuugauuuaaaggaguuggaauuguacaaagaggaacuucagacaaaaccugcacucuuggcaguuaauaaaauggacuugccagaugcccaagauaaguuccaugaauugaugagccagcuccagaauccuaaagguaaaccuauuuauucauuuaauucuaauuuaaagaauaauuacaauguacagagaaugcuguuauaaucaguggaaaacugacaguuucugcucuuaaaagucaaguuugaagaaagaauauacaaaacauguaaauaacauuguaacauaauaauuaccaaauucuagaauguuugauauggacaguaaauuaaaggagacaaaagaaagauuaauuugaacuaaaaaggucaggcuacaugaagaauaaaacuuaaauugggcccauaaggcauaugugggauuugaauaaaaggaggaaaaagucagcaucuaccugugaagucuuucacuuucauuaacauacuucacaagcucuucauucgucuaguacuguacaucauaaaauuaaagacagaacuaagaaguucuaaagaaguauguuucuuggcaaaaguaacucuauagguuucugaagaggaugagucuucugaaaagaacuucauuuuuccuguguaugugugacacaauaauagaagcugugacuccaaaaugauuuauuugucuggaauuuacuuccuggacuauauguaaaguaacuuaaagggauucuccacaguuuugaauauugacauuugcagaacaccuucuauccuauggcaauggugguuucauucagagucuaguagagaaccucaugcacaaaugaggaaaaguaggguguaugguauguggcuaacauguuuuucaauaugucucuguuuuuauucuugguaacaauuguuggaaaauagauuauagguacuaagacugucaaacagcaccagaagguccuuuccucucaaaaaucuuuccccuguguaaucuacauguuggagcuguccuugaguuaauaaauuacucaugggauauaaauauucucugauacuaaauagccuucauuccuaaugacauuugcuuuguauggucauuaguucuuuuugcuaguugaucuugcagagaagggaauuuucagaggaaauaccgaaagugagggugacucaggagucuguagcuguucugaccuaucgugaaauaaaauauaggcccuuuagugauaauccugaguuauccucucuggacuuucuucggggcuuuugaaucucagaaaguaagcuccauguugucuucuccaccaaucuguuucaguccagccuuucuaguucauaucaguuaauccaucuaaucaguaugccaucuccccagccaaucaguaugccauggugacagggaagagguaaaaguaauauaacaauuguuagcccuuguggggugauagauuggacucaucugaaauuaucuucccuugaauucucuauaaucccucuucaguuuuuguauggauccuagcaucauugaugauaaaccuauacuuuggggaaguuaaaggucuccaguguacugaggccaaguagaaugucucaaaucauaaaugauguuauuauuuuuacagaaaguaucuuucagagaaucaaugcugccuugccuuauuuaaccccccccacacacacaaaauuuauuacuuccuuaaguaagucauuuuugugauucaucuucuacucauacuuaguuugguuuaaaauauauuuaucuaacaaguauguuaugugccaagaaccuuaccauaaucaaugguaaaauccaaaggcucugagaacuuauuagaaaaggugaaaaaaggcaugaaaaaugcugguguugguucccugcuucacaaaucaaaccauuaacaugguuuuaacuaacuuucgaaaacaauggaaaucagcuuuguuugugcucuuucuuuuagauuuucugcauuuauuugaaaaaaacaugauuccagagaggacuguagaguuccaacauaucauccccauaucugcaguuacuggagaaggaaucgaagaauuaaagaauuguauaagaaagucacuggaugaacaggccaaccaggaaaaugaugcacuucauaagaaacaguugcuuaauuuguggauuucugauacaaugucuucuacugagccaccaucaaagcaugcuguuacuacuuccaaaauggauauaauuuaaauauauuaaaaaugguauugauggaacaguauuuaaugcuuaaaaacaaggaaauccuuucaucugugacaaccuggaggacauguuaaguaaaauaagccaggcuuagaaagacaaaugcugcauaaucucacuguggaaucuuaaguugaacucauagaaggagagaauagaauggugguuaucaagggcugguggggcaguggaggauugaggagauauuggucaaaauuuacaaaauuucaguuagacaaggcaacugaguucaagagaucuguuguacagcuuggugacuguaauuaacaacaauguauuuugaaagucacugaguaaauuuuaagugguuuuuccaaaaaagcacauaagguaaugcacguuaauuagcuauauugagccauuccacaauguauagauauuucaaaacauguuacacaugauaaauccaguuuuucuacgucauuuuuuaaaauuauauuuaauuuuuuuauuuugaaaguuuuuucacagaucuuuuuuuuaguauuauuaccuucugauauaugugucauuauugaagaaccauaccuuuuaaaguuauuauuuuguaauuaaguaugucaacaguaaaaaauaaccaguggccaggcaugguggcucaugccuguaaucccagcacuuuucggaggccgaggagggcagaucacuugaggucaggaguucaagaccagccuggccaacauggcgaaaccccgucucuacuaaaaauauaaaaaauuagccaggcauaguggcgcaugccuguuguagccccagcuacucaagaggcugaggcaggagaauugcuugaacgcgggagguggaggauacaaugaacccgaggucgcgccacugcacuucagccugggugacagagcuagacuccaucucaaaaaaaaaaaagagcuaaaaaauuacauuuuacaaguuuauggccagcccaccuguaauaacauucucugauauuccuuuacuuaggaugucccuauugagaucauuuuuuaaauuuauguggaaggauucucuagauuauuauuagaaugagcaauucaguuuuguuuguuuuugagccugucuuguaccugguugcacuaaauauauaauaguuaucuuuuguggagaccuuaaaacccuaaauuugaauacauguucaaugauaguaaagauaugacagaaacuagaagauagcuguuuaugauuugagcuuuuggaaaauuuucguuucuugaauguaauaguauuuuuuccugaauuggaggagacugaucuauauuguuucauuuuucuuuuguccuagucuauuucacuuucuuuugucauaaucuauuuaauuucccacuuucuuauuuuaguaaagagagaauaaauagcaagugcaggccaggcaugguggugcaggccagacauagcgguacaugccuguaauccuagcacuuugggaugccaaggcgggaggauugcuugagcccaggaguucaugccugagcaacauagcaagacccuggcucucuauaaaacagaaaacgcaaacuuuaauauuaucaacaaucaauauauuauaagagauugcaauuucuaaguuucuaccugaguguuucacaaauacaaacuggacauuuucccuuuaaaugaguuuuauuauaaaauguacauauugauuguaaaaacaaaaaauucaaauaguacaaaagcauauaaguaacuaauaaaagcucccuuucugcauuaggccccucaguucuucccagggaaaaugauuaauaguuuacauucuugcagaaauuuuuuauguauaaauuuuuacccaaaugaauucauuauauaaauuuuuuccaacuuaguguuuuuuuacauaauaguagcaaguuaaaaaauuguacuucaggccaggcacggugggucacgccuguuaaucucagcacuuugggaggcugaggcaggaagaccacuugaggucaggaguucaagaccagccuggccaacauggugaaaacccaucucuacuaaaauacaaaaaucagcugggcaugguggcgcaugucuguaaucccagcuacucgggaggcugaggcaggagaaucgcuugaacccgggaggcggagguugcagugagcugagauugcgccauugcacuccagccuggaggacaagagggagacuuccucucaaaaaacaaaauauuguacuucaaaaaauuauucuucaaugcuauuuuuaaauuacuagaaauuauuuuggaauuuaauguugcauacagccugagauauggcuguucacccuuugguaaaguauuaaagaaaaauaaugcauuguucucagcuuaaauuuuuuucugauuugacaacaugagugauguuuucccaguauuauuucaauuauauuuguuuuauuuucuguuccucacuccuaccucucauuccaguccccaaacuggcuuuucuuuuauuucuuuuuucuucauugcugauguauuuauugagcaauguccuguaucaggcacuguccaaggugcuguaugugccauguugaagagaacagacaggaccuacuguccuuguauaucuugccuuugauaacagaaacugcaggggauuggaauagccucuuuacaagaaaagaauaagagugaggaaaagcguuuggaauuuauagugaucacagugaccagguuuuguauuggguauguuuuacauuuguaacuucagugcuauuuuuuuuuaagcuccauuguuuucuaaauguaaacaaguaucaauguaaggacaguuucaucaggugaauaucagaaguacugacaccauaaucucauuuug

SEQ ID NO: 14274 - RNA, 2050 nt, Homo sapiens
uguggaacaaugcuacaucuauacuuggguuggcuuaaucaaccucuucgauggugggcccuaaggaagcaccaccagaaggaggagcuccaccaacagggaaucccccaggcauucuuccuggcaugccuucugcacucugguacagcuuggugaugauuggguugcaaaguuccuccagcucuuucugcugauguucaaauucuuccuucuuggcaguccgauucuuauugugccaguugauaauuucauuacaccuguccagaaucuucuguuuguccucaucauuaaucuugucuugaaguuucucaucuucgacaguugcuuucauguugaaugcauaggacucaagugaauucuuggaugacgccuugucccucugcuucucaucuucagcuuuuuaauucucagcuuccuggaccauacguucaaugucuuccuugcucaaauggcccuuauuauuagugauaguaauuuuauucucuuuuccuguacuuuuguccacagcagagacacugaggauaccauuggcaucaaugucaaaagugacuucaaucugaggaacaccuugggguucaggagguaugcccgugaauucaaacuugccaagcagguuguuauccuuggacauggcacgcucaccuucauaaaccugaauaagcacaccaggcugguugucagaauagguaaugaaggucugugucugcuugguaggaauggugguauuacaguugaugaggauggucaugacuccacuagcaguuucaauaccaagggaaagaggagugacguccaagagcagcaaaucuugaacauuuucagacuugucuccagacaggauggcugccuggacagccauaagcaacagcuucaucauggcugaugcucuuauucaguucuuuuccauugaagaagucuuggagaagcuucugaaucuuggggauacuaauagaaccaccaaccaggacaauaucaugaauuugugacuugucugguuuggcaucucgaagggcuuucucuacuggguccagggugccacagaacaggucagcauucaauucuucaaacugggcacagguaauggagguauagaagucaauuccuacauagagagaaucgaucucaauacugacuugggugcuggaagagagaguacgcuuagcauguucacaagcaguacggaggcaucuuacagcucucuugcucucacugauguccuucuuaugcuugcgcuugagcucagcaauaaaaugguugaccauucgguugucaaaaucuucuccacccaagugguugucucuggcuguagacuugaccucaaagauuccauccucaauagugaggauugacacaccgaaagugccaccccccaggucaaagauaagcacguuucuuugugcuccaaccuuuuugucugaacuuuuguaaacaauagcagcaacaguuggcucauuaauaauucuaaguacauugagaccagcaauaguuccagcaucuuugguaaccugaaacugagagucauuaaaguaagcuggcacugugaccacagcacugguaacagucuucccaagguaggcuucugcaauuuccuucaucuuugucagaacaauagaggauaccuccucuggauagaagcuuuuggucucucccuuguauucuacuuggaccuggggccugucagcaucauucacuaccaugaagggccaaugcuucauaucagacuggacaacagcaucaucaaaucugcguccaaucagacguuuggcaucaaaaacuguguuggugggguucauugcaacuugaugcuuugcggcaucaccaaucaacuguuuaguguccauaaaggcgacauagcuuggagugguucaguuucccugaucauuggcaauuaucucuacuuuuccgugcuggaaaacacccacguaagaguagguggugcuaagaucaauaccaacugcaggucccuuggacaugguugcuggcauguagcccuggcuccgauaaagaagaaagccacaggaacccgagagcugcaggcgaguucaaugag

SEQ ID NO: 14275 - RNA, 1293 nt, Homo sapiens
cuagcaguuucaauaccaagggaaagaggagugacguccaagagcagcaaaucuugaacauuuucagacuugucuccagacaggauggcugccuggacagccauaagcaacagcuucaucauggcugaugcucuuauucaguucuuuuccauugaagaagucuuggagaagcuucugaaucuuggggauacuaauagaaccaccaaccaggacaauaucaugaauuugugacuugucugguuuggcaucucgaagggcuuucucuacuggguccagggugccacagaacaggucagcauucaauucuucaaacugggcacagguaauggagguauagaagucaauuccuacauagagagaaucgaucucaauacugacuugggugcuggaagagagaguacgcuuagcauguucacaagcaguacggaggcaucuuacagcucucuugcucucacugauguccuucuuaugcuugcgcuugagcucagcaauaaaaugguugaccauucgguugucaaaaucuucuccacccaagugguugucucuggcuguagacuugaccucaaagauuccauccucaauagugaggauugacacaccgaaagugccaccccccaggucaaagauaagcacguuucuuugugcuccaaccuuuuugucugaacuuuuguaaacaauagcagcaacaguuggcucauuaauaauucuaaguacauugagaccagcaauaguuccagcaucuuugguaaccugaaacugagagucauuaaaguaagcuggcacugugaccacagcacugguaacagucuucccaagguaggcuucugcaauuuccuucaucuuugucagaacaauagaggauaccuccucuggauagaagcuuuuggucucucccuuguauucuacuuggaccuggggccugucagcaucauucacuaccaugaagggccaaugcuucauaucagacuggacaacagcaucaucaaaucugcguccaaucagacguuuggcaucaaaaacuguguuggugggguucauugcaacuugaugcuuugcggcaucaccaaucaacuguuuaguguccauaaaggcgacauagcuuggagugguucaguuucccugaucauuggcaauuaucucuacuuuuccgugcuggaaaacacccacguaagaguagguggugcuaagaucaauaccaacugcaggucccuuggacaugguugcuggcauguagcccuggcuccgauaaagaagaaagccacaggaacccgagagcugcaggcgaguucaaug

SEQ ID NO: 14276 - RNA, 6309 nt, Homo sapiens
ucaugacuuuauuuaaaaauuagcaaacaauacuguagaaacauugauauguaaauuucuaaaaugcugcaucuuaaauuuaguuggcaaagaccacauuuagcaauaagcaugaguuuagucuuccauguagaaaccagauacacuaaacuguaaaaaaaaaaaaaaaaaaaaaaaguuuccuauuguuugaaaauaccaguuuaauauaagauuguaaaaaugcauagauuuuugcauaaaagaacuggcuguacaagaguacuccccuuucacaguauuccuuuuuacuucauaugcgaguuauugauuaugcuguaggauuuaacuauuacagcacuaaaaggcaacuauugagggaagaggcagaaaaaggaaaaaggaauguacguaaggcaauuuuucuuaaaaguacaauaagcuuaauaguguuuuaggaagacaagauaaaaauuacucaaggcuagcuugguucucacugaauaaaaacaaaggacuaaauacugagcuccuucuguguggaucuaauaaucaaugccuuggucgcuauauugguaaucucugggguagucauccugguacucgccaugauacucaucaggguauucugccugauaaucacuaucacugauuuccgaaccauuuguuccuguuccuuggcuuccguugugaaugacagguucuguaggagcagcacaguauuugggaucauauacuugccgcccaagcccauacacacucauuccuuucugggaagcaacuuuguugguacccaucuguagggaaauugucgaguuguccaccggcuguaauguuagcuucugaucauagaugucucuucugguaccuggugcuaacaucccugccugguauuagaacauaguauaaaaguuaaaacagcagcuagaaucuauucuugugaauaauuuauaaauuauagaauucacauugaauaugaacaguaauacaugaacuuucauuugguucagggguaaagcuagcuuaaccaaaauauccugauaccgaaucacuuccaugaagcaauauucauuggcuuuugagcuaggugagaccuuucuucaaaauccuugcucugcuauaaaauuacuauguggccucaaacacguaaauuuagcuuuagguuucucaaacugcaaaauggagacauuacuaccuacucuggauuuaagagagaaugagacauaaagaaugugaaaucauaaugcuuccacaccagaaaguuccaugugaaugcccauggggaccacauacauuaucuggguuaccaauuucaaaaauuuauaauauauucaacagaaacuauguugagcagaucuuaaggacuugagucuuuucaaaaggcugagauacagaagaaccagccacuucacagccacuccccucuuuuucagaguacaguaacucauacuucaucucucuacuuacaucaagcacacacuuccagguucagaguggguagaaaaguaaacgugaguggcagcuaugagagacauaaugccgcacccgguaggauguguuccauaagggcaaaguuugauaaaucucccuuggacucgguaagaaaauguuuuucaaacccuaucccagcuguuguuggaugugagaccugucuguucucaaaugguuguugaacuuccuucugaggugcuggugaucuauuuuuaacaaggaaauauuucuaucuuggaugugguauacugguauuuucaccauguugcauuuccaucuccuuauauugacacaucuaauaggaaugcuaguuaaauccuucuuaguggaacaccagguaauuuuaccuauuaauuaagggcuccuuaaaaaaaaaagucagcauuuaaaugagcaauauuuuacuuggauuuuggagcaagaacacuguaauaaacauaucuuuuuuucugcuggcuagguagaaaggccagcuguucuaacugccaacaaaaaccacgagacacaucaugcuuuugcugcuaucgaaaaggucuuuugauuauuuugcuuucccagcaaaguccacauuccugaaggaauauacucuaaauaaacuauacaaaaaauaccuacuuuaaacuucugguuaauaaaaauaagguaaguguacucuuguacacguauaaaaagguauugcuuaccuggcuggcuccuuuauuagugcccaucugcagacuaauuguggucuggucaaaagguuugucaguuugcauuuugggaucauaaagaugccuccuagucccguaagcugucauaccugccuggcuggcacauuuguugguucccaucuuuuaaguuaaaaauaaaauugcacaaauuaucagaugucaacaauauacacaacacaaacaaaacuuuccaugcuaccaaaaagacagaaggggcacaaccgacaaguuacugagcugaggcuccagucaacucuucuaugugucuacaaacaaauuucaagugcuaacuuuaaaaagaaaauuuuaaagucacuauagauaaaaacucauacauagaagaauuaaacacacuuuaacagguggacugacacaccaaaagucauuacaguggcagaauaauuuccucugcuacucuuuccccagauaaccaaauuaagagguaccagcuucgguuauuucaacagaaguaauccuaggccaagcaauaugcuguucuacuccaggaauguuuuacauaaaaugugaaagcaaaugccaaguguuuucucugggagcuuaacaagggcuuuuuaaaguuucaaaaucaccaacauuuucuccagaaaggaaccacauuuuauuccuguaacucccauguccuuggacagagcuggagaaagguggaaugaggaauuugaacucagcaaaguucagggaaacaauaauuaauuuuucuuccccacugagaacaguauggcuucaggaccaaccauuacacccuguuccacugguuaggcacacuuuucugauguuggaucuuuuuucuuuaaaaauaagauuaaagaaaaucuuuauuacuaauauaaaaucuguucauugaagaaaauucagaaaacacauauaagcaaaaaggaggggggaaaaaucauugugauaccaccauccauucacugucaacauuugugaauauccuuuuagcuuuuuaaccuaugugucuauguauauaucuauagaugcacauauauacaaauacauacaaaaacaugugcauuuuuaauuuuaaaaauccauacugaccacaguauuugaugaucugauuuuuuucccccauaaccuaucuuuucaaacucuaguguauaauuuuacauuacacuuugcuuuuauggaguuguaauucaaccaacugacuacuguucugaaauuuagguuuccaguuucucaccaccaauacaauuuuguacuguguaaaaauaaaucuaacuugcauagacucaguagaaaggggcacuguaucaagcagguacaguggcuuuuggagaguaaagccaacagcauuuggggaauuagcaaugacguuuccaugaccagugaagagaacaaugaagagaaggaaaacaucugaacuacguauuucagaagaauuuaaacugacaaauucuaacagggcuuggcugcuauaucaugauuugguacuguaaauaagugacuuuggcauuaaggucguguaaaauugccuaauuuggucaauaacauuaaggaauuuauaaaguacauuucuggcugggugugguagcucaugccuguaaucucagcacuucgggaggccaaggcaggaggacugcuugagcuccagaguuugagacuauccugggcaacaaagugagaucccaucuauauauaaaagauaaaacaggccaggugcaguaguucacgccuguaauccaagcacuuugggaggccgaggugggcagaucaccugaggucaggaguucaagaccagccuggccaacauggugaaauccuaucucuacuaaaacuacaaaacuuagccgggcaugguggcucauucccauaaucccagcuacuuggcaggcugaggcaggagaauugcuugaacccaggagguggagguuacagugagccgagaucgcgucacugcacuccagccugggcaaaagagugagacucugucucaaaaaaaaaaagauaaaauaaaaaauuuaaaaguguauuuuucuuuuuuaaaaaaaaaaaaaagacaauaugauucaauuaaaaauuuucguuuccuggagaaauaauugucaagucagguggcauaccugagguuuccucuaaaaaauuaucacugucuuaugggcuuuauaaauagauauaaauuguauaaacuacaccccccccccaguacuauaguacuucugucuauucuuaggagaggcuuaauauuuugcauggugagaauuaaucauauugaauaaguaauugaauaagcaacaccacauuacuuaccugcagaccaauuacacuuuggccagcuuuuaauuuuccuucaucaaaacgucuuguuuguuuuucugcauacuuaacuccaaugucaaugguuguauggaauccuuuuguuuuagccuagacagaaacaugcacacuaacugaaaaggccaacagaguuucacagaaggaacaacaaagaaaugauauguccauagacaaaggggcccaaacuagagauaaaaaguauuuaaggcuguucaauaauauacugcaucauuugaaaugugaguguucuaaguaagcuaucuaguacgaugcagcugaugucagcagccuuuccacaaagcuacuaauuacagaagagacaggccccgccccaccuggucugaacccccaugaaaaagcaaugaugcaauucaucaccaauguggugggaaucuguuaaccagccauuaaagacauguacguaccagaccugcuagagccaccagaguagucugaaccugggucauguuuccauucucaaaaagaucauuugcuucgaauaugucauguggcuucauaccauaagccugaauagcuuuaauaaaguugccaauauucuccaacuauaaagaagaagaguuuuauaauuucuggagcuaaauauugacauucauaauuucuaagaauuccaagucuucauaaacaguuauaagacgcugcccagaaagcuguuugacaaggauucaaccaaauacauacuaagcauggcucucucuggaacaggaaagagcaagaagagagugugucucucacugugggucacaucacagucuuaauauuuuuaagcaguuacguguuuucaguuuuuaugggcaagaucuuccuuauauauuuuaaaaggauucuguaucagagcuauccaggccuggaauuuuauuugucaaaagguguauaauuacucauacuaauaaauaauucauuauguguuauuuuaauuucagaauacauuugugguuacuaaauacucauucucucauaucuccaaacacauguucaagaccaguaaguaucccauuuuccuuccucauacacacucaugaacuaagguuaugucugauacagugcucugcaguccacuguuaguuauguggaaugccuuguuuuuucccuuauccuuaaggucuggguugcauuucucuguguaagcugugucaaguccuuucugaauguacacagacuaaauauaggaaaacuucuaagcuaaacguaauaauuacagaacuaguuaaauaaguaauuacagaaccauuacaaaagggcaaaaaauuaaauaugcacaaauuucugcuacaaugucuauguaaaaaccguaaucaaaaaguuaaaaaaaaaaaaaacacaaaaccaaaaaaccaaaccugaaaucaaguuuucacuacauaaaaugcaaccaacuagaaccagaggugguugguuuggcuguuaccugaggccaguucagugaggacucguugaccuucuucacugagccuggcuguagcuuguuuauaagucugaaaagaaaaauaugagagacaucuuauuuacuggcacacaaaaacaaggauugaaauaucaaguugcucccuuuagcaucaguaagggaaagcauuaaagauaucuguagaauaucaaggucugacacccugggcugagaaggagagugagagagaaggcuguggaaagaacuggaagagcagaaacagauucuggagggcuguaacucacucgcagaggaugaugccauccuuuaagcccagcuggaaguuggggccaaugcucaugccugucaccucuucuauccaauugcgaagaucuucuucugccugaugaucauacuuggaagcaaucu

SEQ ID NO: 14277 - RNA, 979 nt, Homo sapiens
guguuaaauaaucuuuauuugauauuacacauaaaccacacuaaaauaccauucaauaaguaaaaggaaccauuuuaaauacagggaauucuaauuagauuggcauaguuaaggccaaaaauauaaaguaaacauugcuaccuuaucuucaacccuggccuuuaagaagcaaauaaacacaaaauauaugugaaucuugcaugguuuugagacagugaaggaauuuccccaguauuuaaauauauucacauaaccaguuauauaaaucuaaauauaaaaccacucuccaauaaguuuuaagauggcacucaccaucuuugugaaaaguugaacauuauuaacaaagucuaaucauaucuuuagaagggguaaacagugauagcauuuacugaauuaaaauuacuuauuaaaauucaaaaaccaaacuaccaaacuuauucauuuaaucacaagccagucuuaguuuuaaaucaggacuguccaacaaaauaugcucucagucauucaugaucugaagucugguguaugagaucuauuaaauuaugguacacacaaaaaagucaggagacauuucuguuuuuuaauaaauaaggcaguggaaaauuguuacccacuaauagcuuuuuugagauaagcuaucaagucugccuuucugccuucuuaaugccggcaaagaucauuuuuguuccagggauguacuucuugggauucuccacauacuccaucaguguauccuccccccaggugaugccuuuguucuuauuggcaucuguguaagagaauccaauggccugaccugucuccugccugaagagaccauggagauuaggcccagucuugugcuugccucccuuuccacgguguggcacugggcacacuucugaacaaaaaucuucuugccuuucucaacaucacccguauuuaauuaucucuuucaucgcuggcacuacaaagguuucugcucggaagccagaugucc

SEQ ID NO: 14278 - RNA, 963 nt, Homo sapiens
auugaucucgaguuggaagaggugaguccugucucaaaauggagguaaaaccgccgccugguugcccccagcccgacuccggcagucgccgucgccacuggggggaggagggccaugauccaaaggaaccagagcagcugagaaaacuguuuauugguggucugagcuuugaaacuacagaugauaguuuaagagaacauuuugagaaauggggcacacucacagauugucugguaaugagagacccccaaacaaaacguuccaggggcuuugguuuugugacuuauucuuguguuacagagguggaugcagcaaugcgugcucgaccauucaagguugaugggcguguaguggaaccaaagagagcuguuucuagagaggauucugugaagccuggugcccaucuaacagugaagaaaauuuuuguuggcaguauuaaagaagauacagaagaauauaauuugagagacuacuuugaaaaguacggcaagauugaaaccauagaaguuauggaagacaggcagaguggaaaaaagagaggauuugcuucuguaacuuuugaugaucaugauacaguugauaaaauuguuguucagaaauaccacacuauuaaugggcauaacugugaagugaaaaaggcccuugcuaaacaagugaugcagccggcuggaucacagaggggucguggagguggaucuggcaauuguaugggucacagaggaaacuuuggaggugguggagguaauuuuggccgugauggaaacuuugguggaagaggaggcuauggugguggaggugguggcagcagagguaguuauggaggaggugauguggauauaauggauuaggaggugaugguggcaacuauggcagugguccugguuauaguaguagaggcggguaugguggugguggaccaggauauggaaaccaaggugguggauaugguggcgguguuggagg

SEQ ID NO: 14279 - RNA, 2221 nt, Homo sapiens
ccuauaaggcuggggauuucuugagccuauagaaucuugaaucauuuagcuauguuaucccaucauuuagcccagcgacuguuguaauagacugcuagcauucaccaaagaucuauuuuuuuuuucuuucuugggcucauaacuagauugcauuugccagcauccuuugcaguuagguccagccauaggacuuguucucagcagcaaaugugugucauuucuaggcuaugcucugacggcaugccuguccauucuauguucucuuuuuccuuucaccugguggaugcagaagacaaugaagccccaaggguagcagagccauagaacagaaggggaucagucccagaaucagcugggaagaacugcccacugaccaggaaaaucugccuggugagggagagccaagagaugcacuuaaggaauaaaauguaaggaggcacuuucucuccaguuuacuuuuuucuugaguucacuucuuuaaacaacauuuuuaacauaauaugguuauugagaaagaucccuacugagaaacaagaggcucugaaccauuucaugaaguuuccaguggcccuauacagcucuaaucugaguugagaauuaaucuuaauuaugucaauuuauguccugcggguuugcagagugugugcuaccauaauuaccacuggauagguagaaaacuaaacucucugacacucagaguucaaaauucaugggcagacuguggaauaaaagaaguagcuacuuuagagccuaauacguauuacuuuuaaaagacuuauuauuuaauguaaacauuuacgugauucauauacauuauacuucuuaaaacugacagcauugaccuggaagacagagucacauuucacauauauuaagugaacaccuugacgguuaguagcuugaaaugcaucuuaaaaauaaaaguuuuuaaguauaaaaauguuagagagauaaaaauuaggauguaaauuaaaauucuuucuuuauauccccacuaaaaaugcaaacauuuuuucuuacuuuuccaauaauguuuuccuuuauuuugugauuagaaagguuuuacauauauaugcuuuuuuaaauaugaaaaucauagaauaaacugauccauaggauucaccgauucacuuuuuaggaguuauuauuuauauuauauauauauguuauuuuaguauauauaaauacauuguuuauauauguauauaugcguguguauauuuauguuaaaaauaaaauuggcaucagacuuaucaacauagauuugauuauuuuuucacauuuaauuauaauagcaacacuuuuucaugucauuaaauaaucuacacaauuaucauuuuaauaggugccuaaaauucccuguuugaauuucccccguuuaguuccucuccuguuuaaauuuacauuaucaguuuuacuguaauaguuuaaaguaaauauuuauguauauuucugauuauuuccagagguaagcauucuagauuuggaguuaauggguuacaaaaugugacuaucucuaagcuaauuucuaaaaauuaccuuauauucccucaagcacugcauaaguguacuggucuccccauacucuaaccagcuuuuaguauuaacauuucuugauauuuguuaguuugauagguaaugacuaucucauauacuuguuuuuguuagcaauucuuugcuuauuaaccuuaaaaacaauuauuuugcuuucauaaauugcuucuucacaucauuugcucauucugccucccccuccaaccuuuucuuuauugggauguauuucuuuugugcaauuuaaaaguacucacuguauauuaaaugaauuagcuuuuaagauaucauauauauuucaauuaucuuaguucaagaugccacuuauuuuaucauauaguuucaaauuuuuggauaaucauauuuauuucaacuuuccucccuaauauauuuccuuguuuuuauguuuagaauguucuucucuaauguaagauaacagaauuauuuauucucauauguuuuguccaugugccuuuuaauuuucuuuuguuuuccuuuagcuuuuaaaauacaucuauuuuagcauaagaacuggucauguaacucuucaugcaugcaagucccuugucauauguauuuuccaagcucuucugcuuugugguagagacauagugaccagcacaacuaaucgaacauggcagcaacaugugaucucaaugcagugaaauua

SEQ ID NO: 14280 - RNA, 385 nt, Homo sapiens
ucuguagauuuucgaaagugguaacagguacauagguaaccaaaguauagagcuuguuuggugaaucuucauccucauuacauuuucuagacaaccgcacauggguaggguaugggacauuccuuauuccuuuggcccagacagcuuuguugaaccuggugucaaugcgcacaucuggaguucccaucuccuucauggcaaauuuccgaaucucuuugagugcccgaggggcacgcuucuugaagcccacugcauggaugcgcuugugaauguugaugguguacccucgggucaccaucuuguugauggcagaacggcccuuuuucuucuugucauccuucuuugcgggagccauucugcugggucuaaguuggaaaggaagcua

SEQ ID NO: 14281 - RNA, 859 nt, Homo sapiens
cuucaguuuuuuuuuccggcuggaaccauggaggguguagaagagaagaagaaggagguuccugcugugccagaaacccuuaagaaaaagcgaaggaauuucgcagagcugaagaugaagcgccugagaaagaaguuugcccaaaagaugcuucgaaaggcaaggaggaagcuuaucuaugaaaaagcaaagcacuaucacaaggaauauaggcagauguacaggacugaaauucgaauggcgaggauggcaagaaaagcuggcaacuucuauguaccugcagaacccaaauuggcguuugucaucagaaucagagguaucaauggagugagcccaaagguucgaaagguguugcagcuucuucgccuucgucaaaucuucaauggaaccuuugugaagcucaacaaggcuucgauuaacaugcugaggauuguagagccauauauugcauggggguaccccaaucugaagucaguaaaugaacuaaucuacaagcgugguuauggcaaaaucaauaagaagcgaauugcuuugacagauaacgcuuugauugcucgaucucuugguaaauacggcaucaucugcguggaggauuugauucaugagaucuauacuguuggaaaacgcuucaaagaggcaaauaacuuccuguggcccuucaaauugucuucuccacgagguggaaugaagaaaaagaccacccauuuuguagaagguggagaugcuggcaacagggaggaccagaucaacaggcuuauuagaagaaugaacuaaggugucuaccaugauuauuuuucuaagcugguugguuaauaaacaguaccugcucucaaauuggaaaaaaaaaaaaaaaaaaaaa

SEQ ID NO: 14282 - RNA, 48554 nt, Homo sapiens
gcgcgcccgcggcccgggaucccgaguguccggagcuccgugguuucuguuggaccucgcgggaggcgguuuucucccgccugcugugcucugugaccucucugcugccuccuccacggucucugggcggagcaauccacacugcugagccuggggugguuuggaauucuucggcgaaguggagcgggcugagaguggguuucccguccccgagcccucccucaucucggagaugccgcacuugugagcgacagggcuucauuugaauuuucgcaccucgcgaguugcggagccugcaucucugaagcugccucggugaagagccacagcauuauuuuuuuucucuuugggagaguagcugucugggauuugagauccuaucuucccugcaaauuaccagguugcaucuucacugauaggaauacauguggguuuaucuucuuuugguuguauguaaaugaaugggucgacaacuuccuccgagcaacuuauuguugcuucaucuauaguguuuaucuucuaaaaauccauuccaacagguuucuccccuuuuauuuuggaauaaguguacuuauuuaacuauggaauggaaaugaagagcaaaaaaaaaaauggggcuagcuggggaggggugguggaaggcugugcuuucuugaguuuucuguucugugguuguuugcuucuuauaaauuggguauuauugugggcuuuucagaacacguauucagauagguuuuuguuguuguuguuuuguuuguuuguuuuuuccuuuuuuuuuuuuuucaagcuagagcucgauaugguagauacucuuccauggguuccgggaucacaugcauucauuauacgucaguuaaaccuggaaaauauuaagggagugaguaaaguuuaacagccuuuuaaaaagucauuuaguucuugucuuugccuuuacuguacguuguuauauauacauguuauaauaugacugacucaccugguuggcuuuggcuuagcaugaaauguuugcuacuugauaauucugauuaauuuguccaggaagucauuccugagaugcaguucuucaaauugagaaauaauucccauguuuguuaaaaaauggaaaucucuaacauuuccauuucuauuuucaguuacauugguuaugaauuagccgcagacauggacaucguuuagaaagaaguuauguaaucuuuaaaaagaagauuaccuauaucccacaauagugugauuuuuguugcaagaaaauacugggucuguuaaagaagaaauuuaggguaaaaguacuuauuuaaaauaauaauuuaaggagagauugagggguuaaauuuguuucaagucaacugaaaauauagucaggauuuucagagauuuuguuuuguuaacauucugcaggcuuuccugcuacaagaauuaugguaagucuccaagagauaaaaauacuuaguguauuucucauacccuuauuuucacucagaauuccaaauuauauuguagaaauucuauguuacaaaauucuaauuuuaaaauuaguccaguuauaacuauaugaagaacauuuuagcauaagcauuccaucacaggguuuugguuauacuuuaguugauacagucauucuuguguuuguucgaaagggguauuauguuacuuugaguauuugugaguuugguaaacugagaggauuuuuaugaacauuuagucuguguuuggaaaagcaguauuugccuuuaauuuuguuguuucauucugcuuuuucuuuguggugauggauagcuguggauauagugaguuuuuccauugcuuucuacacuuuguaaauaagaauauagcuauagcuggaggacuguugaucugggcuuuuuagguugaaaugcauacacauaaaaaguguuuucauugaaguauuauuagggaaaugaacuguauguauaauuaaucguuaaagagcacuuuuauucuggaggccagugagggcaugcauaaaacuggcauuaaaauaucacccaugugauuuccagcauaagauucaaguaauauuucauucuaacgccuauacuacugaauaauucugucuacaauuuauagugcuuugcuugauuugucuuuugaauuuauuaaccauuuauuguguauuuaaguauuuuacuaacagacuuuggagacagauugcauacgaacucauauauccccaggggcaguuuuauguuagagauagucuucugcaaccucagcugguuaaauaauguauuauaacuuuaucauuuacaaagcucuuucaaauauuuuaaauauauguauauauauagagagaguuugauuuuauagacauaaaauaugagccuuguuccacagaugaggaaaauaggacaccaagagccugggagagucuggugauuuggccaaggaaccuuagcucagcagccccagccuucagcagaauauauacacugcagacucuuguuacagcgggguuccaaugaagcgaaaguggagggguguggauuagcaagcguuggucagcaacacacucacagauugcaccccugccuguggguaacagguugugaauggccagugcuguuggcucuggaggcacaggucuggcauguagauggaucagcauaauucaaaaucuugauugaaaaacaacucaguuugugccugcuaccuggaacaauccauuuuuccccuugaaggugcagacucuuguguuuaucuaauuugggcaccuucccagauuaagggacaguaauauauugauuuaacacugaaugccuguaggcuucugcgugauuuuguaaucucucucaauuacaagaaugaauagagaaacaccaagcuuucucauugucacuagcacucuugaacuggucacaucuuuuuuuuuuuuuuugagacggagucucgcucugucacccaagcuagcgugcgguggggcaaucucggcugacugcaaccugugccucguguguucaagcgauacucaugccucagccuccugagaaguuggaauuacaggcaugugccaccacacccagcuaaaacuggucacaucuuaauaggacacccggaugacagcagucauuaguuuugaaaguuauuauuuucuguauuuugaagguccuucaauuacaaagauguucucuguucaaguuacuguguuuguuccuucaguuuguuuagagagcucauggaaagcucucuaaacuaagcugucuauauauucugaacauauaugugugugcgugcguguguguguguguguuuuccagaauguugugcuauuuuaugguaaaaguagccaaugaaagcuuaaagaguuucuggacucaaauucuuuuuuuuuuuuuaaacuugaagccaaacuaaguaaaauaccccacauaaaguaaaaugugucauuuaucuuccuaugcugauuguaugccccuucgguuccaaguguuuuuaagcauaauuagggugacagcauggcugauacguaguccaggcuccaucaucagccagagcuagauccuuggaaugucauguaacucucuggccugacuugguuuaccgauuagguaaaagggucacacaagugaugacuucugucauggaauguucaaguuggaagggaccuuagagggaauguaccugguccaaucucuuuaaugugcauauuuuuaauuucugcugucacaggaguuuagccugucaugauuaccucaaaauugaaacauugaaauuaggcuuuuccaccauuucacagauaugaaauacuuuacaauucuuggcugaaaguugauuuucuuucucaaucuuuccucauauagugucucacuuuuauguguagacuaaaugccgauuguauauaaauguacaugugcuguuuggagccucuuuuuuagcugggugaacgcuaauacugaugaugcacauauugaauaucaucagaaugaagaauuugaucuaauaaacuuuuuugguauucuuagcaacauugucuuaguuaagccugauuacguauagcauuauaauuuuuuucuuuugcuuagccacccgaauaccuucacaucuuacuuuauaaucuucaucuucaauuuaguuuaaacugcgcacacauuuauaaauuuuuuugaagauaugacuaugcauuuauauggucaccugagacauagaaugaucaacccuccagguuuucccagaaccaagggaguucccaagaugcaggaauuuuuuuuuuugagacaagagucuugcuguguugcccaggcuggagugcaguggcucaaucucagccuacugcaaccuccaccuucagguucaagcaauucuugugccucagccuccugaguagcugggacuacaggcaugcacuaccaugccuggcuaauuuuuguauuuuuaguagagacagaguuuugccauguuggccaagcuggucucgaacuccuggccucaaaugaucugcuugcuucauucagccucugaaagugcugggauuacaggugugagccaccacaccuggccuaagaugcaggacuuuaaauguuaacacugggaaauccucaggcaaacuagauauguugauccuccuaccugacaguuucucuuuaugggacuugacuagccauucuccccagcuugaaagauaacauguuaggugguuuuaugcuggauaaacugagacaccuuuugaaagcaaaggaaaugucuucaagguaccauguguauuuuguuuaugugacuaaaauacagaaccaauuauuuguugaugguucuuuucaauguaacuguaaauuagaaaaauugaguaaugaaaguuauagcauuugaaaccuucuucauguaaaauuaaaggggcaauuauauuuauaagagaacuaguauuuauugagcaucucccaaguaccuuuuacuuugcaaaaggggagaaaauuuuguugaaagccaaaaaaacaaaacaaaagaaaaggugagccuugucagugagaccauaacuguuugcaaaaugcuacuaacuuuagaaccuagguaucuacucaagauaaauuuauugaauuuuccuuguagauucaacaugauuaguggaaagagcaugggcuuuggcaucuggucaacuuggguuucaucccuagauccaacuguuaacaacuuuauugcuuuauggaagcuauuaaacucugugagccucuuuuacaucaccuauagcaugaggauaauaauuaucuaaagugcuugguacauaguaaaugcuuaguaaaugauaaauggaccaggugccguggcuccugucuguaaucccagcacuuuaggaggucaaggcaggaggauugcuugaggccaggaguucaaggcugcaguguguugaucaaggcacccacauauggauuaggaaagcuguauuuugggcauuuguuaccauugguguuuuuauagcuccccuaaaccugaaccucccaguuacgguaaucguaucaguuaggauuaauuuguugugauuugaaagauugcucaaauauguuuuuccuacacaugaaagaaguccaaaguuggacaguucaggcuugguauggugggcccugaaguccuucuggcucuccucgaugccauuccuuggauguggcacccuccuggcucaagauggcuccagguagccagaugcaggacaaaucgagaagaaugccucccuuucccuuaaggagacuucuggaagcaccauaaaaggcucguaucacauuguucaaagugucaccaaccuggccaucccuagcuagaaggcugagaaaugucaucauuuagcugaugcauaguuacccuaaguaaaacggguucuguuacugagaagaaaaggaagagaagauuuuuuuuuuuucuaaauacaugacagauuaaagaacacuagauuuuauggcaggcaucuuuucgucuuuaccacugugcugccgcuuuaccacauagaauuuaacuacucaauuauuccccaagacuuuucuauuuuuauuuauuuauguuuauuuauuuauucuuagacaagcucuugcucugucacccaggcuggagugcaguggcaugaucacggcucacuacagccuugaccuccugggcucaagcaauccuccuaucucagcccgccacaccuggcuaauuuuugcguguguguguuuguuuuuuuguuuuuuuguuuuuuuuuuuguagagacagagucucacuauguugcccaggguggucuugaacuccugggcucaagugaucugccugccuuggccucccaacguguugggauuacaggugugagccccuguaccuggccaguuuuaauuuuuguuagcagaguugguggggaucuccacuguugacuuuugucucucugucuucuggucauuuuugcuucuauuauuugacuccuagcaggagaucuuuuaaaaaacaauuaacuguauccuaaugaagagugauuaggaguuuaagcucugguuuuuucauuuauucauuccauaaauauugugcacucauuguguacaggcugcuuuguguuauugacaaugugaaucauuacugauuauauuucccuuuuuuugacuuggcuuccugggggcacagagucaaauuugugacucaguuggauugaguacaagccuugcccugucaaacuuucuuuuuuucugucacccaggcugcagugcaguggcacgaucuuggcucacugcaaccucugccucccugguucaagugauucucccacuucagccucccaaguagcugggauuacagccgccugccaccaugccuggcuauuuuuuguauuuuuaguagagaugggguuucaccauguuggccaggcuggucucgaacuccugaccucaaaugauccaccugccucggccucccaaaaugcugggauuacaggcaugagucaccaugccuggccccuguuaaacuuucuaccuagcaaugugguuagucuucccaucccacuguauagcaguuucaggaugaugcugccucucuaacuuggagugcugaacaggaaguaagaguuggcuuuacgguaggcagcugccaggcuagcauaaauucuggcauaccagaaaaucccuuugauccuuccuaaaugcuugucuuacuuugugccaaaugacuaaugauuuaaagcagugguucucaacccugccuguauaucagaaacacccacagaacuuuuaaaaauuaucuagagaaacugccccaccugacauuuugauucaguagccucugguguaguuuaaaaagcuccacaggggagcucuuuccuuucgcugcuguggcugcagccuugaguaugcucaggcuucagaagaggcuugccucuaguguccucugcuguggcaagaagaauaucugguuagaccccaaugagaccaaugaaaucaccaaugccaacucccgucagcagauccggaagcugaucaaagaugggcugaucauccgcaagccugugaugguccauucccccgcuugaugccggaaaaacaccuuggccugccggaagggcaggcauaugggcauagguaagcggaaggguacagccaaugcccgaaugccagagaaggucacguggaugaggagaaugaggauucugcaccggcugcucagaagauaccgugaaucuaagaagauugaucgccgcauguaucacagccuguaccugaaggugaagaggaauguguuaaaaaacaagcagauucucauggaacacauccacaagcugaaggcagacaaggcccgcaagaagcuccuggcugaucaggcugaggcccgcagaucuaagaccaaggaagcacacaagagcuaugaagagcaccuccaggccaagaaggaggagaucaucaagacuuuguccaaggaggaagagaccaagaaauaaaagcugccccuuuguguguacauacuggccuccgugauuacauagaucagccauuaaaguaaaauaagccuuuaucugcuugcaaaaaaaaaaaaaaaaaaaaaaaaacaacuccacagguaauucugauguacauuugagguuucagggcuuguacccauguggacuggaaaugaucuagggaggauuugcacuuuguuccuuaucugucacacacuggaaaucagaucuuucuugaaaaccuguuuuggccauggaaaaagcagauggggggaacaauaugauaguagagucacuuggguaagagaggcaagaauacugaaaugcuuuaggggaaacuuauuuacucgugauuuauguagagcuggccuugcuugccuauuuugccagcucccauugugggaaauuuuuccuuugagcaaaagaaucuguuuaacuggagcuucaagcucugggaaaagugcugagucugcauguggccaccauuaguaucaugaguuuucagcuucugcuccuugggccagugaagggagauaaagggaagucagguagauuauuauuuucagaaucaggagacuaucaaugagucuucugagcuaaugagagccuucuggugacuccaggaggguuagugaggccacaaggaacuaugaggucggguaggaauccuguuuugaauuaagaguucugcacuuugggaggccaaggcgggcagaucacgaggucaggagauugagaccguccuggcuaacauggugaaaccccgucucuacuaaaaauacaaaaaaauuagccgggcgugguggcgggcuccuguagucccagccacuugggaggcugaggcaggagaaugacgugaacccgggaggcggagcuugcagugagccgagaucacgccacugcacuccagccugggcgacugagcaagacucuguuucaaaaaaaaaaaaaaaaaaaaaaagaguucugugaauuccaagaucaggccuucucuuacucaaauagaacaaaaacacauuccagaguuuauucugcuucaguuuauucauaccauuucccucagcuuccuuaucacauuaguguagaaaugcaaaaaugguauacauguauauccuacuaucucauuaaaacuguuacuguuuauagcauaaugaaacaguggcuuaguuauucagugcuuacuauguacugugugccagagacugggcuaggaauuaugaaacugagguuuaggaugaugaggggcaaaguugggaagcauuuauuuuaagauguuuucaauucuuuugccccaucuucugguaaugugguuuuuccugauaacccauucaagcauauuuuaguuauauucauuuuuaauaugcuuuuauaauuugcuacaaacuuucugcuauucuuaaacagaggcuacugaauugaacucagggaucuuaaagucccuuagaaccucaagauucuauuaaccuuuuggggauaucucuagccucacucugacccuguuauuuacaguguacagaagacucaggagauggcugaacagggucugauguagucauguccugggccuuguuucccuguaaaagucucacuguucguuuauuuuuuugucauuuuucucccagaggauggaccacgcaugacacugcgggcagaauaacaugucugccccuuugccaaauucauuugugagugaaucaggguucaaguaaccucucuagugacuuuguuucuuuccaucacccucucuguugccaucagcgcccuuuaacuuguuggcugaauucagaaaguucugagcuuuucagugucucugaccugcuggaucacaggacucuugcugucacuguggaccgcucagcacuuaaggaaaaguauuccucaccaucuugagaauuuggccaguauguuuuggaaaugccuuauucuaaagucuauaccauuuucauuaaucagagcugacacuucuguaaaugugauacugagccaaaaucuauaugguuucuuaugauuuuuuucccuaauggauuuugaaucccuggaggucagggguucauauucuccacagcaacuggagagcuaggacuuagauaaaguagacauucuaacaauguuuguuaaaugcaacuuuuaaaaugcuuuaaguagaagcccuuacagguaauaucuggaaucuuuuuaaguuugaaaaucuaauggcuauuuguaucagauuuauauguccuggcucuuaauaaccuccuagccuaccugauaaaccugugaaauugcacuuucuuccaguagauaacuaugcuguucucaggugaaauacuucgcuuaucccuugccaguccagccuggggaaggcagcuggaccugagcugggaauuuuauuugagggaguggaaauaggagggguuggccaaggcugaguuagaggggacagcucuuuaguggccugagcuggcucuuuggugcagccgaagauuguuagaauuuuagagguggagagacuuuagagauacaucccaguccucuauuuuacagaugaaugaaagugagucucaaugauguuaagugacuuuuuaaaggcuacagaaggcugggugugguggcucacgccuguaaucccagcacuuugggaggccgaggcggguggaucaccugaggucgggaguucaagaccagccuggccaacaugaugaaacccugucucuacuaaaaauacaaaaaauuagcugggugugguggugcgugccugcgaucccagcuacucaggaggcugaggcaggagaaucguuugaaccugggagguggagguugcagugagcugagaucgcaccacuggacuccagccugggcaacaaaagcaaaacucugacucaaaaaaaaaaaagggcuguagaauucaguagagucaaagugggaacuggacugaagucagaaagaauugaaaagugugcuuuuuucccucuuucucuguccuguccaggagcuaugaagacauguuucuccuuuccguuucuuuacagguuaugcauuaaauuggaagguuuucuuuuuguauacguaauuaugagauggagauaguagagagaaaguagucccauuuuggaagcuuuuuuuugguuaaaaucuuggcucaggaacaguaaaugaacauuuaagaucaucuaccugccuggccaacauggugaaaccccaucucuacuaaaaacacaaaaauuaaccaggcuugguggcgcaugccuguaaucccagccacucgggaggcugaggcacgagaaucgguugaaccugggagauggagguugcagugagccgagauugcaccauugcacuccagccuggguaacagaacgcgacuccgucucaaaaaaaaaaagaaaaaaagcaaaaaagaaagaucaucugacauauuuaggacgcauuucaaguuccacaggcaucaacuuacuguuccuccuaccuuguccucccccaaccuuuuuuugguuuuccuuucuuuucuucuuucuuucuuuuucuuuuucuuuuuuuuuuuuuuuuuuuuugagacagcaucuugcucugucacccaggcuggagugcaguggcucaauuacaguucacugcagccuuuaccuccuggguucaagcaguccucccaccucagccuccugaguagcugggacuacagaugcgcaccaccacaccuggccugaccuuuucaauuaaauacuuauguauaucauuuagguauaauugauuauaccggaaaugaaccugcacuuugugcuugcuauuauuuuuuaagguauuaaagagaugauaacuauguuauuucaauaaauauuuuaugcauguuuuccaaauuuaccguaacaugauauuuuaauuugaucacccuaaggauuccagucguaaaagguauucauaaauaggcuuuguucuuaagccagcuguuucucuuguuucauucuuuuugauucuaaugaaagcuuugcuuucuuacauauggggaaaaccucuuauuauagaggaagcuucuagaguguuuauguauuuuggugacuuaaagucuguuaauauacuguaucccaaagauucaaauugcguuuugcauucuuuccucucagaacuauuuauuuggggccggaagcaguggcucaugccugugauccccagcacuuugggaggccaaugcgggcagaucacgaggucaggaguuugagaccagccuggccaacauggugaaaccugucucuacuaaaaauacaaaaauuaguugggcaugguggcgggcaccuguaaucccagcuauuugggaggcugaggcaggagaaucacuugaaucugggagguggagguugcagugagccgagauugcaccacugcacucuagccugggcaaugagagcaaaacuccaucucaaaacaaacaaacaaacaaacaauuuauuuggacucuuaaaugcuuuugguugguuggcauuucuuugugaauuauuugucaaaauaauuuuuugucuauaauuggaugaaugcuuugcgacaaauuugaaguuuuaacaaaagaaaauacauuuuuuuaaaagguaacaaaacuuacuuacuuuuauagucuuguuacgugaaauuaaggaaagaaaaaugaaaaaaauucaguaacuuaggcuuuuaaagccauaugaaauucuagaauguuuuaucuuucaccugaaaaacaacucaguuggaucaaaagguccuauuuaucauauauucuuuacucuucaauuugcauuuuuuuuuuuuuuuuuugugagacagagucuugcucugucgcccaggcuggagggcagugguacaaucuuggcucacugcaaccucugccuccagguucaagugauucuccugccucagccucccaaguagcugggacuacagguucgggcugccauacacagauaauuucuuuuuguauuuuuuuuuuuuuuuuaguagagacaggguuuugccauguuagccaggcuguucucgaacuccugagcucaggcagucugcccaccucguccuuccaaagugcuaggauuacaggugugagccacugcucccagccucaacaauuugcauuuuuuuuuugagguggggucucacucugucacccaggcuggagugcgguggcaugaucucagcccacugcaacguccaccgccuggguuuaagugauucuccugccucaaccucccgaguagcugggauuacaggcaugcaccaccacucuuggcuaaguuuuuuguuuuuuuuuuaauaggguuuugccauguuggccaggcuggucucgaauuccuguccuuggccucccaaaguauugggauuacaggcaugaggcaccacaacuagccagcaauuuccauauguauagcacuuuaaacuacuaacucauggucuccuuaaaugacuaacagacauuuaaaacaacguuuaggaguuacaaucuuuauugaacagaugaauaagcccaaguuuagagaggcugaguuacucccugcaagcuaacaucucuaguuaauaguagaacuggaguccaguuuuucugacuccuaacuaguguucuuuccacucuagugaagauaaauuguuuggugauauauauauauauauagauuuauauguacauauaucuaaauguauauuaugcguguauguucuauuuuugaugcaauaauuauuauuaaauguugucauacucucagauccuguauauuaagcuucuguuugcuuuguuuucuuuuagcuucuuagcaaaacugguuguuuugcuaagucaauaaagugugguaagaaugaaguucagugauaacagugcaauacuuuuuugguugaugaauguuguauacauaccucccacagaacauucucccucuuauuauccaguguacuuccugugcuuggauguaucugcccucccacugguucccuaaaugccucugggaguaauaccaguauugccuggaaucuuauugaaugugaaggaugggaacaguuuaauuuuacccccacugaagcccuuugcagacauuucagugaauugacguaguuucauuagccauguuaucuagcauuguaucaaaagggcccuuucucuucaauaaggauaaggagagcaaauacagaauaguaaguuuaauguuauuuagucagagauaucugaaaauacacuucugaauacuuuccagauuuaacaucagcaucuuuguuguuacguaauggacaagaacucaauuaguauuuauuaaaugucuacucugggaaugauuugccgcuucauaauuuaugaguguguugaaaucccaaagguauguuuuacuacugugauuuuuuucuuuagcuguuuacaugauaaagcagugcauugaauucuaggcaguuggcaaaucuuaaauguugaaaaaagaaagcaugaaacauuugcuuuugaaauagagaauucuuauuuuuugaaagcauuuuacccauaugugcaguuauugagagaaaauauuuguacuuggcugacuugucuucaccaaaugucacagcccagaccucucuuugguuggagacacagggauaaguccuuuugcucuuaaauaggcaauuaaucuucaaaaaauguagagaauguccuugauaauuacuagauggacuuuauguuguccuuuuuguaauacauuguucuuuaaaaaagaacauuuguuuuauuuuuuauuuuuauuuauuuauuuauuuugagauggagucucacucugucgcucaggcuggaaucucggcucacugcaaccucugccuccaggguucaagugauuuuccugccuuagccuccugaguagcugggacuacaggcauacaccaccaugccuagcuaauuuuuguauuuuuaguagagaugggguuucaccauguuggccaggcuggucucgaacucccgaccugaggugauccaccugccucggccugccaaagugcugggauuacaggcaugagccacugugccuggcuagaacauuuguauuuuauauuuaaaauacaauugucacagggguuuguuaccuuuaaauuuucuucuggauucuaguuuucuagaacaaauuuagcauuugguauguuuauaacuaacuguuguucacagagggaaagaggaugagcaauuaauuaugcuucugauuauauuuaauuaucaagagcaauguuuucacuccugucccaacguauuuauuuuccaacacaaaaugcuauauuucauccauuuugagauagacauuuuauucacauuuuaacaccacugauaucacuauaugucauguauaacgugugaccuaacuauaauugauaacauuuuuacuuccuuaguggcacaugacacaucagggugccuuacaauucaugguauuuuuauuuauuuauuacuuauuuguuuagauugcucuuucagaauucauggaucuuaaauugaaucaaaaucaguacaauggaaagaucuuuaucaaguuuuaaagcacuuuuugaaacacagguuguuuacaguuuuuguguauucauguacacaucuacuuucaguugguguuggccugaaaucaaggguggauuauuuucauuuacauuguuaauuuuggaaacaguuacauaacaagaaauaguuugaaauuugccacauuuaauuacagaaacucuagcuagauauguuaagggguuugucaagcuugaagagcucaaagcuaguuaacacaggaccauacagacaacccacucuuccucauuccuacuuuuucugucauuuuaucuguggucuucugagugcccagaagacacugggcaugaggagcguucuugugugacccacucucgggcugaggcuccuuugucacuggagcaccuguuggcagagcgugucauuuugcacauucagcaaaugggcucccaguauuuuuccuccagaaaaaccaguccagaguuucaaggcucagguuuuacgugcuucugcuccuucuugcccuuucaacagugcaucgugugaaaugguguuucauaguuugaucauuuuguguugcuuuaacaucugucauggauggcaguccauaauccugugacuauacauuuccccauaccccaaggauaugacaacguggcaguuggucgcccugaaguggguacaugauacaucugaggaaauaguuucaggccguguuuauggagcagaggagaguguggagaguguggguaagguuagaaacacagacccugugaaccaucaugcugaccuuugcccucaaaaaacccuuuggagguuuuuucguuuuguuuguaucagauuuuuuuguuuuuuguuuuuuaaagagcauuucugaaaacuggacuuuguguguguuaggggaggggguuuguuaggagaggauggcuauuugguaaugagaccuguuuccacagauugauuggggugaaagacugaguggaugggaggugaggaaauggagauugugugaauagacaacuuugaaaaagcuuauuauuuagagagaagaaagaucacugcaccaauuuuuucuuuucucuucuuuuuguuucuuuucuuucuuucuuucuuugagacggagucucgcucugucgcccaggcuggagugcaguggcaugauaacagcucacugcagccucaacuuccugggcucaagggauccucccaguagcugggacuacaggccugcaacaccacagugggcuaauuuauuuauuuuuauuuuuauuuuuuauuuuauuuauuuauuuauuuuuaccccuaaagcagccugaauccauuuccuuugggugucaaugaggacuuucucuuggguucuugcuuucccaugaccucaaacccuucucaaacucacugggucacaauccaccuugauuaguggugcugccauuucugacucuucccacucuccuccugaccaaccagcccuacaaaguccaaaauuugugacuauccaaauacucucaagucuuacugauucaucuucuuuguugucucuuggauuuauucugcuuuuucucuucucauugcacugccuccucaucuuuugacuggguugcuauucacuauuaaaaaguggggauuauaauaccuaccuugaggguuugcuaggagcaugaguuuaaaugaaauaggugaaauauguggcauggugguucaguguuauuggguguucuaggcuucuucuguuuucauucaauccaucucccaagcuccaguuuuuagccacuuccuuucuuuuuaauccugcuaucagaguugucuucccuaaguacaucauuuucuuuuuagacggagucuccgcaaccuccgccuccuggguucaagcaauucuccugccucaggcucccaaguugcugugacugcaggcacgcgccaccacgcccgacuaauuuuugaauuuuuaguagagacgagccuucacuguguuggccaggcuagucucgaacuccugaccucgugauccacucgccucggccucccaaauggcugugauuacaugcaugagccacuguguccagcccuuaaguacacagccuuuuaaguguguucaguguuuccccauugcuugcaguguagccuaaccuccuuagagggaguccaggcucacaaucuagucccaucuuuacuguccagucuuuuaacccucuauagucucgacuuucacaaaccuuccuugcuuuuuuuuuuuuuccccuugagacagagucucacugucacccaggcuggagugcaacagcgcgaucucggcucacugcaaccucugccucuaggguccaagugauucuccugccucagccuccugaguagcugggauugcaggcacagguccaccacgcccggcuacuuuuuguauuuuuaguagagacaggguuucaccaucuuggccaggccaaucuugaacuccuugucucaggugagucaucugccuuggccuccugaagugcuggaauuauaggcguugagccacugcgccuggcccuuccuugcuuuuuauguccuagcuacauuagaccacuagauguuguucaaaacccuauuuugauguugucuuuguggucuuugaaucaaaguguccuuuuuuccuuucucccuuaucccuucauuguuuaaaacaaugagccaaacauuuauuaauguauuugguagaauuaugauauauauguguauauauauacauacauauguauauguauaugacaaauacagauaucucauaagcuguuuuaucaugacaaggaguagcaugaggucacuucugccaucuguuggacauauugucuuuuugagaaguaacuuaaacucucuaaacuuguacauuuucaucuguuaaacgaagugagguucagauggauggucauuguuucugcucuuuguaaaguccuuggccugaacuuaauuauaacccagaaaaagugauucuaugagagcuuacucuccgagaccacuuuaaguucuagaauaacuuaaagaauuuagcuauaauccuagcacuuugugaguccgaggaggcaagcagauugcuugagcccaggaguuccaggucagccuggguaacacggugaaaccccaucucuacuaaaaaauaaaaaaacuagccaggcaugguggcacacaccuguggucccagcuacuugggaggcugaggugggagaauacccugagccccgggagguugaggcugcaaugagccgugauugagccacuguauuccagccugggugacagagugagacccugucucaaaaauaaaaaaaaauaaacaauuuagauguauggccaguuaacaagauuagggaaaagaagaaugagcauuugugagugccaaguacauuauguaccugugccauuugauccuuugagagaaaccuccacagguagguagauaguuuaccaggagaaaauggaggaugagaaaggguaggcuauuugcccaaaguauaaaucuuguuagacucucucuuaacucuugagcucucccacauacagcgauggcugagcaacagcgugugcuuuagcuuuagucagcugggguuucuuuucuucacagugauucuucucuagauuacagacugcuuacucuagacaguuuggaaaaaaaguuuugguucuguguacguauucauccuaggguuuguguuuuucccuuucuuucuggggcaguauuucuauuuaaacaccauuguagccauaaaaauaauauuuggcuuucuguuacugugcucauuuccuuauuuccacuuauaaaaugugcugugugugugcacuguauuuaaacuaaugaaacagaaagcaaauguuuaacagaauaagaaagaaaugaaauucauggcagauacguuacuuaucacuuuuguguaucuggaguccuauauaggucaaaaucagggauuuuaaugccuugaguuaagcaguagcaguaguagcaggaauaacaaggucagcagcaacagcugacauugauugagcugugauguuggguuuauguguguguuacuauguuuccaagugccuuacuuguauuacaggucuucuuaauaaaccuaggagggaaguaacguucucuccauuuuauaggugaggaaaucaggguacagagagggugggaaacuggcucaaggucguauagcuaggauacauacucacugacuuggcaguucucauauauuuaaauguauuuuauugaucaguuaaauacauuauugaaaugucucucaguuaauguguuaucuccuuuccagggauuuggacuggcuguucuuucugggggcauugguuacagaauaucuucaguguaaauaugacuaagccuagugguguauauauucgacuugcuugaauuacuaaauucccucaaggaacugaagcaguccuuacuaugcauuguuaacaauaauguuuucuaaauacauguaugaaaauacuauagauuuaugaaggugccuuaauuuauuccacagaaugucauugaaauggaaaauuuaauaugcuuacaugcuggcuggggaaauauguuguuuuggauuacaggagauaaaggauuuuuuaagggcuuggcaguuauguuaauagguaaagcaaacauccuucuuucuuucauguuuguuuuguuuguuuguuuguuugugcaauggcgugaucucagcucaccacaaccuccaccuccaggguucaagcgauucuccugccucagccuccugaguagcuggcauuacaggcaugugccaccaugccuggcuaauuuuguauuuuuagcagagaugggcuuucuccauguuggucaggcuggucucgaacucccgaccugaggugaucugucugccucggccuuccaaagugcugggauuauaggugugagccacugcgccuggcacaucuuucuuauuuagcaagaaguaauacuguauucuaaaauugugccuugcaggaagaaaguuucagcuaauacagacauaauauuuuuauaaguuuagagaaauuuuuauuggcuaacaaauaguaccuuguguuauguuugaaugccuuuauguucaacucaguauuuuucccccuuguuuuuuuuaguucuucaccaaaggacauggaugaaaaugaaagcaaccagucucugaugacaagcagccaauauccuaaagaagcaguaagaaaacgucaaaauucagcacggaauuccggagcaagugauucuucuagguuuucuaggaaaagcuucaaacuggauuauagacuagaagaagauguaacuaaauccaagaaaggaaaagaugggagauuugugaauccguggccaacauggaaaaaccccucuauuccaaauguucucagauggcugauaauggagaaagaucacagcaguguuccaaguucuaaagagguagcgcuuggcuuuuuugagugcuuuauauuugcucuucauauaugacacucuaguuauuugagcccuuguauaucauaaggcauagaauuaggucugaggagauaaaguggauagguguaaccuaggcccuaaaguucaucguucaguagcagaguacauauaggaauaaccaacccugaucugguggcaacuagagguaggaacagagugcuuuagagguacaggaaagaacgugaugcugacaggaagagcuggagauggcuucacagaggaggugaauauuucagcugggccuagucaacuaaaaaguauuuugacagugauuuuccagguagaugauggcaugaacaaggucaugaaggugagacaguguauuaccugcucuggaagguaguagccugguacguguguagaauauggaucaugagggugaaggcauggccuggagugcuuggcuuuuaacccuuggauaaggcuaccaaagcugugaaagggagcuucagaugaccuuuccagaccuugaaaaguugacuuuagguuccuagccuuuaaauguacuaguuuuacuuaagaugauucuacuuggccuucuucuauucuguuagaauagacagaucacaguuuuggguuaaguugauuucaugguuuacauugaguauaucaauauuuuucauuggugaaugaaguaaguacuaugacugugucuccuuuccuuauauaccucucccucugcuguguuaacaacaucucuuucaucugcuugacuuucuguguauuuaugacaauuauuucccugccuccuauggccucucaaugccauuuuccugagggaaagacucucagguggucguucagcagugggcuguagucugagcugaugccuucccagggucucugccgacuuacauucuagggcacccuucaccagccuccugggcucccuugugucuucuauggucacccuuguuuucugcaucccacuuguuccucuuucugugucauuuucucauuuugguggagcauauuuucagugaacuuccugagaaaggguacauggaaaguaaguuuuuugaauucuugcuugucugaaaugucuuuauucucauucauaauugauaauuuggguauagaauuuuuguuuagaaacaguuuucucucagaauuugagaguauugccuccauaacuuuauuucuaguguggcuguggggaaguucagugccguccuuacucuugauccuuugaacaggcccuuuguuuucucucuagagacuuugagaauccucucuuuggcaccaguguucugaaaauugccacgauguguaguucuuuauuuauucauugugcucuguguguggugggcccuuucagucugaaaauccauuuccuucaguucuaggaaauuucaucuguaucuuugaaaauguccuucccuauauguuuuuauucuaaaaugacuauuaguuauaguaguucuauuuuggaccuccuggaucaauucucuguaauuuaagaaaauuucuucuauguuuuaucuuuuuaaaaauauuacauggcuaggugcaguagcucaugccuauaauacccacacuuugggaggcugaggcagguggauugcuugagcugaggaguucgagaccagccggggcaacauagcaaaaugccaucucuaccaaaaaaaaaaaaaaaaaaaaaaaaauacaaaaaauuagccaggugcaauagagugugccuauaaucccagcuacuugggaggcugaggcaggagaaucaccugagccugggaggcaaagguugcagugagccaagaucgugccacuacacuccagccugggugacagagcaagacccugucucaaaaaacaaaacaaaacaaaaaaaauugcauucugaggagguggccccugggaggaaugaugcuaggugcagaugcaguguggcuuuugauggugccuuaugaacaguugugucccaaaggagguaugaggauaacugcugagguccuaaagagcaagccuaacuuuagccauuggcacauaggcauuaaacagaagccuggaaguugaaaugauagaaucuuacuugucuagacuagcuuuaugguuuuauuacugguaacguuuuuaucuguugauugagugcagauuuuuggagaccuuuuaaagguauagagaaucggcuugacaacagugcacauggagcaaguuuuaaagaagcaaagaacucaaaauucaugcuuggagaagugcaggcagaccugauuuccuaaagaggucuaggguuuuuaaugaccacagauagcaagcaagcaugcaaaccuugauagggucucacucugucacccaagcuggaguguaguagcccuuugaggcucacuacagccucaaacucccgggcucuagugacccucagccucccagugguuuuuguacacagccugauggaguuucauggcagagaagauuaauuaaacaaugucuuucaauuuuaauaaauuucagcaauuugaaaaaaauuugcauucugaaaaauuuccucaagaauuuguuucauuuuuauuuauuauuauuauuauuauuauuauuauuauuuuugagacagagucucacucuuuuugcccaggcuggagugcacuggcgccaucuuggcucacugcaaccucugccucccggguucaagugauucuucugccucagccuugugaguagcugggaccaugggcgccugccaccacgccuggcuaauuuuuuuuguauuuuuaguagagaugggguuucaccauguuuggccaggcuggucuugaacugcugaccucaggugauccacccgccccggcuucccaaagugcugggauuacaggcaugagccacugugccuggcccuauuuguuucauuuuuaaaccuugugucucguagagucguagggaugacugaaaaugucaccauauacaauuuuuuuauaaaacuagaaaauaugaauacucugauugcaaccauucauaaaauagaacuacaaguacagaucauaauguuaacagugguuauaauaucugcauguugauauaaugauggcaacuauuuauauuuuucugcauuuuccacauauuaagagcauuuucucuuauaaucaaggaguuuaaaaauacuaagccauuuugauagaucuuauacucuuaauacacauggcaaaaauaucaaacauuggcaucaauaauuaauugaauuggaguuauuuugguaacacauguaucuuuauucaguguucacauauaacaaaugugaaaaagaaaaauguuauuuuuuaauuuaaaaaaucugaguugcagauuacaguauagguaguaaaguuuucuaagauggugaaaauguaccuucaguuggaagaaaaguauuacugugucuucuuuaaaagugauauuuuaaaaacaugguuuaaauggauuugagucacaucuuucuuuuuugucucauuaauacacacaaacacauacucuuaaaauuguaaguauguuaagaagauaugaguuucauuguuuaauuuuaauguaaguuaauauuuaugccaucgaaggagcauggcuuagugaaagagaggucuuuugaguuaggaagaccuagauuucacuccugauuggguacuuaccucuugcaugacuuuggcaaauuucuuagugaccccagucugccuuggucuggucaucuguaaaauggcaguaauauuugcuucacaaauuuagaugacacaguauaccuaaagcaccuugcaaagaguagcuauugaaugaacguuaggauuuuucccuuuucccgagaaaaguaaaacauuaacuagcguacugguuaauuaugagucuugggauuuuccauuuugcagcuuucaaaaaggaagaccagccaagaaagucuugaucuagccaugaaaaugccacgugagugauuaguuuccucaaguaaacaagaguccauccucuccccaccccuuuuucuauaugcuuuuucuuucuuucuuccuuuuuuuuuucuaagacggaguuuugcucuuguugcccaggcuggagugcaguggugcaaucuuggcucacugcaaccuucgccuccuggguucaagcgguucuccugccucagccucccgaguagcugggauuacaggcaugcacuaccacacuuggcuaauuuuguauuuuuaguagagacaggguuucuccauguuggucaggcuggucucaaacuccugaccucaggugauccacccaccuuggccucccaaagugcugggauuacaggcgugagccacugugccuggucuauuauuauuuuuuaauuauuauuuauuauuauuuuuaaauagagacaggaucucacuauguugcccugcuggucucaaacuacuggccucaagcagucuucuagccuaggccuccugaaguguugggauuacaggcauguaccacagcaccagccuuaaacuuuuaaaaauaguuuuauuaacaugauauaggcuucacauauuuaaaaugcauaauuuaaugaguuuugacauauguauauacccacgaaaagaucaccacaaucaagacaaugaacauauauauuauccccaaaaguuuccuuguguccuuuugaaauucauacccccuuauucucccaaccuggaccccaggcuguuacuuuuuacgaaaacauguuaguaaaugagauuuaaugagaggaaguaugguuuacuacagugggucuggcugggugaccuugccugagugcuguaacuucccuaauucauuguauucuuagcuguagaauggagcugguuuauaggaccuacuuccaguguuguggucguagccaguagcaguuaguacagugucuagcacauaauaagcacuucauaaaugguagcuguuguuaauaguauuuuguuuuguguuaugcuaaaguacuugauacauuagguaguucaucaucauuaugugcccaauaugaugccaaguacgaguacuuaguagguacucaguuuauauucauucccucucccuuuccucauuaauucuggauaaguauaccucuuggcauaugucauuguucacuaacccuaacucccaaauuuaagaacugauugaaaguugacauucauucauuuacucauccauucaacaaauuuuguugagcacaugcuguguuucauuaaucaaacugagcacugaaugauuccaccuuucauaagacaugggacaaauucuguguacacauaaccagaauauccagaggagaugugugaauagggagauauggaaguugagaggcaggaguaagugcuucuagcugugggacucaagagauggcccgaagggauaagggggaagauaauuuaaccugagaaaugggaugaguaccgugcaggguucuugagcucagucuaggaguaggaagcagucuccauguaggugggacacagcacauguggaagaggagcaugaaacgcccgagagaauuggggcagucccugggcagcucacugcugggcugaggaggugagacagacuuugucaggcaguagagagccaguggagauuuugcagcagaggagacuuaaguuauaccuuaaguuggcuguuuuugagguggcucuugugcauggauugaguugacaggcagauaguugagcaaucuggagagcuuugaaugucugaauauuucuuagcaucuuaacuagguuaguagcuccacggaaaugcaaaagauugguaacauuggugccugguuuguugucaggguuggaacuuucuugcuuuuucuuuuggacuacuuguagagugcuuauuaugucccagccacucguaauucuauccucacaggaaugaagcauagguacaauuauuacaccuguuuuccagaugaggaaacuaaagguuuaaguggcuaagagaaaccuuuuuguccuccaccugugcugcuccuucucuuccuguccaggccuucuucccauucagacucacucucucauugaccucucaguuucccuucaccagcaucuccccaucugcccucuuuugucugugucuaccgguguauccuuugcucagguccucaucucuucauaucuuggcaacuguugugacacucuccaugccaucauuuggacucuagaauuguuuuaucuaaacauaauugggucaugucuguguguaugugugugugcacaugcaugcauguguacgugugugugugcacgugugagggcaaaaagauaccuccuaggccuggcgugguggcucacaccuguaauccuagcacuuugggaagcagaucgcuucagcccaggaguucgacgccagcuugggcaacaugguaaaacccacccugucucuacaaaaaaaaaaaaaaagaugcuuccucauugucuuagagugaagcaugacacucaaggcucuuaauguguucccaucuuuauagauuuaguuuguccccugcccucaaacaccacauuccuguuuggcucuguaccuuugcuugggugguuucucuacuugaaaugcccuucuuccuuuucucugcaucaugaguuucucaucauucuucaggaacucacacaagucacugugucugugaugccuuuggcaacugggcucuucauuccuucuuaucaggcuauaacaugaccuguauuuuaacuacuuauccaguaccacacccuuucaaaguugauuuaguggcaacuuacaaacauacauaaagcaguaaaaaaagaauuggaugagguauagaauuacuauaccuagccagucuaggagcaaaauggacuauuagacuagaaaaauaaaauaaagccaagaauaaaguuaauauagaaauauguuccaucaugugcugcacguugcugcagguggccucagcuuuuccucugaacuuccuaaagagagaaguaucaugaaaucuuaagaguuuucccagugacagaaaugacaaagccaggugcucuggagaagaauuuuuccugaaacgagaugggagggaaauguuucugggguaaguaggaagguggaggugguaccaagucugcagccugaacacauacauggugaguuucaugagguggcuuccuaugagagaccuccaugcagcuauauagcaugguaccagagcacaauucaguaaaagagcuuuauaaaagccaggacugugaugcugcaaccuuaccacuuuuuguuggccuagcuuaauccaaguauaaaauguagaauaaccaagggauaauacucuucacgcuuuguuauaguuauuguuuuauauccauuuacggccccccuuaucucagugaucagcuucucacaggaagggaucauauucacguugguuugauuaaugguagaaaaucagaaagguaaggaaugaggaaaacaauuuaugacugugauuuguccaggaaucaucacagcgcuccauuuugaauuauagguacucagaaagugagauucaggccaggcacaguggcucacgccuauaauaccagcacuuugggagggcaagacaggaugauugcuugagcccaggaguucaagaucaaucugggcaacauaaugagacccugucucuacaaaaaauaaaaaauuagcuggauaugguggugcugugugccugugaucccagcugagagguugaggugggaugaucacuugacccugggggguuguggcuguagagagcugugauuaugccacugcaccccagccuggguaacagagcgagagccugucucagacaaaaaaaaaaaaaaaaaaaaaaaaaagaaaaauaucagauucaugauucaugucugagagccaagagcuacaaauaaauggucauaagcuuucuuuacuauuuccagggacugaccugcuuuuaaggcaguuuuuagcagcaaauacaucagcugaguagaauggcaauagaaaaaugacugcaucuaggccagucuacuucuggcaguacugaagagagccuuuaaaaaauugauacauuuagcagcacucaaaguuuuaaauuuaauuuucucuuuugcauuugggaggaagaagauuaccauauuaucaugauuauuaagucagauucagaaagaaguaugcauuuucaagaaaaaagcaaaaguguagcaaguuuauugaaugacuuuaguucucuuaaaacagcucuucuugccauuauuuaggucaaaauguggacuaugaugauauaauacuuuuuuuucuaacuacucuuuugucuugcuuucuuuauacacaaaggaacuagacaaagaacucccagugcuuaagccauauuuuaucacuaacccugaagaagcuggagugagggaagcuggcuuaagagucacauggcugggacaugccacgguaaugguggaaauggaugagcucauauuucucacggaucccaucuuuagcucucgugcuucaccaucgcaguacauggguccaaagcgauuucgucguuccccgugcacaauaagugaacucccuccaauagaugcgguccuuaucagucacaaccacuaugaccaucuggacuacaauucugucauugcuuugaaugagcgauuugguaaugaguugagaugguuugugccuuugggucuccuugacuggaugcaaaaauguggcugugagaaugugauugaguuggacuggugggaggagaauuguguccccggacaugauaaggucacuuuugucuuuacaccuucccagcacugguguaaaaggacucuaauggaugacaacaaggugcuauggggcagcuggucugucuuggggccuuggaaucgauuuuuuuucgcaggagauacugguuauugcccugcuuuugaagagauaggaaaaagauuuggaccuuuugaccuugcagcuauucccaucggagcuuaugaaccgagguauguagacuuccaaagaaaacauuccugcuaugugauaaauuaacugaauuuaaaaguaaagcaauuaugauuuuugugacacuguaauuuaugauuuuaaugguggacuuuguuauacaugauuggggguugguaggucagauucaauuagauuuuauuuuuaaauauuuuaaauuaaauauuuuuuaaauugacaaguaaaaauuguguauauggugugcaacaugauguuuugauauauguaugcauuguggaauaacuaaaucaaacuauuuuacaugugcauuaucucacauacuuauguuuuuguggugagaauuaaaauauuuuaauuauagucauaugaguuaaaaaaauuacucaaaaucagggaugauguuaccauaagaaagggaucaagguuuaaagaauuacuauaccuagccagaaguucacauaccauucaacuaaacuggucagccaguaauaaaaccuacucuuauucuuucacauggagaauacuuucuuuauauaaccaccuuuugcuccauaacuugagugccccaauccccuguccuacagcucuccuacguuuagcaaagagaaaaagcaaggaauuggccuauagcauuagucccuggugaggguuuuauuucagucagcacugaaguuaaucuggucauggugguguuguacuacucaccacucauccuccaaccuugacauacuauugaccuauuucagagcagcgaaaggucacacucucauuggacaccuaggagacucauccacugucuuuguuuuccuuaauauucucuguuuagggaaaagagaagugauuucaaagaauuaaguuagauuucagucaacucugguuuauaugugcaaauaaagagaaaacaaaacacuaauaguaacaaagcaauggauaauuuuaaaaauauuguauucuauagugcauggacagauacauacaacaacauuuuguuuagguaauuccauaaguggaagaacaaguauuucucuaauacauagaugaauugaaugaaucuaaacuuuuguuuucaucugauuuuguuauuugcuaaauuuuuacauucacuaaaacgauuuugucccuauuuuuauuuacuaaugcuuauuuaucccuuuuuguuuuuugcuaguuuccuuauuuggaggggcuagauauuuuuacccuuuuuugguucuugauaauuauuaaaaugauuacaaaucaauauuggugcuugaauuuuacuuuucuaauuaaauaguuauaauucuaaugaaaccucucaaaaccugucaacuuauauauuuuuagaacuguuacaaaucaguuauguauuuguaacauaaaauuggucuuuacucgauguauguuccuuuuuugguugguuguuugagauggagucucacucuguugcccagguuggagugcaguggcacgaucucggcucacugcaaccuccgucucuggguucaagugauucuccugccucaaccucccaaguagcugggacuacaggcgccugccaccaugccuggcuaguuuuuuuauguguguuuuuaguagagacaggguuucaccauguuggcuagacugguuuugaacuccugaccucaagugaucugccugugucggccucccaacgugguaggauuauaggcguuagccaccaugcccagccugauguauguucuuaauagauuagaacaucuuuuauuuguuaugaaaauaaguuuucauauguaguaauauauaaauuugucacauauauuugugaugauaaaauauguacaaccaaauuuacucacauaaucccccuuuccugcuugcauugcaggcaaacaggaaacaacuaagaugggaaaaagacaaggaggcuauuauuugcccuaagagaguuaaauugugguagccucuaauguguagucuguuucuuugguuacuguuaacggcuuuagaaauaagauauugaauaacacuugagagugcucuauaaauuuaagauguuuagaccgaaaacaacuuucaauaauaugcuuggaauguuucauucuuacuuuagggaaucuccugucaccagguauucuauccaagucaguuaagauuuuaaguuuuuauuuuaauuguuauaucacaguaaaaaauuuaaaucuauuucagguggaaaggaauauaucuaucccuuugauuugcacuaggauuuaaaaaaaaucaagagagaaacaccaaaaaccauuuucaucuuucccugaaucccaagagucaggagauauggcagaacagugcugcucucauuugcuguugaggagaacacaguggcuuuguuuucagccuucuguaggacccagcaacuccuaacaguaaauaucuguugcagauggauaaacuucuccaugaugucuucuguaaaguguggaagcuccugugcugaauccaugucuguuggucuucacuguaguguuaguugucacuggcagacuaggauguaaauaaugugaauacaguguuguuuuuccuccuugaaacugauggcuuggaaggcaaaggauuugcuuguagacaguacacuuucuccuuuauaucaggaauaauacgucuuucuucugaaaguguugguuuuguuuacuguuuugggagaauucuaugaaaguagaugauguucucuaugcuuuccuaagccuugucuuguuuaauccucacaauacccucacauaaugggguaaaauuuauauuucacagacaaagaaauagcagcucagagaauuugaacagacuuuccaaaggcauucuaagaacugcaagagcuaggauucacacccaagccuucugccuccugagcccucgcucuucccaaggcauuaggcacccuuucauuauuuccuuaaucauuuacccauuagucugaucuucuugccaaaccaaacaccucauuguucaguuuuaugauuaaauaaaauuucuugaauaguaauuggauauuuggcuccuggucuuuaaauuuuauguacuaguuuuuguuuauuuuugcuuuagcagguuuuuacaaauuuguaucagcaggacauacaaauucuuuuguaauuggagcuuugguuuuuauuucuuuaccaauuauucaguuucuuugauacauauccaggacuguaaaauaucuacuuuuaaaaguaacagugaggcaggacuuauuucccagucucaauugauaaagugaaaaaacuggcagcugggcgcgguggcucacgucugugaucccagcacuuugggauguggaggcaggcagaucacaaggucaggagaucaguaccauccuggcuaacauggugaaacccugguucuacuaaaaauacaaaaaauuagccgggagaggugguacgugccuauagucccagcuacccaggagguugaagcagaagaaucacuugaacccaggaggcggagguugcagugagcugggaucgcggcacugcacucuagccugggcgacagagugagacucaaucucagaaaaaaaaaaaaagaaaaaaagaaaaaacuggcaaaaaccagcagauggugacagaagugaucccuagcugcccucauugcucauuagccuaagacucucccaccaucaccaugacaguuuauaaauggccauggcaacaaccuagaaguuacugccccuuuccauggcaaugaccaagaaguuaccaccccauuccuagaaaguucuaaauaaucugcccuuuaauuugcauuaacccauucccuaauuuacauauaauuaaaaguggguauaagugaguguaaauacaguuaccaaccccucauauguugccaacucugagugcacuuacugccuauaacuuagcacugcuccucaaggagcaguaucguuuaaaaaaaauugcuggccagcaccacuggcuugccguugaauuauauuucguuugugaggccaaaaacccuccugggcuaagccucaauuuuggggcucgccuccccugcaucaucaguaaguuguaucuucagauagauccaguaaaaucaaaauauacgugaaacaaaaaucucacuauucagaggggaguuugcuugagacuuacuuauuuuauagcaauuuguacaagaaagacuuuugcuuguuuuauuuuucagcagaaaguguaccaaagggagaugguuuugccuccugugacuuaauuccugugcagaauuuguuuuguuuuuacaaucuagccuugaccuggccuucagacuugguuucuagcucauccuccccaaaacugcauguuuuaucccagugguucuuaauucucaacauccauaguccugcgcagaaucuuaaaguuugguuaagugaaacagauuuuagaauuuaguguauaucucaaaggucagaauuaagaaauugccauguuucuucaggugguuuaugaaauaccagcauguagacccagaagaagcuguaaggauucacacugauguccaaacaaagaaaucuauggcaauucacuggggaacuuuugccuuagcaaaugagguaaguuugauugcgauaaaaauaacuuuguguguuugaccaaugauaggauucaggcaucacuguuccuuaguuuucagacccaagacucuggaaucagauacugcacagucaucacagucacugcaugaauuagggugguaaaucauacuaauuaguagaacaauacacacauauacagucagaaaaaaaaaacaacacaaccucauuguguuuucuuuuggcuuauuucugaaguuaguaaagcuuguauuuguauaaccaaaaaucuguauguggucuggagacuagaaaagcaagccaucaugucucaccccucaagcaggcucucaugcuagcagaagacagaagucauguaugugauacagauguuagaaggggaaagugcuguaauguggaacagaugagauggucucagaaucaggauguuugcugauggcagggaucagagagggcgugauggaauaagugacauuugaacuuggcucugagagggcagggaggaaggcauuuucagaggaggaaagggcagagcauaggcucggaggcagcuaguguggggaguacuugaaucaguucagcaggagaguggagggcaauagggagaaguaaggcuaguguggaacuuucuagaaauauauucaguaaacauugacucggugucugcuaugugccaggcauagggauaaaugugauuuuauuccuagauuaaaacagaagagauaauuuuuccuuaaggcagauggacccuagaacucugccacuagccuggguccugggaucaagcagaggauaguauaaagcuuucucuccuuuccuggauccaaggucuucucuaaacaaaacuuagaaauguaugguuaggcccagugcaguggcucacaccuguaaucccagcacuuugggaggcugaggcagguggaucacuugaggucaggaguucgagaccagccuggccaacauggcgaaaccccgucucuacuaaaaauacaaaauagccaggcgugguggugcgugccuguaaucccagcuacucgggaggcugaggcaggagaaucgccugaacccaggaaguagagguugcaguaagucgagauugugccacuauacuccagccugggcaaaagagugagauuuggcugggcaccuguggcucacaccuguaaucccagcacuuugggagucugaggcggguggaucaccugaggucaggaguucgagaccagccuggccaacaugaugaaaacccaucucuaauaaaauuagcugggcgugguggcaggcgccuauaauuccagcuacucgggagccugaggcaggagaauaacuugaaccugggagacagagguugcagugagccgagauuacggcacuuccuuccagccugggugaaagagcgaaacucugucuugagaaaaaaaaaaaaaaaaaaagugagacucugucuuaaaaaaaaaagugagacucugucuuuaaaaaaaaaaaaagugugguuaggacuuggcuucuuuacuuucuguggcaucuuccacaucccagagccucucugcaggaacucaguguuuucuugcaguuuuaguuacuccucugucucacuuauggccugcccucucccaaagaugcaguguguuccaaaauuaccuaauacacugccugcccauucccccacucccuaaucaaaauuccugugccaugaggcagcaacccugagccacaaugcagcaauucuuggccacuguugggagaaggaauagaauaaugacuaaccauaggguuguggggaggauaaaugagaauauaaaugugggugugugggugcguauuuggagaagggagaaguuuaagacugguuuucagugacaauuucuuauuccaucuauauaugugugcguguaugcacauauuccauuauguauauuccauauauaugggacuuagaugaaguaaugguauuuuauuaaaccuaugcaaagaaaggaaucaagguugacuccuagauuuuuagcuucaauagcugguuagacaguugugcucuuuacugagauggggaagaugagagaggauuaaaaaauccugucuuugagaauuauuguguuauucagccuucaagaauuauuccuguuauaaaccuaaccgccaucuuuauuucuuaaugagaauguuaauaaaaacucauuugacuuucagcauuuuggaauuuguucauguuuugauguugaauaaaccucauaacuaugaguuaguugaauuauaaagcagauauaaucuucagagaggauauguuacccuuuacuucuuuuuuuuuuuauuauacuuuaaguucugggauacaugugcagaacauacagguuuguuacauagguauacacgugccauggugguuugcugcacccaucaacccuucaucuacauuagguauuucuccuaaugcuaucccucccguagccccccacccccugacaggccccaaugugugauguuccccucucuguguccauguguucucauuguucaacucccacuuaugagugagaacaugcgguguuugguuuucuguucuuguguuaguuugcugagaaugaugguuuccagcuucauccaugucccugcaaaggacaugaacucauccuuuucuauggcugcauaguauuccaugguguauaugugccacauuuucuuuauccagucuaucauugaugggcauuuggguugguuccaagucuuagcuauugugaacagugccucaauaaacacacgugugcaugagucuuuauaguagaaugauuuauaauccucuggguauauacccagugaugggauugcugcgucaaaugguauuucugguuccagauccuugaggaaucgccacagugucuuccacagugguugaacuaauuuacacucccaccaacaguguaaaagcauuccuauuucuccacauccacuccagcaucuguuuccugacuuuuuaaugaucaccauucuaacuggcauaagaugguaucucaauaugguuuugauuugcauuucucuaaugaccagugaugaugaguuuuuuuuuucauauguuuguuggcugcauaaaugucuucuuuugagaagugucuguucauauccuuugcccacuuuuugaugggguuguuuguuuuuuucuuguaaauuaaguucuuuguagauuuuuguuauuagcccuuugucagauggauagauugcaaaaauuuucucccauucuguaggcugccuguucauucugcugauaauuuuuuuugcugugcagaagcucuuuaguuuaauuagaucccauugucuauuuggcuuuuguugccauugcuuuugguauuuuagucaugaagucuuugcccaugcccauguccugaaugguauugccuggguuuucuucuaggguuuuuaugguuuuaggucuuauguuuaagucuuuaauccaucuugaguuaauuuuuguauaagguguaaggaagggauccaguugcagcuuucugcuuauggcuagccaguuuucugaacaccauuuauuaaauagggaauccuuuccccauugcuuguauuugucagguuugucaaagaucagaugguuguagaugugugguguuacuucugaggccucuguucuguuccauuggucuauauaucuguuuugguaccaguaccaugcuguuuugauuacuguaaccuuguaguauagcuugaagucagguagcaugaugccuccagcuuuguucuuuuugcuuaggauugucuuggcuaugugggcucuuuuuuuguuccauaugaaauuuaaaguaguuuuuuccaguucugugaagaaagucaaugguagcuugauggggguagcauugacucuauaaauuacuuugggcaguaugagcauuuucacaauauugauucuuccuauccaugagcauggaauguuuuuccauuuguuuguguccucucuuauuuccuugagcagugguuuguaguuuuuccugaagagguccuucacaucccuuguaaguuguauuccuagguauuuuauucucuuuguagcaauugagaaugggaguucacucaugauuugacucuuugccuguuauuggucuucugcucgcuuuugaguuugcuugugauuuuuaauucuguauaggaaugcugugauacauugauuuuuguauccugagauuuugcugaaguugcuuaucagcuuaaggagauuuuggguugagaugauggguuucucuaaauauacaaucaugucaucugcaaacagagacaaucugacuuccucuuuuccuaauugaauacccuuuauuucuuucucuugccugauugcccuggccagaacuucgaaugcuauguugaauaggaguggugagagagggcauccuugucuugugcugguuuucaaagggaaugcuuccaguuuuugcccauuuaguaggauauuggcuguggguuugucauaaauagcucuuauuauuuugagauauguuccauuaauaccuaguuuauugaauaacuugaaggguuguugaauuuugucgaaggccuuuucugcuucuauugagacaaucaugugguuuuugucauugguucuguuuaugugauggauuacauuuauugaguugcguauguugaaccagccuugcaucccagguaugaagcugacuugaucauggugaauaagcuuuaugaugugcugcuggguucaguuugccauuauugaggauuuucgcaucgauguucaucagggauauuggccugaaauuuucucuuuuuuguugugucucugccagguuuuggaaucucugccagguuuugguaucaggaugaugguggccucauaaaacgaguuagggaggauucccucuuuuucuauuguuuggaauaguuuuagaaggaaugguaccagcuccucuuuguaccucugguagaauuuggcugugaauccgucugguccuggacuuuuuuugguugguaggcuauuaauugcguccucaauuucacaacuuguuauuggccuauucaggaauuugacuucuuccugguuuagucuuaggaugguguauguguccaggaauuuauccauuucuucuagauuuuccacuuuauuugcguagagguguugauaguauucuuugaugguaguuuguauuucugugggaucaguggugauaucuccuuuaucauuuuuuauugcgucaauuugauucuucucucuuuuguucuuuauuagucuggcuaaugaauccagcuccuggauucauugauuuuuuuugaaggauuuuucgcgucucugucuccuucaguucugcucugaucuuaguuauuucuugucuucugcucgcuuuugaguuuguuugcucuugcuucucuaguuuaguugugauguuaggguguugauuuuagaucuuucccgcuuucucuugugggcauuuaaugcuauaaauuuccucuacacacugcuuuaaaugugucccagagauucugguacauugugucuuuguccucauugguuucaaacaacaucuuuauuucugccuuaauuuuguuauuuacccauagucauucaggagcagguuguucagaagcagguuuuucaguuuccaugcaguugugugguuuugagugaguuucuuaauccugaguucuaauuugauugcauguggucugagagacuguuaugauuuccuuucuuuugcauuuguugaggaguguuuuacuuccaauuauguggugaguuuuagaauaagugcgauguguuucugagaagaauguauauucuguugauuuggggguggagaguucuguagaugucuguuaggucugcuugguccagagcugaguucaguuccuugauauccuuguuaauuuucugucucguugaucugucuaauauugacaaugugguguuaaagucuuccacuauuauugugugggagucuaagucucuuuguaggucucuaagaacuugcuuuaugaaucugggugcuccuguauugggugcauauauauuuaggauaguuagcucuuguugcauugauuccuuuaccauuauguaaugcccuucuuugucucuuuuugauccuuguugguuuaaaaucuguuuuaucagagacuaggauuacaaccccugcuuuuuuuugcuuuccauuugcuugguaaguauuccuccaucccuuuauuuugagccuaugugugucuuugcacaugaguugggucuucugaauacagcacacugaugggucuugacucuuuauccaguuuaccagucugugucuuuuaauuggggcauuaacccauuuacauuuaagguuaauauuguuaugugugaauaugauccugucauuaugauguuagcugguuauuuugcuuguugguuaaugcaguuuauucauaguguugauggucuuugcaauuugguauguuuuugcaguggcuuauacugguuguuccuuuccauguuuagugcuuccuucaggagcucuuguaaggcaggccugguggugacaaaaaucucucagcauuugcuugucuguaaaggauuuuauuucaccuucgcuuugaagcuuaguuuggcugcauaugaaauucuggguugaaaauucuuuuaagaauguugagcugggcgugguggcucacgccuguaaucccagcacuuuuggaggcugaggcgggcagaucaugaggucaggaguucgagaccagccugaccaacauggugaaaccccgucucuacuaaaaaugcaaaaauuaacuggguguuguggcgcacgccugugaucccaacuacucaggaggcugaggcuggaaaacugcuugaacccgggagguggagguugcagugagcugagacugcaccacugcacuccaaccugggugacagagcaagacuccaucucaaaaaaaaaaaaaaaaaaaaaaaaaagaauguugaauauuggccccuacucucuucugggcuuguaggguuucugcugagagaucugguguuagucugaugggcuucccuuuauggguaacuuagucugaugggcuucccuuuauggguaaccugaaguuucucucugguugcccuuuacauuuuuuccuucauuucacccuugaugaaucugacgauuaugugucuugagguugcucuucuugaggaguaucuuugugguguucucuguauuuccugaauuugaauguuggccugucuugcuagguuggggaaguucuccuggauaauauucugaagaguguuuuccaacuugguuucauucuccccaucacuuucagguacaccaaucguguagauuuggucuuuucacauagucacauauuucuuggagucuuuguucauuucuugucacucuuuuuucucuaaucuugucuucucgcuuuaauucauugaguugaucuucaaucucugauauccuuucuucugcuugaucgauucggcuauugauacuguguaugcuuaaugaaguucucuuacuguguuuuucagcuccaucaggucauuuauguucuucucuaaacuguuuuuucuaguuagcaauuugucuaaccuuuuuucaagguucuuagcuuccuugcauuggguuagaauacgcuccuuuagcucggagggguuuguuauuacccaccuucuaaagccugcuucugucaauucaucaaacucauucuguguccaguuuucuucccuugcuggugaggaguugugauccuuuggaggagaggaaguguuaugguuuuuggaguuuucagccuuuuugugcugguuucuccccaucuuuguggauuuaucuaccuuuggucuuugauguuggugaccuucaggugggcucuaugaguggacguccuuuuuguugaugcugauacuauuccuuucuguuaguuaguuuuccuucuuacaggccccucugcugcaggucugcuggaguuugcuggagguccacuccagacccuguuugccuggguaucaacaucggaggcugcagaacagcaaagauuacugccuguuucuuccucugcaagcuuugucccagaagggcacccgucagaugccagccagaggucuccuguaugagaugucugucggccccuacugggaggugucucccagccaggauacacaggggucagggacccacuugaggaggcagucugucccuuaucagagcucgaacgcugugcugggagaaccagugcucuuuucagagcugucaggcagggacguuuaagucugcugaaacugcgcccacagcaccccuucccccaguugcucugucccagggagaugggaguuuuauuuauaagccccugacuggggugcugccuuuuuuuuuuagagaugcccugcccagagaggagaagucuagagaggcagucuggcugcagcggccuugcugagcugcagugggcucugcucacuuugaacuucccaguggcuuuguuuacacugugaggggaaaacugccuacucaagcuucagcaguggcggacgccccucccccuaccaagcucaagcaucccaggucagggucagacugcugugcuggcagcgaaaauuucaauccuguggaucuuagcuugcugggcuuugugggggugggccccgcugagccagaccacuuggcuccauggcuucagcccccuuuccaggggagugaacgguuuuguuuugcuggcauuacaggugccacugggguaugaaaaaaaaaaaaagcucccgcagcuaguuuggugucugcccaaauugccgcccaguuuugugcuugaaacccagggcccugguggggcaggcaccggagguaaucuccuggucugccuguuacgaacacuauuggaaaagugcaguaucugggcuggagugcacuguuccuccccguacagucucucauggcuucccuuggguaggggagagaauuccccaaccccuuguucuuccuggaugaggcaaugccccacccuccuuuggcucacccuccgugggcugcacccacugucuaaccagcccuaaugagauggaccagguaccucaguuggaaaugcagaaaucacccaccuucuguguagaccucacugggagcugcagaccagagcuguuccucuucagccuuuuuuuuuuuuuuuuuuuuuuuuugagacggagucucauucuguugcucaggcuggagugcaguggcacgaucucggcgcgcugcaaccuccgucuccuggguucaagcaauucuccugccucagccucccaaguagcugggauuacaggugccggccacuaugccuggcuaauuuuuguauuuuuaguagagacaggguuuugccauguuggccaggcuggucucaaacuccugaccucaggugauccguccgcuucagccuuaacuggcgugagccacugcacccagccaguuacccaugacuucuaaacacuuuaacacucuuugcauauaugcuguuauaguagcugccucguguaauauaagcagauuaaggauguccuuaacuuggcaauacucuaaaauugcauauauggcaacaucuaauuuaucuagggaaugaugagugcauuuccuacauauauuuaagcacuaaaacuuaaauuacuaguuuugauggaaacgaguuucaagcauuacauaauauguacauugccuuucaagugauccgggucuuuacuuugaauauauucuauuguuguauaucaugaaacugaccccuuuaggaauuuacgaguuguguguggcuagcugccuagacccuaauggauccagaaugcucggagucuucugcuuuucccauuuacucauauugaucucugaucugcuguuuugcuuuauauguaguuguuuugucccaugguuauggggcauuuuuaucucccuucuggacuaaagugcuuggacugugagcucucagucacucagaagccuuucagaccuaccuccaggguuaucuuccagaugguugaaacagcgaagaauuggucugugaagaaacucagaaagauacugcuaaaucuaggcagauuaaagacagagggucuacugccaacucuaacauaucagaauucucacuaaacgcaaacaucgcccuccacacuaaaguuauagcuuagcaaauaaguuacugacguagggugauucugugaguguguacuguuagcccagacuuguacagcaugggagaaagagaauuuaacaaaagaaguuauuuuucaaugggaaaaaagcucaucauuuugaaaucucuuaaaauaauuuaggaaauuauuucaggggaaauuucuugacuuaggguauaaaguuaaauuuuauuuguaauauaauuagugaucuuuuuucuuuauauauaaaauagacuaaaaguaaauuccuguuaucaacuauccauuacuaagggguuagcucuaggaauauuggauaaccagcauacaguuaaaaccaaacuuacucaguagucaguugaaagguauccuuuaucuuuaaacauagccauaaaaccuggaacugagcaagggggaaaaggaugaccuguguguggccaacaacuguuaccaaaccugugcauuuaagggcucaggaaacuugccugguuuuccuugcacaucauuggcugucccuuauucucuguugcuagucccuccucuccgcuugcucugaacagugcgugccguagaagucaguccacggaccucuucucuucuguaguugguuucucccuugggaaucgcauccagucuuauggcuucaaauaccaccuaccugcuguuccucucuagcucagauguuuuucuucuauaauccacauuuauauauccaacugucuccuucacaucuccacuuggauauccauuagguaccuagaacuaaagucugaaauuaaacuuucucaucuucccucaagcuuacuuuucaaacaucucaguaaagggugacucccauuuagcaauuccucagggcaaaaucuugacuccucuuugccacacagagcucaaccuucauauucucugggauccucuuucauucuguagacugugguuucuguaugugacuagacuuuuugaggauaacaacccuucuucagcaaaacaauuugcucuagcauuugguuacacacacacacacaccacaauuugauuucuauauuuuucaaaaauguuaguaacauguaauucucuaauaacaucaucuuuggcacugauuccaucuagauuggaauuucauauggugaaaccgugaugauuucaugcaauccagugauguucaaaguaagauggcaccaaauuucacauacaugguguuggcaugauuucuauccaaccaaauaccuguugacuuaauucaugacucaaaacuguauuagaaaaugugauagacccauuugcuaaugcuucaauuaaaagaaagggccuaauucuaacuaggcaucuguugguuauuuuaguuugaacuguuauuuggaaaaucucccaaauauauguuuaaucuuuuucuauuuuucuucuuucucuuuggccagcauuacuuagagccuccagugaagcugaaugaagcucuagagagauacggacuuaacgcugaagauuuuuuugucuugaagcauggagaaucaagauaccuaaauaaugaugaugaaaacuuuuaauaaaugugagcacaggcacuuuuaaugaaaaaggcaucaucuaaguuuaaaaacaaaugaaaagacuuagaaauucaugaauauugugauuauuuuacauuuggaaacaacuucugcaaguuuauguuuuauguuuuguguaauaacuugcuuccuaguaugaucagcucauguacacuaugagaggguucaggggugggucauuuaaauaaugaauuggcuaauguggauuuuaaauuucauaucaugauauaagcacugcaauggaaauguuuuuacuaaaacauuauauuuuugugguacuagaauuuccugaggugaaaaaccgauauugaagauucauuuuucuuuuuuccauucuucaggaccuucggcaaggugagucaaggcucucuaccuaccuagauguuuuucagaggccuacaaauacaaguaucuuucuuauaugcacauucuaauaaaugaugaaauucaguccaacaugcuuauuauaaacauagcaauucuugcucuaucaaauuagcuuauaugccaaauauuaaauaugguuuauuuagguaagcauaaaaacauaggggcuaucauuuuuaaagacuugauuuucucuauugugguaaaauauauaaauacauauuugccauuuuaaacauuuaccauuuuaaccauuuuuaaguguacaguucuuucgcauuaaugcacccaugaccaccauucacuuaaauuuuuaaaagaacaguauauucuuuuuuuccuagagccuucagaugagagggaacaguauauucuauugcacgucuacaauucccaaaagaccucuuacuuugggaggccaaggugggugggucacuugaacccaggaguuugacaucaaccugggcaacauggugaccucccgucucucucggaaaaaaaaaaagaaaaaagaaaaagccgggugaggugguguguaccuguagucacagguacuugggaggcugaggugggaggaucacuugagcccaggagauagaggcugcagugagcugugaucguaccacugcacuccagccugggcgacaaaaugagacccugucucaaaagaaagcccucuccuuagcugagcagaggaagggaaggaguguggcuaugagaauaugauuuaugccauuuucuguuuuuaaaucuagaagaucuucuaagcacaaauacagcuacaaugaaauauuuuacagacaaaauguuaauagaccauauucuuugaauuaaauuuguuuuuaauuuucucuacacauuuuuuuuuuccuggagucucuuagcucuaaauauaucaaucagauuuauaauuuuuuuuaccugauucagaugucuuacauuuuuauauuaaaugaaccuuaagcaugauucuuuugguaagccaguaugaaugccagugguuggggggcggggggggagucaguugacauaagauuuaguccuaauaaggacucuguauucacuugauuauucugacccuuccuaagggagggagguggauuagauaccacuggaggcccauucuguauuccuaauccagucucagcacuuuauucauacaaaauaaucaaaauagguuuucuacaccaaaugcuacccaggcagugcucuauaauuuauuugcacaccuguauguguggugccacguuagccacuaaaucugaacuuuuacccugcuuucaucauggauuuuuuuguguaaccugaaacaagucaccagugcucacugugccuguuuccucauuugcaacaagaggauaauuccgaccuaccucugaaaaauguguagauuaaaugaguuuuuaaagcacuuuagaaaauauaagggagaaaaugauuucuuaagauaucacugccuaauauagacagguauauuugaaagcuaaauacagguuaaugcuuuugauaauguauuguuccuguugcaaauuuaagcauuauauauuaggagacuaaacauugaaaacuuucacugauuuuuaaauuggaguaauagccuaaauaaguguaaauaaucuuuaucaaaauuuaguguuuaucuacaaagaugcgaaucagucaaggggaaauguguaugcaauguguguguauaugauguaugcgaacauaugugauuuugggguacuaaagcacaaaaaaaucccccauaaaauaaaccuuccugaaaagacugaucauaaacuuuuucacuccaagcagaugugaaucaagauguuagguuuauggugaguuagcuuugagguguguugcccuaauacuagccagcguuguuguagccauauucccugcugcugcacgccgaauugaaaauccaucucuuaccucuucucuaugaagcaagccagguaugucuugcuuaaguauuucuucuccaugaauggccuuaacauuauuuuguauucacguguacuguuuaacugagggucucaaagcacuuuaaacuguuguguucuauuuccacucgucuggccugccucauuuuucuaggcccuuuuguaagcuguaauuuuuuauuaccacucauguucuuucuacacugacacuauucauuaagaacaucaagcuucaucucugcuuacagaaucucaccuuauugaguggguuccacuuuauuuuucauuuguuaucuacauuuugaaggguuuaugugcaaagugaaaacaaauuuugaaaaauaagacaaauccauucucuucuucaauucagucuaauaugcauuguagugucuuuuaa

SEQ ID NO: 14283 - RNA, 2317 nt, Homo sapiens
cuuucuuucuuuaucuucagcuguuguuuauugacauagagauaggcucuauagccacaggcucagaggcggcugcaguagugggggaaaauggaagguggagggugaaguguuugcugcaggacagcugaguggagagcgggcacaggugccagugaggaaggcccaggggauugggaagcaaguaagggccagggucaggaucugcuuaaacuggaacuacugccccaugcccuaaggucccuaacucucacuggcuguuuccugaccccaggacaggguugggaguccucugggcuuccauuuucuaaagcaacuaaacagaguacacagaagaaaggaagcugccacccucuugccauacacucugggggccucuguucugcauuccuccuucuucucuugcuuggguggggccacaugaugggcagccaggcuccgggcucucccgccacagcaggcucuaaaaacagccacguuucagcgaggcauaaaucuucuucccugguguuccagcccaccagugccacacuacagcccagagugagcucuauaagcauugcuggccuaauggaugcauugggggaagggggugggacaggggcuggaggaagagcucuggaguccaucacagcacaggaauaacacacagggugguggagaagccagggccagggugucaccaggucagcacaaugaccacaucauccuucuugaagaagccucaggccuuaccaacauucauggccaaguucacucggagguccacauccucagccuagggcuccuggaugggguccuuacacagcacagggaagauaccacgguacaggugggccuggcgagcugccuggggaugccaugucacaacaaucaugggggcacgugggcaguaucuggccaccuggugggcacaccugcagacuuggugaggacgauuauggccccacugcagcacuugaaggaggccuccacagugcccauggcaguagcuucugcggggucacugguaaugggugccagguggcagaacuccucaaauaauugcaagugguagaugguggccucugccucacaggcaaucaggugcugcaugugcacagccuccagaggauaguucccuuuggcuguuucuccagacagcaugaugcagucagcuuccaccagaacugcauuggccacaccacugcccucagcccaagugggguggagcuucuugaucacauccucuagcaucugaguggcaagaugacaggcuucccagcuugguugcaccacccaaucaucauccucugagcaaggcagaccuucccugcaggaaucucaucucgacggcuugugguggaucaccacgagcuaccauaaucccaucgcuggccuccaggauuucaucaaaccuccaacccccaucaugauucucaauuuugcugguuaucuugcuguucuuuccuuucucucccaagaccuuccuaacuucauggacaucagaugucuugcagaugaaugaugaaaacaucauaucgacaucuugcucgcccccaaacuucagguccuggauguccuucuccaacauggcagacagguccacggcagccccaggaagguucacacucuucuugcugcccaaggagccaccauuuuccaccucugucaccagaaagugagcauccuucugcuucacuuggagagaaauuagcccaucauccacguagaucuugcagcccacuuccaccaccuugcagauguucuuguagucccgccacaggauguucucuuacccuuuuccauguagguauuauccagcgugaacuugagaguggcucccuucuucagcuccaccucugcagugccgcugcccuugacgggcccaguugggaucucagguccuuuagugucuggagccacagcaaugggcugguagaggauggagucagaagcaaagcuuuccguggcugugcgcacguucuugauggucucuguaugguacucaugggcuccaugagaguucagaugagccacauuaauuccagacuuaaucguuuucuucagcaucucuagcaauggagaagcugggcccauaguacagaugaugccagugcuccaggcugugauggguggcgagucaguguccaggcagcacaugugcuccaagaaugugucagccauggcugcgugcagcugcugggucugaaugaaggcagcccuggcuucacuauggggcuucaacauggcuucugagguccuccagugcugaccgacuugggcuacgcugcaaacgcagagaggucaggagccccgggaugugcagcagcugugc

SEQ ID NO: 14284 - RNA, 848 nt, Homo sapiens
gcgggccgcggccgguucccuagcaucacggagccucgaccccgcgaccucccgccccgggucgccaccggccggcgggcgggaggccggcggaaaggcgccgggcagggcgugcgcacccgucccuugcccgcgagcuggcccgggggucgcggcccuuuccggaaggggccccggcgucugccgcugggcuccggcccgcccgcugcgggagugcagcggcugcguugcucccaccugagccgcgggccgaggaggcggaggggccgagugugcgggagggcgugugucucgccuccccuuccuccccggcccccgccugucggccuuucugcugagaaccuaagcugguugucaagugguuugccucgggcguguuccuggcgcgaguucagccccgagaccugugcguuucggcucucggguuuggauucgaaacuuuccgcucggguugagcgugacuugggugcgcugcgggcgccggggucgcgggcugcgcagggcggugggcgugugcgcgggagccggucggaguggaaaacgcgcccguggcggccaccuccagccuggccgcucacccgagcaggggggccgcugcccaagaacccuuuccuggagagcugcuccgagaccgcacagcgccgccgcgucuucuccuuuuccacuccucucuccuaauuuuuuugauuuaccagcguucgacaucguuaucucuuccucuagauuaauugcuucgcucuuuugagcaagaauacucuguguggcaucuuugguacuguggggaacgagaauccagcauuaucuuuaauaaaauccagaaacauuuuugguuguuuccuuugaggggu

SEQ ID NO: 14285 - RNA, 21912 nt, Homo sapiens
agcaggcagcagaguggacgcacaguaacaugggcaacuugaagagcguggcccaggagccugggccacccugcggccuggggcuggggcugggccuugggcugugcggcaagcagggcccagccaccccggccccugagcccagccgggccccagcaucccuacucccaccagcgccagaacacagguaagggccaggcagcuaggagcaggugggcaacaaggguggugucaaggccugaagccuggggcugggaaggucuggaacuuguagcugagucgggagggccaggucacaaaugcaaaagggcuauuaaugugcauagaacaggacagucugggaggcucagaaaggagaccaggaucagagucggcaggugaaagcugggaguaagggugccagcuauagaaucuggccaggguuugaaugcugcucugccgccaggagcuguuugacuuugagcaaguuacuuaaucucucugaaccuccauuuauauaaaacgagauauggcaauacuuacuccauggggaaguaaguuucuagcucacagcaagccuucaacagcagcgaugauuauuuagcuggagaagaaaggagcugacagcagugguuacaggagugagaaaguggggucucccagaagagggagagaguugggcaggaaacucgggcccuugggguaagcaggcugagaagacagagccaccaggcuuuuuuccccugcuccagcccccucuccucguggcugucacccgaaaacuggaccaugcaguucccacaagaguccucccggggguagaggucccaggagggaggaaagacccggaggccugguggggugccaggccgggggcaggcuggggcugcaggcagcuaugcagggaaggcugagggccggggcccugcugcucaggcgcacccuuggccugagucccucccuuccucccugccgcugguggcucugggaggaagugauaaggccugcgaggcuucccuucacacauggggcugcugucaggagggguugugagugcggagggaaaucagagcugaggaaucccugcagggcuucccuccacucaagcaccaggcucugucccccucaggguagggcuuauagcagcuuugcgggggguggacaccccaucuccagaagaggugaggugggcgcugcaggugggaugcgaacuuagccucgggucaggggcucaggagcucagcaccagcagccccugcagcccaggacccuggucuauaaacggaggcacagcucgccucuagcuccuaaggcauggggaacgccagaaggcaugcggcaggugggcugugagaucgccagugcuguaacaggggccuccgggugacaucugggaaggcugaaaggaaacaaacccuuccugaugacccuaucccuggcucccaacagccccccgagcuccccgcuaacccagcccccagaggggcccaaguucccucgugugaagaacugggagguggggagcaucaccuaugacacccucagcgcccaggcgcagcagguaaggccggcaugcccuguccccaucgucuccagggaaaggguggguaaggccuggccucagauggggccggagagggaagcucaacccuucuuugaauuggucccuuguuuccaaaaagaggagaggacugggaagaaccagaggaguugagggacaugcacgggacuugggugacccucagccuccagccuuacccccaacccuggcucaaacucucccccaucccaccccugcaccccuuuccccccucccaccccugcacccuuccucccucuccccccguccccugccugcauuccuccucccucuccccaucucaccccugcaccccucuucccucucccaccccugcaccccuccucccucuccccgucccacccugcacucccgcccucuccagcgucccaccccuacaccccuccucccucugccccauuccaccccugcacccccuccucccucugccccgacccaccccugcaccccuccucccucucccccgucccaccccugcaucccuccucccucugccccgucccaccccuacaccccuccucccucucccccaucccaccccuaaaccccuccucccucuccccugucccaucccugcacccuuccucccucuccccgucccaucccugcacccuuccucccucuccccgucccaucccugcaccccuccucccucugcucccaucccaccccugcaccccuccucccucugccccuaccccaccucugcaccccuccuccuucuccccaucccaccccugcaccccuccucccucugccccuaccccaccccugcaccccuccuccuucuccccaucccaccucugcaccccuccucccucuccccucucccaccccuguacccuuccuccuucuccccgucccaccccugcacuucuccucccucucacccaucccaccccugcacccuucuucccucucccccaucccaccacugcaccccuccucccucucccccuguuccaccccugcaccccuccucccugcccccaacucccaucccaccccugcacccuggccuguccugaccuuugcacucccucgacccaggaugggcccugcaccccaagacgcugccugggcucccugguauuuccacggaaacuacagggccggcccucccccggccccccggccccugagcagcugcugagucaggcccgggacuucaucaaccaguacuacagcuccauuaagaggugacagcuucccggacgccacagccucccuugucccacugaggccccagaaaccccgugacgaccuucccaugacccccucccuucccagauccuaacaccacgugggccccucccgcccucccccagcacuugcacaaagccuggaggagggccucccugucccacacaacuuccugcuuguccccuucccaccccucuccuccccaggagcggcucccaggcccacgaacagcggcuucaagagguggaagccgagguggcagccacaggcaccuaccagcuuagggagagcgagcugguguucggggcuaagcaggccuggcgcaacgcuccccgcugcgugggccggauccagugggggaagcugcaggugcggcuggccagcgacugagagacccgggcgcuaccaaaaggggagcgggguggcggggcaguuccuaaggcuucccgggggcugggaggucccaaacugugggggagauccuugccuuuucccuuagagacuggaaagguagggggacugccccacccucagcacccaggggaaccucagcccaguagugaagaccugguuaucaggcccuaugguagugccuuggcuggaggaggggaaagaagucuagaccugcugcaggggugaggaagucuagaccugcugcaggggugaggaagucuagaccugcugcaggggugaggaagucuagaccugcugcgggggugaggaagucuagaccugcugcgggggugaggacagcugagcggagcuucccugggcggugcugucaguagcaggagcagccuccuggaaaagcccuggcugcugcuucucccccaagagagaaggcuucucccgccaggccaguccagugcagccccucacccacacccacugcuaccccaguuccccugcuucggcccgcacccucccucacaccccagcccacagacucggggcuggccuuaguuacuggaacgccugugaccacagcacuaagagaagcaagcugccccaugggggacuuggucccauggccuuggccuccuucaccaucacuggccgccaaagaguuugaaauaaagccacgugcccagugaaucccaaaggaaccucaacuaaaauaaaaacaauccuaucugacacuugccugacccucuaagucauucaaagcuuuagcucaacuucgauccaucugagcugccauaguggaccccacucagagcugcgucccucccuugaccccagguuggucccugccacuccccugccccugucacugacacauguuuccuccucccucaggcaggagugggaccucccagccuccuccuggggccuccacucagaaugucaggaugagcaggguccuaggaggccucuggugcagccuucccuucccaccauccaugugcucaaagagaaucacccguccuuucuugaaugccauggaucaugggggauuugcugcccacacuccuaggcggccucuuagacauccguuggugccuaacccaagcaucaguuuggcagaggccgagucccuccucuguacuggauaccaagucagcuuccauagggauggggagacaccuggcccagggaggagaugagaagcagcccggauggugcuacauaugucagagagcagggcaggaagggaucaguguggcugccaauggucaggagggcgccauggagugaaccauggccccugccuccucaccagcagcuccucuggagcugauacucaagaccccccgucucucuccucacccuccucucccgcugccucggcuggcucagguguucgaugcccgggacugcaggucugcacaggaaauguucaccuacaucugcaaccacaucaaguaugccaccaaccggggcaaccuucggugagugccccccaccaugccaggccccagccuucuuccccaaggcagggaaggcggggcucugaccagcucuuuccccaugcgugccagcucggccaucacaguguucccgcagcgcugcccuggccgaggagacuuccgaaucuggaacagccagcuggugcgcuacgcgggcuaccggcagcaggauggcucugugcggggggacccagccaacguggagaucaccgaggugggcaccgagggccacccaugaggguguccccaagguggagaaugaggaaaccagugggagaaggcucgggggauccaggcaggaagaggggagccucggugagauaaaggaugaaaaacaccaaaggaggggugccuggguggucacggagacccagccaaugagggacccuggagaugaaggcaggagacaguggauggaggggucccugaggagggcaugaggcucagccccagaacccccucuggcccacuccccacagcucugcauucagcacggcuggaccccaggaaacggucgcuucgacgugcugccccugcugcugcaggccccagaugaucccccagaacucuuccuucugccccccgagcugguccuugaggugccccuggagcaccccacgugagcaccaaagggauugacugggugggauggagggggccaucccugagccucucaagaagggccugcaagggggugcugaucccacaccccaacacccccaggcuggagugguuugcagcccugggccugcgcugguacgcccucccggcaguguccaacaugcugcuggaaauugggggccuggaguuccccgcagcccccuucaguggcugguacaugagcacugagaucggcacgaggaaccugugugacccucaccgcuacaacauccuggaggugaggugcgggauggggcucgggcaccgaaugcaccuguccaaggcaggagucuggcucucacuccauccccaaaaugccagccacggggacaaucagagcagguccaggguugccuccuaaaugggaacugaggacaagcucuagaaccacugaagcaaagggguaggggguggcaggggugugugugggggugugagugggugagugugagaguguggguuucuggggugugcagugggugagagugugggcuugugggguguguagugggugugagacuguggguuuguaggggugggugaguguggguguguggggguagguggguguggguuuguggguguguauaggcagugacugugagacuguggguuuguggggguaggugacuguggguuugugggguguguaggggugaguguguguggguuuguagggguaggcgaguguggguuugugggguguguaggggugagugugugugaguuuguagggguaggcgaguguggguuugugggguguguaggggugagugugugugaguuuguagggguaggugaguguggguuugugggguguguagggggugugugugggcuuguagggguaggcgaguguggguuugugggguguguaggggcgagugugagaguguagguaugugggugugaguguggauguguguaggcggugagugugaaauuguggguuugugggggugggugggugugaguguguggguuugugggugggugugggugugagugggugggugaggggggcauggggaugggugugaacauguaguuguucuuucaggcauaggacccauagcucuagagcuuucaucagauucucaaaggggaccuugacucggcaaagguuaagacccauuuuagagaugagaaauuaaagccuggagcugaggagcgacuggcccaaagucccucucugcucugaggugccuucgcaggcaaaaaccugaaccagcccccuaggcagccaggccucccaauggacaccacucaccucacuccuuccagccauguacgggaaacagagauagucuccccaccccacccccgugaucaccucugucccuaccgaugccacacacccuucugccccaggauguggcugucugcauggaccuggauacccggaccaccucgucccuguggaaagacaaggcagcaguggaaaucaacguggccgugcugcacaguuaccaggugcagaggcccagacuggccaggaaggcaaaggguuugcauacgggggcagcaggggcgggggauggaggagaggcagccauuuagaaacuagggcaggauuuggacaggcagaagaaguuccguagucccagugccauggcgcacacuggccugcgguucggggacagggcagguacuauuccaggcgcugucaucugguggcuuacugugugccagggaccuugcuguuuacugcaugcccagucaugcugauucucagggcauauuggguauugcaguuugugggacccgcuggauccuggaaacaaauaccaggaucaagggcacaccaggagucguaguuugaggaagccggggccugcugagaauuucugugggcuauuugguuuggggaccaggcaugcagaugcuggagauuagagcugcuuguugcauguugaaccugcagcaugaccaugcaugaugugguuuggggugagggugacauugugguuugaggggacacaggguguguuagauaugggguaaucgagggcacaugugguuuggggugaccggagugguggaggaagaaugggcgaggucugugggucugguuugagccucucccccucucucucccuuccagcuagccaaagucaccaucguggaccaccacgccgccacggccucuuucaugaagcaccuggagaaugagcagaaggccagggggggcugcccugcagacugggccuggaucgugccccccaucucgggcagccucacuccuguuuuccaucaggagauggucaacuauuuccuguccccggccuuccgcuaccaggugcccacccuaacuggcucugccagccugggcccagcucuaauucuaagcagccccuggggaccucuaaccuuuccuuuucuuuaccuccccucccaaccccaucaucucucugcagccagaccccuggaaggggagugccgccaagggcaccggcaucaccaggaagaagaccuuuaaagaaguggccaaguggguccccugggagccccgcucucccacacacacccugggggccccacucucccccacacacccugggggacccugccccagcaguguucugggccuaccacucaguaucccaaaacccuguugugaggggguuggacccuugccuggggaggcccugccucugugcacccaggacacccucacaccuuccucucccgcagcgccgugaagaucuccgccucgcucaugggcacggugauggcgaagcgagugaaggcgacaauccuguauggcuccgagaccggccgggcccagagcuacgcacagcagcuggggagacucuuccggaaggcuuuugauccccggguagggcugagcccaggggagcagggagcuagaaagagggggcucuaucagcaucuucaggggugcccuggaggacaggaaguguuacaagucaggacucaugaggaacccggaaccacagguguucagagaucaaguuggggccugaaucuugcacugccagggaggccagagugaggagggcagggccuccgggggccacagcacccaggacaucugucuucccacccacagguccuguguauggaugaguaugacguggugucccucgaacacgagacgcuggugcuggugguaaccagcacauuugggaauggggaucccccggagaauggagaggugagaacuuccaggaaaggggcugcugggaaugaggagagacucagaauuggagugacugggcaggaaccucugcccaacacacacacacacacacacacacacacacacacacacacacacacacacacacacacacacacacacacgccaggauggaaagggagaugcuaagagaccccuggagccugaaaccccacacaagcuacgcucccagcccacccauguggcugccucccugcaagcacauuugcuuaacugcgcguccccaagucauuuccauuaucagugcaaguuuuuaauacaaggaaggcacauccuggcugaccaagagguuagacugugcucgggcacugacaagaaaaacagggauacgucacugagggcggcuucuaggaugcggguaauguuucuuaaugggauacugguuacacagguguguucaguuuguaaaaauccacagagcuguacauuuacaacaugugcaacacuauuccagcauuuuauuuuauuuguuuuauuuauuuugagaaccuauuuacguugcccaggcuggccuugaacuccuagccucaagagauccuccugccgcaggcuccuuuuucaaaagaagaaauugagcgcuguuuagaugccaacauagauuaaauaacuucacuuuuuaaaaagaaacacaaagcuagaguaccaucauugaauuccuucucuugcaagcuuagguaucucugaggugccccaggcuaggcucauuucugagucuuaccugcuccagcuucuagguguuaaaggccuuauuagcacuaaguacuuccucaguacucuuuuuucuuuuuuccuuugagacagggucucacuuuguggcccaggcuggagugcaguaguacaaucacggcucacugcagccucaaccuccuagacucaagcaauccucccacuucaaccucccaaguaguugggacuacaggcgcaugccaugaugccuagcuaauuuuuguauuuuuuauagagaugggguuucgccauguugcccaggcuggucucuaacuccuggguucaagcaauccaccugccucggccucccaaagugcugcgauuauagacgugagccacugcaccuggcccucaguaucuuaagcaaguuggaaucucgugaaacccuuuuugcugccuuaguguccguuucagcccucauucugaccuaccuuuucaagaaaaauagcaccagcaauugacuuuuuuuuagcauaaagguguauagacacccauauaaccuacagccuucacaaggcauagcacauuuucaccacccuggaaaguucccucaucaguuccucacgugaaucccuucccagucugucucccugccagaagugucugucaccacagaauaguuucgccugcucuagaacggcaccuagauggaagcacgcaguguugcggcgucuccugcugaggcuguuuuugaggcgcacucguguugcugcgugacucaguauuucacucauucugcugcugagugccguucauugugugaauauccccaguuuguuuacccauucucuuguuggugacacuugggcuguuuccaggucggggcuauuaugaauaaaccuguuaugaacauucuuguacccggcuuuugugggcuuauguuuuuauuucucuuggguaaauaccuaggaguagaauugguaggucauaggguagaugcauguuuaaucuuucacuuuuuuaaaaaauaaaacugccaggccaggcgcgguggcucacgccugugaucccagcacuuugggaggcccagguggguggaucacuugaggucagaagcucaagaccagccuggccaacauggcaaaacccugucucuacuaaaaauacaaaaauuagcugggcaugguggcgcacgccuauaguccuagcuacucaggaggcuaggcgggagaauugcuugaaccugggagguggagguugcagugagccgagaucacgccacugcacuccagccugggugacagagcaagaauucuacuuaaaauaaaauacaaauaaauaaaauaaaacugucaaacagcaaagcaaauuaaacugcccuuuaacaucugugcaguucaauguauguuaauuuuaucccaaauuuuuaacaaaucuaggaauacagcucacagaaaaugggguauauucacuaaaaauaaggaauauuuauagcaaauuuguuuguaauaccccacacuggaaacaauucaaaugaccaucgacaaauacugauaaauugugguauauucaagugccauaucgcacuaagugugaacgaaacacaaccacacacaacagugcaggugaaucucaaaaaaugugaagagaagaaaaagccagaccaaagaauacauacuguacuacaggguucacuuuauauaaaguucagaaacaggcagaacuaauccacggaguuagaaauuaggagaggaguuagucacugggauggggguggcagugacaggaagaaggcacgaaguuggcuucuaggaugcggguaauguuuguuuguuuguuuguuuguuuguuuuuguuuuugagcuggagucucacucuguugcccaggcuggagugcaauggcgugaucucggcucacugcaaccuccgccuccccgguucaagcgauucuccugccucagccucccgaguagcugggauuacaggugcccgccaccauggccagcuaauuuuuguguuuuuaguagagacgcgguuucaccauguuggccaggcuggucuugaaucccugaccucagccucccaaagugcugggauuacaggcgugagccaccacgcccagccacggguaauguuucucgaugggaugcugguugcacagguguguucaguuugugaaaacuuacagaguuguacauuuacaacaugugugcaccucuggacuuguguugcacguugacaaaacauucaaaaaugaaauucaaaucguucuugcuaacucuggcgcacuugggaaccagcacccagaggcaucugcaguugagcaccagaugcaguuccuuccagcuuccuucccccugggagguccgcuugaugccacuucuucauggcagcacaaacaaggccauggucuucugaggagggcaaccugcacaaugucugcuagugaccaggacacugcugaaggaacugagaguuuguccacccaugaaauccacuaaaacaggaaagauuuugcucuagccguuguuagccaggagugaggaaagagcugugcccuccccugcagcugcgaggacgaucugccugccccaacaaguggggauucagcaacuccacuucuaaggauuacccagcugaagcauuuaaaagugggagcaaggcacacguacaagggcguuugagagagcaccuguucccagaccaccgagcugcccuucagucucagugaaguacaauguagccacuaaaaagacugaggucauguuuuggaaaguccaggccggaggaucgcuugagcccaggaguucaaggccagacugaacaacacagcgagacuccaucucuucagaaaauuuaaaaauuaaccaagagugguggcacgcaccuauagaucuagcuacuaggaaggcagaaaaaucccuuaagcccaggagucugagguuacagugaaugaugauggagccacugcaccccaaccugggcgacagagcaagacccauaucuaaaaacaauacuacuacuuacgucaauauuguuguauugaccuggagggaugucugcaauaaauuauugauuaaaaccaaggaaguacaguaugguaccacuuuuacuuaaaaaaaaacuauaaauaugcacaugcacguaaguucaaggaaaaagggcuggaagguuaacaccugucaauggcgcauaugcccggagggaagaugggguggucuuugucuuaucacuuuacacauuucuguaaugucauuuuucaaaaacaucagaucgcuuuugaaauuuucaaaacaaauaaaaauuaaguuacaaaucaauaauaaugaggaucagcugguacaguuuuaaacuucuauguaguuugaaaugaaacaaaacuaacccugaugcaaacacuccccucgccagagcuuugcagcugcccugauggagauguccggccccuacaacagcuccccucggccggaacagcacaagugaguugggugagaguuugggggagcugggggagcugaugcauuuggagacacaaacagaaagggggucugaaaagcucucccucugugccucaagucguuuucccaccaaaagccagggcuccaggaugcccuccauuccaggcugcaauggcaguccagaccugccugcuucugagagccgggacaguccugaggucuucagagauggggguguggugugucagggccccaggcucggaaccccagggaugcuggcccucagccccucccaagggcagggccuuuccugucccagaggcagagacccugaagccgucccuggggcuggggcugggccuagccuguauccccagggcccugugacaaccuugucuuuguccucucuugccaggaguuauaagauccgcuucaacagcaucuccugcucagacccacugguguccucuuggcggcggaagaggaaggaguccaguaacacagacagugcaggggcccugggcacccucaggucagggccucaccaagaggggugcaacgggugggcaagcugccugggcaaacguggccugcaaagggagcuccacugacgaccccugcaccccagguucuguguguucgggcucggcucccgggcauacccccacuucugcgccuuugcucgugccguggacacacggcuggaggaacugggcggggagcggcugcugcagcugggccagggcgacgagcugugcggccaggaggaggccuuccgaggcugggcccaggcugccuuccaggugagcccagcccagccccugcucugacuccugcccccugggaugccuccuccugccucacucugcccugauucuguuugguucuuuggucccuuccuguuccuuccaaaauccacccucaucucuccauggcauagccagcucuucugggucaggggcagaggaugacauggcccugccgaccacaggggugccuagcccaggcagaagugcagccgaaagagagcaggcagggcccuggcaggagggagcuucagccaggcacaggcugggccucacaagugggcgcacaaagggagggggugcagggcagggcaggggaccccacccaggaugggcaggauggagggagaaggaagggacagagagaaggucagacagaggcaagggcugaagcugaggccagcacagaagccacaggaagccagaggccagacagccuggggcggugccugcaccgcagaacuggucccgggccgggcaagcaagcacagggagagguggaucccugggggcuguggcuuuuuaagccugggcuuccucaggggcagugcugccugucuggggaucaugucugcaguugacaagggcucggucuccccagugccacacuguucagggcagugcugcugucccggggcccaggcuggagcucagcagauuugccuugauuggaggaggagggcauccuaggaggagagggagugggggcuaccucagggacggggaggucaggcugcagaaacacauaggcccugauugggaagaagggaacggaaaauaagacuuaaagaauuuaaacaaaaagagccauugcagcgggaugagaccacaucaucagguuuugggaauaggacuuuagaggcguaggauccauuacagcaucaccgaaccagaagcaggaaggcugagcuaagcagagcagcagcaguggagauaggaaggaagggagggaggggccgaggaaggaaggaagagauauaagacuucacacgcaccacaaaagaaagauuaacgggacuuggugauaugaggcucagccaaucacgggugagcccugcauuucaagccugggacuggcccagcaguuuuccagcugugugccugaccaggaguagacgggauccacacccucccagggaucugccccgugggguccccucugccgcccgaauugugcgucccuucccaggagcacuuacuaucugcacgcacuuuguggaaagcuaagggcuuuacauaaaguaucucauuuaaucuucaccagaacacaaugagguguaaagauggggaaacugaggcaugucacuguaaguacgggauucggaauuugaaugcaggucugaacacacagacgccuucacagagcuaccgugugccaagcacuaugcuucucggaucacgggauuaacacgcaccagauaaggaacgaugcaccaaucaggacgugcagagaaagagccagccgggucccugggcccagcggccaauccaugaaaugggcuggcggaaaaggugcuguccuuggcgccggccucagccacuggggcugccaaccccccaggagcaagacgcagugaagccgcccaggcgccucacuagggcgaccccugguggcgggagguccucagcccucaccggccugucccgcaggccgccugugagaccuucugugugggagaggaugccaaggccgccgcccgagacaucuucagccccaaacggagcuggaagcgccagagguaccggcugagcgcccaggccgagggccugcaguugcugccaggugggcccugcccucacccuaacccggcugguucucugaggcccccacaccccgggacuaaagcacucuggggccaggcccugcucccuagcucaggcugccucauuugccccuccccgcccccaggucugauccacgugcacaggcggaagauguuccaggcuacaauccgcucaguggaaaaccugcaaagcagcaaguccacgugaggacgacggcuuuaccgcccccccaccccuguccugaacacccugacccuggacccuccuccucccacauucucccgcccccaccccucucugacuccccauaagugccccucuccccacccccaggagggccaccauccuggugcgccuggacaccggaggccaggaggggcugcaguaccagccgggggaccacauaggugucugcccgcccaaccggcccggccuuguggaggcgcugcugagccgcguggaggacccgccggcgcccacugagcccguggcaguagagcagcuggagaagggcagcccuggugaggggcagccugggaagcaacagggcacaccagccccaugcccagccccacccccggccccaggccuccaggagcucaggacccgacccaggggguggccaccuccuccacagcucagcaggcaggcucagagcuggcugugcugcccacugccgggcuggccuuguugcuggaccauccccacacccucaaaugcacccccaccaaaaggcuguccccucccucugggcuccucuccgaggcuccccuagcaaucuagcuugcucuggagcuggcacuggggcuauuugcugccacaucaaugccugggcuuuauuuaaaauaaggggguggagucagaggcagaggagcccagaccaacccaguccggccaggggcccccgaacaauacacugaggcuaccuagacaggccgaccccgcugcucaagggcaggcucucuaacagucaccaaaacacaaacaucagcccagguacugcaguccugcugggcccuguccucagagcucccugugcacuauccccagguggcccuccccccggcugggugcgggacccccggcugcccccgugcacgcugcgccaggcucucaccuucuuccuggacaucaccuccccacccagcccucagcucuugcggcugcucagcaccuuggcagaagagcccagggaacagcaggagcuggaggcccucagccagguugggggccaccccaaugaggcacaggggcuagagagacgggaugagcuggggggaccccaguggcaggaaacccccaugcaaaguccccccuggacuuucuucuccuggccgacaugcacuggugcuuuaagacccagcuccucagggaggaauucauggcuggauucuccaggucuuagagaaaacucuauuggccugaacugagcagggagaaacccuaaagaggcucagugggggaggggucaagaagggagguuacuaggaagggcuauggggccuccaacccacugcauccugccccgccaggauccccgacgcuacgaggaguggaagugguuccgcugccccacgcugcuggaggugcuggagcaguucccgucgguggcgcugccugccccacugcuccucacccagcugccucugcuccagccccgguacuacucagucagcucggcacccagcacccacccaggagagauccaccucacuguagcugugcuggcauacaggacucagggugaggcaacaagcaggagcaggccuggccacagcaggguugggaccggccccucucuggccccucaccggccucuccuucccacccccagaugggcugggcccccugcacuauggagucugcuccacguggcuaagccagcucaagcccggagacccugugcccugcuucauccggggguaagugagauggaagacuugguggggagcugcccagggucaggguggcagcuuuggugaggagugucacuggugaggggugucacuggaaacaggaaggagcucuguaacaugucaaggguguggugucauuaggucacuucagaacucuggcuaagcuuuggcucucucauucauuuagacucagaguucugcccugaaacuauagcucccagagccagagcugggaucaaaccggcuggcccuguggcuuucugaaagcuucuguguuccucucuaugucccugggcugucugauguugggcagcauggcaccugggaacuacagucacuaaauccucacucaauccagggagaacuacuaguuaggguuaagaccacccuuggccuuggugucaccaaggacucaaagaaggugaagguuuugguuuuuuuuucccccagagauggagucuugcucugucgcccaggcuggagugcagugguacgaucucggcuuacugcaaccuccgccucccggguucaagagauucuccuauggcgugaaccugggagguggagcuugcagugagccaagauugugccacugcacuccagccugggcgacagagccagacucugucucaaaaaaaaaaaaaaaaauauucuccugucucagccuccugaguagcugggauuacaggcacccaccaccacgcccagcuaauuuuuguauuuuuaguagagacgguguuucacuauguuggccaggcuggucucgagcuccugaccucacgauccucccaccuccgccucccaaagucuugggauuacaggugugagccaccgcgcccggaccgagggugaaggauuuuaagagacccuuccuucaugcuguguccagaagucuugcccgcucucgcagccaggaaccaaaaguccugguaggacugagaacaguuccuaggcugccaucagcugggccuggugauucaaauccacccagguggcuaaacuacaaauaaaccguacccaucuacugaacauaaacuaaauaccacuauuaaggauacuuaaaauaaacacacuuagugaacccauuaugaacugaaagugucuuucacccuucccacguuuucuaaauccccugagucaucuaaguauucuucaauccaaaaugaacuauauuuccuuuggugcaaucuccagaaaccacagauccaaggaguuucagcaaguagaguuguuuuuuguuuuuuguuuuuuuuuuaauuuuuuuuugagaugggaagaacuuggguccuccuugcuccacccacccugcauggugagaaugguggagcaggaaaggcaaaggggaccugauggagugucucuccugccagggcucccuccuuccggcugccacccgaucccagcuugcccugcauccugguggguccaggcacuggcauugcccccuuccggggauucuggcaggagcggcugcaugacauugagagcaaaggugaggcuggggacuaaaggacugccugaagggagucacacaaucuagggacagagggguggggcuggaaggcaggaaauaggaaagagagggcaggaaacaaaguccacaaagcugaaaagacgcucaugagaccaaggggagggcagguaccaaaggcaagggcugggcccugagcuucuggcuuccuggugccugguacauaguagguguugacuggauugaggacaaaggaaaauagaauuuucaaagggauuagggcuaagacucaaagaagaacugcccaagguggauucuugacugugccagagcugaccgaggucuguccaagaccuaaggaugcuacaagguguucauauugagcauggggugcccaggguggucugucaaucaaaagaagagggcugugacugggaggagaguuauaaguaugggagaauaugaagugggagcggggaaggggacugcgaugucacacaaugcaaagggcauggaauucugaguccgaagccgcgcauucuagcgcagcuccaccaggggccaccaccucacccgcgcuucccuucccucuguaaaucagggcugugcagggucucugugaaagcauucuacacucucuuagagaugaaacagccaaaguaauggugguuucagcccaaaacgcugggcugccaggcugggcgacgguggccuguggggaggccccacuagcacugugccccggagaagagccuucccaagcgcgggguugcuugcagggcugcagcccacucccaugacuuugguguucggcugccgaugcucccaacuugaccaucucuaccgcgacgaggugcagaacgcccagcagcgcgggguguuuggccgaguccucaccgccuucucccgggaaccugacaaccccaaggugugagacccugagggcgcaaugguaaccugaagauagggagagaggggaggacucgcgcucuccagcggggcacaccaaccacggcccucccguggccucccacgaccacucagccaccccugcacacucuggcccacccuugugccccggccccucuaggcccgccuccucccgccccugccccgccccuuuggcucugccccuguugacaccgccccagggcacgcaggccccaccaggcccgcuccggagacuuucacguccagggccagccagcagccccgggcugcgcccccgcgcccacccccaccagggcccgcccuaaccccgccgccccgcagaccuacgugcaggacauccugaggacggagcuggcugcggaggugcaccgcgugcugugccucgagcggggccacauguuugucugcggcgauguuaccauggcaaccaacguccugcagaccgugcagcgcauccuggcgacggagggcgacauggagcuggacgaggccggcgacgucaucggcgugcugcgggugcggaggggcgggccgggccugagcgugcgggguuccugcuaaggucuccgagucggguucugauccacugugcucuuuuccgacaggaucagcaacgcuaccacgaagacauuuucgggcucacgcugcgcacccaggaggugacaagccgcauacgcacccagagcuuuuccuugcaggagcgucaguugcggggcgcagugcccugggcguucgacccucccggcucagacaccaacagccccugagagccgccuggcuuucccuuccaguuccgggagagcggcugcccgacucagguccgcccgaccaggaucagccccgcuccuccccucuugagguggugccuucucacaucuguccagaggcugcaaggauucagcauuauuccuccaggaaggagcaaaacgccucuuuucccucucuaggccuguugccucgggccuggguccgccuuaaucuggaaggccccucccagcagcgguaccccagggccuacugccacccgcuuccuguuucuuagucgaauguuagauuccucuugccucucucaggaguaucuuaccuguaaagucuaaucucuaaaucaaguauuuauuauugaagauuuaccauaagggacugugccagauguuaggagaacuacuaaagugccuaccccagcucauguggauuacaguuuuuuuuuuuuguuuuuuuuuuuuugaaacggagucucccucugccgcccgggcuggagugcaguggcgugaucucagcucacugcaaccuccaccccacaaguucaagugauucuccugccucagccucccaaguaguugggauuacaggugccugccaccgcgcccggcuagguuuuguauuuuuaguaaagacgggguuucaccaucuuggccaggcuggucuugaacuccugaccucgugauccaaccgccucagccucccaaagugcugggauuacaggugugagcuacugcacccggcguggauuacaauuauaaaaugacaagauuucuguuuuaaccugugcaguuguggguaugugguggggaaaggggucauucuuuugacagaguccuacacgccacuugacccugcacucugaaaacaugguuuccagccagucugggcugcucccccgugcaguucucaggcucgugaucgagaaggcaggugcagcacucagcugccaggaguggggccugccagaaacaagagucacagagaugugcaacagccaugagcaagcuuuacugcuuauuucauacaggauggggagccacacccacuuccugggacaucacacccguacugaaguccaaaaacaucaucccucccgucuuuccacugacaaguccccauccccuacaagccccaaggaaccugaaagugcugcuggcagccgccagcaugacgaauccacagccuuaaagcccaccugccucacugucgcccuuccauuuagcucggccucauccuugaccucugucccccaccuugaggaaacucgaggacuucuucccaggcagcugcuccaggacacauuccaguuggggaugucuccccuuauucccucugggugcagaccaucucuaagacuuguuuccagaugccaucagcaucuccucuccuugccuaccuuuucucuguucucggggcgaguuccucacugacucccagguccugcccaacuaaagcaccugggccugucaucuauggggccucuaacaaugacuccuuguguuuuucuacuccacccuccaau

SEQ ID NO: 14286 - RNA, 18864 nt, Homo sapiens
cgaguggugcaaacucuuuggcaggagccugaggcaagucauucugacccgggugaggaagguaucugcgaggcagacagaucugaggccgcgccuugauaaauuacaggcccuccauaccaauaguucucaauggcugaggcguagggcaagagugucagaaucaccgggggaguucuuccccaaguacacgugacuguggggaaaagaaagagagaucagauuguuccugugucuguguagaaagaaguagacauaggagacuccauuuuguucuguacuaagaaaaauucuucugccuugagaugcuguugaucuguaacccuacccccaacccugugcucccugaaacaugugcugugucaacucaggguuaaauggauuaagggcugugcacggugugcuuuguuaaacaaauucuugaaggcagcaugcuucuuaagagucaucaccacucccuaaucucaaaccacucccuaaucucaaguacccagacacaaaacacugaggaaggcugcagggaccucugccuaggaaagcuagguauuguccaagguuucuccccaugugaugaaauauggccucgugggaagggaaagaccugaccgucccccagcccgacacccauaaagggucuguacugaggaggauuaguaaaagaggaaggaaugccucuuugcaguugagauaaaagaaaggcuucugucuccugcucgucccugggcaauggaaaugucucgguguaaagccuaucucuacugagauaggggaaaaccgccuuagggcuggaggugggacaggcuggcagcaauacugcuucuuaaggcauugugauguuuauguguaugcacaucaaaagcacagcauuuuuuuuuuuaccuuguuuacgaugcagagacguuuguucacguguuuaccuucugaccuucucuccacuauuauccuauuauccugccauacccgauaaugaucaauaaauacuaagggaacucagaggcuggugccggcguggaucuuccguaaacugaacuccggucuccugggcccauuuuucuuucucuauacuuugucucucugucucuuucuuuuccaagucucuccuuccaccuaaugagaaacgcccacagguguggaggggcaacccaccccuucacgugacagaugucccagcaguucugacgcaccuaggagagcgggguggguggcagggcauauguacguguuuugaaaaaacucccagucgauuuuuguucauuccucccccaaaacccgcguucuacacgcccuugagacgacgggacaucuagagauccuggagccuugggaaaauggcccgaggucggcggcugacgcguuacuauggauacuccauagcuuggagggccagucgggccacacccuuuggacgucacccggagcccacaggagcaccuggcaaaagccaggcccacuuccugcucggcuccgcccagagcagggggcgggcggauaggcgauucccuccaaucacaguuccaaaaggagggggcugacaacauauccuccaaucacagcuugaagugagauugaugugucuuuucaccaaucaccgccaaggcgcgaggggguugucgggaugggggcgggagccaacauagagcccucagugggaugagggugaaacugcuauugccggcggcuccuguuuuaccgcgucagcaugcuggugcauuuauuucgggucgggauucgggguggcccauucccaggcaggcugcuaccgccccuccgcuuccagacauucucagcugucagguaaaaacggaaaaaccuacucagagcgggccauugaccgcccggcagggcagugccggcccgccgggagauggaguccacgagcuugcgcgaggcuugcugggagcuguaggccaggccuaccgggguggaaugucacuccgcggguguuggccucaauuauuuauagugacacuccagucgccagcaggaggcuccugcgucugcagccgcgugucagccagaaggaggggacgcucggggucagugaccacgcccaguccgcacucccgaccggggguccccuuuccuggcccuggaggugauugcgcgauuuggacgaaaauucuuauuaguaugaagagacauuuaauguaguggugcuuccaggauucaaagugagucgaagaagaacuagagauguucagcagggauaaagagccaaucuaauaggccgggcgcgguggcucgcuccuguaaucccagcacuuuggaaggccaggaguucgagaccagccuggccaacauggcaaaaccucgucucuacuaaaaaauacaaaaauuugccgugauugguggcacgcgccuguaauuccaacuacuuggaaggcuggggcaggagaaucgcuucaacccgggaggcggagguugcagugagcugagaucauggccacugcacuccagcccgggugauagagugagacucugccucagaaaaaaaaaaaaaagagucaaucuaguaacuuguacauguguguuuuucgcaaaacacucuacacagguuggucgagagagagagacagacagacagacagaugggaaacaaacaaggacccugaaacuacaacucgaauguaaaugcuuuaugagaagggacugauuccuuuuuuuuucuuuucuuuucuuuucuuuucuuuucuuuuuuuuuuuuuuuugagacagagucucgcucugucacccaggcuggagugcaguggcauggucucgacugacugcaaccucugccuccuggguucaagcaauucucaugcuucagccacccaaguagcugggauuacagaugugcaccacacccggcuaauguuuguauuuuuaguagagacgggguuucaucauauuggugggcagacuggucuucaacuccugaccucgggugaucugccugccucggccucccaaagugcugggauuacaggcaugagccaccucaccuggccauccuuucuaauccuagagugaauuacuugggggccaaacagauagaagauucccaagggcagguggauguggaguugugucauuuggaaagcccaucugacugauggagggcaagagcuggaucgagcuggagcuggaagucuugguacugggaaguaauccacaugcucuuggcaacgaccaagacuuucuuagagucuuaguuuggagacaaugcaagaagcuggaaaaagaccaugcuaaauuauugaaagguuuaaaaacaguucuuaggaaagaguaaggguguugauguuauuuaaaccagagagaaacccaaggaaagacauaaaauaauauucaaguauauauguguucauuagucaguauuuuucaauagauuaugaaaugcauuuaguuggucaggaccauuuaaaaguaaauauaggcugggcacgguggcucacgccuguaaucccagcacuuugggaggccaaggcaggcgaucaccugaggucagaaguuuaagaccagccuggccaacguggugaaaccccgucucugcuaaaaauacaaaaauuagccaggcgugguugcacgcaccuguagucccagcuacucgggaggcugaggcaggagaauugcucaaaccugggaggcagagguugcagugagccgagauugugccauugcgcuccagcaugacagagcaagacuccgucucaaauaaauaaauaaaaguaaauguaggccaggcacaguggcucacaccuguaaucccagcacuuuggggggccaaggcaggcagaucacuugaggucaggaguucaagaccagcccggccaacauggugaaaccccauacaaaacuuagccgggugcguuggcucacgccuguaaucccagcacuuugaggggccggggcaggcagaucacuugaggucaggaguucaagaccagccuagccaacauggugaagcccugucuguacuaaaaauacaaaaauuaaccaggcaugguggugggcgccuguagucccagcuacucgagaggcugaggcaggagaaucgcuugaaccugggagguggagguugcagucagccagcauagcaccacugcucuccagccggggcaaaagagugagacccugucuugaaaagaaaagaaaagaaucagaauacauguuaagaauuagagaaaauguuauuuugugaagcauuuccauuuuguguggcauguauguguucauuguacuggguugcaaguaagauauguuucuugcuguaggccacaguaagucuaaacauuugcaaaacccuguaguaguuaggucagauuguccugcaccucuaaugagggcaugcaugugcucaacaagcauaaacauuugcggaacaucuauuauguaccggaguucugccagugcugucuaagauauaauuuccugccuuucagaaacacauggcguaaugggaaaacuggacaguuacacaaggcagaaggagaguaagcgucucuaucuuucuaauagaaacaagaacacaguggaaaacaagacauaaaaaccuggcaguuggaauggggugggagaaggccucauguaggcaaaaggcacaggccuuccugaaagcaggggaaggaugagaugaagacugcaauuagaagggucuagggaugugaaaggccaugaugguaaagagaaaagcucacacuacucuuuuuuuaaaccuuuccccaucaguaagcuuaucuagaucuucuagaucucaccauccucuccuggcuggauaacuucugcucccuacaaccaguccugucugccuccagcccaugccccucugcuaugaucuuuuuuuuuuuuuucaagacagagucuugcucuguuguccaggcuggaguacgguagcacgaucuuggcucgcugugaccuccuccucccagguucaagugauucucugccucagccucccaaguagcugggaccacaggcacacaccaccacauccagcuaauuuuuaguagagacaagguuucaacauguugaucuagaacuccuggccucaaaugauccacccgccucagccucccaaaguguugggauuacaggcgugagccacugcgcccggccaugcuacgaucuuuaaaaugaaaaccuaaucuuggcacaucucggccuaaaaaucaccaugacccuuauugccccccaaguccaggagcuuuauaagaacuagaaaacugccccucccgcaagucucaugucucuuuucccuucuuguaggucaggcuucagccauacaauuccugaaauuucucucccauccuuucuuacuggagauaccugcacuugcuuuuccucugccuagagcucuccccuuuacacuccacccccaccugugccuggccuguucccccucacagguucccccuuaccuagaaggccuuuccugacucccucugaggagaaggaggagcagggcuucaagcuguuuugugccucugauuuccaguuaacugugagucucccgcacucaagcaugacugcugugaggggaguuacuucagcugucauguaacuccauaacuccgagcagagcaccugcacacaguagguucaaaauguguagaauaggccaggcacgguggcucauaccuggaaucccagcacuuugggaggcugaggcagguggaucaugaggucaggaguucaagaccagccuggccaauaaagcgaaaccccaucucuacuaaaaauacaaaaauuagcugggcgugguggcucgugccuguagucccagcugcucaggaggcugaggcaggagaaucucuugaacccgggaggcagagguugcagugagccgagauugugccgcuucacuccagccggggugacggagcgagacucugucucaaaaaaaaaaaaaacacaaugucuagaauaguggaaucgauguuagcauuuuauagauguggcagcugaaggaaagagaagguaauuguccuauucaagaugacaagauaaguuauuagaauucuuauuuuucucuguuuccuccuucagcuguggagagggagugugugucauggcgccccaggccagggaggggagguaggguaaugggccugggacaucagaagacauggcacacuggcagaguagagccagccugggugcuggagucagacugcagacuugguucccugcucgucccaguucugcugccugcggacaaguuauuucagcucucuuagcuccacaugauuuuuuucaucugucaggugagaauaauggcaccucccucccagggaggugaggaucaagggaaguagcccauuagcuccaggagguggggcugugucugcccugguggcugcugugagcaaguccagugccgggcacaggagcagcucucuuuccucaccucucugcaccguggucccuuaaacccccggccccuuccuguccaggcaguguguggccaucuaacgugccauccaguucuucaggcugucauucugucagagccuggagucgaggcugcgagggcccuggcuggcuggguguugccugagaguugcccaggggaauaagacuuuuaagacuagauuuugugcucagugccucauuccucugcgacuuugcccauggacaugucuuagaaacugaaguugcuucagaacagcccugagaagggcaggggcaagggccugacagaagaggaagugcuccuuccagagggcucagccagagccccaugggugugcuggucagcaggagggcagucggagccucaagccauccaugccucucucuccuuacagguacucugauggcuaccgcagcuccucccuccuccgggccguggcccaccugcggucccagcucugggcccaccucccucgagccccccuagcucccagauggagccccucugccuggugcuggguugggggagcccugcuaggccccaugguacugaguaagcauccccaccucugccuuguggcccugugugaggcagaagaggccccuccugccagcuccacaccccaugucguggggucucgcuuuaacuggaagcucuucuggcaguuucugcacccccaccugcugguccuggggguagccgucguggugaggcuuuccccacuucuccauccuggggacagggcaggacccagagcugcaaagggauggcauuccugccucgcugccucucaggggagagcucaggggagcagcaagggcuagccagggguccaggggugccaggagcaucaacacuggguggcugggugggcaggguuccguggggacuggaagccaggguuugaaccucugagaggcacugauguguccacaugaccagccacaaccuggacaagcgcagugcucaguagugggagaggaagggccaagaucuggcuggggauggggaggaguggcucccccacuuaaaacauuugugcccucugucuccccauuccagcuggccuugggugcggcacucgugaauguacagaucccccugcuccugggccagcugguagaggucguggccaaguacacaagggaccacguagggaguuucaugacugagucccagaaucucagcacccaccugcuuauccucuaugguguccagguacagccgggaguggggcuggggaccgccgaggagccacccgaggcaucccugagugcacugggcucuuucgcagggacugcugaccuucggguaccuggugcugcugucccacguuggcgagcgcauggcuguggacaugcggagggcccucuucagcucccugcuccgguacugccagccgcagggugcagaguuggggugacugauggccugaggggucuggggguaggaccuuauccugaaguaaugucucccucuucugcccuccuuauugguucuugucccaugccagacaagacaucaccuucuuugacgccaauaagacagggcagcuggugagccgcuugacaacugacgugcaggaguuuaagucauccuucaagcuugucaucucccaggucaguggcccaguggcccccaccacguccacacacacacuuucccauguggauucaccaggccagcccugcccgccccagcccugauguugggcugacaggcgcaugcugacucgagaaacccacugccugugagggcaugggugagggaccauggaaguucauggaaggaaaguguagaggcaguguccaaggucaggacaggcugcuucuccacugcucugaaaccgaaucuucccuggaaagccuucccaagcacucagacaagagccuuuccuggcaagagcaaaaucacuucgccugccuuguccccagagugccuggauugcugacaagcauugagcaugugcaguggccuaccgaacacagaugcccuccccuuauccgcccacaccgacucugacugcuggaucaugccacacacuggccuaggcagucacugguguacccccaugcaguucucuuuguucaguuccuagaacagaaagagaagcaagcugggauuugucuaggggaaggaugccacaguucauagcauucucgcucggcccccucaggccugcugcucgcaccccaacuggccgaguuaggguuacguacugugaccgguggacugccacugggccucccaggggccaagaccugggccuuggccgugggagugcagagcuacagucagcugacccuuggaaaaguccuuccugucauggugcggacgccguagccucccgccuucccucccacucccuaggggcugcgaagcugcacccagguggcaggcugccuggugucccuguccaugcugucgacacgccucacgcugcugcugaugguggccacaccagcccugaugggagugggcacccugaugggcucaggccuccgaaaauugucucgccagugucaggagcagguaccggcauuccuggccauccucuucacccuccccacaccguuucucuuuccacuccccggaacuccucccuguccccauccuggacuccuuguccuguuuucuggacuccuuguccuguuuccuggacuccuugcagaucgccagggcaaugggcguagcagacgaggcccugggcaaugugcggacugugcgugccuucgccauggagcaacgggaagaggagugaguccugggagggcggagcacaaagcagagaugccccccacacccugccaacccuucgugccagcccagcugccuccugaaugcacuggucucucucaccaggcgcuauggggcagagcuggaagccugccgcugccgggcagaggagcugggccgcggcaucgccuuguuccaagggcuuuccaacaucgccuucaacugugagugagccauuugggggcuggaggggcgcuugugggcuggggaggagcugggagcagccaaggcaggcaaaggcccucccuucaucugcuggcugccugcauucgccucgggccagcugcuaacucuugcagguaaagggagggugccgaugucccaacccagcuaugggacuccauguggaacgcuacagggccacccucaaggaggccauggaggcgugcccaccccaacuugcucuuccgaggaggaagccaacgcugggaccagucaugcgccucaccugacucucccagucagcaguggcagagcaggcccagggcuguuuccucugcccuggcuucguccucccucacuuccccucuccugcaggcauggucuuggguacccuauuuauugggggcucccuuguggccggacagcagcugacagggggagaccucauguccuuccugguggccucccagacagugcaaagguaagugggggccguucccauugcuacagagcccccugccgcccuccagagcccugcuggguuaggggacacgggugccagccuucucugggggccgacugcugugcagcuccaggccugcccagcuuccccagggaugcauaggguggggagagagagccccucagggcccauaacaacccuccuggcuggggcaguggcgcugcagcaggcaggugcuugucaucuucagccuuccaaaggacccagaaguuuccuugacaggcuuuuuaaaaauuuguuucaacugugguaaaguacacaaaacauaaaauacagcauuuuaaccauuuugaagugugcagcucaugggcagugggugcacucacauugcugugcggcuguugucaccguccgccuccagaacucuuaccuggcagagcggaaacuauccccaugacaugggaauccccauuugcccucccccagccccuggcacccaccauuccacuuucuguccuuaugauuugacaacucuagggacguccucuaaguggagucagacuauguccuuuugugacugcguuuugucacuccacauuguguccucagcuuccuccguguugcacccuguccgaauucccuuccgcugcaggcugugacauuccaugcauggaaggaccauccuugacaggcugugugagcugcccuuccccaugccugccacuuccagggaugacaagcugaccccuguccccacacaccccacccuuauagcuuauugcuuugcguugguccaaaaccacccgcucagcugagccucugggaugaccagagcugaucaccagacagcucaaggcgggccuccccccuccuaucucuuuccaagcuaaacacaagcaguucuacauaaauauguuaugguaaauaaugagauaguaaauaugcuguaacagaucaucaaagggugaagacccgucuccacgaaccgugcaucaccucugccaccccaucccuccccccacgaccccccugcucuuccaccggggcccccaccccauucuacugaggcauguguccucgcccugcugcauggugcaccccugcguguguguccgccggaucagaaccccucacugcaggguguacugucccaggaagcgggaggcggacggagacaggcucccauuuucagccccaaaccugacauuccacagagacguuccucccauuuccgcagcugcauggacacccucgcgugccccguuucugcucgugcucccuaaucugagcaccuucagacccuuucuggucccgggcucaggccuccuuggcagccucgcccuccuccagcccaaggagcuguucugucguggcuuuggaauucagaugcucucacugugauagagauggggucuuggggggcugggagcuguucugucguggcuuuggaguucagaugcucucacugugauagagauggggucuuggggggcugccuccaccacugccugcccugcucagcgcugacccacuucccuugaccagaguuuuggccucucugaaugggacggucguuuuaguccugagggcccauaagaagcccaguggcggcugggugcgguggcgcacaccuguaaucccagcacuuugggaggccgagguggguggaucgugaaguuaagagaucgagaccauccuggccaacauggugaaaccccgucucuacuaaaaauacaaaaauuagcugggcauggugguagucccagcuacucgggaggcugaggcaagagaaucgcuugaaccugguaggcagagguugcagugaccugagauugcgccacugcaccccagccuggcaacagcaagacuccgucucaaaaaaaaaaaaagaagcccaguggcucccuuaauaaaaucaccccuuagcccucuguggugggcaguggugggacagucucccuguggggaggguggcugcacuguccagccccaacccucccgcuucgggacccccacuuccccuuuagggccugagacucugacuuuaccucccaccguacugcuuggccauccagcagcuuuaugacacacacaagaacccccaggggcuugucugugcuguuucgcuggcugcucccacagccacaggcccuagacccauccucuuggagguccuucuagcgcugccuauguggagauucuuccccacucaucuuggggguuuggauuuguugcauaaagcagcugauguguuucccacaggguccugccagcuaagccaagggcccaugcauuggcacuggggucuagcagagagaggggagcaggauggcccggccuaccucaggcagccuaaccuaugagcccauccugaguacuccugauggagauggggaggugcccagacagacagcaaguggggcccagccgccucaucagaaucagggccaggcuccaccugggaacaggcccguagccuacagcccacggccccugagagcagggucaucacacuccaaugagucaugugcauuuugaauuucaguugcugcccagccccuuugccaggcccuaaugucuuccagaucucugguggagaaugugccccugcucaucaacagauagcuggcugggcuggcuccuuccugccuggugccucccccggcugccuuuagcaagugcugacugcacugaguccacugggaccuuuuccuuuuggguuucgaggcuccucccacucacccccacccuagugcuggaagaagugagucugcagcugaaggguugcuggggagucagucuuuccucuuacuuaggaggggaccaggcauacacacacugucacaggucagccaggccagucagggaccagugacucaccuuccuccucagccuccuggcagccggccagcccuaccccggcccugccgggacgaaggaggccacccacugucuagacagauaacacuguggguauacuuaucugcagggcaagcucaugagaaaaauuuuuuucagggaauuuuguuuuggggucuccugagaguuccccuguggcccagugucuucuguuuucuucuuucuccaaaaagauuuaacaucacuucuuccaccuaaaugucugccaaagucauugcuuccccaagagucugcagcauuagaucugcucuccccuucuaagccacgcacccuugaucucuguucaugguggcggccuccgcauccucagggccgagcagggaguccgugggucagcugggcucccuuccucgugggcugauaucaccgcugcaugugugcacaggccucacccugcagaccacaggccagggcacuggaggacacccacagaggccugugccuucacuuccauuuccucguggagcacccccucccaggggcuugggcugagcugagggacagcugucauccucaucuggccaaggagggagccagggcucagcgaucugguguugcuacgucccagggcucuacgcccccauggugcaggagcagucucugcauuuggccacaggccaccugcuuccuugcucccccgccccaccguggcuuccuuccccuccucuggcucuucuuguucccaucuauuccaccccucucuccuuuuucugacagguccauggccaaccucucuguccuguuugggcaggugaguggccgguaggguggagggccugggguguggaguuugugccgugugugccgcugugggagcugccuauugacugggugugggcgggcagaggagcuggggagaccccagcccagagccauggccacucccuggagaugcuguugucaccccuacuccugccucccugcggacuuuggauccccucccacaggugguccgggggcugagugcaggugcccgggucuuugaguacauggcccugaaccccugcaucccacugucugggggcugcugcguccccaaagagcagcugcguggcuccguuacauuucagaacgucugcuucaggucagcacgggugagcaggcguggggaugggucccugggccggggaugaggcgaguggauucggggguggaggucuggacuaaugucccccauaaacaggcccucucagagggcuacagggagacuucaggagggacccgggcaacaagggcugggagccuggucugacugggggucucucggcuccucccagcuaccccugccgccccggcuucgaggugcugaaagacuucacccugacgcugcccccuggcaagaucguggcccucgugggccagucuggcggagguaaggggagcccaccaccucuucacccucugacucuucucuagcagccacucagagcaaggccgggagcagugagcccccgguggggucccuuccuccacugccacaaggggccuucuuuccugggacaaucccuagaaucccuggccucccucccucucaacccaauuccccaggaaagaccaccguggcuucccugcuggagcgcuucuacgaccccacggcaggcguggugaugcuggaugggcgggaccugcgcacccuugaccccuccuggcuccggggccagguugucggcuucaucagccaggugcggggccacaugggcagcccuuggcucccacugcccguccuccccugggcccugcccccuuaguccucaggugccuuuucuuucuuucccacccucauccuugcugcucucgggagacccuggccgucuucacauguccucagcuguugucugggugaggcaucccugucgugggagcagccacagcucugccuggucucccagagcagggacgcuuuguccgcauuuacagcagucuacacagauggggaaucccucagauucucugcaaaucccauagcauccaggucuagagaagccuauaguggaggugcugagcugcagccguucucccucugcuugagguggcacugcccagcgaggguccacccuucccuuugagggccgugaaugaagagggcaugccugcuguccgccagggagagugccugugcagaagaaaggcaaaugcaagcccccaacucccagcgcccugcccugccagcuccucccacucccacuccuggggagggauucugggcccuugguaggaagucgaacuguccuucccuuuugggggccacucugcauccucacuucaccucugacuuugaacgucugauucuucaagagauccuaaucuaauccaccagauagacugucccauuguguaugguggccccuccaguuucuggggcaaagagaauguuucuauggacucugucuccauaaccccucacccacaggagcccguccuguuugggacgaccaucauggaaaacauccgcuuugggaagcuggaagcuuccgaugaagagguguacacagccgcccgggaagcgaaugcucacgaguucaucaccagcuuccccgagggcuacaacacggucgucggugggugcucgggucugccgggaaccagguggugaggcacugggacacaggauuccacaggagcagugagcagcccagugggacugagggcagcagggacagcuggggagaaagacaguugugucagggaagacgagaaccacagccaaaggggacagagucguuguguggggacaggggaguccaggccagugugguucagaaccagcagaccaggcaggcugcagagacaggacgggcucuaggaggagcuggagaaugcgacagagggcauaugacaggcuccuggccagggacacagugaugcaugguguuuggaguccucaccgagucuaaaaggccgccacuuccccagacugaacagaagaaauggggggcugccuccucuccaccauccaucccccucuggcuccuguuuccuuccugugcuuuucaucucuaaagucguuucucauuagaaucggggugacuggaugggccccaggagagggcucuggugguucugaacuaggaacacgcagccuggcacugcagggcgugcaccuugcagcuugacgugcggagcucccaggucuuuuuccagccuucggggccauguuucucggccagugucuuggcucuguugcacaguguuucagcacuucucaggauacagggauaccugggcuucucaacucuggucagucugaguccagccuucugagcuguggggccaguguccccagcccagccaucguguucuagauggcuccuccagccguguugauacacuguccagaugccagcuguccucacugggugcucucccacaucucuuuuggguggcacuuuccuugugucucugauccuaguacuuucugcucauuugggccuucuuggggcugcguccuuacugaccugucacccugcugucaccuugagguucuuuuuggcucccaggcugccacuugugcuguccucugugggcuucgaaucccaccucccuggagucacuggaccccagagcccauguuugggugcuggauguuccccacagccacagagacccgggaggcugggaagguggcuuggaacugcaggcacagggcagggugugggucauccuggccugaggcacugccauggcuggggaggggcauuuggcaacucccuuggagugcaccaagcccugcuggcggugucacaccacccucagaggcagggcaagugugcacaguggcugagggacccagaggugggaugagccagugcagggggaacccagaggaggaguguacacagugugggguggggggucagaggcaggaggagggugcacagugcggggugggggucagagacaggacuagggugcacagugcgggguggagggucagagacaggacuagggugcacagugugggguggagggucagagacaggacuagggugcacagugcgggguggagggucagagacaggacuagggugcacagugugggguggagggucagaggcaggacuagggugcacagugcaagguggagggucagaggcaggacgagcguacacagugcgggguagagggucagaggcaggacgagggugcacagugcgggguggggggucagaggcaggaggagggugcacagugcggggugggggucagaggcaggaggagggugcacggugugggguggggggucagaggcaggaggaggaugcacagugcggggugggggucagaggcaggaggagggugcacagugcugagaggggcacuuagaggaucuugaugggcguucaggaaggacccugugccccuuugugggccacccucaagugcacagcuucaggcuccugcccugccccucccuucccaggugaacggggcacuacccugucugggggccagaagcagcgccuggccaucgcccgagcccuuaucaagcagcccacggugcugauacuggaugaagcuaccagcgcgcuggaugcagaguccgagcggguuguacaggaggcccuggaccgggccagugcaggccgcacggugcugguaauugcccaccggcucagcacuguccguggggcccacugcauugucgucauggccgauggccgugucugggagguuaguuguccugggggcguggaucaguggguugaggauggcuucaucacggacaguggcacaaugcugcaaugaguuauaugaaguuguggccuggccccagggccuugggggcuauauucuggaagcagcgucccauauagagucaggaguuccugcauucagccaagcccuggccucucaggcccucaguuucuucuucuguccccugggauaguauaauugcaccaucagcucccaggaucaaaaggaaaaguacuagccgggugccuguaaucccagcacuuugggaagccaaggcagaaggaucucuugaggcuagccugggcagcauagcgggacccugucucuacaaaauaccaaaaaaaaaaaauuagccggaugugguggcaugcaccuguacucccagcuacucuggaggcggaggcgggaggauuacuugagccccagagguugaggcugcagugaacaaugauugugccauugcgcuccagccuggcaucagaaugagacccugucucaaaaaacaaaaaggaaacauacucagaguauggugcugggagcaaggagcagggcuagcugcccaggguaucaggugcaggagaagcagcgccaaggaaccugugcagggagucaggaguaggaccccagaggccguguggcguuggcuaacagccacucauucaagccaaggcugaggggcucgugcagggagacggauccugaguuggagccuugggcucuguaagggggacagagggaaucauguucuuccaaaauucagcuaaguaaggaaguggcaguaacuaaugcagcaugccaguggcgguuccuuucagauugggcauugguuucagaguguccccagaagggacaccggccuaagugaccaugggcccaauggcugauagagaggcucagcucucugaggguucugaagccugcaugccuuggagcaaccauccgcccuucccucccaucuuccaggcugggacacaugaagagcuccugaagaaaggcgggcuauacgccgagcucauccggaggcaggcccuggaugccccgaggacagcggccccaccgcccaaaaagccagaaggccccaggagccaccagcacaaguccugagaagggcccccugagguguggucgcugccaagcaucaguguuagggcuggggcucagccugggggagccuacuggggacugagcccccaggagggccagcauguggagagucgcugcggcugcuccugcucacaauaaagccggggccgagcagcuggcaggggaggccaaucccucccuccccuccccaguccugccggcugccucccucccaccagagucugccagagucauugggcugcaaugggcagagacagaguuccacgagacaccuccacucuauucucccuuugcccagaccccuccagaccucucaagagacguucuggcc

SEQ ID NO: 14287 - RNA, 4209 nt, Homo sapiens
cagcaccgccggcucagcaccgcuccgcagccccugccugccacggucagcuacgucccaccuggucugcugcggaguccccagcccagugccuagcccaguggagccaccgccuguuccucgggaaggaacagugggaccugaccggccagaucaccuccuccaauccugccaggcuagugccucccugccuuccaaccuuggcugucucccacccucucuucuccucuccuugccuggccuccugaauccuaucuuagccuccuuagcccccugacugacucucucucgcuucuuccaagccucuguagcugguuccgcuccuggguucuggccaugaagcccaccucaggcccagaggaggcccggcggccagccucggacauccgcguguucgccagcaacugcucgaugcacgggcugggccacgucuucgggccaggcagccugagccugcgccgggggaugugggcagcggccgugguccugucaguggccaccuuccucuaccagguggcugagagggugcgcuacuacagggaguuccaccaccagacugcccuggaugagcgagaaagccaccggcucaucuucccggcugucacccugugcaacaucaacccacugcgccgcucgcgccuaacgcccaacgaccugcacugggcugggucugcgcugcugggccuggaucccgcagagcacgccgccuuccugcgcgcccugggccggcccccugcaccgcccggcuucaugcccagucccaccuuugacauggcgcaacucuaugcccgugcugggcacucccuggaugacaugcugcuggacugucgcuuccguggccaaccuugugggccugagaacuucaccacggugagcugaccucccuaccuauccugccagggacccagagagccgaccagucccugcccagcacccacaauucccuagccagcacaggcucccccaaagccaggggaccucuuccuuccuaccagccauggacuccccaccccccagugccacuccgugcagcccaggaagcuguccuccuuggggcuuucucugucucccagcccgaggggagcaugugaggccacacugaccccggcuggcccuaggccugaggucuggcccagggaggcccugcuccuggggcuggggguccuccauggugggaccauucuggggcagaagaccccuaucucugccaggagguggggggggcuugcuuucccucugccuuuucaacauacugccagccccggaggacagccacaggggcccauuuccuuuuccugcaguucccagagaaacacagaaaaaccuguaggcugugcccugggcuuugguggggauuggcgggguggaggagcugaguugaugggcucccaagagcguccugcaacaugugcccacuggagcguggggcugggggcauugagaugcgggcuucaguauucaaagaagagacgcaaacauaccaugagguggggagaggucccaugaccaugugccugccugggggagauggccaucacccugucugcccgccccagaucuucacccggaugggaaagugcuacacauuuaacucuggcgcugauggggcagagcugcucaccacuacuagggguggcaugggcaaugggcuggacaucaugcuggacgugcagcaggaggaauaucuaccuguguggagggacaaugguagggagcacacaaaugaggcugggggagggcacggauggagugcaaaaggcuaggggaaggagaggaggagaggaggugucaggguguucccccagaaccugugaaaggggcugggcuggcucaucccaguccuggggagaggggcugcagugagaggucuugucugguugggcaggagaccugaccacacaggucaggccucacaggucccuccccgacagaggagaccccguuugagguggggauccgagugcagauccacagccaggaggagccgcccaucaucgaucagcugggcuuggggguguccccgggcuaccagaccuuuguuucuugccagcagcagcagguacccuuccgugugccuccacaccuacuacuucaagcccacaccaccucagacccuaaacccucagcuccucagaccugucuaggggccucuccccagcuggccucucacgcucuccgggaagccuccuuaacccuguccccccacagcugagcuuccugccaccgcccuggggcgauugcaguucagcaucucugaaccccaacuaugagccagagcccucugauccccuaggcucccccagccccagccccagcccucccuauacccuuauggggugucgccuggccugcgaaacccgcuacguggcucggaagugcggcugccgaaugguguacaugccaggugaggggcugggguuuucgucccauggcgggcagggcccagggagcugaggcugcuucuaaagccaucuccccgguacccgcaggcgacgugccagugugcagcccccagcaguacaagaacugugcccacccggccauagguaagggcgagccucccccaccucccguccgccccgcuccgcccgcgggcgucugacgcggcccgguggcccgcagaugccaugcuucgcaaggacucgugcgccugccccaacccgugcgccagcacgcgcuacgccaaggagcucuccauggugcggaucccgagccgcgccgccgcgcgcuuccuggcccggaagcucaaccgcagcgaggccuacaucgcgugagcugcgcggggcgggcgggcuccuccgagccgggggcucccgacggggcggaacggggcaggccaggccguagcccuagugcgcacagcccgggcggaggcagccuccgcagccucacuggcucuggggcuccgugcugguugcuuaaucuuucuggccccgggggaugcugacgccuccucccaggggucuguuuuuuuuuccuuuccuuuuauuuuuuaaucuuuacuuuuaaaaaacagagacggcggggggcgggggaggggaggggaggggacucgcuguauugcccaggcuggucucaaacuccuggccucaagauccucccuccucauccucccaaagugcagggaguacaggugugagccaccgugcccggccucucccaggguucuugaaaggagugggagaacccacagcugcuucuugccagcagugggcaccaggcgguggccagcccacauuugaggccauucuuguccucagggagaacgugcuggcccuggacaucuucuuugaggcccucaacuaugagaccguggagcagaagaaggccuaugagaugucagagcugcuuggugugugugcagggcccccagggcugggggggugugggcaggcagguggcuguaaguugaagggugacccugucuccacaggugacauugggggccagauggggcuguucaucggggccagccugcucaccauccucgagauccuagacuaccucugugaggugggccagggcccccacugcagggggugggaggugggaaucagggccccuaggaugagggggaaggugugcacuggccaccucccauccugcuugccuccagguguuccgagacaagguccugggauauuucuggaaccgacagcacucccaaaggcacuccagcaccaaucugguaacagccccucuucuggagcccuugccugcuccaagggugcuagggcccaccccugaagccuagaccaccaucccgccccagcugaggagaaacaggcaggagggugugcagugaccucgacuggucccugggaggaggaccacuccccaccucugacccucucguccucacacagcuucaggaagggcugggcagccaucgaacccaaguuccccaccucagccugggccccagguaacacauaauggcccccuaaaaucaagggagggcaggggcaggcucaggacagugggugugcccguucccaccccagcacucugcucuguuccgaagaccucccaccccucccugugccgucaccaagacucucuccgccucccaccgcaccugcuaccuugucacacagcucuagaccugcugucuguguccucggagccccgcccugacauccuggacaugccuagccugcacguagcuuuuccgucuucaccccaaauaaaguccuaaugcaucagccu

SEQ ID NO: 14288 - RNA, 2166 nt, Homo sapiens
ccuuauuuauuuguguaaauguguauauauggagcuaucugucucuguacgucugucugcaccccugagagggauugggaaaguuguuuccucaauccucagccagaguucgucuguccuacugcuuugggguaggccccaucuugccucucuuuacaaagaaaugaaaugcaaccgucacuggccucuguagaaauucuucagcacuccccuaucucccccaccccacguuaacuaccucuacccccaugcuuuuccacuagggcugcucaccgcuugcucuuguuucuauaccucgggcuccuaacgugccaucucuuccugcuucccauuaaacaggcaagcuucuccagcucuguuuucuccuccuuggaugagcuggaaaacuuugggagagauucacuucacuuccuguugcauuuaggugggguauguccaagccaucuaacuuagggggaggucacuaaugacuggggcacucauaucacccgugagcucaugaauaaauuguuuucuaugcagaagacacggcagcuuagucugucucugccacccuuugauauuccagaugcaagggccuagagggaaggacccacuuccaguuuucuguucuuacagcauuaacuaucaucucuucuucuccucuuugcaccauuuuugaagcuugggauaccccuaccucuucuguuacagaauaagauugguugaggggggccauggcuaaguggaugggacaggaaugaauuugugugauagacauagcagaggcuuggggauuggaacagcauuaguggacaaagugaacacagggagcagugcucacagauccaucugcagacagcaggcaaagggcacagaaaccaguggaaguugguaucaugguaacugggcuuccugggaagaaauaugaccuguguugauuugggaggggagauacaguagagagcagagccaucgagaagaaaaaugggcugugaaugaggcaaagaaauucaggaaaugaagguauuaaugucaggaaggggagggaaguacagcucaaauaccuggccuccuuacuuuccuuagagggaaagcuucuggcuauuccugauuccuggaauggaagacuuaucaacgucucaucacccugacaugugcuggacacuucuuauggcgagaccaagacagcucuccuuggcagcucauuucucccagcugguuugggcaaccaaacaaagcaaucuggagccgugacuggucauuaacaaugguaccacaguucuccagcuaggacacacagagcuagggcagaucuucucuauuuuuuggcuaauuucagcagggcuugagaauuaggcuaaaaauauguaguccagaccagccccauucccagccuggucuagaucaaggcuaagucuccuuagauucagccuucacagggaaccuaugggguuagaaccuuuuuuuuuuuuuuuuuuuuuuuuugagauggagucucgcucuguugcccagucuggagugcaguggugugaucucggcucacugcaagcuccaccuccugggcucacgccauucuucugccucagccucccgaguagcugggacuacaggcgccugccaccacgcccggcuaauuuuuuguguguguuuuuaguagagaugggguuucaccguguuagccaggauggucuugaucuccugacuucgugauccacccgccucggccucccaaagugcugggauuacaggcaugagccaccucacccagccgcgguuagaucuuucuuuuuaggagauaagccaggcagagguugaggaucacaggagccauugucauucuggcacggcuggagcagaguuucuguggccauguguccccugugguggcaggcaagagaacaccugggcaggaaggccacagaugagaagcagcucaaaccaaggccccaaccugcagggguuuuucuggcucuaccuaugaagccuccuaaccuguucaaagcaguauucaaccagccgaagcagcuuguuuuccacagggaaucuggaggugacuauugcuaguauuuggagcccaggaaccuauuccuacacauacccauggcccugucucuauuuugcccuaucuacauguaagguuugugucagccuugcaaaaggggcugugggcugagaaaauaaagc

SEQ ID NO: 14289 - RNA, 14955 nt, Homo sapiens
ucaacagugaugauaacuauggcuguggacagguaaaaauacaaaauuuccuguaucccaauaggaagagagguucacagacguuggugugaaaaugcaaacuccuggccaucucugcaccucucucauucuaccaaaugcgauuaaucaauaggucugaugcucagcaaucugaauuuuuuuauuuuuuugagacagugucucggucugucaucaggcuggaguguagcggcacgcucugcucacugcagccucaaccuccugggcucaagugagccuccucuuaucagagcagcugggaccgcaggcacaugcuacuaugcccgguucauuuuauuacuauuuguagagaaggggucucccuacuuugcccaggcuggucuugaacuucuaggcucaauugauccuccuacaguggccucccaaggugaugagcuuacagucggauuacaggugugagccacugugccuggccagucugcauuuuuuugagacaggguuuugcucugucauccaggcuggaaugcaguggugcaaucucagcucacugcaaccuccaccuccugggcucaagcgauccauccacccuagccaccugagcaggugggauuccaggcacauaaagacggguuuugccauguuucccaagcuggucuugaacuccugagcucaagugauccaccugccucagccucccaaagcgcugggauuacaggugugagccaccgcaccuggccugcauuuuuaacaagcagcccaacugcugugcaguuggggcagaaccucagaucacaaucagaaaaccacgcuccuggacagugguucucaaaauagucucuagaccagcaacaacagcaucaccuggaaacuugcuagaaauguuaacguucuuggucucccccaaaaccuauugaaccagaaacgcugaggcgagaucuggcaaucugauugcaugagcccuccaggugauucugauucauguuaaagucugugaaucacaggccugagaaaagguacaauuucaaaucagaaguaaagggacaaaguucuuccagcuccuauggacuagucuucaguucccaucgacacacugacgcuggauccagcuccugcugugggcagugcauguuggcacugcagggaggagaaggccccagagacccgagaaggaagguagggaccguggcuuccucuuucuuuauugggcgcuuuguagaugucacgcaggucuaaaaguuacacugcuaaauaauuauuuaaaaacugaccaggacgaagguccugguccggagcuccaaaccagaagcaaaaaggaaucggggcggugggcugggggguacuccuccaacaucaccaaaacccagaaaacgaggauccuaagcuccuccgcaggccaaauccagggcuugggccccugggcuaacccgcaggugccucugacugcaucacacucagaguaagauaaccagcaaggggcuggagggaacggccagccgaguccagacauggacagauguaacuggaaggaggacaggaaacagacagguacuguccagcuguagguaagagagugcagcuaaggcagguugaggggcaggggagaggcugggggagcaguauugcagcaaugcaggaguguagccccaggguccuguccugagcggcuggucagguuagcagcuguuaguucccagauggagcuccugacccgaacccagguagagggcucacacguuguggguccucuuggugagcuggggcuccucauccaccagcuuggacuugaggugcuccuuguaagccaggaugucuccaggccacuuggugauugucugcuucucacagacccaaauuuccugugcaaccuagaaagcaaaaccuggacuuaauccugggcuagucacugucccugccucugcccagcagacuguccugaggggcgucuaggaagaaaacuccgccccccaaacccauauccaacucacugucucacuacuucuaaguuauuugggauguucuaacccaaggguaccaucaucagguuuggagccuuccaagccaggaacugcugugucacuccuauugucagcucccuggcagggccuagaucuauucagaggcuucacucucagccuucuuuucuccaccucucaucuuccccagagcuucagaggaaugagcaacaacuuuuucucaaaugacugugguagcugucuaaucaaaauccuccuuagaauacuauuuuuggacugaagaaucuugggacaguaguaaaagcaccguuuucuacccaacucucuuucccauuugggcccaaaaugcuaaguugguugacaucuccagauagcuacugaagaaaugaaguguuucaguuaaggcuuucuaaguagccccaaagaggcauaagaacugguccucaccaccugugucuacacucugagccccuucucuuaauucaguaggcggguauuaugcacccuccacaugccaugacuacccuacccaacccccuagaagcucugcugugccucacccccuggccagggccucaccugcugaaugagucugaagucauggcugaccagcaucauaccacccucaaacucauugauggcaucugccagggcgucgauggucucgauauccaggugauugguggguucauccaggaagagcauguggggguucugccaggccagccaggccagacacacucggcacuucugcccgucugacaaguuccggauugggcucaccugaguagaaccgugaccuacauauaacuuggcauuauccccgccaaacagcacagcucaucucucccucauuucucccugacuccuccauuagcaucgccauuuauaaaaagugaggcucagagagacccacuagucucuugaggccugaaagagacucauccggaaaccugaagcccuugccauuacuaagcccacaccucucgcucucuuggcaaugaauuggauccuuccagaucugaauccagaaauuuguuuucuagauuacaaguuccuuugcccucaagcacuauggcacaagggcaugucagagacuggcacgcuauccuugcccccucaaaaugcuccauuacauaacaaccuagaguaaagaaaagguaguagguucuuaggggagucaaauggaggagacucugguuuggacagcuuccaaacccaggcugccaggacaguauccccugacccacccagccacagucugccagcuaucuggcauccucaccacacccuccuuuacugaccuguuguuucccagugagaccguaucgcccaaugaucuuccucauuucuuccuucuccuugaucucuggguagcacuucaucauguacuccaaaggugagagaucuaaguccagcugcucuuguaaaugcuacaggaaaaauggaagccacccgggugugacuggcaucccgcuucaaaauaaacccuacuagguaacuuccuauuucuaucccaggcaccuguucuggguucaagaagcagguaggagccaccuaggcuggaauuccugccagggggugggggcggcuggcuggaacucagccagauacagccccucccuauacccugggcaauuccccggaucccaaccccaggccuguaccugaugguaacgcccuaucuugacaugagaguguuuucggaucaugccaucuguggguaguagcuaggaagaaaaaaguagaaacguaagcaugaaacaaaggaagcccaguuagaaacauaggcagagcaggcaaacaaacacauguucacacugaacaagacucaacuuccuaaaaagaauacaucaccaacucgcacacugcuauucuggccacucuaaaaauauuuaggaagauguacugaagcagauguucucaagaggcaaagauacaauuuaaguaguuauaaaaugucuacugaaugcacuaugcuguauaacaaaggacuuggauguaggugcaacauacauuuucuaaaauuaaaaacaguuaaguccucaaaguugucacugucaucgauagguucuuagaaacagaaccuauuuuaaaguuucacuuuaagugaaacaacauauagcaaaacuaauuuugccacaggcuaacugauauaaacaagaauuagguuccugcagcauuuuuggucacaaaaaaagaucaccaaacuucuaaauaaagauccaaagauucuuuucuuuaagagggagucucgcucuguugcccaggcuggagugcaguggcgagaucucgacuaacugcaacuucucugucccaggcucaagagauucuggaguagcugggauuacagacacccgccaccacaccuggcuaauuuuuuuuuugcauuuuuaguagagaggggguuucaccauguggccaggcuggucucacacuccugaucucaagugaucugccugccucggccucccaaagcacugggauuacaggugugagccacggcaccuggccaaaaaacccagucacuucuaauauucaacaucaaaauacaugugagcuauacauacacuuaagaaagauuaauaaaaacaagguaagauauuuacccaauuuuuggugaaucagugagugauggcaauuuuaagagugguggguuaaaccaaggaauaaauguuugcaaagggaaaacuguaaggagcaccuccuaccaccacacaguuaaaaaauaaucacgaauguggcugguuugcugacugcauuuguaugguuaucauaaacuuuaugaauuuuucuuuuacaauauuuuauauucauucauucuaucauuuuccaaccugcuuauucaaguuuaggaucaugggcagcuggagcccaucccacaacccagggaacaagacaagaaccagcccugaagaggacaccauuccauuauaggaugcacucacacacccgcacucauucagacuggaaccacugagacguuccaaguaaccugacaggugcagcuuuggaauugggaagaaacugaaguaccagagaaaacccauguagacguuaaagggaaagugcaaacuccacaaagacaguggccccagcugggaaucauuucuauuuuucaucaauauuaaugaaaugacauuacuugagaaccugcagcaucccuaaaugcacagauguuccuauauucuaaaugcucugauugaaaauagaaacaugggccagacgcgguggcucacgccuguaaucccagcacuuugggaggccgaggugggcagaucaugaggucaggaguucaagaccagccuaaugaacauggugaaaccccaucucuacuaaaauacaaaaaaauuagcuguggcgugugccuguaaucccagcuacuugggaggcugaggcaggagaauugcuugaacucgggggaugaagguugcggugagcugagaucgcacauugcacuccagccugggcaacagagcgagacuccaccucaaaaaaaaaaaaagaaaauagaaacgugcuuaaacacauacauguauucacacacacacucuaagacuccucccuaccuaucccugucccaggaaaacagcccccagccucagcacuguccaaccagacauucccccucuccuggcugcugcuccaccccuccagauggcucacucaccaccaggguacucaggcccucccaaaguaguagccccugcaucacuccccucuuccuuaaccaucgcaaggccuaaucuuagagggauccacgcccaccuuggcaccauaccucuccaguuagcagcuucagaagaguugacuucccugcuccauugggcccuaccagagccacucgugugucaaggucaauuccaaauucuagauuauuguagaugcaaggcugagguggggaugagagagauguggacacaaggcuagaauacagaucugcuaugaccagcagaccaagcccgcugaauucccagucaccaagagaggaggaagggagaguagcgggaggaagcacucauagcagaccccgccucgcccacugccuccgcccaccaacccagcugaguagucuucuuuccauauacacgaagaaaggcccgcgagcagccuuggaugaggcaccccagcugccacaccugaaaaucccccagagcacgugggcuagcagguguggucagcacagaacaggagcaacucccaugagcugccacucacccuaagauacaccccagccacccaugcccugcccugaacuuaccccaucuuuuguauacuugaagcucacauuuugcaccauaaugacagguggagggaucuugccacauggugggaaauaaaaugacagugucuaggaagaaaagagggcauuuaucaaguuggcuccuuucuuauccaccucaccuuaggccacccaaccccacccaaucacaccccacccaaucacaccccaccuuaucgcucacgacccucucugucaguccugaugccaucauuuucuguagcgucuucuccuugcucugggccugccgggccagcuuggcacugccaugaccaaaccucgcaauguaguucuaaaaaagaccaaagagagcuuggaguaugugcaggcgcucaacaauucaucuucaauccaggguaaaaauguugaucguaacuucuucccgacauccuccaucacuaccgcuucucgaaaugcccucauccgagcccccugcuucuuucagacaggaggccaugagccugacucugcagucucccuaccuucaugugugcaaucugaucuugcucccagugaaaccucuucaucugguucuccuccagcucuagccgcgucuucacguacugaucauaauuacccugcauggaaaugugccagguaaggcaggcagcuuuaaccuggguuucaauccuggauucucacucagaguuuagggggaugagggauggcacuaacuuggcccuggcucuaaggcugugcaguaagaagagaggacgugcauuacagaagcauauccuaacaucaaaucggagucuuuucaauucuaugccccucgcucagcccagccagggccaggcuccagcgcaaauccuuagguuagcuagaaagacaccuguggcacugggaauaguccugaaaaucacggucauacggacgucacgaggcucagagccuuccaauaccaccuccuauuccuuccccguucccuagaggcugaagccccacaaaagacugcaagagcugucuccagaggggaaaacagaccauucagauuuagaagcugacaaacccugcauaaguggacuaccaugguuucuaucugcaaacaaaaacuggacucaagcuaaauauccaccagaaagggccuaacaaguuacaggauaaacacauaacgaaauacuaugcagugacugaaaagauugugauugauuuauauauacucacauggaaagcaguccaaaauauacuaaauuuaaaaaagcaaccuacagaaugauuauuaaaauuguaacuguggccaggugcaguggcucacaccuguaauuccagcacuuugggaggcugagguggguggaucacuugaggccaggaguuugacagcagccuagccaacauggcgaaaccccgucucuacuaaaaauauaaaaauuagcuggguaugguggcaugugccuguggucucagcuacuugggagggugaggugggaggaucgcuugaaccugggaggcagaaguugcagugagccaauaucacgccacuggacuccagccugggugacagagacagaccccaucucgagaaaaaagaggccgggugcgguggcucacgccuguaaucccagcacuuugggaggccgaggcaggcggaucaugaggucaagagagggagaccauccuggccaauauggugaaccccaucucuacuaaaaauacaaaaauuagcugggugugguggcaugcgccuguagucccagcuacucaggaagccgaggcaggagagucccuugaaccugggagguggagguugcagugagcccagaucgcgccacugcacuccagccuggcgacggagcaagacuccagcucaaaaaaaaaaaaaaaaaaaagcugcaauuguauaaaaagaaaaagauuacguauacaugacauuuucuacaaaugugugcaaguauacaugaaguuucuggaaggcuauauuauaaacuaauacuccuaugacuaugaaugaagaggacaucaaucguuaguuucuuacaugcuuuuugaaauauaaaaugaaaaggcaaggcacaacagugggcuauugagauccugacccccauucuccuguggucaugggaggugggguaaauguguagacuccagugaagcagaauuaagaaggcauucaagaaggcagagggaggccucgugugguggcucaugccuguuaucccagcacuuugggaggcugaggagggcagaucaccugaagucaagaguucaagaccagccuggccaacauggcaaaaucccgucucuacuaaaaauacaaaaacuagccagacauggcagugcaugccuguagucccagcuacucagaaggcugagguacaagaaucgcuugaauucaggaaguagagguugcagugagcugagaucaugccagccugggugacggaaugagauucuguuuccagaaaaaaagaggcaaggcagaugagagcagggccugccuggucaccgugaaaagucaacuucuuugccacaaggcaaacauacaccuugugugcacaggcugccaauccauggccuauggccugaaagcaaugacuuugggauuaaaauaaaacaggugguaggacuccuuguccauaucuuuuuauagcaauagguagaaaggagcuaauagauaggucugcuuuuuuuuuuuuuuugagauggagucuugcucugucacccaggcuggagugcaguggugugaucucagcucacugcaaccuccgccuccaggguucaagugauucuccugccucagcuucccaaguagcugggacuacaggcaccugccaccacgccuggcuaauuuuuuuguauuuuuaguagagacaggguuucaccauauuggccaggcuggucucaaacuccugaccucaagugacccacccaccucggccucccaaagugcugggauuacaggcaugagccaccacaccagccuuuuuuuuuuuuuuuaaagagaauuucagagaauugguaugcacagagauuaccagaagaagccgaggcccacucaccguauaauacuucaguuucuuguugugcaugugaaugauauugguacagacaccauucagaaaauccugggaaugggagacgaggaccaagaugcgcuuaaaacuguaaagccaaagaaccaauuagugaagagcucaaccaugggagcuagcugacaacaggugaacugaaagucaggcccauccucaucccuaagcaccuuuuagauguguuguccaauuccuggcuguuagcaagcaccuaagccacgacucgacaaucuaacuguaaggguauuuggacgccuuucaguguggcgagacagccugaguuuccucaaucuucuguucuaauuuucaacagaaugggauggagacgguaguaacagugauaguaaccagaaguguguauguacacaaauacacccacgaauguauccaaaacugugggugggaagaacugguacagacacaauaaaaaacaaaaugcuuuacuuuuugaaagaagguacuaagucaucguaccacuaaaagccuucuuuuaaaauugguacaauauuccagcuuauucaguucuuuagcuguaggaccaugaccauauuggcuauauuuuccuuugucacugcaucaugaucuuagauggaagaccucuuuuuagcuuuauacaauuaagaaaaaaaauauaucuuuaauuaagaucuugaauuugaaauauggacaaaaccaacaaggauuuuuuuuaaaaaaaaaagcucauaaauuucaaacuaaagaaaaacaaucaaaauaaaaggccagccuucaacagcccuaaaggugcucacugcuuguccaagaaagugaacucuguccuuccuucaguuccuuucucaccgcucuaacaucagugcaguuucugggcauccauuuucuagauucccccuuugggaccugcccgcucacaucccccauuccacccucuuacguuuuuaguucuucuuccaaccacacgcaagcaucuagguccaggugguugguaggcucauccaggagcagcaugaagggccgaauaaagagggcucugaaggacgguaaaggagacagaagcaccucagaauuauaauggaugugacacaggacgggacaaacuugccugcuacaugcaauucugaguaggcuccuggcuugagucuugaaaucaauuuuaggcucuauaccucagagggaaaaggagaagcaggacagaaacaagagucgaagagaagagauugaagaguagaauacggggcucagaagcauauaaggacaguucgaggcaaggcuguagaagucuuuaugaguuuaugagccuugugcacugaaguuggagacuacggagaagacaaaaaaauacagaggaaauaaacugcuaaaacaaauuagaccuaucugaaggucugaagauagaccuaucuugugggguggccagagucuagcgagggauagacucuaaagcucugguucccaaaccagaaaucuguguuuuuaaaagcuccuugggugaaccggaggcagcuaauccuugcuagcauguggaaccacugugcuuauacucuaaggcacaugcaggcaacuuucuagagaaguauaucaagucuuauaaauucccuucacagagaaugauggggcaaggaauuaccuguuuagugacucuggggggauuauugggggaaugcuggucuauggaaacucacuuugaguccaggccacaagagaauaagaacgacagcuaucauaauagccgucuaacauuuuaucuuuacagcuggaauuagcaggacuagaguacaaaaaggguggaaagggaauccuggugggaggacagaaacagaccuacuccaccguuuuaccuaggacuaccccuaggaucucuaaacucugugcugggugcuaagaauccaauagaaaacugagucacucuaccacuucagccaggaagcucucucucuagcccauacacaacaacccccuccacacugcagauguccaugucucauuugacacuuaccacugacuccuguuccaaacaguuccacuggagugaacacuaaacacuggagagaugggggaguuauggggguagggaaggagggagggacucaccuggcaagggcaacccucauccuccagcccccacugaagucuuuuagcuucuugcgcugcauggcaggugugaaacccaguccaugcaagauccgcgaggcccucaucucugccuugucggcauccagcuccuccaggcgcucguagagcuccaugagcuucucacacuccgcuguggacaguguauggccaugaggcuccugggggccuuucugggaggacgcccaccccuaugcccaggucuggagcccuaccauccucaugagccagccgcucugccucuuucuccagcauggcccgcucugugucgacuuccaucacacaaugcaagggugucuugucacuagggggcaucucucgagucagaugguagaugucgaugugcucagggaugggcacuucacgcuucccaauagcagagagcagcauggacuuuccugagaggggagagcagcagacgcuugguacagugaacuccccuaucccucuucaccacuaguucuuccaccccagucaaacugggaccucauccauuuuuuuuuuuuugaggaccuuucuucccuucauucguucaaaucuugccagcccccauucuugggauuccuuucuaacuuuccuccaauucuugccccaccccuuaucugaagcuuuuuucacuuaccacagcuucacacgccccugaccaacuucuccagcaccugcuguaacuaaucaugugguacaggguggacgcacccuaaucugaaaauccaaaaugcuccaaaauccaaaaccuuuuaagugcucacaugaugcuuaaaggaaaugcucacuggagaauuucagguuuuuggauuagggaugcucagccgguaaguauaaugcaaauauuccaagauccgaaacacuucugguuccaagcauuucagauaagggauacucaaccuguacauaacacauacugcucugcguugcuaguuccuuuccccuggacauaaucuggucucccaucccuauucuaaaugcuuugcucugaacacaguugaugcuaaauaaaugcuugugagugacagaugagcuaaggagagauaccucccaccuccccuuccaaggccucaccaauuccauuuaaaccaaugaggccauaacgacggccugaguuuaauuccaguuuggugucacugagcagcucuugaccaugaaagguaagugagagguugaugaugugaacaucaguacuguuggggugagaggccaggacgccagugacagcucgagcagcagcuuucuucaucucaaaguccucuagcuccuuggucagcaaaucuacuucugcggauagaaaagcaguuugggaagauggcgugagacagacucggcucuccacaaaggucaacguccugaaggaccaggcuccaauccugcugagcacucagauguuucccaaacuuuacagagugcacaaugacacagagcugccccgacacccugcuuuccuuuguuuuguccucccauaucuguuuacuuacucccaucacucuuaacuucuguccuccacuacuguggccaggaauaaaacuuccccacagccugacuuuauugcucuuucuaauugcuuucuaagucccccuuuucugaacgccuaucuguuacaacuugcagacuaauucuccuuuccucuucaaacauuuacuuagugucuaccugagaagcaagucauaaaaaaaacccaagacaggguccuugcacucaaagaugaaacaauuuagacaaagaaacaggagauacaacauaaaaagguaaguaacacuaaaagacagcaaaaggguauagagaauggaaauacuguggucagguuugacugagagacgcuucauuaucuugagcugggccuugacagaaaugucaaauguagcuagcaaaaacaugaugguauuauaauucagugugugaaaggacagagauguggugacuauccaagagauaauaaauagucuggauggagcagaaggcuguuuagggaguuuucagggggcagggaagagggcugggauuggacugccaagggccuggaauagucuuuaccgcauauggccauguuucccagucuagacgguaaguuuuuggagggaagacgguagugccucaguguauagcaccaugucuagcacuugagaaauaauaaauauuucccaaaauauaaauaacagaaagggagcucucucccaggaaaaaccccauaaaucaacucauaaguuacucucuuguagguagagccacuacaccagugagaggacaagcuuauuguauaauguagcaaagaaccuggcacauuggucaccaugcauagaaauggaaacugagaaaggggcagggaacugauccccuccucacaaucuaauagagcagcaaggcagcucagcaacucucacauccgcuugccacugaguaugugagaaccucgucuucggcuuccuugcgcaaugacaggguggcacgaauuccaacucuacugauuugauucaucaugaaaaguugcaugacaccagauacauucuccacuacccccagcaucaagauuccaacucuggcuggggcaugcauuaagucuuagcaaccauccccaacucaccccucccucaauucaccuguggucucucugccauuggccucauucuucucugccaccugugguucugugacaacaucuccauuuucuucauguccuuuucugggccgcugucgagcuuuggcagccuccuucuuuuuggcugccuucuucuuggccaggucggagggcaugaugaugacccacagggguagguuacuguuguuucagggagccugaaggaaggcaaacagauacccccaaacccuaaacuuacuaguaagaaugccugggcccugcuccaucccucucaggaaucuucguaucaacaucaagccucugaugcccuggccugcccccgccucgucuguuccaacuuggucaggguaucccaaaccaaugccgauucucagcggcucuucuaaucuuaacaucucuucccacaggcaccagucccccacggacugccucacuuuggaaacgcuccuucuuucagggccuccggcuggggaccagguucugccccucagcggaggucuccgucuccgguuucccuacaacuuggcgcuccgcacucagcuagccgccucacuuuccgggcuuccuccucccguccgucucgggccucuucucgaucgucccucuccacaucacccggccgucgagcccagccucuugccgggacgcacucguccucgcccgcgugaguccccuccgagucuccacgcucgucacccccggguccucccccaccccgcccgucagcuucucucccuuagcccuaucuucccccucgcagagcccuccauccaaaccccgucccugcuuccucuucuaauucucuuucccccucaccggcggggacccucucccuacagcuccccuuccccuaacucacugggccucgcugcucggccuaugucgcaacagagcugcuccuuaggauccuccgcgugcggccggcucaccagccaaucacggccucgggugguucucggcgcgccgcgcugccuccuu

SEQ ID NO: 14290 - RNA, 14955 nt, Homo sapiens
aaggaggcagcgcggcgcgccgagaaccacccgaggccgugauuggcuggugagccggccgcacgcggaggauccuaaggagcagcucuguugcgacauaggccgagcagcgaggcccagugaguuaggggaaggggagcuguagggagaggguccccgccggugagggggaaagagaauuagaagaggaagcagggacgggguuuggauggagggcucugcgagggggaagauagggcuaagggagagaagcugacgggcggggugggggaggacccgggggugacgagcguggagacucggaggggacucacgcgggcgaggacgagugcgucccggcaagaggcugggcucgacggccgggugauguggagagggacgaucgagaagaggcccgagacggacgggaggaggaagcccggaaagugaggcggcuagcugagugcggagcgccaaguuguagggaaaccggagacggagaccuccgcugaggggcagaaccugguccccagccggaggcccugaaagaaggagcguuuccaaagugaggcaguccgugggggacuggugccugugggaagagauguuaagauuagaagagccgcugagaaucggcauugguuugggauacccugaccaaguuggaacagacgaggcgggggcaggccagggcaucagaggcuugauguugauacgaagauuccugagagggauggagcagggcccaggcauucuuacuaguaaguuuaggguuuggggguaucuguuugccuuccuucaggcucccugaaacaacaguaaccuaccccugugggucaucaucaugcccuccgaccuggccaagaagaaggcagccaaaaagaaggaggcugccaaagcucgacagcggcccagaaaaggacaugaagaaaauggagauguugucacagaaccacagguggcagagaagaaugaggccaauggcagagagaccacaggugaauugagggaggggugaguuggggaugguugcuaagacuuaaugcaugccccagccagaguuggaaucuugaugcuggggguaguggagaauguaucuggugucaugcaacuuuucaugaugaaucaaaucaguagaguuggaauucgugccacccugucauugcgcaaggaagccgaagacgagguucucacauacucaguggcaagcggaugugagaguugcugagcugccuugcugcucuauuagauugugaggaggggaucaguucccugccccuuucucaguuuccauuucuaugcauggugaccaaugugccagguucuuugcuacauuauacaauaagcuuguccucucacugguguaguggcucuaccuacaagagaguaacuuaugaguugauuuaugggguuuuuccugggagagagcucccuuucuguuauuuauauuuugggaaauauuuauuauuucucaagugcuagacauggugcuauacacugaggcacuaccgucuucccuccaaaaacuuaccgucuagacugggaaacauggccauaugcgguaaagacuauuccaggcccuuggcaguccaaucccagcccucuucccugcccccugaaaacucccuaaacagccuucugcuccauccagacuauuuauuaucucuuggauagucaccacaucucuguccuuucacacacugaauuauaauaccaucauguuuuugcuagcuacauuugacauuucugucaaggcccagcucaagauaaugaagcgucucucagucaaaccugaccacaguauuuccauucucuauacccuuuugcugucuuuuaguguuacuuaccuuuuuauguuguaucuccuguuucuuugucuaaauuguuucaucuuugagugcaaggacccugucuuggguuuuuuuuaugacuugcuucucagguagacacuaaguaaauguuugaagaggaaaggagaauuagucugcaaguuguaacagauaggcguucagaaaagggggacuuagaaagcaauuagaaagagcaauaaagucaggcuguggggaaguuuuauuccuggccacaguaguggaggacagaaguuaagagugaugggaguaaguaaacagauaugggaggacaaaacaaaggaaagcagggugucggggcagcucugugucauugugcacucuguaaaguuugggaaacaucugagugcucagcaggauuggagccugguccuucaggacguugaccuuuguggagagccgagucugucucacgccaucuucccaaacugcuuuucuauccgcagaaguagauuugcugaccaaggagcuagaggacuuugagaugaagaaagcugcugcucgagcugucacuggcguccuggccucucaccccaacaguacugauguucacaucaucaaccucucacuuaccuuucauggucaagagcugcucagugacaccaaacuggaauuaaacucaggccgucguuauggccucauugguuuaaauggaauuggugaggccuuggaaggggaggugggagguaucucuccuuagcucaucugucacucacaagcauuuauuuagcaucaacuguguucagagcaaagcauuuagaauagggaugggagaccagauuauguccaggggaaaggaacuagcaacgcagagcaguauguguuauguacagguugaguaucccuuaucugaaaugcuuggaaccagaaguguuucggaucuuggaauauuugcauuauacuuaccggcugagcaucccuaauccaaaaaccugaaauucuccagugagcauuuccuuuaagcaucaugugagcacuuaaaagguuuuggauuuuggagcauuuuggauuuucagauuagggugcguccacccuguaccacaugauuaguuacagcaggugcuggagaaguuggucaggggcgugugaagcugugguaagugaaaaaagcuucagauaagggguggggcaagaauuggaggaaaguuagaaaggaaucccaagaaugggggcuggcaagauuugaacgaaugaagggaagaaagguccucaaaaaaaaaaaaauggaugaggucccaguuugacugggguggaagaacuaguggugaagagggauaggggaguucacuguaccaagcgucugcugcucuccccucucaggaaaguccaugcugcucucugcuauugggaagcgugaagugcccaucccugagcacaucgacaucuaccaucugacucgagagaugcccccuagugacaagacacccuugcauugugugauggaagucgacacagagcgggccaugcuggagaaagaggcagagcggcuggcucaugaggaugguagggcuccagaccugggcauaggggugggcguccucccagaaaggcccccaggagccucauggccauacacuguccacagcggagugugagaagcucauggagcucuacgagcgccuggaggagcuggaugccgacaaggcagagaugagggccucgcggaucuugcauggacuggguuucacaccugccaugcagcgcaagaagcuaaaagacuucagugggggcuggaggaugaggguugcccuugccaggugagucccucccuccuucccuacccccauaacucccccaucucuccaguguuuaguguucacuccaguggaacuguuuggaacaggagucagugguaagugucaaaugagacauggacaucugcaguguggaggggguuguuguguaugggcuagagagagagcuuccuggcugaagugguagagugacucaguuuucuauuggauucuuagcacccagcacagaguuuagagauccuagggguaguccuagguaaaacgguggaguaggucuguuucuguccucccaccaggauucccuuuccacccuuuuuguacucuaguccugcuaauuccagcuguaaagauaaaauguuagacggcuauuaugauagcugucguucuuauucucuuguggccuggacucaaagugaguuuccauagaccagcauucccccaauaauccccccagagucacuaaacagguaauuccuugccccaucauucucugugaagggaauuuauaagacuugauauacuucucuagaaaguugccugcaugugccuuagaguauaagcacagugguuccacaugcuagcaaggauuagcugccuccgguucacccaaggagcuuuuaaaaacacagauuucugguuugggaaccagagcuuuagagucuaucccucgcuagacucuggccaccccacaagauaggucuaucuucagaccuucagauaggucuaauuuguuuuagcaguuuauuuccucuguauuuuuuugucuucuccguagucuccaacuucagugcacaaggcucauaaacucauaaagacuucuacagccuugccucgaacuguccuuauaugcuucugagccccguauucuacucuucaaucucuucucuucgacucuuguuucuguccugcuucuccuuuucccucugagguauagagccuaaaauugauuucaagacucaagccaggagccuacucagaauugcauguagcaggcaaguuugucccguccugugucacauccauuauaauucugaggugcuucugucuccuuuaccguccuucagagcccucuuuauucggcccuucaugcugcuccuggaugagccuaccaaccaccuggaccuagaugcuugcgugugguuggaagaagaacuaaaaacguaagaggguggaaugggggaugugagcgggcaggucccaaagggggaaucuagaaaauggaugcccagaaacugcacugauguuagagcggugagaaaggaacugaaggaaggacagaguucacuuucuuggacaagcagugagcaccuuuagggcuguugaaggcuggccuuuuauuuugauuguuuuucuuuaguuugaaauuuaugagcuuuuuuuuuuaaaaaaaauccuuguugguuuuguccauauuucaaauucaagaucuuaauuaaagauauauuuuuuuucuuaauuguauaaagcuaaaaagaggucuuccaucuaagaucaugaugcagugacaaaggaaaauauagccaauauggucaugguccuacagcuaaagaacugaauaagcuggaauauuguaccaauuuuaaaagaaggcuuuuagugguacgaugacuuaguaccuucuuucaaaaaguaaagcauuuuguuuuuuauugugucuguaccaguucuucccacccacaguuuuggauacauucguggguguauuuguguacauacacacuucugguuacuaucacuguuacuaccgucuccaucccauucuguugaaaauuagaacagaagauugaggaaacucaggcugucucgccacacugaaaggcguccaaauacccuuacaguuagauugucgagucguggcuuaggugcuugcuaacagccaggaauuggacaacacaucuaaaaggugcuuagggaugaggaugggccugacuuucaguucaccuguugucagcuagcucccaugguugagcucuucacuaauugguucuuuggcuuuacaguuuuaagcgcaucuugguccucgucucccauucccaggauuuucugaauggugucuguaccaauaucauucacaugcacaacaagaaacugaaguauuauacggugagugggccucggcuucuucugguaaucucugugcauaccaauucucugaaauucucuuuaaaaaaaaaaaaaaaggcuggugugguggcucaugccuguaaucccagcacuuugggaggccgaggugggugggucacuugaggucaggaguuugagaccagccuggccaauauggugaaacccugucucuacuaaaaauacaaaaaaauuagccaggcgugguggcaggugccuguagucccagcuacuugggaagcugaggcaggagaaucacuugaacccuggaggcggagguugcagugagcugagaucacaccacugcacuccagccugggugacagagcaagacuccaucucaaaaaaaaaaaaaaagcagaccuaucuauuagcuccuuucuaccuauugcuauaaaaagauauggacaaggaguccuaccaccuguuuuauuuuaaucccaaagucauugcuuucaggccauaggccauggauuggcagccugugcacacaagguguauguuugccuuguggcaaagaaguugacuuuucacggugaccaggcaggcccugcucucaucugccuugccucuuuuuuucuggaaacagaaucucauuccgucacccaggcuggcaugaucucagcucacugcaaccucuacuuccugaauucaagcgauucuuguaccucagccuucugaguagcugggacuacaggcaugcacugccaugucuggcuaguuuuuguauuuuuaguagagacgggauuuugccauguuggccaggcuggucuugaacucuugacuucaggugaucugcccuccucagccucccaaagugcugggauaacaggcaugagccaccacacgaggccucccucugccuucuugaaugccuucuuaauucugcuucacuggagucuacacauuuaccccaccucccaugaccacaggagaaugggggucaggaucucaauagcccacuguugugccuugccuuuucauuuuauauuucaaaaagcauguaagaaacuaacgauugauguccucuucauucauagucauaggaguauuaguuuauaauauagccuuccagaaacuucauguauacuugcacacauuuguagaaaaugucauguauacguaaucuuuuucuuuuuauacaauugcagcuuuuuuuuuuuuuuuuuuuugagcuggagucuugcuccgucgccaggcuggagugcaguggcgcgaucugggcucacugcaaccuccaccucccagguucaagggacucuccugccucggcuuccugaguagcugggacuacaggcgcaugccaccacacccagcuaauuuuuguauuuuuaguagagaugggguucaccauauuggccaggauggucucccucucuugaccucaugauccgccugccucggccucccaaagugcugggauuacaggcgugagccaccgcacccggccucuuuuuucucgagauggggucugucucugucacccaggcuggaguccaguggcgugauauuggcucacugcaacuucugccucccagguucaagcgauccucccaccucacccucccaaguagcugagaccacaggcacaugccaccauacccagcuaauuuuuauauuuuuaguagagacgggguuucgccauguuggcuaggcugcugucaaacuccuggccucaagugauccacccaccucagccucccaaagugcuggaauuacaggugugagccacugcaccuggccacaguuacaauuuuaauaaucauucuguagguugcuuuuuuaaauuuaguauauuuuggacugcuuuccaugugaguauauauaaaucaaucacaaucuuuucagucacugcauaguauuucguuauguguuuauccuguaacuuguuaggcccuuucugguggauauuuagcuugaguccaguuuuuguuugcagauagaaaccaugguaguccacuuaugcaggguuugucagcuucuaaaucugaauggucuguuuuccccucuggagacagcucuugcagucuuuuguggggcuucagccucuagggaacggggaaggaauaggaggugguauuggaaggcucugagccucgugacguccguaugaccgugauuuucaggacuauucccagugccacaggugucuuucuagcuaaccuaaggauuugcgcuggagccuggcccuggcugggcugagcgaggggcauagaauugaaaagacuccgauuugauguuaggauaugcuucuguaaugcacguccucucuucuuacugcacagccuuagagccagggccaaguuagugccaucccucaucccccuaaacucugagugagaauccaggauugaaacccagguuaaagcugccugccuuaccuggcacauuuccaugcaggguaauuaugaucaguacgugaagacgcggcuagagcuggaggagaaccagaugaagagguuucacugggagcaagaucagauugcacacaugaagguagggagacugcagagucaggcucauggccuccugucugaaagaagcagggggcucggaugagggcauuucgagaagcgguagugauggaggaugucgggaagaaguuacgaucaacauuuuuacccuggauugaagaugaauuguugagcgccugcacauacuccaagcucucuuuggucuuuuuuagaacuacauugcgagguuuggucauggcagugccaagcuggcccggcaggcccagagcaaggagaagacgcuacagaaaaugauggcaucaggacugacagagagggucgugagcgauaagguggggugugauuggguggggugugauugggugggguuggguggccuaaggugagguggauaagaaaggagccaacuugauaaaugcccucuuuucuuccuagacacugucauuuuauuucccaccauguggcaagaucccuccaccugucauuauggugcaaaaugugagcuucaaguauacaaaagaugggguaaguucagggcagggcauggguggcugggguguaucuuagggugaguggcagcucaugggaguugcuccuguucugugcugaccacaccugcuagcccacgugcucugggggauuuucagguguggcagcuggggugccucauccaaggcugcucgcgggccuuucuucguguauauggaaagaagacuacucagcuggguuggugggcggaggcagugggcgaggcggggucugcuaugagugcuuccucccgcuacucucccuuccuccucucuuggugacugggaauucagcgggcuuggucugcuggucauagcagaucuguauucuagccuuguguccacaucucucucauccccaccucagccuugcaucuacaauaaucuagaauuuggaauugaccuugacacacgaguggcucugguagggcccaauggagcagggaagucaacucuucugaagcugcuaacuggagagguauggugccaaggugggcguggaucccucuaagauuaggccuugcgaugguuaaggaagaggggagugaugcaggggcuacuacuuugggagggccugaguacccugguggugagugagccaucuggagggguggagcagcagccaggagagggggaaugucugguuggacagugcugaggcugggggcuguuuuccugggacagggauagguagggaggagucuuagagugugugugugaauacauguauguguuuaagcacguuucuauuuucuuuuuuuuuuuuugagguggagucucgcucuguugcccaggcuggagugcaaugugcgaucucagcucaccgcaaccuucaucccccgaguucaagcaauucuccugccucagccucccaaguagcugggauuacaggcacacgccacagcuaauuuuuuuguauuuuaguagagaugggguuucaccauguucauuaggcuggucuugaacuccugaccucaugaucugcccaccucggccucccaaagugcugggauuacaggcgugagccaccgcgucuggcccauguuucuauuuucaaucagagcauuuagaauauaggaacaucugugcauuuagggaugcugcagguucucaaguaaugucauuucauuaauauugaugaaaaauagaaaugauucccagcuggggccacugucuuuguggaguuugcacuuucccuuuaacgucuacauggguuuucucugguacuucaguuucuucccaauuccaaagcugcaccugucagguuacuuggaacgucucagugguuccagucugaaugagugcgggugugugagugcauccuauaauggaaugguguccucuucagggcugguucuugucuuguucccuggguugugggaugggcuccagcugcccaugauccuaaacuugaauaagcagguuggaaaaugauagaaugaaugaauauaaaauauuguaaaagaaaaauucauaaaguuuaugauaaccauacaaaugcagucagcaaaccagccacauucgugauuauuuuuuaacuguguggugguaggaggugcuccuuacaguuuucccuuugcaaacauuuauuccuugguuuaacccaccacucuuaaaauugccaucacucacugauucaccaaaaauuggguaaauaucuuaccuuguuuuuauuaaucuuucuuaaguguauguauagcucacauguauuuugauguugaauauuagaagugacuggguuuuuuggccaggugccguggcucacaccuguaaucccagugcuuugggaggccgaggcaggcagaucacuugagaucaggagugugagaccagccuggccacauggugaaacccccucucuacuaaaaaugcaaaaaaaaaauuagccaggugugguggcgggugucuguaaucccagcuacuccagaaucucuugagccugggacagagaaguugcaguuagucgagaucucgccacugcacuccagccugggcaacagagcgagacucccucuuaaagaaaagaaucuuuggaucuuuauuuagaaguuuggugaucuuuuuuugugaccaaaaaugcugcaggaaccuaauucuuguuuauaucaguuagccuguggcaaaauuaguuuugcuauauguuguuucacuuaaagugaaacuuuaaaauagguucuguuucuaagaaccuaucgaugacagugacaacuuugaggacuuaacuguuuuuaauuuuagaaaauguauguugcaccuacauccaaguccuuuguuauacagcauagugcauucaguagacauuuuauaacuacuuaaauuguaucuuugccucuugagaacaucugcuucaguacaucuuccuaaauauuuuuagaguggccagaauagcagugugcgaguuggugauguauucuuuuuaggaaguugagucuuguucagugugaacauguguuuguuugccugcucugccuauguuucuaacugggcuuccuuuguuucaugcuuacguuucuacuuuuuucuuccuagcuacuacccacagauggcaugauccgaaaacacucucaugucaagauagggcguuaccaucagguacaggccugggguugggauccggggaauugcccaggguauagggaggggcuguaucuggcugaguuccagccagccgcccccacccccuggcaggaauuccagccuagguggcuccuaccugcuucuugaacccagaacaggugccugggauagaaauaggaaguuaccuaguaggguuuauuuugaagcgggaugccagucacacccggguggcuuccauuuuuccuguagcauuuacaagagcagcuggacuuagaucucucaccuuuggaguacaugaugaagugcuacccagagaucaaggagaaggaagaaaugaggaagaucauugggcgauacggucucacugggaaacaacaggucaguaaaggaggguguggugaggaugccagauagcuggcagacuguggcugggugggucaggggauacuguccuggcagccuggguuuggaagcuguccaaaccagagucuccuccauuugacuccccuaagaaccuacuaccuuuucuuuacucuagguuguuauguaauggagcauuuugagggggcaaggauagcgugccagucucugacaugcccuugugccauagugcuugagggcaaaggaacuuguaaucuagaaaacaaauuucuggauucagaucuggaaggauccaauucauugccaagagagcgagaggugugggcuuaguaauggcaagggcuucagguuuccggaugagucucuuucaggccucaagagacuagugggucucucugagccucacuuuuuauaaauggcgaugcuaauggaggagucagggagaaaugagggagagaugagcugugcuguuuggcggggauaaugccaaguuauauguaggucacgguucuacucaggugagcccaauccggaacuugucagacgggcagaagugccgagugugucuggccuggcuggccuggcagaacccccacaugcucuuccuggaugaacccaccaaucaccuggauaucgagaccaucgacgcccuggcagaugccaucaaugaguuugagggugguaugaugcuggucagccaugacuucagacucauucagcaggugaggcccuggccagggggugaggcacagcagagcuucuaggggguuggguaggguagucauggcauguggagggugcauaauacccgccuacugaauuaagagaaggggcucagaguguagacacagguggugaggaccaguucuuaugccucuuuggggcuacuuagaaagccuuaacugaaacacuucauuucuucaguagcuaucuggagaugucaaccaacuuagcauuuugggcccaaaugggaaagagaguuggguagaaaacggugcuuuuacuacugucccaagauucuucaguccaaaaauaguauucuaaggaggauuuugauuagacagcuaccacagucauuugagaaaaaguuguugcucauuccucugaagcucuggggaagaugagagguggagaaaagaaggcugagagugaagccucugaauagaucuaggcccugccagggagcugacaauaggagugacacagcaguuccuggcuuggaaggcuccaaaccugaugaugguacccuuggguuagaacaucccaaauaacuuagaaguagugagacagugaguuggauauggguuuggggggcggaguuuucuuccuagacgccccucaggacagucugcugggcagaggcagggacagugacuagcccaggauuaaguccagguuuugcuuucuagguugcacaggaaauuugggucugugagaagcagacaaucaccaaguggccuggagacauccuggcuuacaaggagcaccucaaguccaagcugguggaugaggagccccagcucaccaagaggacccacaacgugugagcccucuaccuggguucgggucaggagcuccaucugggaacuaacagcugcuaaccugaccagccgcucaggacaggacccuggggcuacacuccugcauugcugcaauacugcucccccagccucuccccugccccucaaccugccuuagcugcacucucuuaccuacagcuggacaguaccugucuguuuccuguccuccuuccaguuacaucuguccaugucuggacucggcuggccguucccuccagccccuugcugguuaucuuacucugagugugaugcagucagaggcaccugcggguuagcccaggggcccaagcccuggauuuggccugcggaggagcuuaggauccucguuuucuggguuuuggugauguuggaggaguaccccccagcccaccgccccgauuccuuuuugcuucugguuuggagcuccggaccaggaccuucguccuggucaguuuuuaaauaauuauuuagcaguguaacuuuuagaccugcgugacaucuacaaagcgcccaauaaagaaagaggaagccacggucccuaccuuccuucucgggucucuggggccuucuccucccugcagugccaacaugcacugcccacagcaggagcuggauccagcgucagugugucgaugggaacugaagacuaguccauaggagcuggaagaacuuugucccuuuacuucugauuugaaauuguaccuuuucucaggccugugauucacagacuuuaacaugaaucagaaucaccuggagggcucaugcaaucagauugccagaucucgccucagcguuucugguucaauagguuuugggggagaccaagaacguuaacauuucuagcaaguuuccaggugaugcuguuguugcuggucuagagacuauuuugagaaccacuguccaggagcgugguuuucugauugugaucugagguucugccccaacugcacagcaguugggcugcuuguuaaaaaugcaggccaggugcgguggcucacaccuguaaucccagcgcuuugggaggcugaggcagguggaucacuugagcucaggaguucaagaccagcuugggaaacauggcaaaacccgucuuuaugugccuggaaucccaccugcucagguggcuaggguggauggaucgcuugagcccaggagguggagguugcagugagcugagauugcaccacugcauuccagccuggaugacagagcaaaacccugucucaaaaaaaugcagacuggccaggcacaguggcucacaccuguaauccgacuguaagcucaucaccuugggaggccacuguaggaggaucaauugagccuagaaguucaagaccagccugggcaaaguagggagaccccuucucuacaaauaguaauaaaaugaaccgggcauaguagcaugugccugcggucccagcugcucugauaagaggaggcucacuugagcccaggagguugaggcugcagugagcagagcgugccgcuacacuccagccugaugacagaccgagacacugucucaaaaaaauaaaaaaauucagauugcugagcaucagaccuauugauuaaucgcauuugguagaaugagagaggugcagagauggccaggaguuugcauuuucacaccaacgucugugaaccucucuuccuauugggauacaggaaauuuuguauuuuuaccuguccacagccauaguuaucaucacuguuga

SEQ ID NO: 14291 - RNA, 457 nt, Homo sapiens
uucagggcgacagacuuuccaucccagaaccauuggcccaauuuuuccguaaccuuguggaaaagacccuggugcuggugaacgcugcugugacuuacucaaagccuugauuggccacauuuugguacuacgccaaguuugagcugguuccucccaccccugcugagaucccuagagcuauucagagucugaaaaaaauagucaauagugcucagacugguagcuucaaacaacucacaguuaaggaagcugugcugaaugguuugguggccacugagguguuaugugguuuuaugucggagagaucauaggcaagcguggcaucauuggcuaugauguuugaagaccaguauuuaacaucugauuauauuugauuuauuauuugaauguuguuggaccaugugugaucagacugcuaucugaauuaaauaagauuugucaaaauuaaaaaaaaaaa

SEQ ID NO: 14292 - RNA, 10170 nt, Homo sapiens
uucugcacucuauuucuacagcaaaagcggaagcugcgacucuauaucuccaacacuuuuaacccugcgaagccugaugcugaggauuccgacggcagcauugccuccugggagcuacggguggaggggaagcuccuggaugauguacgucccggcccaggucucuccagguguccuggggugggcaugggcugcacugagaacagaacaaggugucugcacuaagggcuagggagucagcccaggcuggguggaggggcaggccuagagacauuccaagugcagaggauuucaucuaagcccacugcccugucggcugccaacuuggccuccuucugcuccucccaccucgucccuguucugcccccauggucccuguugcucucccacagcccagcaaacagaagcggaaguucucuucuuucuucaagaguuuggucaucgagcuggacaaagaucuuuauggcccugacaaccaccucguugagguaagaccaagagccccuccgcccuugaauugccacccucccacaggccagaaucccugaagaaccagcacagauuugggucagggaccacccuagaguccugggccccaccacuccagaugggccuuugggagacacagcucuucucuccuggacaguggcaucggacacccacgacccaggagacggacggcuuccaggugaaacggccuggggaccugagugugcgcugcacgcugcuccucaugcuggacuaccaggucugcaccugccaugcugccccguacacgccacacaaggcccucagggcagggcuaggucccaaaguggugcaucuugagagaccuccuuccccucccaaaccuauccuuccccaggggcauguuuccucaaucaacacaucccccuaguccugaauggccuggcccugggcuccuuccuuucucucccuuuggucuaacuuucacaguccccuuuucccagccuccccaguucaaacuggauccccgccuagcccggcugcuggggcugcacacacagagccgcucagccauuguccaggcccuguggcaguaugugaagaccaacaggcugcaggacucccaugacaaggaauacaucaauggggacaaguauuuccagcagguaaccucucuccugaacccugggaucuggggagcaggcggaguucuccagcaggggaaguaccucuaccaagguaacuaccaccccucccuucuagauuccugaguagcagaagcaguacacagucauggucuuggagccaagagaccgaccaggauucuaguucaggcccuacuguggauuagcucugugcugcagccaauccauguuagcccccccaaguuaggaagaccuggaaacccuacaaagccaaccgcuuucuggaauguaauauucuuggcacuuggaguuaggauccccagguucuaguccugagucuggacucuggguaagugacucagcgauucugaaccuuguuuccuuaucuuugaaguggagugacaauaccuguccuaucuacucuccugggcaguuaggaaaaucaaauugcugcaaaagugauugagcaaaauuccaccaaaacagagaauauucuuauuaaugcauuuaaaaauaaauacagcagauaaaccugaggaguaaaaauagcaguugauauuuauugggcacuuaccaugugccaggcacugucccaagcacuuuauguguauuaguucacugacuucucacggcagcccugggagauagguauucuuuucauccccacucuagagaugaagacacugagcccugagguguuaacuugcuccagguugcauaguaaguggcagaggcaggacugauacauaagcaggcugacccagggcccgcacucucaaccccugccccacacugacccacccccuaucuugucagccauaccgguggcuccaccaccagaccagcccaccccaaucccauccccaugcgcacugaggaaucagacuuccucucagcuucuuguggccuuucuagaacaaaaggaucuacaacugcaugaugaucucuucaagaagagugaucucucucuccccaauuguccugcuucagauuuuugauuguccccggcugaaguuuucugagauuccccagcgccucacagcccugcuauugcccccugacccaauugucaucaaccaugucaucaggugagguggccccagcuugcuucucagaccagggaaugaucucguuccugccuucccugccccucccucuccucccacucccaucucuucucccucccuguuggaucugccccagccccggggcccuggggccguaugggggcaucguggacacgaagggcuggacuucccuggcagcguggacccuucagaccagaagaagacggcgugcuaugacauugacguggagguggaggagccauuaaaggggcagaugagcagcuuccuccuauccacggccaaccagcaggagaucagugcucuggacaguaagguggggcccaagcccagagcuggagugggacauuaacccagagaugauagaggagacuuuucugagaccagggugugguugcagaugagcagucuggguuaaauuaaaaaaaaaaaaaaaaaagagaccagacucugggccaaugggacacacauggcccguccaugcugcuuggagcugaaccucauuccaaguuuaguucugcccauccccuccuccccugggacuucagagaaaucaggggcucugagggguuguccuucacagaagaaacccccucucccuccccuucccacccgcuuccuuuccccucgucucccacaucaccaaagccagguggaaagcaucuaucuuucuaccugcagauccaugagacgauugaguccauaaaccagcucaagauccagagggacuucaugcuaagcuucuccagagaccccaaaggcuauguccaagaccugcuccgcucccagagccgggaccucaaggugaagagggagacucagggaguacuggaguggaagacaagcacagcgggaaagagaguaaacguuguacuccaggggcaggugaggggauucagggcucagggcucaccccacgcucccucccaggugaugacagauguagccggcaacccugaagaggagcgccgggcugaguucuaccaccagcccuggucccaggaggccgucagucgcuacuucuacugcaagguaugcagggacccuugcccugaggcuuccccauccucaacuccaagagaaaccucccuguucagcuugugggcagcccucgcagcuccccacaguaaagcuucaccacgcugccucaccaugcaauggcccucccugcucccagaugcucuuucagggcaggcggugucaguaggugggauuguccugaucacucaccagaacacugacaccugcuccuguucucacuuccucuaaagauccagcagcgcaggcaggagcuggagcagucgcugguugugcgcaacaccuaggagcccaaaaauaagcagcacgacggaacuuucagccgugucccgggccccagcauuuugccccgggcuccagcaucacuccucugccaccuugggguguggggcuggauuaaaagucauucaucugacagcagccguguggucauuggaaacuggggaggggagggggagagaaggggaagggaagaagguggggaggcagugggucccucgggacgacuccccauucccuucccuuggauucuucuccuuacucaauuuucccuagaccuaaaaacaguuuggcagaagacauguuuaauaacauuuucauauuuaaaaaauacagcaacaauucucuaucuguccaccaucuugccuugcccuuccuggggcugaggcagacaaaggaaagguaaugagguuagggcccccaggcgggcuaagugcuauuggccugcuccugcucaaagagagccauagccagcugggcacggcccccuagccccuccagguugcugaggcggcagcggugguagaguucuucacugagccgugggcugcagucucgcagggagaacuucugcaccagcccuggcucuacggcccgaaagagguggagcccugagaaccggaggaaaacauccaucaccuccagccccuccagggcuuccuccucuuccuggccugccaguucaccugccagccgggcucgggccgccagguagucagcguuguagaagcagcccuccgcagaagccugccggucaaaucuccccccuauaggagccccccgggaggggucagcaccaggaggggagggggggucagggccagcccccgggggcccugggggugaucucuguggugacagggcaggauugaacuccuggaaauggacuggaaagaaggccugccagccagagauggcauucaugcgacagcgguugaggacuucgggcccaggccuuguccacacggugguaaggaagaagagaguguccacagggugcuucuucgagaccacguccaugagucgcaccugggaaggggccucugcucgcacagcgagccaggccagccucgucccaggguaccgucgcucuaacuccgcugcugcagccuucaccccaagaaaugggucuggagcuccacggccaccuucucguggcccguagaccagcaacagggugagcaaugcauguucucguggcuccaggacauuggcugcaaaggccucgaggaaagccggggcugcagcagcuucagccaccaggaguggcagcaccagcugcacucggguggccucagugacauagggcauagguaggauuuccacccggcucaguggccgcagcaggcugacccugcgagccagggcccgccggugcccacgcugugucacacauuccaacagcagguccaggguguacuccaugccccgugcugggucgaagcgccgauagccguugagcagucgcugcuucuggaagcgcaggcggggcugauagcgccgauugagcugcuccagggcagucuccaacgcaucacccacguccgcccugcuagcccccuguagugggcacuugggagccccaucugcacaggagaaggugugcugcucugugaaguagucccagcccagcaccucaaagcgagaguguggugugaaaggagcagggagcccaacgggccagcucagcccugccuccccuucgggggucagcacggucagguuccggaucugagccuggguuggagggaaugcaccucacauuagugccagcuccaggauccuacccagcuccagcugccugggcucugagauucaaacagcugagcucuguccuaacuccaucaacacuuagugaggggucccuugcuaaucacugaaucccuuguacguuauucuucaccucuaaaaugcagauggaauaggaaucauacucaccuuacacaaaugccaugagaaggagguggaaaaugugcuuuuugcacagguaaaaguaucuugaaauagaagcucaacagccuuucucuccuacacccaaaggacucacauccucuucauaaucacaccuuuguuuucaucuacacuccaccucugccaagccugacguucaacuugagaauucucccuucuacccuugggcuuucuugggacaguucuagaaguaaagaaacuucagaguuuuugccuccucaguggacaggcacuauugaggaggagcuaaaacuauucugucugaacacugugcggagcuuccugauccucagagucuacuugcaaaccccuuuagcugcauucaaguugugcugggagcuuaccuuaugauugcuuuggacccccaaagaccuuugucccuguaguugcuuuaaauuuaaguauggucggccucuuccugcccugccauuauacagggccuagcccagccccacugccagcugcucguucauugcacgccuggacaucucaggcucucucugacccucugacugcgguccucugcccaccugcuccucuucagcucaccugcaguuguucuauuucacuguaagcccgcuccaacuccagagcgcugaagcguuuguggagccgguacaugaggguaccuucggagacagggugcacggcgaaggcacucaggaaagccgagcucccuuccuucucagggucccuauuuuuggccaguucaaaugagcgauacugcugccccuagagggacaaucagaccaaucaaugacacacacaagagcugccagucccaaaccgcccuuaaccauacucaguguucacaucuguuagcacugcugcguuagaacagaggacagaagaggcacccuuuccagcaccucgcuuaaccccaguucuuucacugcccacauuuuggaaaguagaaagcaaguaggcaacuaaggacacucucggcuacucucagugcauugcuuacaggcuagcccugcucugcaaggagccaucacagaaauaacauauuaaaaauaauaauaaugauacuuucuucccccaaagauucccauuguucuucaagggaaugaaugacacaagccagaaaauccucccaauacuuugguuugagaggaugagccaccucuggguucuuccacucuucuccagcacaagaaacagggcagcucucugggcuggaaaagugaucaccucacuucucuggagacuagccaucucuaagacaugcccacacugccauaacugaaguguggaugucgggggagguguggagggcaggggggcaggggagaaggacugcugaguaggagcacccuuuggucuugcuuagggguuccuaacaagauacuacuuuugauagccccagguucucagauugccaaaggugagcaacggagggcccacagagcggccaguggccaggaagggggaacaauggccucuaaggugcugcugggaggaaggccaaucacucaucccccacuagcuuaucagggacugggacugacuugaaagagcugucaccuggugcugugagacacagccgacgcccagagagucaaugaggcagcguccaagccacucgucaggacgggcacugagaaugucuccucggcagccauccagauguggccgcagacgaagcaggagacuccgugacaacagguagccaaagcccccaugacaguaccgggccugcucgccugcgccaaugaacuccucugcccggccuaaguacaggucuugguugaugcugagguggccagcaagggcugccaggcggggggccugcacauaugugucauccugcaugaugaagaaccagucguagucggccccaaagugugugugaagguggcgcagggucucugacaugagccaggcgggccgcucauccccaugagacaccaccugcaucccugcuggagcccgggccccccgcugcccagugaaguagaguaaccgagggaagugaugggccaccguacgguucacagccacggccaaaguggacaguguagcucgggaggucaggacagccaccagcaaccgcucacgggagcccagcucugucuggauguaccgaguccuguggaaagaccagugugccagaggucaacucccuaaucuuuaggaacccagcuuguucagaauauacaucccccucuaggagugaguuggggcugagaagggagaaacuuccuuccuugucaauauuaauuagguacugaacugaguauccacuaaguagcugacacgaauugauuugggaggggagggagucuaccaaggauagauuagguagguuagaugcaauuccuccucuguucaagaacaucgaacccuggcugggcacgguagcucacgccuguaaucccagcacuuugggaggccgaggcagguggaucaccugaggucaggaguucaagaccagccugaccaacaugaagaaaccucaugucuacuaaaaauacaaaauuagcugggcgugguggugugcaccuguaauaccagcuacucgcaaggcugaggcaggaaaaucacuugaaccugggaggcagagauugcagugagccaauaucgcaccauugcacuccagccugggcgacgagagcaagacuccgucucaaaacaaaacaaaaacaaacaaaaaacaucgaacccuaauuuaacaccaaugaaugugagacuuucuaagaccugagaaggagggaaaaaacagaaagaaaccaugauggaaaauaagccagaauugcuccaagucgcccgacgccgauugccaauggaaaggcagaggcaaggauuuacaccagcccaaaacagggccagugucuggggacuaugcacacauguugcucucaccugagcaccuucuuguagggcuuguuggggucccuguaguaggggacaauccgggguuugaagucuucaucacuuuggucuagccgagcucuggaaucuggauucuguggcccuccucgcuccccuacagccucgacacagggaucuucucccucccccuggauccaggaaacccgcaggaggcucaggcugcaccccagagacagcccuaagaugaggggaagcgcuggccgcagcagagccaacagggagcucagucgcauggugguaggcccugccaggugggugccccaggggcacagccucaaggaucaauggauugaugggcaccaggccaguaguaggcuuucaguuuuaaccagagaaccuggggucaaugaggccaaagacagagcgaggcccgcuggcuuccaggaccagcauccccaagaagauuguccugucuucacaacuccuucugccugcucuucaacugugaaggugucggaacuaacccccagccaaaacgguaauaaaugaaacaaucaauuucacucacacugggauuauggucugucuuccacuaaaaagaggaggaaguaaaacucaauacugccaaagcuaacccaaaaaggaacacuacacacaucugcagacugggccuaagucaacagaugacagcaagugauaagagguaagggaaaagcacacgauccaucaaaacaacagccccaaccagaggagccggagccugccucagugggccuuuccggaagaaugccugccucuggcaucgguccucaggcgggcuacugaaggggcugcugagccacugcggcaggcccggugggcacaagggaaggggccagagccucuuucuacucugcuccccguguuugagaagacgcaacggcuacaggaaccccuccucccacucaggagcggucuggagccacucgcauggcacacauaaguucugcccacccgaaugagguagaucggugacucagcacugacagccucucaggagcgccauggccgauggagccaucuugcagggcauucuccucggaaccccagcugcugaggagacagcaggcggggacuggaacucugugugcgagcgauucggugccugguuuuaccagggccccaggggccaaaugaagcaaaccaaaagcaaagagagagcacaagcagcaacuagagacaaugccaggguccugggaacgcaaacagaagcgcggccagcuuccgacaggaccccugccgggggcccacagccccugcgcuaccucucggcgaucagagaccaagucuagcccuagaacgaagacccgacgcgagucuucgccguucgucucaaaacagaaauaaacuggccacgucaccgggcugcugagaagggggcucgggagaccagcucgggucguucugcgaggcggggucggaggucgcggcugggagacuggggcacagaccucguucucaggccagucggcgggagcggaggccgcgccagagacagcaucgaggccgcgagcgcaggaccaggagggacgcccaaggcccucggggaggaggcccggguuucagggccgggggccggcggacaccggauaaaggacggccggggucucccggcgucccgggagggggcggggcggaggcguggggaccaagagcggcgucccgcacgcgccuggcagggagcagggacggggaagggggaacagaccccagugcccgcugaggcgccggcuccgccgcugcagccgcugccaccucacagccccuguccgcagcuuccucuuccgcugccugucagucacccgucucua

SEQ ID NO: 14293 - RNA, 13985 nt, Homo sapiens
cucuagaccucaguucuuucacugcagaacauauuggauagaauaaggaugcuuccaacuccaaaauucuaagguuuucuuuaauguacuuaauuguuucaaaugauuauaguuuuuuaaccugugcuuucauaauauaauacaacuuguuucuaugauuugacuuauguuucuaggcaaggaugcaauccccaacuuuaauaaugaccucaugaaaaaacaauuuuguuuuuaaaaugacuuccagaaauacacuaugguguuaaagaaagagagagaggggaccguuugccaccacagcaggaaacaaaacuaaggagacugcagcaugugaaaaaugauccaauugaaaaagacaaguuucggccaggcgcgguggcucacaccuguaaucccaggacuuugggaaacugaggugggcgcaucacuugaggucaggaguuugagaacagccuggccaacauggugaaaccccaucuuuacuaaaaauacaaaaauuagccaggugugguggcacacaccuguaaucccagcuacucaggaggcugaggcacgagaauugcuugaacccgggaggcggagcuugcagugagccaagaucgugccacugcacuccagccuggaugacaaagugagacucugucucaagaaaaaaaaaaggacaaguuucuccuuccuucccaaucuggaguaauaaagaguuccugguuauuaacacuccugugggauuaucuuuuuuuguucuuucauacccaagagagcuagggcaugugaaaguggguaccucucugcgguugguaauaugaguggccgcaugauccacguucccaucacacgcccucaggccaagccgggcuuccugggcaguaaaccccaacugcaacaaauuguccacuuuugauggaucaauauauagcucuuuaaagagcugacgugccuagagacagggaaauguaagaaucauguaaccacggcaauacuuaaagcuuaauacaaagugaaagccuaaaagaaauuagauuguauccaaugugaauuaaaaggcaucagauuuuggauaaaaucucuaaacuaggccuguuauuaacaaguacaaauggaaacagaccaacacuaccucuacucacauaacuuagccacagcacaacacgagguaagaggcuggguguugcagaagugacugguaaccacuuuguuuuugcaacaaaagcccccgaauuucagcugugcacguggcauuucucacccucccuugcagcuggguguagccagguagugaagucgaagucaauggcaugcagccacagcgcugggugcagcugcggggucaucucuccaguggccugcucuggacucucucuugcccccucugcuggcuggaagaggcacugacaggagcaaccuaggacgccucgcugaggcuggcgggcugcucacugcuccggccuggcucaccucuagacggcaagaugagugagccauaaacuucuauccaauuaaagucacugucuuuuugaagucucauuacagcaucuggcuguacucuaacauauacaaauauguuucugguucaacaucuccugugcacggagaaagcacaggcauguuucucacaagucacaaacuacuaaguuaaaauccuuaacuucugggaauguuuuuuaaaaggaggugaaaauugguuacaacuuuacuuuucuuaccuuguuaagauacucauaagccucuacaucauuuccacugugauaguuucggaucccuugaaguaaguagagucuuagaaacaguaccuucucuuucccacaauuucccuaaaauuauugaagaaaaaaaggauaaaauugccuuauuucuaauuacaggucuauaauacucaucucugucauucccuuggucuccagaggggcaacaugauagguauuaaaauguccauggcuucacuaugacugacggcaaaagugaagcccccucuuccccauccccugugguaugauaacauuccucaugccacacaggagagucagugucagggcaccagccuccagacaugcagcacaguggcccuucuggucagcagagaaguaugcagaaauccaaaccagguaucagagagucugcaucagcaggauuuugaugacuuggggaaaucagaaaaauccuuacucgagccacagcucuugagcugugacucauucacguaaaccauuacugcugaaaugucuauuuucugcauuuacaucuugcaaauuagacucuaccgauauaaagaagucagcagcucucuccuggucagggugaucacugaugggguucuaugacuagcaaaccauguuccuuugggcuaaaugcucacacgcuaaguaagagagacagccagauuuguaaaacauugaacacuuuauaaauauauaguuuaaaaagacuauacugcauacuacuaucaaaaugaaauuaccuucuggcaguaguucaaauacuuuaacaggaauaaacacaaaugcuagaaauggacucaacgagacauaagaugaauuccaggaacauacuuuuauguggaccagucucugaugauuuucuccguaacaauuuuuaaagcauuucugggccaaguuuaauuuuuuuucugcaucaucaaggcauuccagcuguuccaggcggaaguaacaccacacuauauccagcuggaggacggcguaguuauccacuguguccagcagcucucugcaacacucacuggaaagagaaggacagugacaucacugccaagcagcauuugaaacauuuuuagcauuugaaaccuuuuugugaaugacuggaauucuuuccccguucuugguauauauucaaaggcugacugcucuaaaagagagauccuaauguuuaggaagggagcuguguuuauaaucucauccuucuaaugggggaaagaaagagaaaucagaaaucagggcuuaggaaucaaagcuuaccaccacuugccccaggacacacaugcagccccuugauaggaagcagaacccagggccacuguuucagaggcccucagcaaauacggggaagaccaugcuuuaaagcugugacuuccaauccugacugcaaaucagcaucaccugggccagagcaacguucuuucuuucuuucuuucuuucuuuaagaaucauugaucccacccagaccaaacauaacagaaauuucuggggguugggccuggugguuauacugccagagucuccccagcugauucuaguguacagccagggcugaacaccacuucuuuaaagacaccaaaaaaaucccuacguacuaugaaugccucagcugaugacggcucugacaaggcauucauguucaaucauauucaagcugggggaaaaacaauccagaaagcaccaggcucuaacggcccagcugauuucugagggccugugugcaggcaaaauuugacuccguauucguggcagcaggcugaacccaggcgcagcaaagggaagaaagacagcaacagaagucagugugcuccaggaggagcacugacaaagacagccaucaaggugacuaauuuuaaguuaugauuacauuaaaaauuccuaaugccaaucuaggucucaagucuucaauaagaacauuuggaaccacacauuguauaugaacaagguuuucucucuuuauguucauugguguucuacuaaaaauaagaaugcucuuguauaaaacuacaaaauccacauggccucaagcuuccuguccugccuaucaaaauaugcauggaauaaaaaaaaaaggacuuuaauuuugucauuuacucuuuaaaacaguagucuccuaaagagggcccauguacacaguccaguugugggugcggcaagaaaaauguaucacagcaguauuuuuauauuuauuuucaucucucucaacauuucuaauuucgugaauguuugagaacacauacaccauguuuuacacacgugugcacgcagacacacagauguggagcugggugaggggugcuuucuccaaaucuacggcucagccugagaaccugccuuugagagaaacagcagcgcuuuguggauuguggucugaucucacagucguguugagauuuccugccucuaggcacauucuggucccagugacagaagacucuccugccacucgcaggaaagcaaugggcauguggccgaacuucuccaucuccugcauguugcuuuaacaggcucguucauguuuuacuaagcaucaagagcgugggcagaaauggccucaugucaguuaaaaauaaaaucaauaugcacuuaucucaaguuugacccaggagugaguauuuauuugugcagccaaaaaaaaaaaaaagagagagaagaaaaccaacaaaaugaacaaacacacaaaaaacccaaagcagaggucucauauuagagggguacaugucauccuuuuaguuuugagaaaucaacacuuauuauuauauauaaaacuauauuuaaaccugaucauuugcuuggggcaaagugguuucuuaaagccugguauaaauugcauuuagaaggcugggugugguggcucacaccuguaaucucagcacuuugggaggccgaggcaggaaaaucacuugaacccaagaguuugagaccagccugaacaacauagagacucugucucuaaagaaaaaaaaaaaauuauaaaaauaaaaaauuucauuuagaguguacuuuuauuaacauugcuuugguuuacaauuuuaguagcauuaauauucaacacuguuacauuuucaugcugacgauauuaaaauaaacguaaaauauuuauuuaaauaaaaucuacugagccuagcuuucaaaaaauuaaauccuggccaggcacaguggcucacgcuuguaaucccagcacuuugggaggccgaggcgggcagaucaccugaggucagagggucaagaccagccuggccaacauggugaaaccccauuucuacaaaaauuagcggggcaugauggcgggugccuguaaucccagcuacucgggaggcugaggugggagaauugcuugaacccaggaggcggagguugcagugagccgagaucgugccauugcacuccagcgugggcgacagagcgagacuccgucucaaaaacaacaacaacaaaaauuaaaucccauuugagcuuaagucgguuauuuaacagaaauuuauuauguuugucuuacaguuuuuuuguuuuuuuuuuuguuuuuuuuuguuuuuguuuuugagacggagucucgcucucuccuccaggcuggagugcaguggugcaaucucggcucacugcaagcuucgccucccggguuccugccauucuccugccucagccucucaaguagcugggacuacaggcgccugccaccaugcccggcuaauuuuuuguauuuuuaguagagacgggguuucgcccuguuagccaggauggucugaucuccugaccucgugaucugccugccucggccucccauaguguugggauuacaggcgugagccaccgcgcccggccaggcuuaccuuucuugaaauuaauauuuauuuaacauaaaaauuuuaggccaggcgcgguggcucacaccuguaaucccagcacuuugggaggcugaggcggacggaucaccugacgucaggaguucaagaccauccuggccaacauagugaaaccccgucucuacuaaaaauacaaaaacuagucgggagugguagugggcaccuguaaucccagcuacuugagaggcugaggcaggagaaucgcuugaacccaggaggcagagguuacagugggcggagauugcaguaaacuaagauugcgucacugcacuacagccugggcgacagagugagacuccgucugaaaaaauaaaauaaaaaaauaagccaaacuuaccuaacuuuuuucaagaaagguuagcuaaaaagucauuuucaauuuuauuacugguuuuagggaauuggauuauagugugcuguaguguaguuuuuuucugauauuucuuguacuuggggucauuaaagucauugcaucuggggguuuauaguuuucaucaaacugggaaaaauuaauggccauuuuuuucuucaaguauuguuucugucccacaugucugccuuuccagggacuccaauuacaugcauuuuaggccgccugaaauugugccacagcuugcagaugcucuguucauuuuuuuuuuuuuuuagccuuuucucuguuuuuucagauaguuucuauugccuuauguaacauuuaacuaaucuucucuucuauagugucuauucugcaguucaucccaccuaauguacuuuucaucuuggauguuguacuuuucaucucuuacauucuaaugugggucuuuugaaugucucccaugucuuuaucugacauguucaguuguuccucugccuucuucagcagauggauuacagucacuguuuuacuguccuugucuacuaauucuaucuucugugucacuucuggaucuguugcuacugacugauuuuuuugcuuguuauagguuacauuugcuuguuucuuugcaugccugcuaauuuuucaguggaugcuggauauuuuugaauugcuaaauuauugaguuuuguuagggaugcacuuauuugaaaacgguaaguuaaggguacuguucaggaguagcuuuuaagcuuuguuaagugaaaccaaauuaugcccuagugcugaggcaacacccuucugaagacucuauuugacgcccugugacuaccaaauccuccacucuggcuggugggaacauaaacuauuccuggccuucuaugaacucggaggauuauucccugcuucuuucaugugguaccuugcccagcccugggcaguuuccucacacacaugugcugaucauuacugagcagaagacucaaaagggcuccucugaagcucucugacacccucucucuggcagcuugcuccucucaccuccuuggccuccugcaagcccagcuccaucucuuuaacuccagggagcacaaggcucugccuggguuugcccucccugccccguaaccugaaacuucuccagacacugagcuccccucauguuucccuaccucagggucaccguucugcacugccaggaagucacuguuucauacaauuuggggaaagaaacuauucuuggucauacuacauaccauacuccaagacauaugguaggaaguugugacaaaacuucuagcuuacuuggagaaguaagggggaaaagucaaauggaaaaggaaauggaaaaacugaaguuuccuccaucugcauucuauuuggcuuacauuacugcugauuuccuuuaugaaaagagagaaaucacacacacacaaaaauaugcuaacaaguuggccaggauaaauagaugcccaggauaaauagaugcccaggaaaaaaaaaacuuucucuacuuagaaagacauuguuaauuauuauuucauuauuauaccuaccacuuaccggacauguuaauguaucaugaacugaagauguagccaaauuuguauucaaugguucccugagaccuaaaaauuauuucaaggauuuguccaggauaaaaagauugagggaggcucacacagauguaugaagaucaaccaugucuuuauaacugcagaagcuuaguuaugaguguauauggaagcucauuauacuaauuuuuauuuuuaugacuauuugaaauuuuccauaauaaaaaauuagaaacaacuauggaagggaaugaaaaauuuaccuaaacuuuuaggaccuaauuuaaagccuguuuacccuacacuguuugcagaagagaaugaaacugacauccagaaagaggcagagacagagaccccagaagcacaaaccagcccucauucucacuauucccagcccggccccuccccucccaauuccuuuuuuguguacguuaaaguugggacuuguucacuuagaacccaaaggcacugaccaauggaaaacuauaaauauuugcauucaucuucugggaguauacaguauuaucuugggaaugcaccaaaacagaaaagaaguuaacacuaaauuuguuaacuuuugaccauuuucaaaaaaucaagucuacuuuucaaauguugaauaugucugcaucauagucucuuaguaccguuucccaugaagaggaaccaggacuccuugggaaauugcugauuccuggucugggcauuaaaugcccaagaugagccuggaguaucuuuggauuccagaaaucagagacugcaaagacuagcagggucaggucaaaaaaacaugggcugccugccagccagcaugaccaauuuaagcacugaaguuugaaacacaucaaauguuuuaaauccaugaguuaauaaugacacuuaagaaaaugaaaagaaaaagaaaccucuuuggucaccuuuggagggugauagugaagcaacucauuuauucugaaaacaagaaaauaaggagaaagaaacaaaguauuuuauucuaacuuuccuauacaaauuguaccuccacauauaaaauaacugaugagcaaaaacaaauuuuucagaauuccagcaauaaaugcagaagggaggcugggugcgguggcucacaccuguaaucccagcacuuugggaggccaaggcaggaggaucacaugaguccaggaguucaagaucagccugagcaacacagggagaccccaucuguauaauuaaaaaaaaaaaaaaaaaaaaaaagccgacacagcgacucacaccuguaauaccagcacuuugagaggcugugguggguggaucacuugagcccaggaguuugagacuaguaugggcaacauagugaaaccucaucucuacaacaaauacaaaaaaauuaucugggcauggugaugugcaccuguggugaugugcaccugugaucccagcuacuuaggaggcugaggugggaggaucacuugagcccaggagauggaaguugcagugagcugagaucaugccacugcauuccagccugggugacagagugagacucugucucaaaaaaaauaaguacagaaggaauaauaucaccauuauacagcucuuaaacaacggauuugaggaauaaucaucaauacuaccccaaaaccauuaggugaaaagcugacaggaaacuuuauaauggaaaguuccgacuagcaacauagcacauguacagaagaagagaggauauccuaccugcuugaaaauucuuuucuuuacagggaggaaaggucaauuagaaauacaaagggaagaagaaauucaccaguuuacaccauaacuacucuuuuacauuaaccacuguuguagaugaaagucugcagucucaagggcauggcaggguguucuguauagucugggccaucuuccuuaaagcugguguucaccaaguacaaaagcgccuaccagaaauauuugucagcguccaacagacauggcaaggcuauuccauauucuuuucuuuucaggaaagcucugcccuucucaugauaucccauagcuaacauaagggccuaggaaaaaauacaaauuuaaaaaacaucacuuuaaaauauaauaaggcaaauuauauuaaaagcauauuacuuuuuaaaaaacaaaguaaaaaaaaugaaaacaagaucauaacucaaucuaaaagccaaaauuaagaaaaauauaauuaauuaaagcuuuauuucauuuaaauacugaagccaaacacuucauuuauuauagcugauacaauccuaaccagcacuuggcccuuugcuuucauuaguuuauuuucguauccacugaucuggauucuacuucuaauauucuauucagacuaaacauauuaaaaagcagccaguaaugcuuguaucauuuuuauuuuauuuauuuuauuuuuuugagacggagucucauucugucguccaggcuggagggcaguggugcgaucucgggucacugcaaccucugccuccuggguucaagcgauucuccugccucagccugccgagcagcuaggacuacaggcaugagccaccaugcccggcuaauuucguauuuuuaguagagaugggguuucaccauguuggccaggcuggucucaaacucccgaccucaggugaugugccgccuuggccucccaaaaugcugggauuacaggcgugagccacggugcccggcugcuuguaucuuuaaaaagggcauucauuucacuuucuauucuuuuuuuuuuuuugagacagagucucgcucugucacccaggcuggagugcaguggcgcgaucucgacucacugcaagcuccaccucccagguucacaccauucuccugccucagccucccaaguagcugggacuacagguacccaccaccacgccuggcuaauuuuuuuuuuuguauuuuuaguagagacaggguuucaccguguuagccaggauggucucgaucuucugaccucgugaucugcccgccucggccucccaaagugcugggauuacaggcaugagccaccgugcccggccucacuuucuauucuuaaucaucuaguuuuuucagaaguuguuugucaacuuuaguauuuccaaaacaaauuuuuuuauuuuauuuuuuuuuugagacagagucucgcucugucuuccaggcuggagugcaguggcgcgaucucggcucacugcaaccucugccucccgaguucacgccauucuuccaccucagccucccgaguaccugggacuacaggcgcccaccaccacgccuggcuaauuuuuuuguauuuuuaguagagaugggguuucauuguguuagccaggauggucucgaucuccugaucuugugauccacccaccucggccucccaaagugcugggauuacaggcgugagccaccgcgcccggccccaaaacaauuuuuaaaaggugauccaaaauuuuuugaaguucauuagauuuuucaauuuaaauguucgcauaauucagucugauaaagcaguagucccaaccuuuuggcacuagggacugcuuucauggaagacaauuuuuccauggacaaggaggaaggcagaugguuucagggugaaaacauucuaccucaggucaucaggcauuagauucucaucaggagugcacagccuagaucccucacaugcccaguucacaauaggguucaugcuccuaagacucuaaugccgccgcugaucugacaggagguggagcucaggcggugacgcucacuugccugcugcucaccugcuauguggcccaguuccuaacaagccacggacugguacccaucugcagccuguggggugggaaccccugugauaaagguuuuccaaaaagaucuggaugucgucauucaauguaagagagcagugggcaaguaaucaucauuuucaaaagacaaacauuggccgggcacaguggcucacaccuguaaucccagcacuuugggaggccgaggcaggcggaucacgaggucaagagauugagaccaucuggccaacauggugaaaccccgucucuacuaaaaauacaaaaauuagcugggcaugguggcgugcacuguagucccagcuacucaggaggcugaggcaggagaaucgcuggaacccgggaggcggagguugcagugagccaagauugugccacugcacucuagccugaugacagagcgagacuccgccucacacacacacaaaaaaagacaaacaucaaucuacugauaacucaaacacugauccacaguucuguuaugaaaacaacuuuaauccggccgggcgcaguggcucaugccuguaaucccagcacuuugggaggccgagguggguggaucaccugaggucaggaguucaagaacagucuggccaacauggcgaaaccccgucucuacuaaaaauacaaaaauuagccaggcaugguggggcacaccuguacucccagcuacuugggaggcugaggcaggagaauugcuugaaccagggaggcgaaggcugcagugagcugagaucgcaccacugcacuccagccugggcaacagaguaagacuccuuuucaagaaaaaaaaaaaaaaaacuuuaaucuuuaauuuuaaacagaguaacucauagaaugaagccuacucaaaaccaucccuuaaaaacagaaaaauuaaaauuaauuugacccauagucauucauuauaagaagcuacugaacccuuucucagagauugaucuuagaguccaaguuccagaaugcugcuauagaggcccccaaggggcugggugcaguggcucacaccuguaaucccagaacuucgggaggccgaggcgggcggaucaucugaggucaggaguucaagaccagccuggucaacauagcaaaacccugucuccacuaaaaauacaaaaguuagccaggcaugguggugcgugccuauaaucccagcuacccaggaggcugaagcaggagaauggcaacagagcgagacuccaucucaaaaaaaaaaaaaaaaaaaauuagcuggacauggugguguguaccugcagucccagcuacccagaaggcggaggcgggaggaucgcucaagcccaggagguuaaggcugcagugagcuaugauggugccacuguacuccagccugggugacagggcaagacccugugucuuaaaaaaacaaaaacacggcagaguucgguggcucacgccuguaaucccagcaguuugggaggccaaggugggcaaaucaccugaggucgggaguucaagacuagccugaccaacauggagaaacccugucucuacuaaaaauacaaaauuagccauccgugguggcacaugccuguaaucccagcuacucaggaggcugaggcaggagaaucacuugaacccaggaggcggagguugcagugagcugagacugagccauugcacuccagccugagcaacaagagcaaaacuccgucucaaaaacaaaaaaacaaacaaaaaacccacagauauguuuaagauuaaaccuccgccuaccuaucccaaauuauagaacagggaaagaguaugaggaaauagggaagagaagucagaaucaccuguggacuuuucccaaacgacacaguuucccuaccccuauucugauccaucccuuaggggacaagguucucuaguaaaauaaacuaaauguaaagcacugccacaggaagcugcaugcacugaaggcagugggucguguccucagguauguugaaagucacugcuccaggacagugagacaugacauuuuguacuaaugcgcugaaaagcacagggugaggcccauuggaugccagugcucaccacguggugacauuuucuguuuacgaggcuggagauggagcacuguuuccaacccuuuacaacacuuccaacauaaagcaacuaaaaaaccaccucugcccugacaacaaaucuaagaacaggccacacauuucucauaguacuuacuuuucuuucugaugggggaauucugauugaucugccugucugguuagcuaugucuaaguacggugucauuucuggauccaccacugucucugcugcuguaacaaaaccaaaaggaccuccaugaacucaauguuaaacaguuaugaugaugacagccuuaaaaauguuagacuguugaggugagacucagugagagccaugaucccccaacugugugauccagugcugcccccaagcagcugagugggugacaagcccagagcucuggguaccucucuuugccaguauuucuaguccucucuugguccucugaauuuguuuuucuuugaguuuggccucauuuugcuccucuuccucuaacuggaaguuuuuccucgcguccucuucagauuguuuuaguucaagcaccaucgcuuucacauugugagccacgccuuguucuucaaggguuuucccuauaaaaaucagaacugccuauuauuuuaaaaagccauuaagcuuaccagguaacaguccauuuucuauguuaaauggaa

SEQ ID NO: 14294 - RNA, 7934 nt, Homo sapiens
agucaagaugucgcacccguccccccaagccaagcccuccaaccccaguaacccucgagucuucuuugacguggacaucggaggggagcgaggugagcggagucugacgcucgcggaaaagccccgaggaggcggggguucccgggauuugggggauuccaagggcggaaugcggcuccggccggugacugcucaguuucgcggaggggauggcugccuaggcugguccgccggagcaggcccggagaucuagggcuagaucgauccagcgcccuuguaucaaugccaucgguggugcggaaguuucuggaaauuucuaguucgggaauuguggcguccuuuagguuugccuccugauuugguggcacuuccacgccaccuuugcacuaccaaguuagcaugaaauauuuuauguuugcaaugggacaguucggaaagcauauccugggauaugcgucugcugggccccaggaaacuauauuugccacaugagauaauauaucagcacgugcuguguuauuuauacguuaaagggacuuguuugcucauugcuuuugccuuauuacugauucuuaauuuagagguccguucagaugagcaaacauuuucucuuaauuugccauugggaaaaugcgcucaacguagugaugguguugccuagguuacauagccgcucagaaguuccuaaggccuggugaauuagggagcguguugcuuuguaacuggauuggccuuguucuggaacacguuggaauugcuggccaggcaauguguuugaaugcauguacaggacacacacacguuuacacguacauucaguuuguugcaacuagcuagggcuagguuuaaucucaccugucuuagcugcuaucuagaggaggaauuuuuacagcuuuugcuucagagguugcaugaggcaguuugcucagagcacaaaggcugcagguauacguaacacguggcaaguccgcccacccaaagacuguuuaauuuucucccguugguugcuuggugauuggaaauucucaguaccucuugaagaaauuacucaggauuuaaaacuauuuguauuuaaugauaucucuuacauggugcuaaucuuuuggcuacuauaauugguuaugauccuuaguguaauguuucaaaucuguuuauauacauacaugacaguagguagacuaaauuugaauauuagaauaaaauaagauucacuaauucuagugaguauauucaaaggaaaugaaguuuguaugucaaagagguaucugcacucccauguucauugcagcauuauucaugauagccaagauaauggaaucaaacuagguuuccaucuacagauggauuuuuuuuaaaauuugauauaugugcacaguggaguacuauucacccauaaaaaauaaugaaaucuugucacuucugacaacaugaauuaauauggaggacauuauguuacaugaaauaagcugggcacaggaagacaaggcaugaucucacuuacaugugguuucuaaaaaguugaccuugaaguagagaauggaaugguggauuucagggguuggguagauguugaucacgagagaccuaauuucaguuagaaagggggaauaaauuuaagagaucuauuguauaacauaaugacuauaguuaguagcaauguguuguguucuugaaauugcaaaaaagaaaaauuacaguaaaggggaacuugguaauucaugauugaucugcuaccauaauuauaccaaccuucuuuuuaucauuugucuauuugguuguuuugcauacugacaagauuuucuuuucuuuuaguuggucgaauugucuuagaauuguuugcagauaucguacccaaaacugcggaaaauuuucgugcacuguguacaggagaaaaaggcauuggacacacgacugggaaaccucuccauuucaaaggaugcccuuuucaucgaaguauguguaaauuuucuuaaucuuguuauucuucauacagacaaguccuguucuuuaggauuuggggaagaaaacacuaaguaggaagugaagcuuaaaaaguacuauuagcguccaugucugaggcaguaacgcaguuucguaaagguuaggcugugcgagguggaauuacuuaugguacuaagguuuaucuauagagaaauggacuccccuagcuuuacccauccucucauucuccuucacucuaagaugauuugauugagaaaggaaggccguagucaaccaaccuuagguagcuucauugccuggugacaaaaaaguuaugcauagaccgggcgcaguggcucacgccuguaaucccagcacuuugggaggcugaggcgggugaaucacgagaucaggagaucgagaccaucuuggcuaacgcggugaaaccccgucucuacuaaaaauacaaaaaauaagccgggugugauggugggcgccuguagucccagcuacucgggaggcugaggcaguagaauggcaugaacucagaagguggagcuugcagugagccgagaucacgccacugcacuccauccugggcgacagagugagacucugccucaaacaaacaaacaaacaaacaaacaaacaaaaaaaugcauaauuuuugggccugagugcuugggaaggcagcagauuugaagauucaguguuuugggcacaugggugauaguguggucaaaauaugccauuucauacugcuuauuacacuuuguaaugaaucauacuuuuguuuagugauaaugguucucccaauagacugcaggcucuaugaguucaagaacuguauguuuucaccauuuuguuuuuggcaucuaauacaguuauugaguaagaacucaguaaguauuuguuuaauaaauaggcaaauaagcaauaaucacaagagcaacauuuuuuaaacgauuuauuaagaaaaaauuaacuuuuuaaaaaauauuuaaaauguuuacuuucauguuuaauaaaaacuugaaauaugcuaauaaacuauaugcagaaaauauuuaacauagcaagugugagacugcuaucuuuagaaaggucugccugcaagaguagcacuuguuuggagucugggaacuugacacuuguaccauuuccuaaauaguaauggugauuuacuaugccuagccuauuuguacaaacaugaaugugugcucucuuuuggggagucuggaauuuugguacaugcuagguagagugugcccaauaaauaccuugggugcugagucucuaauuggcucuccugggcagaaauacuguguacauguugcugcauuuuuguugcugggggaaguguguguucuguagcacuucaugggacggagaaagcauaaggaagccugcacauggauuuuuccagacucugccugugucuuucccgucaucucgcuguguauccuuaccacugugauccaaccacauacugauuugugugagcucuaggguucucugaacaugaaagcaaucuugguaaccuuugacacaaagugauauauuugcugaaaauuuuccauuaggguagaacaaaucuacugggaaucauuggucuguauucagcagacauuauugaguaacuaauauguacuauguguacaugcacauaguuauaaggauguaaaacaauacaguugguguacuuaaggagaucauugcuggaaggggcagaucauaaugccauauguuauguaggcagagucaagauacuaugggagaaaaauuaggacauacagcuuagggauuucagugacaguuuuauaggggagguaucauuugaaccgauuuucugaauguuagcagggaucaggcagugaaaauagguuggauucagauggugaaaagccugaagcguuuggaguugcggagacggguggggagcgacaaacaggagagagacaugacuagagucaugcacuacaaaguugucuuacguacguauccauuaguaagcauugcuaaaggcauccaugucucagucacuaauagccauuuuccuuuuuuguaguuauuaagaaauuuaugauucaggguggagacuucucaaaucagaaugggacagguggagaaaguauuuauggugaaaaauuugaagaugaaaauuuccauuacaagguaaaguagagaaaaugcauguuauugcugauaaaaagauuguuauauaucuggaauacuuguuggauuaagacaccaaaaaauguuucaagugugcuuagauucuccauuucuuguaauaggaaucacuuuuguaaauaaugguucuuuaauauggaaaaguuuucauucaguaaugauuaauucagcauuauuucauugugauccaguuuuuauaugcuucaguuaagccagugaguuuuuaaaugcgaccagcaucuggcaaaauuguuuccaggaaaaauguuuccauuguuggaaggaugguaacuugugcauccuuauccuugaauuugaagagcaacaaaaccaucacuaauauccaggaugucaggggauuugcacacuagcagauauaguuaaauguccaagcuccuaaaggacuucaguggugccugugccuucuugucuucguugucccaagauguaauugggguauauugcaucauucaaguuauaagaauggacauguaaguacaaaaguaaagugauauuuuuggaaauaaggaauaugagcaaggguauuaggauaauuugaaaaaaugucgucagucuuccagucaguguuuauugagccacuaucacuggcaccaaaggguuuauaaaaaugaaaggccuugaugacaaggaauuuauaauccuaccucagagacaagauuaagauacaugggacuacuggagaauaauaguauauaaauaaaugcuaaauugauugaauauccuugcuuguauaacauugcuaauacugucuauauacugcaggagaaagaugugauuuaugcagucugaauuauuauggaagucauugaggaggaauggcuacuugggcugugcagacugggucuugcaaggcggcaacaugucugagauuugguuaggcaggaacuguaguauugaugcagaauuuaaaaagggacgucggugaggaaagacaaaggcaagagacguugaggaaauaaaguucuaguuacuguuguaccaaaggaagcuaccagaaggaugaaaacuaaaggugaugugaugaucacauugacauagagaaaaggggccuauagacaagacacaugauucuugcuuucuauaaacgugguggccuuaaaaucugaauuugauuuagacugaggggaguaaaaggcauuuuggugggguggggggugucaugaaacauuauauaacaugagaguuacggugcaugcaccaacaaggaauacauuuagaaagccuaggagauaaagugaaaagguuaagaaauuggguuucauagauccuuugacaggauuaugccaagguagaauuuugauuucaagauguaugcagcaguuucuuuugagcacucuccgaagaggugauucaucugggaugaaaaccuaauccaaauccuguaugauuuggauucuuuugagauuaggaaaguaccaaacugaaugucuuggguaaauucaguaucccauuauuguuccaguuuauugauguuuuguaaaggaagacuuauacuguaggcauauuuaugaauuuggaagaccguucaggucuucccagaaaaaaagagcauucaucauaaagagggcaaaauauauuacaagaguuucauaaugcugcaucuucauuuuaaaggugaaguguaaguauuuucucauggccaauuuagaaauaacccuccccccgacuauuguuucuguuaccuauuuacuuugauaagguuuuuuaaaguuuaaagugauuaagugccccauguuuugugaauuaaagguugcaguuuauaaaaaaauaaaaaguaauuaaaaaauuuuauaagugaaaaguaaaaaaaaguaguuugaucuaaaugguaguauagugcaccccaguuuuauguucaguaaaagaacaguucagacuaacacacaauucagaaaagaacacaucuaaccuugguuuucuuuuaauuuuuauuucuacagcaugaucgggaggguuuacugagcauggcaaaugcaggccgcaacacaaacgguucucaguuuuuuaucacaacaguuccaacuccucauuuggaugggaaacaugugguguuuggccaaguaauuaaaggaauaggaguggcaaggauauuggaaaauguggaagugaaaggugaaaaaccugcuaaaguaaguaaaaaguuacagugaaauacacuuauuaucuuaguugcuaucuuuuugagacggagucucgaucuguuccaggcuggagugcaguggugcggucucggcucacugcagccucugucucccagguucaagcuauucuccugccucagccuucugaguagcagggauuacaggcgcgcgcuacaacacccggcuaauuuuuucuguauuuuuaauagagacgggguuucaccauguuggccaggcuggucucaaacuccugaccuugugauccgcccaccucggccucccaaagugcugggauuacaggcaugagccaccgcacccagccuguuaguugcuaucuuaaagaaauauaaguaaaaggaucaggugauuauuagcuggaaaaauguuauaauaauuuuggguauaggagccaggaucugccacuuuuuuuuuuuuuuuuuaacuuuucuacaaugggaaagacaauuaggguaguuuuaaaggagauuuuuauuauuucaacuuucauuuggugaucuuugcuaguuuacguuaagucuuccuauaccugcaaaacuguucaguugguauguauaguaguacauaguggaaugaggauaauaagcccaaaaucuugucuggauuguagcauuaacuagaggcuuggccuugacuuuguuacuuaacuuuuccacacguguuuucuccugucuaaauuacuuauggguuuagacuagauuaucucugaagacccuuguguacuuaaugucugugaaucaaaaugaccuuaauauuggcugggcaugguagcucaugcuuguaaucccagcacuuugggaggcugaggugggaggaucacuugagaccaggaguuggaaaccagcuuuggcaacauagugagaugcugucucuauuaaaaaaaaaagaaaaaaagaaaaaccccuaaacgaccauaauacuacccagccuaagugacaggguugugagugggaguuggaagcucaguuacuuguaggagguaggcugucacucaguguaugacaagaauaguaguaaaccggaagcucaugccccaccuaaugccacuuacauagacaaugauaaaauugccaacuuauucuguguuuauugagcuccugaauagcaauaaaaugcuuauguaaauacuaacauugucguauuaguuggaauguauaaaaacagcauuauaguacauaaaugagccuucucacauaaaucugugaauuggacagugcugcacaugacuucagcuguauagcuuuuaucucucauuauuacgauagugcacuucuacaauuuaggguuauuuuuacaguugugcguuauugcagaauguggagaauugaaggaaggagaugacgggggaauauucccaaaagauggcucuggcgacagucauccagauuucccugaggaugcggauauagauuuaaaagaugugaguacuuucagauuagucaaacuuuaauuaauuuaguaagugaaaauauuuaguacuaaaaguuugagcuuuuguuucagucucucauaugauagaaucuagcauuaaaccacauuacuuacuaaaauccaacauauuuguauuuuuuuauacagguagauaaaauuuuauuaauaacagaagacuuaaaaaacauu

SEQ ID NO: 14295 - RNA, 12645 nt, Homo sapiens
gggcccgcgugccccgcagccgccacgcgccccgcaguccgugccgaggcucccgcccgagugcgcgcgggccggcgguggcgugugcgcacgucauaugggccgccggccucccauugguugcggccgccucaccagaccgcgugcggacgggcucgcgggcggggcggggcaagcucaggccacgccccugggcggugcgcgcgggcgguggguaggccgggcaggcucacgugaugcgggccccgcggcccgccauauaaacccgcgcgcccgccaggcgcugcggccgucccgggccgugacuccuccuuucccccgccccgccuccguucggagagccggcgggcgggcgccucucggccagguacgcggccggcugggauaggggucgcgggcgggcuuuggucgcgcagcagccgguccuccccggagguaggcgggcgcgggcccuguugggucuuugggacgcgggucccgcuggggccggggaugcugcucgcugugagcgcgggucccguccgccgcuggccccgggcgggcgcacgggggucuaaccuuggggggcggcgcugccgccuggcccgggugccgggguucgcgucccgcggggccuuccucgcucuuugucucuucugagugaacuugaugacccccuucuuccaggaagcgccucuuggacgcgugugaccgaugcccagauugcacgaccacuucuggagcugcuccugugcgcacagcgcgaggcgccgaggccccccgcgagccagcgccgcggggcuggcggccaagguuggggagaugaucaacguuuccguguccgggcccucccugcuggcggcccacggugccccggacgcugaccccgcgcccaggggccgcagugcugcgaugagcggccccgagcccggcagccccuaccccaacaccuggcaucaucgccuguugcagaggagccucgugcucuucucgguuggggugguccuagcccuggugcucaaccugcugcagauccagaggaaugucacucucuuccccgaggaggugaucgccaccaucuuuuccuccgccuggugggucccucccugcugcgggacagcagcuggugaguaccccuccugguucuucuggaaguaaaaagggugucuuuucgguugaaaguacuuuucagccuauaagaaacaugcauuugaaacuggaacuauccacagauugaaagugugcaucuccagucuugggauuuagagaaaugaaggagggguagagaggaccuggcacccccgagggcggguucgggccacagcucucugaaguuugaggaagcacagugauggagaugaggcagggagauaauuggcuguucaagcaggugcugugccaagcugacugagggcccuucccuccuggcguccggguacagccccagcugucaucccgcgccagccgccccggauuggccgccuggggaacuggugagcagcgggacugaaaggccauuggucgcggcagcaaacaugcuacccugcuggauaacugaaaacaaacccgucacauggguucaggaggcgguugccaggggagcaacuucucagcacuuccuuuugccgggucgcugaguaaacuguggucugaagccaaaccgccuacacccugaacuguuagagcucuguagauuacguucuuaaggaaaagaguaacccccuuacggcguuuagauuuucguacacccaagcaguagcauagaugcuguacaacguaacacugagucagucugaacuguggacacggggacugcuggguguguguacuagacuuucuuggcuaucauugaaccgcuuuuauagaaauguugaguugaucuuggcucagcagaucacuuacugcuccuguagucacacagcauuuguuuauuuaacgagcuugucgggugcuuucugcaaccucaacucuauaagcuguugaaauguuaauccaaaagugagcaccacaagccccuauccuuaagcagcuuagagucugguggggaaaacaaaccaguaugucagugacuccagugcagugcagggagcauccuguuugcuuuguggcugacguuugucagcugacugcugaccauaggcuucagaugcuuugcuguguucauuccuuacagcaauaccauguguagcuucauuuauagauguggcaacugaaucacaggugaagucacauccaagggugcgcagguagaaaggggccaagccaucguugguaacugcuccugcugccuugguaggugugucuccugcacuguggaaacacauugccucaguugacucacugaaaacagcaagcagcagagagguuuguagcagauuaacagagggcuccguguugaagaacuaggacaggugucuguaauuauuaaguaguggguagaauguuuucauauuuguucucggagggacgggauccucuuucguuuuucgaaacacuuuauguggcuguacuaauugaacauuuuuugagaacuauaucuagauuuaaaauuccauguuucauauacauuuggcagaauaguuucuuuccuuuaaccaaaaacuugaucuuagaaaugaaauaguuuagccuucaguauuuguaauuggauccucaaggguuucuaggaauaucuggacaauuucucauacucucauauucuacuuuuuuuuaaaccaucagccaagagcauaaguaaaauuuuucauaguauguuuuuuaccuauuuauuuauuaagcuauagugaaguaaaguuaauuugggggguccauuuuucagaacuccaaaauuagaaccugaugaaguauaauaaauugaaaacaacauuuuuuaucugaauguuugaugcaaacuguguuucuuguuucucaguugaaccuaaaauguauauuucuuucauacuacacugaggugaaacaauugcaggguucucaagagcccugggacacagugacccuugugucccagcauccaaccccacgggccggcaccccacuccccccuacagacauucauuccugccuucaucuuugccauuuuacuucucuuuuggaaugccauuccuucccaccuguccaaauuccaaguucgugucuauaaagaauaacuauuccagaccacagugaucucuuucucugugucccaguuacauaauccuuauaauuuuacacaugagaaaacaaacaugcagagccacgucccaucagagggcaagcugggauuugaggcugaguuuucucuucuuggucugguguucuuuccgcagcuugaggcuugaccaugcgggaaccagauggagaauaagcgaagccuguguggggcugucucgccccguacuugcccaugugcaugugugcacaguaggugcucagugccucguacagaacaugcuagaacccccgaaaaucaacuccagggccacucuaggagcaugugacccagacugucaaagucacaucagcaaauauguaucucaucacgugcccagccccaguacugggugguggcaggagugucagagcugugaugugacaggguguggacagaugcuaaccuuuuuauuguaagauagaaaucacaccggaugaaaagacaaggugaacuacauagucauuuaaguucugugugcuuuaggcaaauguggauauuaaauauaagguuacauauugcucauauuaauaugaauaaucccugcuugauuccuuccuguguuuacugagacauguucaacuacacuaaauaauagugauuuuuaaaaaacuuuuccaaacaguacaauuuugugggagugguacucaaagagaacaagaauauaaaaucacucugaaguuauagcugauaauuuuuucuaggaaaaggacugguuugaguaauguacuguguuacuaaugaccacguugaaauucuggaacuugaaucugcuguauucuaacauugucaacuuuuuuaaaacagcuguuguuggccuacuguaccccuguaucgacagucaccucggagaaccccacaaauuuaagagagaaugggccagugucaugcgcugcauagcaguuuuuguuggcauuaaccacgccagugcuguauccuuaauuuucugugcuacguccagaguaucuucuuagguuauauauugaagcguuuuguuuuguuauauacucaaaugacuccaugucauaauacagacaugauggugguaccuacccauuucagauuacuaaaaagagaaagaagaauggggcuaucgaugacuucauaguaaaauauauuguuuuauggucaaaauaaauauauauuuauuuauauuuuuauauauauuauauauauuuuuaaauauauauaauauauauaauaaauauauauuuauauaaauauauauaagcacuuuauauauagcuuucagcaaguuuauucuuaugguuaaguuuuugacucagugauggcagggagauuucaggugaucuuaaugauuacuguaaccuguauccaacaaauccuuucuuuagcuuauuacacaguuuuuauggacagugaauuaucugugguacaauaauaaaauacccauguuuuuaacccuugugguuuuacguuuuuuuaucuuaauaagagucagcaaacuuuuccuuaacuuuuauaucaccagaaauuggauuuugccaauaauguccagcuguccuugacuuuagcagcccuaucuuugggccuuugguggacauuugaucguuccagaaguggccuugggcuggggaucaccauagcuuuucuagcuacgcugaucacgcaguuucucguguauaauggugucuaucaguaaguguguguuuucaaauauuggcuuuggaaagcuuacuuaacuuucauuaaaacauccacuaagcuuagauauuuucauauuuuauuuguuuuuuauauagaaugauacagauuuaggcaugaaauucucaaaaaugcugcuauccauaacuuaauguaacgcaaaggaaaaccaaguaguagcaguuacaaccaaacaaauaugaacauucguaacauuggaugguugauaugcguucugcauauccccacuacagagaaucugugauguagaauugagccaggugaaauugacugcuaagguacaguuucuuuucucgcuccagguauacauccccagauuuccucuauauucguucuuggcucccuuguauauuuuucucaggaggcgucacgguggggaacauaggacgacaguuagcuaugguaagugaaaugaucauauuaucuucuaaaacuugcgucucuuuaccuugauagaaugacuuuacaugauacauucaaauuugcguucauauauucugguucagacuugagugacaacuacugagaaaagcuuauauuuaaaaaaauagguaaugauacccagguaauucuuugcuaaauuauaaaaauucauaauauuugaucuagaaaaggaacuagagcccucgcacugccccuuugaauugcagauguggucaguguucugaauucuugaaauuucuguaguaagcaguagagaaagugacuggugugugaguguccccuccuccuucaccaucggaagcagaucuggaugaccucaugcagugauacuuugcucccugagcaucaguccaccaguguuucuuuucacaaaaucagaguggaugcagaugaugcuggccucuuaguccacagucaagcaaaucgagccugaggcugcagagucugucucgggccagggcagggacuaaugugggugggcaaggggacagccugguucaggcaggcagcaccuuucuguggggcagguggcccugggcauggagaaguggugaugagagcaccgcugcacguggccgggucaccauguagacggacuguccugccugaacauugcaucuguucucagcugcaggagaaagcagugcuaccccgcagagcuucucucacagccccccugagggagacggaaagguagugaacuccaggauggcuuuagcaguucucauuaguuaaaaauugacaucuuagcacuucaauuuaaaaacauagagguggacuuuuaaauguuauuuugaguugacuuuggcaggcugaaagaaaguaaauuaaaaaaaacaacaaaaaccuagagcuguugcucucggagauaagcucugggaaaacuuaucuuaguaccucaugcuauuuuuaaaacaguacauuuauuuuugccagcugauacccuucugugaggaguugaauuugaagaccacuuggcuguuucacaaaaccagaaguaauuacagguagaauuugcagucuuccacugguuacugacucucugcugccaaauuucucaugauggagaagaaaggacuuugcuugccuuuuuuuuuuuuuuuuuuuuuugagacagagcucuggagugcaguggugccaucauagcucacuguaaccuugagcucccggacucaagcaauccucccgcuucagcgucccgaguagcugggauuacaggcacaugccaccauacccggcuaacuuuuuugcuuuuuguggagauguuaucucccugccuuguccaggccgggcucgaacucgugggcucaagccauccucccaccuuggccucccaaagcacugggauuauaggcgugagccuggccuugcuuuuuuuaauauuaaaaaucuggucggauggucccacauggaaauaguauguuguuuucaugcauucgccaucauccccguuaauagucuucaaaggagagcuggcaacuccaucauugcuuucuugcuuugagauuuuuguuucgguacucuuugggagagaauuccuaagaagguuuuuagaauaaaauuguccucaaccagauugacuaauuacacauuauaacuacaacuugaauaacauuuaaagaguugguuauuucuguuugauagguuggugcuguuauaugucaaggcuuuuuaaaucgguuuuaagaaauaagcauuauuuugguggagguagaaauuucacaacauucauaaguucuaaacaucuagaaaugguuggaggaaacauuuucguuuugaagauaguuucauuaaguaaucccugcugugcuccuuugcuuacagaaaaaaauguuaaagauaacucaaaauaggauaguugguguaauuauaauucuccuuacuucagcuuucucuucauccuuuuuauucuuuaagcuugggggaaaauguuuggauguucucguaucuuaaaacuggaggagagaggcugggcgcgguggcucacgccuuuaaucccagcacuuugggaggcugaggcgggcggaucacgaggucaggagaucgagaccauccuggcuaacacagugaaaccccgucuguacuaaaaauacaaaaaaaaaaaaaaaauagccaggcgugguggugggcaccuguagucccagcugcuugggaugcugaggcaggagaauggcgugaacccgggaggcagagcuugcaaugagccgagauugugccacugcauuccagccugggugacagagcaagacucugucucaaaaaaaaaaaaaaaaacuggagaagagagaucaccaccuuaauccccuucccugcugggcuaucacaugaaacugaccucugagguucuaagccuaacccgccuaccacuguuuuuauucauaaauacuuaaauccuuaccucuggaucccaacuguuacucuuuuuuucacuucaaaauuugcaaacucauuucuauccaucaaaccccggaaauggcccaggggcuucacagugcaguccccucccuccugcugcauccguuccucaggcugugccccagguugcauucguggugcguguuuucucccagggcagccuuccccacauuccacucuugucauacuguugacucacaaaauggaaguggcugaauguuccagggauagugucuaagagcuauugguuuaagguugaaaccuacaccaaguaaggcuuugugaagggagaugacgagagugaaguuguugacagucugaaggugaagagauuccgaggcucaguucagcaccgggaccagacccgcccagauccaggguaauuugaggucuguguuuggugcugaugguuuugcccagugcacuccacacccucuccuucuuagcugucucaguucucuucagaugccuuuguucuaacuuaugcuucccucccuuaagaagaaacauaguuacuugcaagaauaaccaugcucaaaaguuacaaguuggcuuugcuucaaguuauauggucuccuagcuuuuucuaugugguauuuccccccacacaugccguuguccuuuguguccgaaaauacagcagaaacauuuguuaucagccuguuacgguuuuuuuguuugcuuuuuguuuguuuuuauuuuuacuuuuuuugagacggagucuugcuuugucacccagacuaaagugcaguggcacaaucuuggcucacugcauuugaaccgucucccagguucaaaugauuauccugccucagccucccaaguagcugggaucacaggcgcccaccaccgcaccuggcuaauuuuucuguuuuuaguagagacgggguuucgccacguuggccaggcuggucucgaacuccugaccucaggugauccaccugccucugccucccaaagugcugggauuacaggcaugagccaccgcgcccggcccagccuguauguuuaaaagaaaaugagucuguaaccaucauuuauagaacuuguaguuguugcuguuuguagcuucaaguccuuucucaagaguaagcugcaaacugccaacagcaaucaagccuguccugcugccacugcccggccccacugggccaccuggaggcagagucccgcccaccucagugucagcuugggauuugauuugccguuccuguuuuugauugacccaauucagcugcuaaugauaauaauacuauuauuguuauugaggguuuacauuuguugggcucuuacugcugcacaggaggcauugugcugagcguuuccauuguuagccaguuuaguccucauaacacaagucuuugaaguagaaacuauuauuagcccauuuuuaaaaggggaaauugcagcuuaggaagauuaaacaacuuggccaaguggguggcagaggucgacguggcaccgugcuucucauuagcauaccacacugcccuuucaacacauagcucgcaccugccuucacccuggaagcagguuuacagcagccuguguuggugucuggguugccauuuacaaugugccaccauuaggcaacacugcuggaagucccugugccacgugucagguccgcccgggcuggcugucguucgucucuggcgucuuugccaggccucacuguggccucugucgaccagggauucuaaaaguccacuucccauuuauuuaucagcacauuagugaacagggagucaaaugugaugaccaguuuucuuuccagguugcugccaagaguuugcucuuuuguuuucucaccgcaguuuguauagaacccucccaguguucauaucuaaaaauuggcagugcuuucacaugaucaauuccuaaaagcauguauguuuccuagaaggucuuauuguguguguccccaggguaguaacuggcauaccugggugacucaacccagacucaugacuuucuuaccugucuguucagaugagaggcucuugcuguuuucuggaugaguaaucuccgucauugcugaaggugaggagcucagcuccuuccucuuaaagugaguggagggcaauuaaguaacgugggaagucacgauucugagggaaaaaaauucuguauggagguuucucuuuugcccuuuagcagaagcuccguggccucaggaaggucauuuaaucucucuggcuuugcuucuucaucagugaaauacuguucuccauuaagaauuuacccugaggugccuggucauaguaguaacuguagugucuaccucucagaagcucugugagggucagaugaggaagaacauguagaaaggauuucccaacugugaagcucugugugaauugagggcacacagagcuucaguauuacaaagcaugaccuauuuccaaugucuguuucaacaaacugcugguaagguggguuauaacacaggcaucagauacuaauaaagguuuguggcagaaaccucccuucagauaaagguucaaucccuuaaauugcaguuagaacuuucaggaaccuaucauacccuaagcaucaccaugcuuugauaaaauuggguguuuccuuuauauagauauuaauuuaguuaaacuuucaccaauaucuuacacuuauauaacaggcuuuauauaagggccucagcagcguaauuucaccugaggcagagaauuauccuaauuuugcaggugagagcuguggcucacggggccagagccaugaagacggugcaggggagcugggagagcuggccucggucuccaguucucugcacaugucccaccucucaaucuuguugcuucagucaaagaaagugucaaucuuucccauguuaggaccuacuuaauugguaauuaaaauauuuauacauuuagugcuaauuuucucuuuccuuuuuuuuuuccuuucuacacauaggguguuccugaaaagccccauagugauugagucuucaaaaccaccgauucugagagcaaggaagauuuuggaagaaaaucugacuguggauuaugacaaagauuaucuuuuuucuuaaguaaucuauuuagaucgggcugacuguacaaaugacuccuggaaaaaacucuucaccuagucuagaauagggagguggagaaugaugacuuacccugaagucuucccuugacugcccgcacuggcgccugucugugcccuggagcauucugcccaggcuacguggguucaggcagguggcagcuucccaaguauucgauuucauucaugugauuaaaacaaguugccauauuucaaagccuugaacuaagacucaauuaccaacccgcaguuuugugucagugcccaaaggagguagguugauggugcuuaacaaacaugaaguaugguguaauaggaauaauauuuauccaaaagauuuuuaaaaauagggcuguguuuaaaaaaaaaaacaaaacaagaaaagcagcagugauuauagagaggucacacucuaaguggggucgcggcguggccacgcuucacggucacgcucguccguccugcaguggcguguuuacauggucacacguguguguaucaccagugggucaacugcuugucauuccucccguggcaguuuguguagacaaucuuacugagcaaaaggcaaugaaaagucuugguucccacacugcgauauauuggaauuuucaccucaguuuaugaaguuuauuucgaaauccauagucaucuaagaaugaauaccugucugccauguauuucaaucuuagugagccaaaauuguuuguuuguuacuacagaauagagaugacuguuuuuugccacagcccuauggaauuugcaaucugugauugccuuguaaaaaggagagugcauauggcacugcauuaaacgugugguguuucuagucaaugauauuggugagcacaauguauucauuuaauggcauagaccauaccagaccuaauuugcaaguauugggucuuaaacuucaagugcaauguauaugaaaaccaaucugagccuuguaucucuuaaauauuuauuuuuuuuaacgugugagauguucgagagaagguucuccauucauuucagugcugccuggaggaaacucggcaaugauuucuuucaguugugaaguuccuuucguguuacacccuccacugaacccucaaccuucgaaauacuccaguuuuguggguuuggucauuuuuacuuauaaauuuaccuuuuuguauuuugcaauuuacauguguuugguuuguuuuaaauucugugaaaguggcuugauuaaaagacuccuuuuaaauggaagccaccagucagcagaauggaagcuuagaggaacuugccugugagcgcuggucuuuguguuugguuuugugauguaacgaucuuugcugggguuuuuugcuuuguuuugagggaaaugucuuggaguaaauuuuaaguuccuggaguuaauuuguuuuacaggaauuuuguuuuuuaaaaaaauaggaucauucugaacuuuggaaugacccccuuauauauuuucugaaaaugaaaacaguuacaugaaaaaaauuuccaaugaagaugucagcauuuuaugaaaaaccagaaguuauuagaugaaagcagcgagugaaucuuuaaaacagacuugaucacgcacacacaauaagucuuucucuccgaaaccggaaguaaaucuauaucuguuagaaauaauguagccaaaagaauguaaauuugaggauuuuuuugccaauaguuuauagaaaauauaugaaccaaagugauuugaguuuguaaaaauguaaaauaguaugaacaaaauuugcacucuaccagauuugaacaucuagugagguucacauucauacuaaguuuucaacauuguguucuuuuugcauucauuuuuuacuuuuauuaaagguucaaaaccaagu

SEQ ID NO: 14296 - RNA, 12645 nt, Homo sapiens
acuugguuuugaaccuuuaauaaaaguaaaaaaugaaugcaaaaagaacacaauguugaaaacuuaguaugaaugugaaccucacuagauguucaaaucugguagagugcaaauuuuguucauacuauuuuacauuuuuacaaacucaaaucacuuugguucauauauuuucuauaaacuauuggcaaaaaaauccucaaauuuacauucuuuuggcuacauuauuucuaacagauauagauuuacuuccgguuucggagagaaagacuuauugugugugcgugaucaagucuguuuuaaagauucacucgcugcuuucaucuaauaacuucugguuuuucauaaaaugcugacaucuucauuggaaauuuuuuucauguaacuguuuucauuuucagaaaauauauaagggggucauuccaaaguucagaaugauccuauuuuuuuaaaaaacaaaauuccuguaaaacaaauuaacuccaggaacuuaaaauuuacuccaagacauuucccucaaaacaaagcaaaaaaccccagcaaagaucguuacaucacaaaaccaaacacaaagaccagcgcucacaggcaaguuccucuaagcuuccauucugcugacugguggcuuccauuuaaaaggagucuuuuaaucaagccacuuucacagaauuuaaaacaaaccaaacacauguaaauugcaaaauacaaaaagguaaauuuauaaguaaaaaugaccaaacccacaaaacuggaguauuucgaagguugaggguucaguggaggguguaacacgaaaggaacuucacaacugaaagaaaucauugccgaguuuccuccaggcagcacugaaaugaauggagaaccuucucucgaacaucucacacguuaaaaaaaauaaauauuuaagagauacaaggcucagauugguuuucauauacauugcacuugaaguuuaagacccaauacuugcaaauuaggucugguauggucuaugccauuaaaugaauacauugugcucaccaauaucauugacuagaaacaccacacguuuaaugcagugccauaugcacucuccuuuuuacaaggcaaucacagauugcaaauuccauagggcuguggcaaaaaacagucaucucuauucuguaguaacaaacaaacaauuuuggcucacuaagauugaaauacauggcagacagguauucauucuuagaugacuauggauuucgaaauaaacuucauaaacugaggugaaaauuccaauauaucgcagugugggaaccaagacuuuucauugccuuuugcucaguaagauugucuacacaaacugccacgggaggaaugacaagcaguugacccacuggugauacacacacgugugaccauguaaacacgccacugcaggacggacgagcgugaccgugaagcguggccacgccgcgaccccacuuagagugugaccucucuauaaucacugcugcuuuucuuguuuuguuuuuuuuuuuaaacacagcccuauuuuuaaaaaucuuuuggauaaauauuauuccuauuacaccauacuucauguuuguuaagcaccaucaaccuaccuccuuugggcacugacacaaaacugcggguugguaauugagucuuaguucaaggcuuugaaauauggcaacuuguuuuaaucacaugaaugaaaucgaauacuugggaagcugccaccugccugaacccacguagccugggcagaaugcuccagggcacagacaggcgccagugcgggcagucaagggaagacuucaggguaagucaucauucuccaccucccuauucuagacuaggugaagaguuuuuuccaggagucauuuguacagucagcccgaucuaaauagauuacuuaagaaaaaagauaaucuuugucauaauccacagucagauuuucuuccaaaaucuuccuugcucucagaaucggugguuuugaagacucaaucacuauggggcuuuucaggaacacccuauguguagaaaggaaaaaaaaaaggaaagagaaaauuagcacuaaauguauaaauauuuuaauuaccaauuaaguagguccuaacaugggaaagauugacacuuucuuugacugaagcaacaagauugagaggugggacaugugcagagaacuggagaccgaggccagcucucccagcuccccugcaccgucuucauggcucuggccccgugagccacagcucucaccugcaaaauuaggauaauucucugccucaggugaaauuacgcugcugaggcccuuauauaaagccuguuauauaaguguaagauauuggugaaaguuuaacuaaauuaauaucuauauaaaggaaacacccaauuuuaucaaagcauggugaugcuuaggguaugauagguuccugaaaguucuaacugcaauuuaagggauugaaccuuuaucugaagggagguuucugccacaaaccuuuauuaguaucugaugccuguguuauaacccaccuuaccagcaguuuguugaaacagacauuggaaauaggucaugcuuuguaauacugaagcucugugugcccucaauucacacagagcuucacaguugggaaauccuuucuacauguucuuccucaucugacccucacagagcuucugagagguagacacuacaguuacuacuaugaccaggcaccucaggguaaauucuuaauggagaacaguauuucacugaugaagaagcaaagccagagagauuaaaugaccuuccugaggccacggagcuucugcuaaagggcaaaagagaaaccuccauacagaauuuuuuucccucagaaucgugacuucccacguuacuuaauugcccuccacucacuuuaagaggaaggagcugagcuccucaccuucagcaaugacggagauuacucauccagaaaacagcaagagccucucaucugaacagacagguaagaaagucaugagucuggguugagucacccagguaugccaguuacuacccuggggacacacacaauaagaccuucuaggaaacauacaugcuuuuaggaauugaucaugugaaagcacugccaauuuuuagauaugaacacugggaggguucuauacaaacugcggugagaaaacaaaagagcaaacucuuggcagcaaccuggaaagaaaacuggucaucacauuugacucccuguucacuaaugugcugauaaauaaaugggaaguggacuuuuagaaucccuggucgacagaggccacagugaggccuggcaaagacgccagagacgaacgacagccagcccgggcggaccugacacguggcacagggacuuccagcaguguugccuaaugguggcacauuguaaauggcaacccagacaccaacacaggcugcuguaaaccugcuuccagggugaaggcaggugcgagcuauguguugaaagggcagugugguaugcuaaugagaagcacggugccacgucgaccucugccacccacuuggccaaguuguuuaaucuuccuaagcugcaauuuccccuuuuaaaaaugggcuaauaauaguuucuacuucaaagacuuguguuaugaggacuaaacuggcuaacaauggaaacgcucagcacaaugccuccugugcagcaguaagagcccaacaaauguaaacccucaauaacaauaauaguauuauuaucauuagcagcugaauugggucaaucaaaaacaggaacggcaaaucaaaucccaagcugacacugaggugggcgggacucugccuccagguggcccaguggggccgggcaguggcagcaggacaggcuugauugcuguuggcaguuugcagcuuacucuugagaaaggacuugaagcuacaaacagcaacaacuacaaguucuauaaaugaugguuacagacucauuuucuuuuaaacauacaggcugggccgggcgcgguggcucaugccuguaaucccagcacuuugggaggcagaggcagguggaucaccugaggucaggaguucgagaccagccuggccaacguggcgaaaccccgucucuacuaaaaacagaaaaauuagccaggugcgguggugggcgccugugaucccagcuacuugggaggcugaggcaggauaaucauuugaaccugggagacgguucaaaugcagugagccaagauugugccacugcacuuuagucugggugacaaagcaagacuccgucucaaaaaaaguaaaaauaaaaacaaacaaaaagcaaacaaaaaaaccguaacaggcugauaacaaauguuucugcuguauuuucggacacaaaggacaacggcauguguggggggaaauaccacauagaaaaagcuaggagaccauauaacuugaagcaaagccaacuuguaacuuuugagcaugguuauucuugcaaguaacuauguuucuucuuaagggagggaagcauaaguuagaacaaaggcaucugaagagaacugagacagcuaagaaggagaggguguggagugcacugggcaaaaccaucagcaccaaacacagaccucaaauuacccuggaucugggcgggucuggucccggugcugaacugagccucggaaucucuucaccuucagacugucaacaacuucacucucgucaucucccuucacaaagccuuacuugguguagguuucaaccuuaaaccaauagcucuuagacacuaucccuggaacauucagccacuuccauuuugugagucaacaguaugacaagaguggaauguggggaaggcugcccugggagaaaacacgcaccacgaaugcaaccuggggcacagccugaggaacggaugcagcaggagggaggggacugcacugugaagccccugggccauuuccgggguuugauggauagaaaugaguuugcaaauuuugaagugaaaaaaagaguaacaguugggauccagagguaaggauuuaaguauuuaugaauaaaaacagugguaggcggguuaggcuuagaaccucagaggucaguuucaugugauagcccagcagggaaggggauuaagguggugaucucucuucuccaguuuuuuuuuuuuuuuuugagacagagucuugcucugucacccaggcuggaaugcaguggcacaaucucggcucauugcaagcucugccucccggguucacgccauucuccugccucagcaucccaagcagcugggacuacaggugcccaccaccacgccuggcuauuuuuuuuuuuuuuuuguauuuuuaguacagacgggguuucacuguguuagccaggauggucucgaucuccugaccucgugauccgcccgccucagccucccaaagugcugggauuaaaggcgugagccaccgcgcccagccucucuccuccaguuuuaagauacgagaacauccaaacauuuucccccaagcuuaaagaauaaaaaggaugaagagaaagcugaaguaaggagaauuauaauuacaccaacuauccuauuuugaguuaucuuuaacauuuuuuucuguaagcaaaggagcacagcagggauuacuuaaugaaacuaucuucaaaacgaaaauguuuccuccaaccauuucuagauguuuagaacuuaugaauguugugaaauuucuaccuccaccaaaauaaugcuuauuucuuaaaaccgauuuaaaaagccuugacauauaacagcaccaaccuaucaaacagaaauaaccaacucuuuaaauguuauucaaguuguaguuauaauguguaauuagucaaucugguugaggacaauuuuauucuaaaaaccuucuuaggaauucucucccaaagaguaccgaaacaaaaaucucaaagcaagaaagcaaugauggaguugccagcucuccuuugaagacuauuaacggggaugauggcgaaugcaugaaaacaacauacuauuuccaugugggaccauccgaccagauuuuuaauauuaaaaaaagcaaggccaggcucacgccuauaaucccagugcuuugggaggccaaggugggaggauggcuugagcccacgaguucgagcccggccuggacaaggcagggagauaacaucuccacaaaaagcaaaaaaguuagccggguaugguggcaugugccuguaaucccagcuacucgggacgcugaagcgggaggauugcuugaguccgggagcucaagguuacagugagcuaugauggcaccacugcacuccagagcucugucucaaaaaaaaaaaaaaaaaaaaaaggcaagcaaaguccuuucuucuccaucaugagaaauuuggcagcagagagucaguaaccaguggaagacugcaaauucuaccuguaauuacuucugguuuugugaaacagccaaguggucuucaaauucaacuccucacagaaggguaucagcuggcaaaaauaaauguacuguuuuaaaaauagcaugagguacuaagauaaguuuucccagagcuuaucuccgagagcaacagcucuagguuuuuguuguuuuuuuuaauuuacuuucuuucagccugccaaagucaacucaaaauaacauuuaaaaguccaccucuauguuuuuaaauugaagugcuaagaugucaauuuuuaacuaaugagaacugcuaaagccauccuggaguucacuaccuuuccgucucccucaggggggcugugagagaagcucugcgggguagcacugcuuucuccugcagcugagaacagaugcaauguucaggcaggacaguccgucuacauggugacccggccacgugcagcggugcucucaucaccacuucuccaugcccagggccaccugccccacagaaaggugcugccugccugaaccaggcuguccccuugcccacccacauuagucccugcccuggcccgagacagacucugcagccucaggcucgauuugcuugacuguggacuaagaggccagcaucaucugcauccacucugauuuugugaaaagaaacacugguggacugaugcucagggagcaaaguaucacugcaugaggucauccagaucugcuuccgauggugaaggaggaggggacacucacacaccagucacuuucucuacugcuuacuacagaaauuucaagaauucagaacacugaccacaucugcaauucaaaggggcagugcgagggcucuaguuccuuuucuagaucaaauauuaugaauuuuuauaauuuagcaaagaauuaccuggguaucauuaccuauuuuuuuaaauauaagcuuuucucaguaguugucacucaagucugaaccagaauauaugaacgcaaauuugaauguaucauguaaagucauucuaucaagguaaagagacgcaaguuuuagaagauaauaugaucauuucacuuaccauagcuaacugucguccuauguuccccaccgugacgccuccugagaaaaauauacaagggagccaagaacgaauauagaggaaaucuggggauguauaccuggagcgagaaaagaaacuguaccuuagcagucaauuucaccuggcucaauucuacaucacagauucucuguaguggggauaugcagaacgcauaucaaccauccaauguuacgaauguucauauuuguuugguuguaacugcuacuacuugguuuuccuuugcguuacauuaaguuauggauagcagcauuuuugagaauuucaugccuaaaucuguaucauucuauauaaaaaacaaauaaaauaugaaaauaucuaagcuuaguggauguuuuaaugaaaguuaaguaagcuuuccaaagccaauauuugaaaacacacacuuacugauagacaccauuauacacgagaaacugcgugaucagcguagcuagaaaagcuauggugauccccagcccaaggccacuucuggaacgaucaaauguccaccaaaggcccaaagauagggcugcuaaagucaaggacagcuggacauuauuggcaaaauccaauuucuggugauauaaaaguuaaggaaaaguuugcugacucuuauuaagauaaaaaaacguaaaaccacaaggguuaaaaacauggguauuuuauuauuguaccacagauaauucacuguccauaaaaacuguguaauaagcuaaagaaaggauuuguuggauacagguuacaguaaucauuaagaucaccugaaaucucccugccaucacugagucaaaaacuuaaccauaagaauaaacuugcugaaagcuauauauaaagugcuuauauauauuuauauaaauauauauuuauuauauauauuauauauauuuaaaaauauauauaauauauauaaaaauauaaauaaauauauauuuauuuugaccauaaaacaauauauuuuacuaugaagucaucgauagccccauucuucuuucucuuuuuaguaaucugaaauggguagguaccaccaucaugucuguauuaugacauggagucauuugaguauauaacaaaacaaaacgcuucaauauauaaccuaagaagauacucuggacguagcacagaaaauuaaggauacagcacuggcgugguuaaugccaacaaaaacugcuaugcagcgcaugacacuggcccauucucucuuaaauuugugggguucuccgaggugacugucgauacagggguacaguaggccaacaacagcuguuuuaaaaaaguugacaauguuagaauacagcagauucaaguuccagaauuucaacguggucauuaguaacacaguacauuacucaaaccaguccuuuuccuagaaaaaauuaucagcuauaacuucagagugauuuuauauucuuguucucuuugaguaccacucccacaaaauuguacuguuuggaaaaguuuuuuaaaaaucacuauuauuuaguguaguugaacaugucucaguaaacacaggaaggaaucaagcagggauuauucauauuaauaugagcaauauguaaccuuauauuuaauauccacauuugccuaaagcacacagaacuuaaaugacuauguaguucaccuugucuuuucauccggugugauuucuaucuuacaauaaaaagguuagcaucuguccacacccugucacaucacagcucugacacuccugccaccacccaguacuggggcugggcacgugaugagauacauauuugcugaugugacuuugacagucugggucacaugcuccuagaguggcccuggaguugauuuucggggguucuagcauguucuguacgaggcacugagcaccuacugugcacacaugcacaugggcaaguacggggcgagacagccccacacaggcuucgcuuauucuccaucugguucccgcauggucaagccucaagcugcggaaagaacaccagaccaagaagagaaaacucagccucaaaucccagcuugcccucugaugggacguggcucugcauguuuguuuucucauguguaaaauuauaaggauuauguaacugggacacagagaaagagaucacuguggucuggaauaguuauucuuuauagacacgaacuuggaauuuggacaggugggaaggaauggcauuccaaaagagaaguaaaauggcaaagaugaaggcaggaaugaaugucuguaggggggaguggggugccggcccgugggguuggaugcugggacacaagggucacugugucccagggcucuugagaacccugcaauuguuucaccucaguguaguaugaaagaaauauacauuuuagguucaacugagaaacaagaaacacaguuugcaucaaacauucagauaaaaaauguuguuuucaauuuauuauacuucaucagguucuaauuuuggaguucugaaaaauggaccccccaaauuaacuuuacuucacuauagcuuaauaaauaaauagguaaaaaacauacuaugaaaaauuuuacuuaugcucuuggcugaugguuuaaaaaaaaguagaauaugagaguaugagaaauuguccagauauuccuagaaacccuugaggauccaauuacaaauacugaaggcuaaacuauuucauuucuaagaucaaguuuuugguuaaaggaaagaaacuauucugccaaauguauaugaaacauggaauuuuaaaucuagauauaguucucaaaaaauguucaauuaguacagccacauaaaguguuucgaaaaacgaaagaggaucccgucccuccgagaacaaauaugaaaacauucuacccacuacuuaauaauuacagacaccuguccuaguucuucaacacggagcccucuguuaaucugcuacaaaccucucugcugcuugcuguuuucagugagucaacugaggcaauguguuuccacagugcaggagacacaccuaccaaggcagcaggagcaguuaccaacgauggcuuggccccuuucuaccugcgcacccuuggaugugacuucaccugugauucaguugccacaucuauaaaugaagcuacacaugguauugcuguaaggaaugaacacagcaaagcaucugaagccuauggucagcagucagcugacaaacgucagccacaaagcaaacaggaugcucccugcacugcacuggagucacugacauacugguuuguuuuccccaccagacucuaagcugcuuaaggauaggggcuuguggugcucacuuuuggauuaacauuucaacagcuuauagaguugagguugcagaaagcacccgacaagcucguuaaauaaacaaaugcugugugacuacaggagcaguaagugaucugcugagccaagaucaacucaacauuucuauaaaagcgguucaaugauagccaagaaagucuaguacacacacccagcaguccccguguccacaguucagacugacucaguguuacguuguacagcaucuaugcuacugcuuggguguacgaaaaucuaaacgccguaaggggguuacucuuuuccuuaagaacguaaucuacagagcucuaacaguucaggguguaggcgguuuggcuucagaccacaguuuacucagcgacccggcaaaaggaagugcugagaaguugcuccccuggcaaccgccuccugaacccaugugacggguuuguuuucaguuauccagcaggguagcauguuugcugccgcgaccaauggccuuucagucccgcugcucaccaguuccccaggcggccaauccggggcggcuggcgcgggaugacagcuggggcuguacccggacgccaggagggaagggcccucagucagcuuggcacagcaccugcuugaacagccaauuaucucccugccucaucuccaucacugugcuuccucaaacuucagagagcuguggcccgaacccgcccucgggggugccagguccucucuaccccuccuucauuucucuaaaucccaagacuggagaugcacacuuucaaucuguggauaguuccaguuucaaaugcauguuucuuauaggcugaaaaguacuuucaaccgaaaagacacccuuuuuacuuccagaagaaccaggagggguacucaccagcugcugucccgcagcagggagggacccaccaggcggaggaaaagaugguggcgaucaccuccucggggaagagagugacauuccucuggaucugcagcagguugagcaccagggcuaggaccaccccaaccgagaagagcacgaggcuccucugcaacaggcgaugaugccagguguugggguaggggcugccgggcucggggccgcucaucgcagcacugcggccccugggcgcggggucagcguccggggcaccgugggccgccagcagggagggcccggacacggaaacguugaucaucuccccaaccuuggccgccagccccgcggcgcuggcucgcggggggccucggcgccucgcgcugugcgcacaggagcagcuccagaaguggucgugcaaucugggcaucggucacacgcguccaagaggcgcuuccuggaagaagggggucaucaaguucacucagaagagacaaagagcgaggaaggccccgcgggacgcgaaccccggcacccgggccaggcggcagcgccgccccccaagguuagacccccgugcgcccgcccggggccagcggcggacgggacccgcgcucacagcgagcagcauccccggccccagcgggacccgcgucccaaagacccaacagggcccgcgcccgccuaccuccggggaggaccggcugcugcgcgaccaaagcccgcccgcgaccccuaucccagccggccgcguaccuggccgagaggcgcccgcccgccggcucuccgaacggaggcggggcgggggaaaggaggagucacggcccgggacggccgcagcgccuggcgggcgcgcggguuuauauggcgggccgcggggcccgcaucacgugagccugcccggccuacccaccgcccgcgcgcaccgcccaggggcguggccugagcuugccccgccccgcccgcgagcccguccgcacgcggucuggugaggcggccgcaaccaaugggaggccggcggcccauaugacgugcgcacacgccaccgccggcccgcgcgcacucgggcgggagccucggcacggacugcggggcgcguggcggcugcggggcacgcgggccc

SEQ ID NO: 14297 - RNA, 20696 nt, Homo sapiens
uuuugaacuucuaaccaauauuuuaaaaagguaaaaaccucaucaauuucuuuauaacugcacccucuaguggccuguuuuaucuauuaauuuuuuuuuuuuuuuugacagucucacugucaaaagucucacuguccagcccaggcuggaguacagugguacaaucuuggcucacugcagccucuaccuccaggguccaagcaauucuugugccucagccaccucaguagcugcuauuaccagcaugugccaucaugccuggcuaauuuuuauauuuuuaguagagacaggguuuugcccaggcugguuucaaauuccuggccucaagugauccgcccaccuuggccucacaaagugcugggauuacaggggugagccaucacgcucggccauaucuauuaaaaaauuuuaagacaaucauacacaccagccucacugcuuagagaacccuguccagugugccugaccccuuuucccucccuccuucuccucucacccccaagauaguuauuugaaaauggcuugaaauacaaacaauaaaaccuuagaucaaaaaaaaucucaaaauauaauacauuaacagacaaugauauagcucuaccaaacauucacacgcaggcaacagaauaagccuuuggguuuaccaaggacauuuuacagucaaagggccaccugcccuccuuccuucccugacuacauucucagggaagcuuuuccuugcagacacuucguugcaaggucagcuuucucucucagcacguuggcuucgucggcgcuucugugggccugugcguucuuuagcaagaaguggcugaugaaaagcuucaaacccucacguaacacccccagcuuuggguugucagauacucuggaaaggaaucguauaaacacaugucagggcugagcuggccucuccuagaucucaauccuggguaucucgcauagugagacauaaccaguuucuuuuaaaaauaaaauucucaauuaagaacuucuuaacauauuuuauuauuaacaaucauuguuaguuugcuagcagacaaguuucuauuccccagaucuaaugcauaccagcuuaaaaauaaaaccgaaaagauuaagcuacacguauaguacaaccuuguguuuguaaaucaacacaagugaaaacaaucucuucauuucucuuccaugucucgucggaaaggguggggcacauaccuugugaaaauuaaacugaggucuucaacuucuguuuccauuaauaggauacuuaauacuuuucguaaaaaacggacucuggguuuguccaauucacugaauucaacuaccuaauggucaggacauggagaaaaauaaaguuacacugauuuagccaacuuuuucaaugauuuguaauauaguuaauuagaguaaaaauuaaucuccccccuucccccacucuacccgauuuaagaagcuauuuccagagcuaagaaaugaacaccuguuggcaaggaugugggccuugggaauuccuacacacugcuggcagagguguggccggccacagccaccguugagaacaacucagcaguguaaguggaauucccgggucauacaccuuaugaaucagaaauucaguaucuagaacugaaccauaaauuaccuccauucccaaaaguacccauccccuaauuaaaacuauauauauauauauauauauauauauauauauauauauauauauaaaauuuacuucuagaagacuaauccauauauaucucugcccuagaaaacuaucaaaaaaucagaaauaaacacggaucaguaggauaaguaaguauauaaacugaggcauacguauacaguaggaugcuacccagaacagacucacgggcgccaacguggacccacugcaaucuuagcugaaugucagcgagcuagaggaggggacuaaacgcauggugacgggaaugcuacccacagggaggugcgcagccaaacaccaucacaggcgcuugcggacccgaggacgcggcgagaccacaaaagcauggucgaaacacagagaaacucggaaugagagcagcccggaggggcagggcggggggcaucucuaaagcucuacgccugagggugugcuccugccacgccucucccgcucaucggugguagcaucugugcuguuccaggaugagcgcaaugccugggcgagcgaaaggcaaggcaggggagcggagggggagcaacgccuccuccaugagcuaaguuauuccaguugucaggauuuggcguaaggcucggugcccucauuuucaguacaguggccaaacuuggacaccacacagcaagggacgcagggugaacuggagccggcaugcugaugaacugcacacgacacacagaaacacacgggaagcuguggcugcggcugucuugugggucugggccacugcagucaacgccccucaacuaucucugcuuuucacuucccuuugccccccaggcgcuccaguuuuuuuuuuuggcuauucagagucuguuggucccaccauccaagccuuacaggcccacaucuaaccccaacuccaccugguaagaugucuagguuucagcugggcgcacuggcucacaccuguaauauuagcacuuugggaggcugaggagggcagaucacaaggucagggguuccagaccagcuuggccaacauggugaaaucccgucucuauuaaaaauacaaaaauuagcugggcgugguggcaugagccuguaaucccagccacuugggaggcugaggcaggagaaucgcuugaaucccggaggcagagguugcagagauugcaccacugcacuccagccugggugacagagcaacucccaucuuggggggggaagaaaaaagaugucuguguuucaugguccacugcaaagucccaaaacacagcagggcaggagaaagccuacaguuuuaaaacaccuuacaucaacgugagcaaacucaccucaccucuaaggagaccaggcccuacuucauccgcccuucuccucacuaacagugaccaguucaggauuuuauaauuaggaccagcaaauuaaccucaagcuccaaaacacauucauucagauuagcaaaagaacugcagcggugccuucauuuaccagaucaauuuguagcacauguuagucuggccguuuucuguccuggcuaggauaaugcaagcacuuuucagaugaaucagaaucgaagaaaauacgcugguaaaacaggaccugauuuaccagguacuaaacaauuacacucccauuuccauugcuuucaauauuuucacacguuacacgaaccuuuaagauggaaagggaaagcgauuuugucuucaacaagugggccaccagaugaaccaaauuagagaaauucguagcuggcaaguuuuccaagucccgaaauuugucccauaugcugaacuggaaagucaucuaguaucauaguuaaaaggagaaaaaaggcaaacggccacaaauuacuauaauauaucacuaacaacauaaccuaaagguauuuucuuauuaucuuauuuuuaauauucuaaacaucaagacuuuuagugguggccucacuguucuugccuauagagcauagucccaaacagcuucacaagaaucuccuucuggugcaguucuuccccccaaaucagcagauacuaacagaacauucuaaggaaaaggccacagcaaggggcaucagaacagacuggugcacugugaaccgacgaggugcuccugcuggccuggccacacugccugcaucuguggcagaagcaggugacaugaggacaugguggacccuugacacuccccucuagcccucccacuuccgcucccagugaagguggccuggcagccagcguggaccaggugacggggauaucaggggccuccugacuuggggaacuccuuugcagguggguugagccagguagccuguguagaaaaaauaguagagcggacguaacuggugccuccgcacuaagcuaccugaaaucuccuuucauauucacagaauuugcuagccaggaaagcauagaagggauuguaaguuuucucuugaaggcagcaauccaugagaacgugaaugauuucucucuccugcugauccuuaaguccaagccuagaaaacagaacagcaaugacuggaacaucacucgacuuccaaaguuuaauggcugauaccuuucaggggaacaucuucccgccuggaagggucugguuagaggcgagccacguaaaggagguggaggcagcggcagacaccagcuaggggcccagcccugucacaaccucucugguccucagguucuccuacaauguggcaaaaugucagaggagacaagaccaucuagggggucccccgucgcugcaaaagucgacagcugugcccggcugacaauaaacugacucaaucgugugugcccuuagagcugguuccugcuauggcgaugacuucacauuuucuuacuuuuuuuuuugagacagucuugcucugucacccaggcuggagugcaguggcaugacuucagcucacuacaaccuccaucucuccgguucaagugauucuuguaccucagccucccgaguagcuggauuacaggugccaccaccacccccagcuaauuuuuguguuuuuaguagagaugggguuuugccauguuggccaggcugcucucgaacuccugaccucagguguuccacccaccuuggccucccaaagugcugggauuacaggcaugagccacggugccugccgucguuuguaaaacuugaguuagagcucacacacaguaaaaccuauccuuuguaguguagaguccugaguguggauaagcccauauggucaggucaccaccggcaaugccgaaacagaacucuccaucacccgugagaaccuggggccgugagccacccuugccgugggccacugcuaaucugcuucugucccucuaguuuugacucugccucugucacacagauucagggcaagguggcuuccugcacggcagaauacacucgagagucaccaugcucuuggggccuugggaguuugccccucgugaugccaaguaguaaguaucccuuagacggcgucucaugguuuauccuuuccccaacugagggguaugugggcugcuuccaguuucuggugagauccgaauacggcugaggcugccaccucugcacagaggcagacacucuguaccucaggagaggagcaccagcuccacugcaaacagcacagccccacguagagcacucaggugaaggcagcgcaggcggcgaaggcggcccaaagaaccaacugaguuucagcugcauugauuaucaauucauguugauuaaaagcuuagacucauaacucaugauuuugaggaauaagaaugggaaaaacuauuguuuaauacacguaguuugauaggccaaaauuuucaacacaugaagucaaccagaggaaaaauaaacgaaguccuucgaguacaaaggauaagcuagacccgcugacuagagaauaagaguucuccucaaaagagcccuuuuagagaccaagggugacuagggagaugggagguuuucggcaaaacggcaaggccacagagaggcaaagggaacucaggacuuccacuccaacuagaaacucuaguuuagaaaauaaaacccuaauuaucagaauccuaaaaggaaccauguucucccuguauuucauccuaguuugaagcaaauaaaagaauauguauuaacauuacauuguuuagaaguaccucauaaaacuacacagguacauuuaaagauuuuuuuuuucuuuuuaaaugagaugggggucucaguauguugcccaggcuggucuugaacuacugggcuaaagugauccuccugucucagccuucuaaguagcugggauuacaggaucuuuaaaaucuuauuacaacuaauuauacaaacuauaccaggauguuuuaaaugaagaaucagaauagcuuuauuaugaagauuuauguauuuuuaagcaauucgugacaaccaacagccacugacaaggucaucagauacuuucagucaaaacuccccagucuccagccugagcaacauggcaagacccugucucaaaaaaaaaaaccccaaacccccaaucuuuauauaucauaaaauguucuaaugaggaacuacuagaggcaaauuaauaggaacaugacgacuaacccagagaugcacgaauccaacagcgugagcggauggucaugagaacagcccaguccucccuaggcagcaucagacucagucguccaaaacucaaaaagcaaaucaacuuacuuauuuuacagcaucucauuaauaggucaaaaugugcacacaaaugcuuacuucagaagcuuuucaaaagcauccaaaaaaucuucacuugucauuauugugcagaauauguuucuccggaugucuguguucauccucugcuuccgggcgaguucuaggaucuuugaacugaccuggaagcacgaugaauggacaagucauacgcaugucuccaugcaaacugccucccgagaggugccaaacuguacuucagugucacugaauagaacugugaggucuacgugggcggauggcaccaaguccacucucgggcaacgccccucugugcaaggggaacacauagugaagccacagccgcugggggagaaaacacucaugugggaggcuucucagucgugguucaaccucagggcaagcgacgaugaauaaaacagagaaccagucacuggcagagccugggaaaccgugaccaugagugacacagaaucugggacagggaaggacaugaggggauaacgagggaagucuggaugaaaaaugggcuugaauuuccacaaugugaaauccauagccuguagccuagaaugcacagcccggggggcagccugaggggucucagcaacggacuccugccccgugagcguucagguccucaugcgcuccccugccccgugccauucaacuuuuagaucuuuuaaaguccaauaaaaagauacaacagaaauggaauaauuauaucacaauguaauauuaauagcaauuucuguaaggccuccagauaaaccuuguacauuucagugaccauucaagaacaguaagagagcugcuccagguaaagccaggaccacacaccacacaggggggugccucugccuggcagccuugagcaugggugucccuaccguccccacaagcugcuucugcaggugcguauggugacuguugucgaucaucggggccccacuccaggcggaccccacaauccaccagcgacccgucugcuccgcacucaagacacugucccaggagacgcgaagcugcgucucagaaccugagccggcguugcggaccugaugaagagagaagagcuaaugaaaugcuuuuaauugguucauauuccguccuuccaucaccgguggcuuuuuguuuuugaccaugacauuucuggugcaugaauacuggaaugggucacuggcaauugggacgguuagccuguuuggaaaaaugccaaaacuagcgguaaacucaguguuuuguguuugagaguccaucaccccaaacacgcuguguuuggaaagcugucccaacaggagagaguaacagagcugccucaggcucaguggcaggugagcacaugccuggaagagccugggucagcaaugauuuggacuugagaugacaggggcugaaagacucacuccaacagggaggcugccccagucuccauccuggcugcaugucagagagagucaaaggaccuacgucaucccaauuuccuugguccggauggggacuuggccuucucugaaagcaucggaugauccaauggugcagcccaaguuuagcacccggggugaggcaaagaggacgcucgcccaacaugggcuuccccacacacggacauucugcacgagcacgcccagaccacugggacagccccugaggaaaaccgagccgcguucacucugccucugagcacucucacucaccagacaccacccugacgugcaggucugacuauuucuugauuuucaugacaggcucaugccgacacggaagcucugagcaaaacagaauugaaaguuccuugacucaccaaagcucucugcaguuuccucagcuucuccacgggcucggggucauagccuggaauuuugcgcaugucauuguucuucagggccaacaucgucucuagcauaaaccgaaucuucaagaaaaaugaaaaaauggaaaguccaucauuucaaacagucuaaacggcccauucaaguuggcaagaaaucuaccacaccugaugcacauggccgccaccgccacgauacaaagucaggacagccuuuagguagagacagucuaaacuagucucagccgcuuacucagggcuacauaauacuucaaaauggaaaugugucccccaacgucaagugggaacccaaacuccccagagaucucuuuucccuucugcucgccacacgccucacccuuccgcaccguccacaccuacucggccaccccggccucuacuacgcuccugcucccacccuggccccccgcgaccugcucuggacauccucucuccuaccacuggccuuguaauuuuuuuaacuuuaaaacuggaaguaaugucauacagaaaaguugcaagaacagcacaaagaauucccacauacccucugagauguccccaaaugucaacuucuuacugauacagaauucacauagcauaaaacucacucauguaagguauauaauuauguggcuuuuaauacauucagaguugugcaacuaucaccacaaucaauuucagaacuuucucaucaccccagaagagaaacuccaagcccauuaacaaccauuccccauuuccccaacuccccagccagcuccccagcccacuaauguacuuucugucucuucuccauuugaaaccaccauugagcccgcugcucccauucccuucuccagcccccuccucuucagacuggcuucuccggggaccaggauaagccagucaggaccgccgucacaauucagcccaaaaugcaaaucccuuccuccucuugcugguccucagcaucccacacgggcgugaauucuuccuggggacacuaguguucccuggcuccugggaccauccucauuuccuucucaccugccagcucucccuccugccugcagcuagacgucagugcuccuuaaccugaagguccucuucacagcccaccugcugccaggcaaguccacccauuuccauggcucccaggacccccucuacgagagcagccccauaucccuucagcccacucuguucacagcuaacccagucuuucaaaaauggaggugccuguccuaaauccucaucuccuccugcacgguccccugugccccugaugggugacccugagcccuccuucccuucaucccaauccacaugaggucuggucacuucugacgcccauguccacacccacugccacgaucccaacauuugccaccaccuacuccccagcuccugcaaaacuccuccugacuucgaccaccucaugccucuuucugccuuggagucaaagugaccaucagaaggaaaacuccaaccugucauucaccugcuggaacccuucagaugccucuaggauaaaacccucaauucccugcaguaauuaacaagggaccagagaccugaacucugccuuuuucucuugugaugcccccuccaggcucucaaacuaacccuuuucggguucuuccccaaacggcuucccaggaacacgcgguuccacacaucucaucaucugaacggcacacaaugugggagcugugaucagucccuguuuuacagagggggaaacugaggcucagaagacccagguuaugcugcugucaaguggcagagcccaaaguccaacccaggcugacccuagagccccauguccuguggccuccucgguaagcauuuuuuaacggaugaauguuaaauaaaucaguuuuuaaauucacaaaauauuuuucugguaaaggaauaagguccauucacauauuaaagccagaaaacaggaugagacagaaaaaacagaaaucacuaggaaagcaaguguaauauuuaccccagauacugauuuuuagguucuggccaguuugugagcuuuagggacuuaggaagcagaucaagcgucgcacgcguacccuggucugguccugaaacucgcugccugccccgcuggcuuuggucugggcuucagugaucaauuccuuaagugauaaagcaucaucuuuccucaaugaaaaacccacguuuuucagcauuaacaagaucaguucaauaucuuuuucggugaaaguuccaaucaguuuuuucaaaaugucgaagaugaggagagacuguaccacguggaaguuguauaaaugggcaaugacggugaacagguugucacacucuuucccuucgcuuccguauuuauagauggcaucgaacuuccucaccacugccuccagaaagugggcaccgaccugaaagaaccacacagaaaaaagauuauguuauuccuagaaaccuuccuuucuccuucaacacacagaacuggcacuuucuaaauuaacaaagugccacaaggcagggcauuccaacaaggcaucccucggcaacccagagcagccggccagagugccccagccuggacgcaagggcaccuuccucuuguuaaaaucaacaaccaaggggcacuguuuggccagcagccauucugacuccuuggaaaaauaaaacuguuaaaaaugauguuaaaaacacaccuaugucucucaaaauauuccacuacuggccaggugcgguggcucacaccugcaaucccagcaauuuaggaggcggagguggguggaucacaaggucaggagauaucaagaccauccuggcuaacacggugaaaccccguuucuacuaaaaauacaaaaaaaaauuagccaggugugguggugugcgccuguaaacccagcacuuuugggaggcugagguggguggaucacaagaucaggagaucgagaccauccuggcuaacguggugaaaccccgugucuacuaaaaauacaaaaaauuagccgggcgugguggcauaugccuguaaucccagcugcuugggaggcugaggcaagagaaucgcuugaacccaggagauggagguugcagugagcugagauugcgccacuguacuccagccugggcgacagagcaagacucuguguaaaaaaaaaaaaaaaguuccacuaccuaacaauauucauuucuuaaaagauuuuuuugcagauuuuuaccccaaauucauuucuuacaaggaagcaauacgagugauuucuaaaacagauaaacgcaacacauucugaauaucagagguugccaaauagacagguacuuaauaaucucuggaagggcuccagguggcacggaggagacgcccuacuuucccagggcugagucucuggcacuaagguagcuugugaauacacucacuuggcucagccagugguuugaggggcacugggcccugauggggaccagcagguaaaccagacacugcccugaggggcggaaguggggccaggaacugccgggccugguggagcuaagcaaggccuaaguguucuccuugugcuguucugguacauuuuaucccgaauuccguaacuguggacugaaggaugagaagaccugcaugugggucuguguggucuucagcaaguuccuggaacccuguuuuuucacuguguaaaagagagauaauaaaacuugaaggcagaaaacagucguuuucagucuugcuggcaacacuaccgugucaucauuuuccgucaaaucucaacuuaagcugggacuggagggagaaggcggaagcagggacaugguggugacaaagagugacccccacagcccagccaggagacgauggccuaaauaacgcagcugcgcuggaccagggaugaagggccuggguaacacagcaacgcauggcagugugugacaccggcuguaaaagcugaaggaucugugacucccagguuucuggucuggguaaccaggaacuacgugaggggcagcaagcuaguggggcuggacaagaccagcucagggguuauuaagcuucaacaggggccauccagacaggacuggauggagaucuaagggugucagugaaaaucgcaggcaaggcugagauccaccagacagucuugaguguauggggaaguacacagacaucauugcuggacugcaaagaaaucaacgcuagaagaauccagagaaaggcaacagacuggcgggaggccacagugacuuccuggaggccagcucugauggacuggauauacacuucaguuuguaaagaccugagacuuaaccaagccaaccuguaguuuccauucaagccccuucaaugaagauaaacuggaagacacauucuauuauggcaaccauguuauagucaaauauaauuuuuaaaaguaaauuagaauucugcagacgucaauaaaaauuuaggcauaaaacauauucauguauauuuucuuuuucuuuuuuuuuuuuuuuuuuuuuuuuuugagacggagucucgcucugucgcccaggcuggagugcaguggugcgaucucggcucacugcaagcuccgccugcuggguucacgccauccuccugccucagccucccgaguagcagggacuauaggcaccugccaccaugccuggcuaauuuuuuguauuuuuaguagaaacgggguuucaccauguuagccaggauggucucaaucuccugaccucaugauccacccgccucggccucccaaagugcuaggauuacaggcgugagccaccacacccggcuguauguuuucaauuauguauauuacaucaaaauuucucaaaauucuaaaucugaaguuccauuuaaugucuucaaaauaaaauauaacagcauaacauuuaagaauauaaguaaaauucacguugguaaaguuauucaagcacauccuguacguuaacucugauguggaaauuuuaacaugaaucuacauagauuggguuuuugaguuuuaaaggacuuacagaagcaauucagcagcugacaccaucgucuuuaacacagaauguuuuucucgguacaggacugaaagcagcugaauggagccagcacccugaaagcucaucacacgcuggcagaaguuucuguggaugucauuaacuaaaguacuguaaugacuucccuucggaacaagucauuucauuguccuucaugcaauuagcaaagguuuaaaugaaaguaggcccaauuaucucauguuuuccaaucaaguaaauuccugaugugcuguggguggucacggucuguggcuuuuccuguaacucacugagauacugccuauacuaagaucauucugaugauuaagucagcugaagcauaccaguguccucuaggaggacagggagguaccaagaaagucacagaauggcccugauuaugguaaucacagggcccaggaauggcacccagugauuccaucacuuuguaaugacaagaaaacagacucccacaugcucauacaugaaaaugaggacagcucuuagaaauaaaaaauaacaagaggguucccaaagcagcuggugcagauuuucauaucugagaugacccauguagcucagaagagucccgcacucagaugcucaggccugugccccucucuccagcccucagcuuccuaaugccccacaggccuuucaaaaagcugccaccaugcaacuacugcuagacauggaaaaauguggaucagaacauuaucuagcaacaacaaagaaaucagcagugguaggaaaagccagccagaggaagaacagaauuaaaacacgaaaaucuccuucuguacauaaauaaugagccuucaaugagcgcuuauugugggccagcucuuuccuaugccuauuacaugaacuaacucguugaccuuaacgacuggacacaggaagacucggaggcacaaguucaucuaagugacacagaccgugcgcguuacagcauguuuuguacucaggcagcaucuccacccaccccaugccgccuucagcacagaagccccagugacaagaaggcuacuucauuuuggcaaauccgugcaucuuuuuuuuuuuuuugagacugagucucgcucugucacccaggcuggagugcagugacgcgaucucggcucacugcaaacuccgccugcuggguucacgccauucuccugccucagucuccggaguagcugggacuucaggcgcccgccaccaugccuggcuaauuuuuuuuuguauuuuuaguagagacgggguuucaccuuuuuggccaggcuggucucgaucuccugaccucgugauccacccgccucggccucccaaagugcugggauuacacgagugagccaccgcgcccggccggcaaauaugugcaucuuaaagcaagcuuuggagagccccacuugguaagacucuaaauaacuguuaagauuauaauugagagaaaguaauauaaaaaugaaaugaaugugacuagcauugcaguagaaagcaugcuugccuaggagcccagaaaacaaguucuguguacuuuuaacaagacgugaucuugggaauuucacauagcgcuucagcggcuuugccugcugcacugcaaagcaagcuucaguaaaggucugcccugaucucaccgggacacuuuaggauuaaaggugaggaggagacgaaaguauauaaacguacaccagguaauuagacuuuuagggaugcugugcugcuguggccuauuuuuuggaguagagcugucagaaggcaaaaaacuaagagaaccaccauuaaaagagacuaucauuuaaagauccaaauggguuaaacacugcauuugcauguaaauacuguaucacgggaaaacuaagccucacugacccaacccuccauucguucaccaaccucacaacaaucuccuuuaguuggacggauuuacuucaacacaucugaaaucagcuaccuugggggaacugggauacugacugggaguguuaugacuuuccuguauucaauuaagagagaacaggcccagaagagggcagugacuguggaaccaaggccaucaccaaagagccucucugacuuuaaccacaaggguuguggagcaagaagaauacgaaagggaugugggggugggguggacauuuacuuagcaccugucgggugccagaugcuuucuguacacuguucaguucaaucccaacaaaagcccacuucacugaugagaaagggccaugacacagaaagggcaccaggucucccugaacauguccaggcaguuccaugccccagugcucucacaucucccaucaauaccaacaccucaguagugagaccacaccaaccauuaucuuccaaacaucugaaauaaaucaguguuaagggagaagugcaaaggaaaugaaggcacgucugagaugucagucgagaagaaaauuaacuaacauaaaagacaugcuaggcuggacagaacagggcugggcauggcagcucccgccuguaaucccaacacauugggacgccaaagcaggaggaucacuggagcccaggaauuugacaccagccugggcaacagagugagacuccacuucugcucccaccaaaacaauuagccaggccugguggugugcgccugcaguuccagcuacucuggaggaugaggugggaggaucacucgagucugcagcugugaucgugccacugcacuccagccuagacgacagagcgagacccugucucaaaaaaaaaaaaaaaaaaaagaauggacagaacaaaaaagcaaaguuaagcaaaaucaaguaaucaaguacuuccugaaugcucuuuacaacuacaugacauagacaauagaguauuuauucacaacaaaaaggaaucgacacaagaaccacccacagcacacaauuacgcacuuaucaagccuaucauuaaaauaaucaccaugagacacuagugacagccuggagaaaagguacaacuguaccucgauuccaacuguguggugaaggaugcugacuaagagaacaugcuccaucaucagucugcugggcauggccgaggcagugacgcaggcacccaugagagcggaggucagggugucauucauguccuuucugcugugggccauguacaguuccuccagcugcccacugauggaagccauguuggguucacucaaccugcagagaauuguaaagacagagagcaacaauguuuccaauuaggaauuuucaguucaauuuuaaaaaauuaaagaguuauccauaccaacaauauauucuauuuuuauguacacuuuugaccccuuaacuauucuuaucuugccccaauaacccagcauauauuauucauaaccagauaauauucuggaaucccaaaacaauguaauugcugucuuuacaagaugaaauguggccacacugaggcauacccuggauuaagucuacagaaacauacgugaggauacuccccugaauauucugaccugauaucccauaggcaggguccagccuuaggacguguuguuagaaaaaaugcuaacguuuuauuucuuagguggcacaaaaauccuuaguuccuaacacuagaaaaggcugcucuguuugaacggguaguggggacacuacacacauauguacguggaagguuacucacugugaaccugugcuaauacugaacucgacacugaaacagagguuuauauaaauucccaggauaacaggaaacaaaaagcaauacaagggggaagggggugggugaggccauggaggggcagcaggggagagaugguggugaguuuuaucucaauugcagcgguggugacucgaaucuucaugugauaaaacuacagaacugccccggugcggugacucaugccuguaaucccagcacuuucggaggcugaggcgggcggaucaccugaggucgggaguuugagaccagccugaccuacauggagaaaucccgucucuacuaaaaauacaaaacuaguuggcgugguggcgcaugccuguaaucccagcuacucaggaggcugaggcaggagaacugcuugaaccugggagguggaggcagagguugcagugagccgagauagcgccauugcacuccagccagugcagcaagagcaaaaacuccaucucaaaacaaaacaaaacaaaacaaaaaaaccuacacagaaucacaugcacacacacauccucaaaaccaaagagcugaugggcacguguaacugacaaagccccaccuguaugguuuccaaucaguuuuuuaaauguucuguucuuaaaguggguaacaacaaaaugcagacaugagcaaugaguaagggggauggaagaccaggugaauguguuucugcagagaggggacauaagccaguccuuccaacacuguccuuagacggacaaagaaccucugccccuuuccuuccugcuucucagaauaacaaugugagcauuugggcugcucucaaacccuaaagggauucaaaguagccaacagucggguauccucuccuucucgagguaugggucucaugggucucggugcaucaagccaagaacagaaaggauccaaucgacuguccccaucacuucuauuugaauugcugggauaauuccuacauuuuaggaaacagacaaccucucuaagugacacaguguaacaacacuacaaggucaccuguuaaguagaccuuuuacauguuucuucagccuuucuaguucuuccuuuuucuugaaguccacugucuccucagcuugccucacaugaggugggauguacuuuucaccacuuccacaaagacucugcuugaaaagagaaauaaauuacaaaaaauuuacacugaccaaauccuguguuuuuucuuugccauauguguauuuaaauauuaaacuuccaagaacugguggaagcugcuacugaucauugcugcuuaaauacaucagauuuauugagugcuuaguauauggguaaacauuccacucaccaggcugugccugucacuauucccauuaaugcuauuaauaauacauuucaccaucucguuuuccccuguguagcucuucagacccagcugugcaccucugguaucugcucaacuccaacagagcccuaucuacugcgcuuuugcucggccuuaacuuacugcaggcacaguagcauacaagaaccuaaauuaaacaaaccgcuaauuuuggagggaaaguguccuaaaaacaauuucaaacuuguuuaaaaguaauaucuaaguuuauaugauaaaaaucaaaaccggccgggcacgguggcucaugucgguaaucccagcacuuugggacgcugaggcgggcggaucacgaggucaggagaucaagaccauccuggcuaacacagugaaaccccaucucuacugaaaauacaaaaaauuagccgggcaugguggugggcgccuguagucccagcuacuugggagaugaggcaggagaauggcaugaaccugggaggcggagcuugcagugggcggagacugcaccacucuacuccagccuagacgacagugcaagacucagucucaaaaaaaaaaaaucaaaaccaacucacugcuauuuccuaaauuaucaagggggguggugguguuugcaaaucauuaaggacacaaacauuugcaaggcacgauccucacugcuagguaguuuaaaccugguucaauaaagaauauuuguauacauagaagcugaauauuuacauacauagaacuagugcgauguggggagaaggaaaugcaggcaauuccacacagcugccuccaaccaugagcuacaugcaaaggaacgcugagauaaaauaugcaagaugacagcccaugaaugccuugauugcuacguccuagauucugaacuuuuuuuuuucuuugaaacagagucuggcucucucgcccaggcuagagugcaguagcgcgaucucggcucagugcaaccucugccucccugguucaagccucagcuucccaaguagcugggauuacaggcgccugccaccacgcccggcuguuuuuuguauuuuuaguaaugacgggguuucaccacguuagccaggcuggucucaaacaccugaccucaaaugaucugccccgccucagccuuuaucuuuaauucaauguuggacuuuaucuaagggagugcuguaaauuagcuucgaguuuuagaaaauucacucuaaaagucgggcacggcagauguccucggauacucgaaagaggccuuaacagaugagguaggguuaacagguuuagagaccugggcugguaaacacagaaugaagaugcugcacuguggaaauggcccuuaaguccccgggauaaaaaugucucuauauugcuuuucuccuaaacuuuacauuaugaaaauuuaaaaacaugaaagaagaccgaauagaguaacguacucgauuuacucacauucagcugaaaccauuaucaagacaccaagucugugucauuucugccucacgccccauucccugucccguuauuuugaaggaaaucccagagggccuagagaguguucacacgauaccuuauccguuaugucaccguccuccgaggaauuuucacucuuuucuucaucuucugcaaaacggacucucuucccccuccuuuucuccugcgcucccuuuuccuuuucuucccccuguuccucuucuguauccucgucgucguccucgcucugcgcuucugcuuccugcgccuucuuuuccuuuucuacgucucccuccuccuccuccucacuuucguccugggagucacucucuaagucacuuucggggagugucuguccggcaucuuccuccuccucaccacugcugucguacaagccgcuauuuuucccagacuccagggcucccagaauauagucaagaccgucgcgugcaaagcucagcggcacggagcugcugccguccuucuuuuugcgcuuguucaaaccgaggcaacgcuccagcuuucggaucucucgguccuccuccucguucgccgcuaaaagcgcccguuuccgggcagcggcgguggcggcugcggagggucuggucuuugcgguggcggccguggccuuggccuugacccgggacggccgcggcuuccugggaggcgaggggucccgacuaggggcugggcgggcgcgcuccuccguguccugccggugaccgcuggcuucuucggcuccgcuucggccucccaggccgggacccuguucggggcccgccguccucugcagccggcgugcuuuccgcaggugccgcuucuccuuccucaguuccuuacggcuuuuucucccucccgggcgaaagcucaccggggcgccgcgccccucgcaacccccgggagccucgccuuccgaagucgcgugcacgaacuccuccaccgcuagcuucagccucuucagggccuucuccccaccgccagcaggaccgcggcgcggcccgcgcccgccucugcgcuucaugcggaccacgcgucccugggagccgcccgggccggccucucccgcgcuccuggacgccgccaucuuucgaaacgcguggacgcacgacuuccggccgagg

SEQ ID NO: 14298 - RNA, 3007 nt, Homo sapiens
uuauccgucacucgccgagguuccuugggucauggugccagccugacugagaagaggacgcucccgggagacgaaugaggaaccaccuccuccuacuguucaaguacaggggccugguccgcaaagggaagaaaagcaaaagacgaaaauggcuaaauucgugauccgcccagccacugccgccgacugcagugacauacugcggcugaucaagguagcggagagccagagcuccucccggggcgugggguggagguggcuccguuucccagaguggggugauucacgucuugaggucucggccggugugagagcccagccuguuccccuuucugcgcccauccccggcucggccgccaccccgcccgcccgccccauuccguuccccugagcuggccgggccggagccucauuuuguuuucuacuuuuuucucuccuaugugcauccccccaggagcuggcuaaauaugaauacauggaagaacaaguaaucuuaacugaaaaagguaauucaacaguggcgggacgggggacaagcguucggugccugucaccuucgccaaggccauuaccgccccugcucccccuucuugcagaucugcuagaagaugguuuuggagagcaccccuuuuaccacugccugguugcagaagugccgaaagagcacuggacuccggaagguaaccccucgcccuuuccagaagccagagagaccaaguguuauguaagaaguagugucggcuguguagaaccacugacuacacaggccgaaguuacugagaacuuggacagaaaaaauagccagcaaguguucaaacuacugaggaaaaaaaaaaauuagauaugcugcacuuaagaauacuagggcagguuaaaagagcuguuuaaguaaguaucagagugcuguggagacucggaaguguuuaagcugcuuaaguaaguauaagugcuguggagacccggaagaguuagauauaaugucauuuguuguaauucaguuucauaaaaugguucuuguuugacccuaacguaacaguuuuuguaauuguguuaaaucacauuuuuuucuuuaauuugucccaaucuucagguuacagucucuagcuucgccauguacauggcccuuccguguacauggaugggcggggagguaacuaaaagauccuuuacacaauaaaguagaugaucaugauaaaugagguaagguccuauuaucacacacuucaaacacgguagaucagaaacccacuaugauacucgcuuccugucuguuugcuaaggaauauaaaauggcuagaaaguuuaauuugaaaccuuugccuccauuuggaauaguagacaccaguuaagagggugucagaugccuuuuuuuuuuuuuuuuuuuuggcuggucccuguugauuggucagaagacagcucagcuaaaaggggaaguugucugggugguugcuuuuuuucugacgucuguuccucaggcuggaagaaaugagcagaaaacaagggaugaguacuuuuuagaguaugugcauguuacguaauaccuguuucugggcaaugcugcuucuucugacucaacaaauggggagagcaaauugaaaaugcguaaauuggaaggcaaguucugaaauuaaacguuguacuuuggccugauguucugaccuuuaaggaagcaagaguuuguaaacuuccaaauauuuacuauucugaacugccguguaaaccugacguauucccaagucaacauaccaguauaccaauaggaugugaauaauguguguguugaguuuaaaaccauagcaguuuugcucuggcaaguaaugaaagcguucucgcuuccugagugugagcuccagcagacugcagaguggccaguccacaguuguagccugacuucagugaguucugaugugugcuuuuugcaaauacauguucucagaacagugagaucauccagcaguggccuggacugcacucacauaaaaaucaugagacagccauggcuacuuguuucuguaauacaugcauguguguuuuuuaaaaccuaugauaggccucugauucugcagcugcaacuuuuauggaauguuuuccuucuccacaucucaugugaugcucuuauuacaggacacagcauuguugguuuugccauguacuauuuuaccuaugacccguggauuggcaaguuauuguaucuugaggacuucuucgugaugagugauuauagagguacgauugaguucggagcagagggucugaagagaguucagaguuauaaaugcuuacaaugacuuuuuaaauuguacucuuucuuuuuaggcuuuggcauaggaucagaaauucugaagaaucuaagccagguaugucuuaguuuuugguuuccaaauuuguaaguuuacuggauuauuuuaaugauggaauaaaaauugggucuugagagcaggcugaaaugucacugaguguguguuuuacucucucauaauagguugcaaugaggugucgcugcagcagcaugcacuucuugguagcagaauggaaugaaccauccaucaacuucuauaaaagaagaggugcuucugaucuguccagugaagaggguuggagacuguucaagaucgacaaggaguacuugcuaaaaauggcaacagaggagugaggagugcugcuguagaugacaaccuccauucuauuuuagaauaaauucccaacuucucuugcuuucuaugcuguuuguagugaaauaauagaaugagcacccauuccaaagcuuuauuaccaguggcguuguugcauguuugaaaugaggucuguuuaaaguggcaaucucagaugcaguuuggagagucagaucuuucuccuugaauaucuuucgauaaacaacaagguggugugaucuuaauauauuugaaaaaaacuucauucucgugagucauuuaaauguguacaauguacacacugguacuuagaguuucuguuugauucuuuuuuaauaaacuacucuuugauuuaa

SEQ ID NO: 14299 - RNA, 934 nt, Homo sapiens
uaaauuaguguguccuauagggggaaaaaaaccaagaaaccaccuuuuaaaaagaaugauaugccauauacccuugauuuucauuuugcauuauauugacguguuuuuuugaaggaaaaaaaguaauaaaaaucugauagucuaagacuccacuauuuaaaagccuaauuacuuuaaaaauaugcauacuuucagaacuuuuaccaaaacacacaacuguugaagcagucacuucucuauggaaguaugcauauuggugucaguuucuuuguacaguuguacuuagauauuuuuuaugauuuuucaugugcagguaucaagguuuugaaguuuuaguaaaagaaauucuguagauuacauucccaagaacauaaugcuuacacaaaauguauauuccacguuuuaaagcuuaauuguauuuuacuuuacauauacacuucaguuaacauagagcacuuagaaucuauuugguauuuuugauuucucaaaguaaaaaaaaaauuagauuuuuagguuugauaugguugugucauaaucaucucguaauugacaauuuuaacuuuuggcaauaaaaggaaauugggauaucuuuggaacuguaaaaccugguuuaaucuuuuucuuucuagacucuugauagauuggauaauuaaacaguauccagagaaacuaaagaaaugggcauuuuaauugcauauuuuaucuugaguuacuuuuuaaugaacacugcucauuacaacuuuacaaaccaaaaguguuuacuaauuccaguaacuaccauuucuuuuucagcuagaugagugaucggaaaauuuuuguugcauuucaaaaucuaaauaaacuacagacuuuauccuuauaccaugaauguuuuuuuuuaauacucugucuuaaaauaauacagcaugguacaauaaauagugcuuuuauguau

SEQ ID NO: 14300 - RNA, 9659 nt, Homo sapiens
ucuagguucacagcaaggccacugguacagacaaucuuugaagguggaaaagcaacuuguuuugcauauggccagacaggaaguggcaagacacaugugaguauugaggccuggcggggaaagagccuuucccuugugcaccccuggcucccuauaaagggagacaaugaguuuguugagaaaggccccuuguuacagaugccccaucaccagauagccuugccaugucagaugcagggaggggcuuuagguccagccuucuggcuuuguuguggcccacuguagugaaggagccaguagugcucugcucuaggccaacagcccuuuuccauggucuucuaccccuucccuuugcagacuaugggcggagaccucucugggaaagcccagaaugcauccaaagggaucuaugccauggccuguaaguacuguguacugcugcuucaggguugggcacagaaaggcagguuguuugcuuagcaaaguucucucccucagcccgggacgucuuccuccugaagaaucaacccugcuaccggaaguugggccuggaagucuaugugacauucuucgagaucuacaaugggaagguagcuggcaggaagccccuuguuuacacuguuggggcccagcacuuuuuaaaaccuugaagcuggcuagaaguugaggccaaaaaccuauuagcugauuagcugucaagccacugaugggccauucugcccuggcauacacauguaggugguuuaaucugauggugagauggcaccuaaguucaagaaguauggcaagaauacuccucagggcgcccuuucaggugcaagguuugccuguguguguccugaccucccucggccgaccuccuucaucccuucuuccccgauugugcacguucagucucauauucauucuuucccugcccgcaccaccauauaucucuuccaccccucucucuauucacugugugcuucugcagaguugcuuuccuuagagugggaucuagauaauaaaaauagcuaauauuuaucauuaauaagauauuaggggccaggcgugauggcucacaccuguaaucccagcacuuugggaggccgaggcgggcaggucaccugaggucaggaguuugagaccagccuggcuaacauggugaaaccccaucucuacuaaaaacacaaaaaauuagcugggcaugguuaggggcaccuguaaucccagcuacucgggagucugaggcaggagaaucgcuugaauccaggaggcagagguugcagugagccgugaucgcaccauugcacuccagccugggcgauacgagcgaaacuccgucucaaaauaauaauaauaauaagauauuaggagcuaugcacuauucuaagcacuaccugucucaccuuuacagaugagaugcaaggcuagagugguuauuaacuugcccaggcucacacagcuaguaaguuaccagagucacagcaaacugaggcaguucggcucagaucccaaguauauugaccucugcuaggcugacauccaucaguucguauucucugccuuuccugcugcuggcucuuguccgagcugggcaggcuaguaggaggaagcagucggguggggugccgggugcccaguggccuuagccucauucccccugccuggcacagcuguuugaccugcucaacaagaaggccaagcugcgcgugcuggaggacggcaagcaacaggugcaagugguggggcugcaggagcaucugguuaacucugcugaugaugucaucaagaugaucgacaugggcagcgccugcaggugagaguccuggugaggggaaggagcgaccuucucaugucugguuuaugaguaaagucuagcucugagcacauuucuguuuacccagagugcugcuuugcccaguuugguaagggcugcgaaggccucugcuuuacggggucucaauaagacauaugaccccagggccagaggcuuaucagaaccaagucaggucaggcacaguggcucacaccuauaaucucagcaguuugggaaaaugaagcaggaggaucacuucaggccaggaguuagagguugcagugagcugugaucgcaccacugcacuccagucugcaugggcagagcaagauccugucucaaaaaaauaaaaauaaaaacaagucaaaguguuaccccaaaggcaugcuuccuggcuucuuuggguucuccuugcucuucccucccuuugugguggaagucgggagcucugggucuguucugggcuggaaguaauggguucauacccccucugcacagaauuaggggagcacuuuuccacuagggcuguagacauugguacaguggggcgcuacgcagcuauagaggcccagggagggggcugcccucuacaggguccucaaguucuggcaggugguucaugacagcuucccccuucccuuugggcccuuuagcagagggaauuuauccuuccccguguccuucuagggcuccaggucugacaaaggcccuaguccagaauccaguacuaauuuggcugccaggaaaauguauuagguccagagcuggagggagaauugcuacccagggagggcaagauggaagccugggacaggaaaacaggacuuuuucgccuccuaaccugugucccucccuuccuagagaacuucuguggacuugggugccaugggggcuggugaccacagaaucucauaaccuuucuuuaccacagaaccucugggcagacauuugccaacuccaauuccucccgcucccacgcgugcuuccaaauuauucuucgagcuaaagggagaaugcauggcaaguucucuuugguagaucuggcagggaaugagcgaggcgcggacacuuccagugcugaccggcagacccgcauggagggcgcagaaaucaacaagagucucuuagcccugaagguaguggggcagcuagagcugguuggccgggagagcuacugggaagggauggggagggaucagugcaaggaaagaagggaccucaguuguuccugcugcccccacaggagugcaucagggcccugggacagaacaaggcucacaccccguuccgugagagcaagcugacacaggugcugagggacuccuucauuggggagaacucuaggacuugcauggugaguagggucacuuugaaggugaugguacaggaggagacagaguugcuuuccacagagacacuuaguccugucccugggcuggaagcucagcacugcuggcugccuggguuuccaggcuguaccgugacugggcuuccagacccugcuuuaaugcacgagacuccuuguggccuaaccaagcguggaggaaaggaucuauucccuuuaagauguguaggugcagcucuugguuugggagaggucauuccugcauuaccugaugaaaaggggguuccagaauucggaagaugggccuuugggucagcaggagagggaaguccuugucuuuuccauggccucccucagguucacuggcucccagccuagaaaauagaaauagccuggaucauaaggcuguguccuugaaugacguccucuuuccuguuuuauccccaagccccuguaugugagaucugccauccuuccccucaagagaauauucuccccuacccuuuggguaggaguccuuucaugaggaaggugggauuuucugacuaagcucuaccuaaggcauuauccuuuggccuaagggaacugaaguuuccagcagaagccacagagcuuuaagauaggaccuugggcugggcgcgguggcucacgccuguaaucccagcacuuugggaggccgagaggcagguggaucacaaggucaggagauagagaccauccuggcuaacauggugaaaccccaucucuauuaaaaaauaaaaaaaauuagccaggugugguggcaggugccuguagucccagcuacucgggaggcuaaggcaggagaauggcgugaaccugggaggcagagcuugcagugagcugagaucgcaccacugcacucuggucugggcgacagagugagacuccgucucaaaaaaaaaaaagaaaaaagaaaaagauaggaccuugguagcaagacugucucagugaaggaauaaugaagcaaaagauaauuagaugugucuuugaaagcaggaaaccaaugucugaggcaccuuaauuugcagugcccauggggcaaguggccuagcacagcgcggugcuaaaugacuccucccaccaauaccaugugggucuccaaagcuugaagaaacacccugacuggaggccccucagggacaggcuauauagcauccucaccgugccucucagccuuuaaucacccaccccucuuuugcagauugccacgaucucaccaggcauaagcuccugugaauauacuuuaaacacccugagauaugcagacagguacuaguaccuacagcuaggugggaugcggaacaggacugggcaagggaagggcagugaugagaggggaggaggcucuggggccucagggccuacuguauacuccucugugacucugaaccugaggcuugggaguuccgccgugaugcuaggucugucccaauccucuccgggcccugcuggagagucagcugggugaggggcuuuuccaguccagcuuuaguuuucucucuccuuggcugaaggcaagguugccauuccauccccuuggagccucaagccucgaagccugggcggugccacauuccucuggugaguaccaagggggugcugugggaucugagaccuccuuguuuccucagggucaaggagcugagcccccacagugggcccaguggagagcaguugauucaaauggaaacagaagagauggaagccugcucuaacggggcgcugauuccaggcaauguaaggaccaggaugcggccaagcaagacagaaguguggccugcugaggcggcaccugggucacauaauugucuuucuuuuuggcccucucaguuauccaaggaagaggaggaacugucuucccagauguccagcuuuaacgaagccaugacucagaucagggagcuggaggagaaggcuauggaagagcucaaggagaucauacagguaggcagcuggcccuggacagggagcuggaugcagcacggcccucaguaugcuccacaccauucccagaacaugaccugggccuuguucccacagguauucacauagcaagaagcagcccucuacaccagcacucuuuaauucuuugccuguuaacccagcuguucuucuaauuaucacaaccccuucugcagguuggcacacauaggcuuucugacaucacacuagccagagcuagucucuccuccacgcuccugauagaggauuugaagggugauccauaugcagggaucuugucuuguguuuuggugaauguugcaacucuugugcugaauccaagggccaaaaaacaugaaguauagguaauaggcccuaaggguaugacuugagaucaauccugucucuuccauucacaaacugauuuccuugugaaauucauuuagccucacugggccucaguuuuugcaucucugaaauggucaagguaggaugguuguauuugagcguucaguaauaugcuuauaaagugucagcacaguacccaguguguggucaggguucaguaacugguaggugccccugcuacuguaaucccuacuguggaagagcaagugacugggaggcaggaauuuacgucccaaugguggggcgcucagaggauugcagagcaggaaggaagaacuuggggcagguguaacugaggagggacugugaaggguaagugcucaggccucuccuccccuuccuggagugcucagggguacagaguuuuguaagcacauggcacuuucaggaugaaugagaggcucaccguggucagagcaaaaggagugaacaggugauggaggguaguuaaggcuguggacaggucaacagggaucugaugcuagagucuucuagaugguucaucucacaggccuggacugcaucaugaggaagccuuuggaggguguuaagcagaguggugacaugggcaugucagagcuuuagauauaucauauggccaccauguggagccugguuugggggcuugagaaaagcaaagguagaggcaguuaggagauuguuggaaaggguucaagaaaaacuauugccagccaggcgcgguggcucaugccuguaaucccaacacguugggaggccgaggcggguggaucaugaggucaggaguucgagaccagccuggccaacguggcgaaaccccaugucuacuaaauacaaaaaauuagccgaguaugguggcgggcgccuguaaucucagcuacuugggaggcugaggcaggagaauuacuugaaccagggaggcaaagguuguagugagucaagaucgugccacugcacucuagccugggugacagagcaagacuccaucucagaaaaaaaaaaagagaaacuagugccuagaccaaacuguguccguguucaugggauuggaaugaggacaugagauucaugaaccauuuagauauacaagcaugaaaaucuuacaagguaccccccaaaauauguacucucucucuauauauauauguuuuugagacagagucucacucgucacccaggcuggaguuuaguggugcaaucuuggcucacugcagccuccgccuccuggguucaagcgauucuccuuccucagccuccugcguaccugggauuacaggugcgugccaccaugccuggcuaauuuuuuguauuuuuaguagagaugggguuuuaccauguuggccaggcuggucuugaacuccugaucuuaagugauccgccugccucagccucccaaagugcugggauuacaggugugagccaccaugcccagccuauauaucugguugguuuuuguuuguuuguuuguuuguuuguuuuggggggggauggaguuucgcuuuugucccccaggcuggagugcaacggcaccaucucggcucaccacaaccuccaccucccagguucaagcaauucuccugccucagccucccaaguagcugggauuacaggcaugugccaccacgcccagcuaauuuuguauuuuuaguagagacgggauuucuccauguuggucaggcuggucucgaacucccuaccucaggugauccucccgccccgaccucccaaagugcugggauuacaggcgugagccaccacgcccagucguauaucuauuauuuaaaaagaaucauuugaccgggcgcaauggcucacgccuguaauccugucacuuugggaggcugaggcggccacaucaacuaaggucgggaguuugaaaccagccuggccaacauggugaaaccccgucucuacuaaaaauacaaaaauuagccaggcaugguggcaggcaucuguuaucccagcuacuugggaggcugaggcaggagaaucacuugagcccaggaggcgaagguuauagugagccgagauggugccacugcacuccagccugggcaacagagcaagacugucucaaaaauaaaauaaaauaaucauuuggccaggugcagugagucaugccuguaaucccaacacuuugggaggucaaggaaggaagaucacuugagcucaggaguucgagaccagccuggguaacauggccccaucucuacaaaaaauaaaaauaaauaaauaucccaaagguggugugugcagcaaaaauuauaauaaaaagaacugaggguagggauagcauuaggagauauacccaauguaaaugacaaguuaaugggugcagcacaccaacauaguucauguauacauauguaacaaaccugcacguugugcacauguacccuagaacuuaaaguauaauaauaaaaaaagaaagaaagaaagaaaaaaaccauuuagggagcagaauugaggaggauuuggugacaaguacggugaaagaauaaagucacucgggcugggcgcgguggcuuaugccuauaaucccagcacuuugggaggccaaggcaggcagaucacaaggucaggagaucaagaccauccuggccaacauagugaaacccugucucuacuaaaaaauaaaaaaaaauagccuggugugguggcgcguaccuguagucucagcuacucgggaggcugaguuguauaccuauuauuuaaaaagaaucauuugaccgggcgugauggcucacgccuguaauccuagcacuuuaggaggcugaugcaggcagaucaacuaaggucgggaauuugagaccagccuggcuaacaaggugaaaucuugucucuacuaaaaauacaaaaauuagccaggcaugguggcaggcaccuguaaucccagcuacuugggaggcugaggcaggagaaucacuugaacccgggaggcggagguugcagugagccgagaucacgccacugcacuccaaccuggcgacagagcaagacuccgucuuaaagaaaaaauaaauaaauaaauaaauuagcuggcuaugguggugugugccuguagucccagcuacucgggaggcugagacaggagaaucacuuaaaccugggaggcggagguugcagugagccaggaucgcacaccacuucacuccagccugggugacagagugagacuccaucucaaaaaacaauaaaaauaaaaucacucaaauuucuagcuugggcaucaggaccaaugauguuauucauuugacauaagagauggggauaagcuugggauaggaggccggaagugguggcucaagccuguaaucccagcacuuugagaggccgaggccugcggaucaccugaggucgagaguucgagaucagccuggccaacauggagaaaccccgucucuacuaaaaauacaaaauuagcugggcgugguagcacuugccuguaaucccagcuacuugggaggcugaagcaggagaaucccuuaaacucgggggguggaggcuauggugagccgagaucacgccauugcacuccagccugggcaacaagagugaaacugucucaaaaaagaaacaaagaaaacgaaaaaaacaagcuugggguaggaagagggugaauucaagcuaaggauuuccuuggggagagggugaacagccaggguaugggucagggaccagagguaaagcaucuuacucaggugucugcauugcaguugguaggaccccaggaaugauuugcuaaaugguuauugaacugacaagguccucccuguguuguagcaaggaccagacuggcuugagcucucugagaugaccgagcagccagacuaugaccuggagaccuuugugaacaaagcggaaucugcucuggcccagcaagccaagcauuucucagcccugcgagguggguguggcuggauggggugcagguggacgaugguggccucugcuggcucuugggcagcugcaggugauggcagcucugcccugagugaaugggggcuccucagacucucacuaaccccauauguaccgcuacccuuucuuccagaugucaucaaggccuugcgccuggccaugcagcuggaagagcaggcuagcagacaaauaagcagcaagaaacggccccagugacgacugcaaauaaaaaucuguuugguuuga

SEQ ID NO: 14301 - RNA, 55232 nt, Homo sapiens
ugguuuucuugcagaucauuuaaugaauccucaaggacuaaugaaauaaaugcuagacugcugaagaugaguacaaguggcauucugggugccagcugcuuucuucuuuugaaaacaaggccauggggacccaugggcacaguguauaugccuucuggcaggagaggacugauggaggaaugauguggguguguggccauucccaugucuguggaggcggcugguggcagccuucauucccuucugcagggcccucgccagccccucccuacccuucaagaacccccaccccagcuuccacuaguuucaacauaauucacaccuaccugguguuacugaagggaaagacccaggcucaaagcugaaugccaccagccagggcccaagcuuagcuuccugcauuggcagaaugccggcuucaggcucucucagaccaaauuuggaaaccgguuaauggcuuuggugcaagggaucagcucccuacucuggucaucugaaaaccucaacucagaggugacuugguuuuagagucuggcuuccuagugaccaagcagagccagaccugaucuccuugccugccagucccagcuacagagcugggaccagggacauauuugaaguacaacuggagcagaggcaggaguaacugguaauaucugacaauuuagaaugcagaaugugaugggacuggaauuacgauuccgcacacacucagcguggauccuucugccagacccaguuagccccagugcuguuuacccagacugggcacugcuucuguaggaacuuuccaucccagggggugggguggggaggggcugaagcuuugggggagugcaggugcugugggggucagcacuccucaugcugcucccgugcugccugauuaccgcacaggcauuucuggggcagcccugcuaugcaggaucuccgaacaucaagggagaugucagcgccucugcuuagcaccaacguucccacaaccaucccaagaagcaccuaugaaugaggcacacccagaaaagaaauggguaagaucacacaaugaggaaauccaggcuggggaaagagguuuaauaucccgguacaccguggugagaagccugggcaaagcaucugcacagacaggugugugugguugagcccaccaggucccacuuucucucaucccagucccucccuaaggugcugccuagaauucugcacacacauucuuacucccccaaagcacagggcuuucuuccagauugcuuuuugaaggaggcguuuaaaccagaagggcaaagaugcugacacagaguuugguuuuuauuguuauguguuuggcugggugcagaacugcccucaccaccccuggccacccuggccucuugggaggaacaggcagagagguggcuucagauggcucuuggcugccacucuaggccucggggcuuauacaaugagcagugggcucuaccuuccaacaggaagugcaaacuaauucgaagucacacuucaccaggagggagagauggucuuggcugaaggcacuuuaaucagggagcaaacccagugccggaguuugucuucucguuacucugauaaaucuagacaccacucuguuggagaaccagcacugccggcagcugggguuagugcacugacugagcgaggcaugaggccugcucacugguagaacuucuuguuagggcuguuagcauggucagcuagcagcuggcauggggugaacuguuuuccauaggcagcuucauauuucuugagccgguccacuaucuucugggcgccauacagauccacaaagcggaaaggcccugaauagagaaagaggacuucguugaaggagacgcaacacgggcuccaggcuaaagugagcuuccuucccaaccugcgagaccaaccucccagacaaggcgggaagccaagcccaaagacggcuccgaugucucccucugcagguguggccaagauccccucuugcaggcacaugacugccucauucacaaaucuugucaccaggcggaacuggaugucuucgucugaugagcugccaacagaaagagauguuuagguagaagaagaggaaaaggggaggaaagccagagccgcagaugcagaauggaagucgggaugggugcauggggagcucugugggccgguuggugcuggcccucagagaagaugcugccugggugaaccaaacuuucccauggaaaaaguggagaguaacuugcccuaauuaacaugaaacugagcaccuagaacagggccuggugccgagaagauaaucaguaucucuuugacaucagcaacagucagcugcucacaaaugauaauaaagaucugggagggugaaggggccaaggagaaucuguccuuccagcggcucucugggaacuugccagagaaggcuggagcaggggagggccuucaccagacguggccugguucucaccuagaugcugggcagagaccaaggagcacgugcgagggccuuccacuuggaaagcaccaugccagcaucaggagugguccuccuguucagguaugguggucacaaagaaaauggaagacagcaccauggcacguguauaccuauguaacaaaccugcacauguaucccaggacuuaaaguauuaaaaaaaaaaaaaaauggaagaggggcugggaagcuuugggcugucagagaaagucaauuuccaggcauuagccacucaaacggacuuacacuucagacuuaggaggcagcuucagacucgcuaaaauacuauccaugucagaauucaaauccuuccucuucacacccuccugauagauguaaaagcccuucccagauuuacgaccuaaaacaggcaagaaaagggaguguuacuauuuguucucagggagggaguguuacuauuuguucucagaacccuggccuggccaggcgugguggcucacgccuguaaucccagcacuuugggaggccgaggcggaggaucauuugaggucaggaguuugagaccagccuggccaacauggugaaaccccaucucuacuaaaaauacaaaaauuagcugggcgaagcaggaggaucgcuugaacccgggagguggagacgagauuaugccacugcacuccagccugggcaacagugugagacucugucucaaaaaaaaacaaaaaacaaacaaaaaagacccugaccugagaauucuugucucuguuggucuauuauaaagcucuggccucuucugaauuccugaauuuguaugucuagcuaacccuagcaaauuagucuuugucagaagagugggcagagaaggaaagaagaucuugugacccggagcuugggcaucuguguacauggaugagaaaggccaccugggugaguuuuaacauccccauaugcagcaccggguccuagaacacccagguuguaaugcugauuuugcuguuuugccaagacagaaagucacuucucugugggccucaacuguauacuguguauggugagcuuauacauucuccucacagguggccagacagcaugguaaagcccggaugcagagcuugcuucugcacuauugcagauuucaucucugggggauaaaaaugcuuguccaucuggcauaacuuggaccaggugaugcuagagccccagaaggguagaacucugccuuuuguccauaaucuauaguccuagcccuuagaagguucacaugacaucuuuuuuuuuuuuuuuuuuugagaaggggccucgccauguugcccaggcuggccucacacuucugggcucaagcgauccucccaccucagccuccuaagcagcuaagaccauaagugguugcuaccgcaccugacucauaaaaucauuuuugaaaucgccagugauaagggcucuguguuuagaaaacuuucuuccacgagggcuucuguaacucuuuggucucaggaacugcuuagaacuuuguaacuaauggugcuaguuauguuuccuugaggcuacucaccuaggaagcccuuggacaccaucugugucagcaguucuggguuuccaccuccaaaccgcuccccaaagacuuugcccagaucuuccgccacauguuucgcuacauccacaccaacuucauccaccaguguggcggcacccacaggaaagccaaagcuuguggucagggaauccagcuucuucgggucaacuccuuccugaacaggaagcgaugcagggaccucaggggaagggcagcccaaauccccccaaagggcucccuguacuggcuccaaacacugccuuguguaaaacccacuucugagugucaccugaccaggcccaggacuggugcuauuucauucagggaagcacaaagaaguuuggggccacaaguggaaagucugagccuucucuaaucuacagcacuuuaaggacguuuagagaugacuaaauucuucauuuucuucuuguuugcauuucugaaucucaauaauaaggagauugcaugacagacggcugagugugucaugaccaacagaagaaacaucaucaaagaggagcacucagagcccugugauccccaagucuggguaagugcccagcgaggaggaucccucuccuuuccugccagaaugaccucgauggcuacuggagaggucugugugcuguggaaacagaugcagcaccaguugaaccaagcgggcccuguucuggauggucccugccucagagaggugcagaaacagcauagaagacaugcugggggguggggugccuuuagcuugcuggaacagugaggaggcuguggggcagagggaaagcucugccccuuucagugcaguauaagcccaacuuccgacugcugugcagagagagggcaccagggaccuuccuagacaagagcaggaguugguguaucagaaggaagcuugguccuuaucuugacaucaugaguuuuagagugacugaaggaguggaagaugccgcaaacacucuggagagcaauaccaaccuggaggauucggaugacuucagacaucaugggcgcaagacaccugguaguauagaagccagguccauccugccaaggaagagaacaugagcucccuggcccugcugcugggacugagucugaaacacucuaccuuucccagggucacuucaaagucauuugaaagucacuguaaaacuuaaggugacuuaaaaucucaaucagaauccuuaaaaaugaaauugcaggggaagccguacuagggguagccuggcuugaaucaaacaguacagcagauaguuucauggucaccuucaaggucugggauggcugggagaacccugccacauccuagauacuccccacucccaccuugacucagugggacagucaauaccaccguccauccuggagacaacccaggggaaaaucauaucaaagucuggucauuugccccagaauauuuauaaacaagccuggagguaaaaggagucuuauuagaacuuuucaaaaacucugcagcucuguuauacagccccuuaccuuaaccacaaugaugaccuuccccugcuugagaccaacugcuacagcugaagcacuggugucuuuggaaguuuucucggucgugauaaucuccagcagcugcaucuuguccacgggagagaaguagugcaugccaaucaccuggcaaggggaaccaaaagccaacagaucggagaaugcgggugaggaaccugagagcauuccuucucugcuaggaaaacacuagaaagaaagguggcugugauauaggaauacugcuugacauagcugagugguuugguuccaugggucuuugauaaaaguuuaguauguuuagggagagcacauuggaauccuccucuuccauuugcuucuaagguuuuucacuacagacaucugauccucccaacaaucagugccaaaaccacagcucgaggccaaacuagauuuauuggggaacgacggaugaagguuccacuuauauuaaugauacugaugguuuagauaagaggauccaguuuuuuugggcggggguggggcaggcagaagaauuaauguguugggcugucagagaaguauuugcauuuuacacagaugggucucaccaccaggauacuagguuuaacuaacacuccucaacagucagaugcacuuaagacucauuaaaccagcaguucuccaaguguaguacccggacccaacaagcacugucaucaccugggagcguuaggccugcacauucucaggccuagcccagcccuacugaaucagaaacuccauggguggggcccagauuuguuuuaauaaucccuccuggugauucugaugcgugcuaagguuucagagaaaccccucauugagcuaacaguuacauagucuucccaacagaacuguggugaaagaagucuaauucauuaauuuauaguuuugcuuucucccucucacuuuagcuauaagguacaacaagugauaucuguaauuuuuggcugcucauuaucuaccugcucuucaauacauuuaccacuuauuccuuacauuuaauccauuacaacccuaugaacuggucagccuaauuaucuagaugaggaaaaaagguaucaagagguuaguaguacagagucagucagcauaugacggggugggauuccaucacaggucugucuaucuccaaugccauuauguaauacacagaucaaguaaauguuauguaaacuuaucaauccaaaaguuguuucuaaccccuaaaguguucuuuuacuuacaucugaaauacuuaggaccugauucagacucaguacuccugagcaaaaggaauuagccuuuauugauguagaauuucuauauaauaaaaugcacagaucuugaaguguucacaucaaugaguuuugacaacuguauauacauccauauaaucacuaacccaagcaaaauauauuuacaucacucagaaaguugugccaaagaugaccaacucauccuggauggcuggggauuucccaauuuguggcacugaggguccuguaucccuugcucccgggcaaaccaagaugguuggucacccuauuuugucuuuuuggccuuacuuuuaaaugaaugacaaaaggcaagcaggugagaaaagcuguccuagauacuuggagggcagaacugcaaagugugaugcuugcucugcuccgauggcggggagagguuaccaucaaaugaacagcaacggcaucgccuguacugauuuuagaugccacacagaugucuugagugauaugacauggccagacuguccaucuguagacuaucggcugcaacuucucccuaugaccuuuagccugccaucauugagccugccucugucagguccccgcaucacuucuaaucugcugugugcuaggaaacuagauuaccuugcauuagcaagcuagaagaguaggaauaaauaggcuuuuguguuuucaguacauagaauuuguauuaacacuuucagcugcuuaaaguucuuuuauaauuccugccuaccuucggcugguucugguuagcagaggcuaacugguauccuccagagaagugaguuguuuuacuucucuuugaaugauuucacuuccccuuaauuacucugguugagagcaaaaauaaauuucugggcaucauuccaaauacucacagaaagugcuucuauacccagcccuuucaugucccgggguagaagguguaagcaaacccacgggcagacacaucccaccauuccugccauucccugaucuggagguggaaccaaaccuguucuaaacagucacugacucugcucuguagccaaacugguauuuuggagcauccuuucuuaaggccuauccuucaaugccuaauucuaggauacaggugggcuuuauauccugaaccugaaaaauaaugcccauuugggauccuugaaaaggauauuuuuuguuguacuuaacuuacuccugcaucucacacuagucaugguauuagcauuuauuguguccaguguuuaggaaccacccgcauccacuccguaauccacugucucuucuguacucaagcuguaagccuuuaucagugaaucugaagcaauaaaacaucucaggguuuuucucuguuccgaguuuaccuucucaggucuuuugcugacagcagcgauuucacugauugggagagcagauguguuacuggcaaagauacagugaucuggaaucaccugcaggggaaaagcauuuaacaaugugucagguaggccugggagaugauuagaggccacaucaaagcuaaugagugacaccugggcccagcccacucugucccccacaacugcucagacaguagaugucacucacccagacauugacggaucaccuaggggguuuugugucggggaauauguugaccuuguuccuuuucccauucugccuuccucuaguuauggcccaucauaaggucaccuuauccugaccuggagacuacaucucagcaguugggucaauaaaacagcuuagaacaacacugaaaagacggccuugaauugcaauucauugauuucaacacccagcaugggugucaccuccucuuuuguuuggaucugcccugaaucacuccccgcuucaccuuuauaagaacaagccaaaaugugcaugcuugucucauuuuauacaguguguuacuaaaaaacggcauaccacuauaguugcagcuacaguacacaaauacuauuaacuauuagcuuuauccaccuggagaauagucucuaaugcagauugucuccgcauucuggccacgaucccaacuuauucauguuuuuuuuuuguuuuuuuuuuuuaaagacagagucucgcucuguugcccaggcuggaguguaguggugcaaucuaggcucgcugcaaccuccgccucccaguuauucauguuuuuauucagaugguuggaugagaaacguggaagggacaccugucaaaugugugcaaaucuggaacaggcagaauccuaacagagaugagaaucaaggaggaagacacauucaacacacugaaaagcugaguacaaaauaagauuauaaugcaauaaaaguaaaguacugccuuaagauuuaaaaaaaaaaggaaagaaaagaacuguauagguacuugaaggacaagaccuggcuuggcaguauuugugauaaagaucccaugauuuuaguuaaucaagaguggagggugggcaugguggcuaaacaacuauaaucccaacacuucaggaggccaaggauggaggauuacuugaggccaggaguucaagaccaaccucggcaucauagugagacccuauaucuacaaaacauaacuuuuuuuuuuuuuuuggagacaaagucuugcuuuuucgcccaggcuagagugcaguggugcaaucucagcucaccgcaagcuuugccgccuggguucaagcaauucuccugccucagccucccgaguagcugggauuacaggcaccugccaccaugccuggcuaauuuuuuuguaguuuuuaguaaagacaggguuucaucaucuuggccaggcuggucuugaacuccugaccucgugauccacccgccucagcaucccaaagugcugggauuacaggugugagccacagugcccggcccuacaaaaaauaacuuuaaaaaacuagccaggcauggugguacauacccauaguccuaguuacucaggaggcugaagugagaggcucgcuugagcccaggaguucaagguuacagugagcugugaucaugccacugcacuccagccugggugacagagugagacccugucucuaacaacaaaaaaacaaaacaaaaguggaaugaauugacaguacagcaugacugucagaaagcuuacguagugucagguuacuuucuuaguaauauagugucuaaugcugguggugaaauccuuucugaagagcaaacuaaugucuccaaagcuggcuggcaaacauucuucccuuccuuggacauguaugucuuuucucccagcuagaaguagagucuguuucccuucuccuugaaucugggcuggucuugugacuuguuuuuaucaacacaaugcagcagaaguuacccugccaguuccaggccuaccuagaccuguggggcccgguagccucuuuuuuuauuuuuuaaauuauuuaucuuuuuuucuuccugacaauaaacuuaggaagcucaguagcuucugcuuuuguucucuuggaagccugcagccacgcuacaaagaaguuguggugagacgacuaagugaggauggacuaugagagaugugggggaagcagugaggugccccaaccgagcuuccugcggaaugcagcccaggagugaccccagccuugaaaucaauggacuuaagcaccacugucucugcagagcccugcccagauugcagaauugugaaaagauaguuguaaacacagcaguagaacacggagacaugaggaagauacuagagaggacaaccgaaacgggguggucuagagaucaugccuguggaagauuguccaaggaauggguuuuguuagcucuaugggcaauaagagaagauaauguuuguuuguuuguuuauuuauuuauuuugagacggaguuuugcucugugguacucuuauuuuuuguaaugagcucacugcucauuauauccagcauguugccaagucagaaucauuucauguucaccuuucaguaacccacauucuguuuauccaacuguagacuagcuuaggccuugguccuaccucaucccugaauuacugcuauuacuccuucucggggcuuacucuuccuacuccccacuucaaguacuuguuuuguucaugucagcccaucucaagaagugccuauggagaacauuugggagcugggccaaagcagcauuuccacagaacaagcaucuggacgaacugucuucccuauuuccuuugcagccuuagaccugaagagguuuguuuuuggcuuucggcuaaccaaaaaaucucaaagcaucuggcuauacucugugagguuaucuguauguuugggugacagagcuccuacaugaauaaggugaacgcacccucauuuucuuccuuuagaauuuagauuugaccuuuauaacauaugcagugugcaugagcacacauaaaaacuuaacguuugauaacaaaaagucuuuuuuuuuuuuuuggagauggagucucgcucugucacccagacuggagugcaguggcgugaucucggcucacugcaaccucugccucccagguuccagugauucuccugcuucagccucccaaauagcugggacuacaggugugugccaccaugcccggcuaauuuuuguauuuucuaguagagaugggguuucaucauaucggccagucuggucucgaacuccuuaccucgugauccgcccaccucagccucccaaacuacugggauuauaggcgugagccaccaugcccagccuuugaauaguccuuuuuauaaaagcaaucaugaguuuccuauagcuccuuuaaaaaaaaaaucucuguguuuucuguucacuacacuaggauucaaguacaacagccccuugcuuaccgcuucuacuuccuuuagcacucugugcuuaagacuaagguccucaaacacagcuucaaucaccaugucggccuuuucaaaaccuugguaaucaagcugcccagucaaguugcugaagauggaaucccuuucaaaugauguuagagcuuucuucuucacuuugucauucaaucuagaaaaaacacauuccuaguuagaugggaagaaaaggaaacuaacguuuauugaauguccaugggccagagcacaccuguguuuuucaccaacucugugagguaguuauucuauuacucccauuuugagggagacuuucaaguuguuuagucuuagagggaccuguggucaaauagcuugauaagggagggugcuagcauucaaagacauguuaacucccaaguacacauucuuucuaccauagaaugccuccaaaugcccaauuuacguaaacuaaaucacucuuaaaccaguuaaauuugccaagaggaguaaauaacaugaauacuagaauggcaaaacaaaagaggaguucugguaauucucuaccuaugacaggggaagcagccaaagugugucugagaccacaugguuuauauuugcuuaucgcaaauauauaauuuuauguuauucuguaguuguaaucuuuuuuuuuuuuuauuuauuuuuugagacggagucucgcucuguugcccaggcuggagugcaguggcgugaucucagcucacugcaaccucuugucuccuggguucaagcaauucucugccucagccuccugaguagcugggauuacaggcgcccaccaccacgccuggcuaauuuuuuuuuuuuuuuuuuuaguagagaugggguuucaccaucuuggccaggcuggucuugaacuccugaccucguguuccauccgccucagccucccaaaguguugggauuauaggcgugagccaccgcgcccagccugugguuguaaucuucuaaagaacagagaccaagcauuauuuccuauauucuccaucuacuucccacucauuaccuaguagcacauugcacugauuacauaaaauauuaacucaagguuucuuuuuucccauagggagcagaaaaggauuccuguuauucagacauucaacugauuauuuuucgucgccaagggaaacagguucucuuagauuccgucugaccacacuuucagaauaaauuaccuacaguuuuccucuaaaugaagaaugaagcuaaaccccauucacuaauuuccuuaaccaaaagcaaaauuaaggccacaagauaaauacaaaggaguauucaaagaaggucuuaagggcugggcaugguggcucacaucuguaaucccagcacuuugggaggcugcagcaggcggaucacuugaggccaggaguucaagacaagccuaaccaacauggugaaaucccgucucuauaagaaaaacaaaaaucagcugugcaugguggcgcaugccuguagucucagcuauucgugaggcugaggcaugagaaucgcuugaacccgggaggcagagguugcagugagccaagauugcaccauugugcucuagccucgguaauagagugagacugucucaaaagaaacaaaaacaucaaauaaggucuuaaaaguaugggcucaaagcuuuuguuuuugacaaucaugacagcagucagcaaacaagauacuugucagcauucaaaacauuaucaguugcucuaauucuaaugccugauuaaacuauucccaagagaggacaggaacuauugucccaagucagcaguguggugagcggcacucgccagaaccugauguuucuaagacgaaaaggggaacccaggacacuauucaagagagacugggggaggaaacuauuuuagagcaacaauuucuuacuuuggugaugguauggaaugcuguuugggaugcuugcaugcuaguuucagggcacugcugcuaucuagcacacaucauuuuuuuggucagaaucuucuacuacaacuuguuaucuuacaauaaucugccaacacgaugaaaccugccagguccugguuagcauuauggcagcaauaugugagcuucucugcagaaaagggauaacaacaugcuuaagcuaucuaauccauuuaagaaacaaaaaagcucacucagcuaaaagucacaugcaggaugcuuuaagugcagccagcuuguccauuaaaugugagcagaaaacugaucaaaccaacccuccauuuggccaagcugcugcuccaccuuccccucugcaaaacaggcagcaugugugugauggugagagaggcagguggugaggaaggggaauaauauucccccuuuauuaauucagagguaagauggagauagucuguaaagccccagacacuguggagggaucaguucauggcuucucucuguaaugccagucaggaaauaaaagucugaagaguccugaucccggcccugccuucccccugcaguuacugcccauuuccuuacauccuaaccucacucagucuucucaacagagacagucaugcuguuugaauaauccuuaacaauagagcaauuaccugcaaacuauaucaaaauccgcaggccugauacgaaaguguaaaauggcauuaacaaguaucuacuagauaagauuuucccuucugcauucaaagacuacagacuccaaggauguuaauugucuaugauaucuauaacaaaacgaagucaaagaaggaauuggcauuucuaaaaaucaaaagaaacuuggcuucacuacggaguaucuagaacucauuauguucaggaaaaaggaauccgugauggcaagaacaaacaaacaaaaaaacccaccaagccaccacaaaaaacaacuaaccaagaaacaaaggacauucuaacucuugcaaagagagagagcaggcuuacccuuugaacacuuguugcuguccucggucuagcgcagugaggguggcaucuuuaaguauagucuuuagccccuuauccacggagacuugggcgaugccugcucccaucagcccugcaccaagaauagccagaugccugcaaggcaaggaugaaaugacuuucgguaaacugaucuuaaucauuucagucaaaguggaagauugccuaaguuauucaauaaaccaacuaaugcaggcacaacuauaagguguuucaaauaauuuuuauuuauuaaaaacacagcuuuaauaaaugauugaucuuaaaaguuaagugcaaaaacccaccaggucuaaaagaacuggucuacccaagaagacagaauuauacuaaucuucaaucaugcuucgaaaucacugaaaucaaaacaaccaguuuacauuuaagucaacaugaguauuuuuguuuuucgaacaaaaagaccaaccucuuuucuuauugaacaacuuauuuguuagugauuuugacuaucugccagucaucuuucuuucuuuuuuugagagacaugguuuugcucccuuacccaggcuggagugcaguggugcaauccuagguuuacugcagccuugaacuccuggguacaagugauccuucugccucagucuccugaguagcucggacuaaaggugcauaucaccacuccuggcuaauuuuuaaguuuuuuuguagauagggucucacuaugaugcccaggcuggucucgaacuccuggccuggccucaaaugauccucccacaucagccucccaaagagaugggauuacaggugugagccaucguguaaucuuucauuucccccaaaaucugugccuuuaucacuccucgucuggaugaauucaaagucuccuccauggucucuuugcuuccagaccuuaucccuuccuuaaacacuuccacauaugcacauugcuaccuuuuuuugccccugaauuccucuagaacuucucaggacgacuugauuuaccccagaguauccuggaauggcuucguguccauuauuugucuccucaauuaaauucuaagccuuuugaggaccagagaucauaucugcuuauucauuuuaguucccuauaguucuggaauaauuugccauauucccauaguaaauaacuaagaaaaauuuuuaaagaaucucuucauaaaagaagcccaaguuuacagcacuguuauccaaauuagaguugaaaugagggauaaaguuucauucuuaaccauucugauuguaauguucaaaaaucauacuaaaguccugaaaaggaaaucuaacuucaaguccuaggagcaucuucuaaaugcagcuuuguaaugguacaaauauuuauauggugagugauaaguaauugcaggacaaugagaaaauacaguagagaaacaaaaaauagggacugaaaaaaaagacugauacauuugcuacaucaaaauuaaaaauuucuguuuuggcugggcacaguggcuuacgccuguaaucccagcucuuucuuugagaggccaaggcgggcagaucacaaggucaggaguucaagaccaaccucaccaaaauacaaaaauaaaaaaauuagcuggguuugguggugugcaccuguaaucccagcuacucaagaggcugaggcaggaaaauugcuucaaccugggaggcggagguugcagugagcugauugugccacugcauuccagccuaggugacagagugagacuccauuuuuuuuaaaaaaaaaaauucuguuugacaaaugaacccacaaaauuaagacaaccauagaaugggaagaauuugugacauauacagcagacaaaggauacuacuggaaaaacagaacaugcauauaucaauuuaaaaagacaacgaaauaaaaugggcaagggauauaaagcaauucauaaaagaacaaaacaaauugucaguaaagaugcucaauuucagccaggcacgguagcucaugccuguaauccuaacacuuugggaggccuaggagggaggaucgcuugagcucaggaguuugaaaccagccugggcaacacagugagaccucaucucuauuaugaaaauaauaauaauaauaaaaagauguucaauuucccuaauaacuggggcaaugcaaauuaaaaugagaugcaucagacuggcaauuuuuuuuuuuuuuuuuuuaagauggaguuucacucuugccgcccaggguggaguacaacggugcgaucucagcucauugcaaccucugccucccagguucaaacgauccuccugucucagacucccgaggagcugggauuacaggugcccaccaccacacccagcuaauuuuuguauuuuuaguagagaugggguuucaccauguuggccaggcuggucucgaacuccugaccucaggugauccacgcaccucggaaucccaaagugcugggauuacaggcguaagccaccacaccuggccaaaaauuuuaaaguaucaguuaggauguacaaaaaauuaguucaugcaugguucacggaaguauacuuuguccuacuuuuggggggguucuuugguuuuguuaaaaccaagaacugcauacuguauaacauaguaauucuacucgucauuaucuacuuuacagagauggacuuauacacaagaugacaugcugugaugaacagcuauauaauaauguuuguaaugaaaaauuguaacagccaguaauucgucaacaggggauuaaaaggaaggaguuaccugauauguacuaaucuacaucuccaagucauaucacugaguaaaaagugcaagcuacaggauccauacagaaggauuccuuuuauguuaaaacauaccauaaguauaggccaggcaugguggcacaugccuauaaucguagugcuuugggaggaugaggcaggaggacugcuugaggccagaauuuugagaucagccugggcaacuuagcaagaacucaucucuacaaaauauuugaaaaugagccggguguggugguaugugccuguagucucagcuacucaggagacagaggugggaagacugcuugagcccaggaguuuaagguuauggugagcugugauuaugccaucgcacuccagccggggugacagaaugagacccugucucuaaaaaaacaaacccaccccuuuccccuaacaaaaaaaaucccauaaacacaaaagaguaucuuauaaucuuauuuaugauaauuuuuuugaaaggagaaaaagaaugcauuauuuaguagguuuuuuuuuuuuuuuuuggugggagggcauuugcuggaauguuaacuuuagcuguuaauaacaauaauaguaaaaucuaaaacuguguuuaaagcuuuuuugguauaacagaauccacagcuaaaauauuacucauuucuuaacuguuaugcuccgcuucauuaacaccaaaauuuucaugauggcuuuauaguuguuuaauauuugucuacaacaauguagaguuaaauuaacacacuucacaaucuacggaauccuucuaauaaacaucuucagcacccuugaaaugacccacuuguguaauuacccagcaggcuaacaucuauggugcacgaugcuuuauaagccaacugcugggugacaugaacuuuugaggguugauuacacagaaauguugugauuugaggaaugcauaacaugguaccuugucuguauacuaauuuguagcucaguauuuuuuuucauaaguacugcucuucacuuauuagaacugauggaaugcguuauucauaugaaagauuaauuuguaaagagacaauagauaaggaauuccaguuaucauccaaggcaagggggaaggggccuagagaaauaauaguggaagaauuacugauaacugggaaagcaggaagggggacacccuaucuacaauguucauuauucaauuuucaguuuaacauauuuugccuuggguaucuuauagcuuauucuucauuucuaagaugaugcuaacuuuuucuucaaugucuuucccaaguuaggucaacuccuauauuuauccuguuuuucugcccauuuaguucugaguuuuugaauuuuugauucaaggcaguuuuuuuucugauuugcaaaugcugauuuaagaauauuuaaaucaaguucuguuauagucuucuucugcauugugguuguuuuuugggggacagaauuuucauaaacuucaguauucugauucucauuuucucuuuuuuucuuauauuagcuuuuugugggugcugucuuucuuuuuugcauacugacuacacaauaccaccuuuuccaagggguauuuuauuguuacauggagauguauacuaccuccauacgacaauaaaugcucaggcaggaggagucuggaguuaauaaauuaagacacuagguuuuuuaauuuaagaguacccucuucuguugcaaagugcaguuucuuuaauugacagcauucuuuguguacauggagggauacgguggggagggguagaaguugguguaucuagguuuuguaauuuugcaggaugcuucucugccuucuauuuaugccgugcacagggaauggguggcuuuguuuuccuuauuaaucuguugauuuuuguagaauguguaaagagauacagguuuaaguggccauaauuuuccuccugcaacauggaaguaauuuacccugcucaucgaaugcaagguacuaucaagguuagguggaacaaaugcaauuggcucuucagaugggauugauagcagucacuaaauguuugagagaagcaguuaagguuguauuucagauucuaauuggaaaucagcccucuugguuagaaucuuaccuguuucacccggacuucuuauccauuuuauuuuguauuuuguauuuguaaucucauuaaaggugagaggauggagaaggcaguaucauuagcugcuucucuuaaaucccccacagcaguucagcuagaacagcugaaccucaggacuacugacauuucgaacuggauauuucuuuaugguggggacuaucugugcauuauaggaugguuagcagcaucccuggccuccacccacagaugccaguagcaucccucccucccuaguugugacaaccaaaaauguucccaggcauugucaaaugucccccugggaggcaaaauuguccacgcugagaaccacagagcuacaaguugcaucauuaaacauagacucugaagagcuauuaggcagcguaauauggaaaaaggcuggcuuauggcaauacacaugaaagaggcaaacagacuuuccaauacuuagguuguaagcuaaaagaaggacaagauuuuaacaauuacaaugagguuuuauguuuuuuaaugaggaagaagugugaguucccagagaugacaucucaaaucacagggagagagaugaucauugaacagugcagagggagugugugguuugggaagggggaccuaaaccagacuucuaggcaacaucaauaugugacaagaaagccucuauaggaaugaccagagggguuuggaaaaaacucagaacaggcagaacuuugaaagccaaaaaguuuuuaguagacauaagggcucaaaugugcucaggaaagaaguugagggcaagacugaauuaagauacagaucuagcucuguagaucuucaaagccucugugaacuuugcacacaguaaaauucacaagggcuuccuacguagaguuuaacuuacuuaacauccuucuguggagcuccaaauuuauucuucuugcacaggaccugaccaugguagagucccaucaaggccuuugauucuuuggucauuacaagcucuccaaauuucugaaaaguaaaggggaaugagaaaagguagaacuucacagucuagguuauauggauuccuucaguucagguuccucugaagagcagagguaaugcaugugaagccugagucccuggggaugcgggggaguuuggggguucagugcugcagaagucugucucucacugaugugucuugucuuuacuugucuuaucuggagcacuuuccaacuacuguguugaagaaaguuuuggauauaacuaagcucucagauucuuuacaccagaggugugguaaccuuuuucauaaaacuagagucucagggccaaaaugagccuccacaaucaucucaaaccaacccucucauuuuacagauugggaagaggagguccaaagaaauggagugacuuugcucaaggcuauacugccucaaaguggcagaaauggaacuugaaccaagacaguaugacucugaacuccaguucuuuuuuuuugagauggagucucgcacugucacccaggcuggagugcaguggcacgaucucggcucacugcaagcuccgccucccagguucacgccauucuccugccucagccuccugaguagcugcgcuacaggugcccaccaccacgccuggcuaauuuuuuguaucuguaguagagaugggguuucaccguguuagccaggauggucucgaucuccugaccucgugaucugcccgccuuggccuuccaaagugcugggauuacaggcgugagccaccgugccucgccucgaacuccgguucuuuuuccacuguagcaggcugcccacgugggacuuaccacuuuuaaaaguagcuuaauuuauggagaaaaagucucaacuuggugguuaaaggcauaauaucuaggauuugacagauccugucucugccacugccccauugugaagcuuucuucauccuuaaaaaugggaaaaacaauacccauuuuacaguauuguucugggggauuaaaugagaacacuaguaaaaugaccagggucucaagguuagcuauuauuaauaucacuaggauauaaugguaagauugcaugguuacaaagagcauuucaaaagaaucccucuaauaaaguugcuuucaugacccaaaagaacauaaaaugacaacacaaucaaugcuuuacuaaucuugauacaggauguuuuaucuaauaaaccagugauuuucaaacaugggcaaaagauucaucaauggucagaaauuuagugggugccaauaagcauuacauauauaaaaagcggaauacacagaaaauacugagcacaaugcacacaggacaguuacugauucgugaaacuuauuccucaauuuuucuguacguauguuuaugugcacuugguuauauuuuuaaaaaaucagaaaugcccaaugagacaucuaguaccagaaguguuuuucugguacuuguccugagcucuucagauuuuuuuuuuuguccuuuuacagguugagcaucccuaaucugaaaauccaaaauccaaaaugcuccaaaauccaacuuuuugagugccaacaugaugucaugggcaagauauuacacauguuaugagcugcagucaaaacuguuuuaugugaaaaauuauuaaaaauaauguaugauauuaccaucaggcuauguguauaagguguauaugaaauuaauuucauguuuagacucugaucccauucccaagaucucucaucauauauaugcaaauauuccacuaucugacaaagucugaaaucugaaauguuucuagucccaaacauuuuggauaagagauauucaacuuuauaaaagagcaaccauucuucgaugaucguuuaaaacuuaaaaacaaacacaaaucacuuaaaucugcaacaucaccaaguugcuagaaaaguacacagguaaagcugguacauacaucucuucugucuucgucuuuuaguggguacaagauacuuccuuuccuuuuccaauuuaccaaaaaauucaauuucaucaucucuaggccuuaacauguaagaaaaauauuuuucugucuuuguauucauuuugucucaauaaaaccugcccaagugcggaacaaaaaacacccaagugacuuguuuugaaaggauuagaacucuguuccugcccuucguagagacaaccuuauuacuaaaaguaaguucaaacaucugcagaccauaggguuuuuucuuuuuuuucuuuuuuuuuggagacagggucucacuuugucacccaggcuggaaugcaguggugcgaucuuacuuagcucacugcagcccugaccuccuggacucaaacaauucuccugccucagcccugcaaguagcugggacugugggugcaugccaccaugccuggcuaacuuuuguaguuuuuguaaagaugggguuuugccauguugcacaugcuggucuugaacuccugagcucaaacgaucugcccaccucggccucccagaauguugggauuacagggguaaaccaccacgccuggccccauuaggguauucuuagcauccacuugcucacugagauuaaucauaagagaugauaagcacuggaagaaaaaaauuuuuacuaggcuuuggauauuuuuuuccuuuuucagcuuuauacagaggauuggaucuuuaguuuuccuuuaacugauaauaaaacauugaaaggaaauaaguuuaccugagauucacagagauaaccggcaucacucccuugcucaauuccagucuuuaccaccuaaaaaacauauaaagcacuugcucagcguuggaauagauuggcgagauguacaauaaugcugaauaaaauugccaguguuguuaguccucaaagaguaagucaaaagucuagacuggaaugagaaagagaagaggacugaggaucuggcugcucucgacugacuuaauucuccaucuuugaggcuacugcuaaaucuagcauaacauggccaugagaaggaaagacaaagcuugaauuacucuuccggcuucucuccugaucuucaaauguaggcagauccucaacuuccacuuucagcccuuuucacucucuacacuuucucccucagaugcaugaccuaguuuaucacauuaaugaacucuacaaaauucaauguaacauuugggguaaguacuauccuaaguacaauggcaaauauaaaagaugaaaaaaauaacccuguacuuacucacuaucauaauuuaugagaaugacaaauuuuuagaaauaagcaaauugacaucucuaacucugacuucucugucuaaacuacuguugcuugaauuucccaaaauaucugaacucaauauaucugaaccuaacucauaaccucucuuuggcaagccuguugcugcuuuccuauuuuuacuauucuaucucagggccuuauucaaagcucaagccuggauuaucaggacaguuuugcuaauucacugcucuacuuugucucuccuucgaaaccauuuuuacccacuaccaugaaaauggcucucuagaaucuuuaucggacaaagguaaaauuucucaauucauuauuaccaaccuucuaaaauccagcuucaaucugccuuucuucagacuaacaucucauuaucccccacaaauacuggucucacuaauguuccuugaagagcuuguuuuccagcuuccauaacuuugcucuaaaugcccacccuccuuggcaauacuuucccuccuucaccuauccuccacccagcuuucaggguuggggucagaucccaugaggcacuuacugaucucuuugucucaugguaauuguugccuccucugucccacucaucuggcauuaaucuuaugcugccuuauaucucuuaaaggcuauccaccuuaacacauauauauaucuaacuuccccaguccagccugugagacgaaggcaggugggggcauguuucauauuuuaugugcuuuggugccuucuacucaagauauacuugcugacugacccauucaccaauucugaagucuuugguuauauacucucuuaaucuuggacuuuccacacugaaaaguucuaaguuuuaaagucuacuguuggagauuucuugaauccugugaucauuuuaauuauucucauugaucuuuugcagagcuucucuacaucauuacaucuuuuuuauaauuacagcaaugaagaaguccuugagggauuuuagguacugacaaugauguugaccaagaauagaacagagccaucaauuuuguuucaacuacuuuuugguuagugccugacacucuaauggcuuugugauacugauaugacuuagguuccuuuccugguuuucugguuuguuacugauacauuuaacugcaucaaucaaugaguaaguccagcacugauuuuccccaaauauaucacuuuauaugaguccuuacagcuugcuaugcccuucccuuauuuuugguaaauacuuuaauagcagaauuaagaaauuuaguacucaacauacaugguccagaauggcaauaaggaggagugaucuauauaaaggaaggaaauaugagaaaagugggaauauuggguaagacucacaucaauuauuuucagaggugcaggauaaaggccuuuagucugcuuucgcacuuuuucuuccacuuuuuuguaaaccuguugccugacaaauggaauagucauggcauacgcugucaauucuguaaaauaaaaugcuuuuagauauuuacuauaaagagccuagauucccuuguuaguuuaugcucuaaacucuauaaaaaugaaguaauucuagcuaucugcaagaacugcucuuuauucugauacacacaauauaaauuucaaccuaagcacuaccuuaaacaugcuaagugaugaauguuaaagcugggccuuggguacaugaguguuuauaacacuguuaucuagucuuuuuguguucaugcuuaacauuuucuaaaaugaaaaguuuucuaugacucaagggucaucauaaggaaaaaaaagguuuuaaaaauuggcuuuaacuggauaguguaaaguugaggaguuguuacaucuccuaccuaaggcugacuuuaugcuuugaguaaauaaugcauuuaccacuuccucauuuugaaucuacagcaaauaaaauuaaauucucaggaaagaagcuuugccuuuguucuuuaacaaugauacucacuuuccaccaaucccuugucucucuuuggagagaucuucuuaucagcuaguccuuuggcaaaaguaauugcaacuucuucuagguauucuauuguccguuccucuggagguuuuaguccugguccuauaaaaaugaaugcaacacuggaaugcaaaucaggcuuagaccagucccagguagugaaaaacccagacuugccaaagccaaaggcccuagcacagcguuccauuucagacuggagacugguagguggcaaagucauaaaccaagaagucaaagaagggaaaucacaaugaauagaggagaaacaauaugcucuagguagaaaacgcggucuuuaacuguuucauuugguuuccacuucugaguagaauguaguauguaacacacacaaaaggaaugcauuaugucuacugcaaccugcauucuugcugcaaaacuggaaagaaaaaagaagaaaucaugaaaucauuuguaaagacacuggggagcuauggaaguaacaaggacaacaugaacuaaaauucuagagagcaagagccuaucuuagcugaacugaugauugcugaucauuuucuuuucagggauguguaaugcuuuugggcauggacugaagacuggacuugacucaagcagaaggaaagugaaaccaucagaguuuuugguggucauguacaacagauuagaagcuagaagaaaccaagugcaaagccaguuuuccccaaggaacauuugugaaagucuaagaugguacacaaggaggaaggggcuagcucagagagguugagugaaaucucucauaguaucaugauguuuaauagauaagguacuucuauggagaagggggccugaaaccaauaugcaacugauuuuccacgcaaggccucugccagaucuugaaccugcuuggggcaagagguuacagagcuaggcucaaaaaaucugaagaacaaguacagugguucaugccuauaaucccagcacuuuggaagacugacacaggaggauugcucaagaccagccugggcaacauagugagaccccaccucuauuuaaaaggaauccaaagaacacaauuuauagugcugugaaaacagacaccuaccaggcucucaaucaaaagucuguaagagccacauuggaggagguggcuggggucaaaauggcaaucuugugcaguacugugguacuuaggaaacaaaaucccaacugagggaacccauagcagacauacaaccaaucucucccuuaagacauuugaccuauuuuuuuuuuuuuuuuuuuuugagauggagucucacucuguaaccuaggcuggagugcagcagugugaucuuggcucacugcaaccucugccucccaguuucaagcgauucuccugccucagccucccgaguaccugggauuacaggugcaugccacugugcccagcuaaauuuucuauuuuuaguagagaugggguuucaccauguuggccaagcuggucuugaauuccugaccucaaaugaucugcccaccucggccucccaaagugcuaggauuacaggugugagccaccgagccuggaccauuuggccuauuuugaaccuguguggggaaggaggaauaauaacuaagcccaaaacuuuggagugacaaaaguucaguguccagaaaaguccuaacacagucauaauccugagggaggccagggcagcuggaaucugugacgugaaaugcuggagagcagcugcugcacaacaggagagcuccagagcucuaaagagcgguccuugaaacucuggccgaguauuguucugcaugugcaugaggggaaacuaucugcagcugaggaaagaaccaccauaaaaggcaugaaaugaagcaaggaaagaaugacccauagccaggagacagaucaauaaauagacacagauucagaaaugaaaaaaaugauagaaggagcagacgugauguucaagacuacuguaaauucaugcuguauguuacagaagguagaggaaaacaggacgauaaugaagagaaacugaagauauaaaagugaaucaaccccagcuacuuaggagacugaggugagaggaucacuugagcccaguagcucaaggaccagacucggcaagaccccgucugaaaaaaaaaaagugaaucacaugggauuggauuaacagcagggauacacagaagagggaaacaucaggaaacuugaacacauggcaguagaaauaaccagaaugaaagaagaccuaaaacaaacaacccagagcuucauuuuugggcaauaucaaaugaccuaacaaugugaaauuggaaucuccaaaaaggggagggagacagaaaaauauuugaagaaauaauagccaaagaagucuccaauuuuuacgaaaacuauaagcccauauguccaagaugcucaaugaaucccagacauaauaacuuuaaaaaaaaucccaacaaaccaaggcacaucauaaucaaauugcuaaaaccagucauaaaaggaaaaucugaaagcagacagaggaagggaaaggcacaucauauauagaaguauaaagaaaagaaugacagcugggcacaguggcucaugccuguaauuccagugcuuugggaggcugaggugggaggaucacgugagcccagggguuugagaccagugugggcaacaugguaagaccuugucucuacaaaaagaauuuuuuuuuuaauuagcugggcaugguggugcaugacuguagucccagcuacucgagaggcugacguggaaagauugcuugagcccagaaguucggggcuucagugaguuaugaucauaccacugcacuuuaaccugggcaacagagcaagacccugucucaaaaagaaacaaacaaacaaaaaagugccaagauaaaagugacaacagacuuuucaucagaaauuaugcaagccaaacacaauggagacauuuauaaaguaccaaaagaaaaacauuagccggccaggugugguggcucauguaaucccagcacuuugggaguccgcggugggcagaucacuugaggucaggaguucaagaccagccuggccaacauggagaaacucuauuaaaaguacaaaaauuaaccaggugugguagugggugacuguaauuccagcuauccaggaggcugagauaggagaaucauuugaacccgggagguggaaguuucagugagcugagauugugccacugcacuccagccugggcaaaagggugagacucugucucaaaaaaaaaaagagagagaaaagaaacauuagcaaucuaggaaaaauauguuuaaaaaugaagugggaaauagacuuugucagacaaaucaaaagguaagaacagaccuacacuacagaaaacacuaaaggaaguucuucagguugcaagaaaaccaaaucagaugggaaucuggaucuaccuauacaaaggauaaaaagcacuaaaaaugguaacuaugugggcaacuauaaaaaagaucuuuucuaauuuuuuauucuccuuaagagauaauuaucuaaaacaaauauaccaauauauacaagaauuuauaauguauguagcaguaaaauguauaacaacaauagcaaaaauggggaguauacaaaauaaaugcauacucuuuuaagguucugacaccacaggaaaauauuaucaauugaaaaccggccaggugugguggcucacaccuguaauccagcacuuugggaggccaaggcaggcagaucacuugaagacaggaguuugagaccagccuggccaagauagugaaaccccaucucuacuaauauacaaaaauuagcugggugugguggugugcaccuguaaucccagcuacucaggaggcugaggcaagagaauugauugaaccugggaggcagagauugcagugagucaagaucacaccauugcacuccagccugggcaacagagcaagacuccgucucaaaaaaaaaaaaaaaaagaaagaaagaaaauagacugugauggguuaaaaauguauacuguaaaaccccagagcaaccauuaaaagggaaaagcaaaguaaaaggccaguaaugaagacaaaaaauauauauauuuuuuugagauggagucucgcucuguugcccaggcuggagugcaguggugugaucucggcucacugcaaccuccaccucccagguucuagugauucuucugccucagccucccaaguagcugggauuacagaugugccaccaggccaggcuaauuuuuuguauuuuuaguagagaugggguuucaccauguuagccaggacggucuccaucuccugaccucgugauuuguccaccucggccucccgaagugcugggauuacaggcgugagccacugugcccggccaauaaaaaauuauuaauccaaaagaaagcaggaagaagaaaaaaggagcaaagaacugacaggucacccuggaaggguuagaggacgcacccuucaccaccacugugagaaaucaauuugugaggugaggcccagcaucuuugcucugugguugcuucucuuuguaggucagaaauuacagugggaacugcuaccaucaacugggaucccuaaaugcaauggggauaaaggaaucccgggguggcagggcccaaguagcagcaccaugccaaaucaaggugggcauaguuaccauaauaaauaguggagccaaagcaguaaucagaauagucugacuugcugagaccuauagcauugggugguugaucauggugucccuaaaaaagaaauagaugggcagucuacuaacucuuacuugaucuguauaagcagaagaauucuaggucugguaaacagaaguauaacuugaaucaccugaagagagucauggccccuuaagcaauucccagaaaugagcuaguuuacagacccagaaucuccuuaaugaaagggaagcuguguccucuugaggagacuuuccuguuuaucuuucuccuacccuuccccaaaggaccuauggcuauuugccuugcagaaggggaaacaaugauuuuuuggggauuacuagacacuggcuucugaacuaacacuaauucuaggggacccaaacuucgcugugguccagcagucagaguaggggcuuaugaagucaagugaucaauggaguuuuagcucaggucugucucagugggccuagcaggucccugagcccauccugcgguuauuuucccaguuucagaauguacaauuggagcagacauacucagcaaugaguaauaucacuauaugcucugacuuguagaguaagggcuacuauggugggaaaggccaaguaaaagccacuaaaacugccucuaccuagaaaagaguaaaccaaagcaacaccacaauccuggagggacugcagagauuagugucaccaucaaggacugaaagcgguagggguggugauucccacuucauucucauucaacuugccuacucuggacagugcagaaaacagauggauccuauagaaugacaguggauuacuguacaucuaaucagguggcaacugcaauucuaacugguguuccagaugucguuuuauugcuugaacaaauuaacauacauccuuggaccugguaugcagugacugaucugacaaaagcuuuuuuuucuugguaucuguuaguaaagaccaccagaagcaguuugcuuucagcaauauaccuucaaugucuuaccuuagggguggguguauuguuuucaaccauauaucauaauuuaguccacagagagccugauuaccuuguccuuccacaagauaucaugcugguucauuacacugugauauuaugcugaauggaucuggugagcaagaaguauuaacuacucuagacauacuggggguaagacaugugucugucagaaggugggaaauaaaucccuccaaaauucagggccucccauguuagugaaauuucuggggauccaguggucuggggcauacaaagacaucccuucuauggcaaaggguaaguguugcacguggccccuccuaccacaaaaaaacacggagaacaccuggugggcugcuucagauuuuggagacaacauauuacucauuuggguugcuauuccagcccauuuacugaguaacuaaaaaagcugcuaguuuaagugggacccagaacaagagaagcuguucugccauuugggccacgugauucaaaccugauggcgccugaagugucggcagcagacagaggugcugucuggagucuuuaauagaucucuauuaggugaaucacaacacagacccuuaggauuuuagaaaaagcccuaccauccucugugaauaacuacucuccuuuugggaaacaguguuuggcuuguuagugggacuucacagagacucaaagcuuaaccauggggcaucaaguuacuggugaccugagcugcugaucaugaaacagauguugucuaaccuacuaagccauaaagugggguguacacgguagcacuccauuaucaaauggaagugguauauguaagacugggcuuaaacagacccuaaaggcacaagcugcaugaggaaguagccaaaauaccccacggcccuguucuucuuugucucuuccagccugcaccuauggccucauggggaguucucuauggccaguugauugguaaagaaaaacucaggccugguuuguagauauuucugugugauacgcagguaccaccuggaagugcacagcuguaacacuacagucccuucugggacaucccuuaaggacaguggugaagggauagccucccagugggcaguacuucugacagugcacccgguuguucauuuugucuagaaagaaaaauggccugagcuaagggucuacucugauucauaggccguggcaaacgguuugccugggugguaaggaacuuacagggaacacagaugaaaaacuguuggcaagguguuaugggcugaauuguguccccccuaccucauucauauguugaaguccuauccuccaguaucucagaaugugacuguaauuggggauagggccuuuaaagaagcgauuaaguuaaaaugaggccauuaggguguacccuaaucuaaucugacugguauccuuaugagaagaaaaaauuuggaaacacaaaagagaugccagggaugugcagacacaguaagaaagcagugccaucugcaagccaaagagagaugccucagaagaaaccaaaccugcuaacaccugaucuuagacuuccaguuuccagaaaugcgagaaaacauguuaaguuucuguuguuuaagccacucagucugguauucguuauggcagcccuagcaaacuaauauacaaggacaccuggggaauaggucaguggauagaccucucugaauaggcaaauaaugugaaaacacuugugucccauuaaaugcucaucaaagagugaccucagccgaggauuucaaugaucaaaguggaugggaugacucguucuauggauagcagucagcaucuuuccgcagucacucuuaucacugcuucaugaacaguggccaugaugguggguguggagguuaugcaugggcuuaggcaauauggacuuucacuuaccaauuugugguaaguggacuuauuuguggacuuauagaguaccuuaugguaucccacaccauuaugguaucccacaaagcacugcuucuuaucaaggaauucacuucucaguaagugaagugcagcaaugggccaugcucacgaaacacugaucuuacuacaucaccgggaagcaguugccuugacagaauggugggauggacuacugaagacuccaucacagugccagcuaaguggcaguauuuugcagagucaauguccuccaggaugcugcuauguuuuaagucagcuuccaguauagggugcuacuuuucccacagccaggauucgugaguccagaaaucaaggagagcaaacagaaauuacccaguucacuauuaccccuagugaucuaaucuaccagcaaaauuucugcuucuugucccugcaacuuugggcucugccugucuagagggcucaguuccaaagggaggaaugcuuccaccaggagacacaacaaugauucuacugaacuguuaguuaaaacugccaucuggccacuuugggcuccucaugccuuggaaucaacaggcagcagagggcggguacuguacuggcuggggugauuaauccugauuaccaaggggauauuagguugcuacuauacaacagagguaaggaagaguaugucucaaauguggcagaucucuuagggugucccuuaguacuaacaugaccucuaauuagucaguagaagaucacaacccaguucacaugggacugcuaguggccuagaagacauuuuaggaaugaaggucaccccaccaggcaaagaacuaggacaaacugagguacuuccugagggcaaagggaauaugaaaaggggaguagaaauaucacccuuuccacaccaaaccugguacacagccagugcacugcggugucaucugagggagcugcagucaaggacuugggucucuggggcuggcuaagcucuuacacaaaugugcauuccuagccuagaugccuucuauuccuaggucuuuuuauauggggacuuuggcugaggccuucuucaggugccucugcugagaccuugucaaaggaggaaggggaaaucuuuuauuuauuuauuuauuuuuuugagauggaguuucacucugucgcccaggcuggagugcaaugguacaaucucggcucacugcaaccucugccucccggguucaagugauucuccugccucagccuccugaguagcugggaaugcaggcauguaccaccacgccuggcuaauuuucguauuuuuaguggagaugagguuuugccauauuggccaggcuggucucgaacuccugaccucaggugaucugcccgccuuggccucccaaagugcugguauuacaggcaugagccacugcaccuggccggaaugggaaaucuuaaagacacuucucccagucuacuccacucuccucacccaggguccauaaagccgcaggaaccuuuuguucagggcuuucacaacagugagaugucccccacuuguaugcuaaucuaccagauccucaaccaguguaccauuccauggggaaaacgguacuggggggaaaaaggagcuggcacuuucuuugguuuuuagccuuuuguguaaacuaucaaaguaagugaauaaaggcuccacuguuacuuuccuuuuggguuguuuaauuauuuacucugauauuugauagcucaguucucuuuccacaucagcugaauacugaucuggaaauauuauaaauauucauuucugaauacaguaaugaauacuguacuauuuaugaggauuucuuauuuuguuaugaauauauauaauuaaccaaauauuuguguuucuucucuaucuccuuaucaucuaauauaagauguauccauaaugguuaacuuuauaucauagcauuuauguuacagaauaugagagaagagugaauuucacccaaggacucugcauccucuucuagggaaaggauuaguguauuuuugguuguauaaaggagaauugcauuaugucaggauaaaguaugacuccugucauugccuuuauuugaagacuauguauggcuuuaggagauguguaugggugucaaacagacaagggguggaguaugauagucuucagauauguuaacuuggcuaggcuacagcccaguuauucaauaaacauuaaccuagauguuacuaugaagguauuuuauaagugauuaaaguccuaucagcugauaaacuaucaauaucaggaaugaaugaggagacaucaguauagaguauaaaaacauuaaaaugacaaguauuaugaacagcuuuauugcaauaaauuuggcaaauuguuaauagaugaacaaauuauuugaaagacacaaacuacuaucguagcuuacucuagaauggagaaccugaauagcccuauaucuauuaauugaauucauaaguaaaaauuuucccaacaaagaaaacuaggagcccaggaauuacugguuaauucuaucaaguauuuaagaaauaauaccaacucuacauaaaaucuuccagaaaauauaagaggaggccaggcacaguggcucacaccuguaaucccagcacuuugggaggcugaggcagguagguggaucaugaggucagaagauugagaccauccuggccaacaugaugaaacacuguuucuacuaaaaauacaaaaauuagcccaagaucucgccacugcaccacuccagccuggcgacagggugagacuccaucucaaaaaaaaaaaaaaaagaggagagaacacuucucaauucauuuuaugaagccagcauuauccugaugccaacaccacgcaaaaauaucauaagaaaauuauccuugagacuuuaucccucaugaugacauaaaaauccuuuauaauauaugacaacaaaauggaguuuauuccaagaagcaaggcuaguucaauauucaaaaaucaaugugacugacauuauuaauagacuaaaaaagaagaaaaccccacaauuaucucuguagauggagaaaaggcaugacaaaauucaauacucauucucagcaaaccugauaaagagcacauaugaaaaaccuacaacuaacaucauacuuaauacugaaugcuuuccuccuaagacugggaacaaguugacaauacuuguucucaugacuucuauccaguauuguacaaaggucuuagacauugugguaagucaagaaaaagaaacaaaugacaucuauauuggaaagaaagaagucaaacugucuuuacuuacagacaacauaauuaucuauguagaaaauccucaggaaucuauuaauaaaaaaggcuacuagaacuaguaaaugaauuuagcuaaaccacaagauacaagguccauguccaaaaaucuuuguauuucuauauucuagugagaaauuaaaguuaaaaaaguaaaacagccuacaaguaugaaauaccuaggcauaaauuuaacaaaauguguucaagaucuauucacugaaaaguaccaaacacugcugagagaaauuuaaagaccuaaauaaacagagaacuuuaccauguucauggaugaaaugacucaauauuuuuaagcugucaauucuccccaaauuuauauacugacucaaugcaauuccaauaaaaauccuagcagguauuuuuguagauauggacaaaaugauuauaaaauuuguacacaaaugcaaaggaacuaguaugagcaaaauaauuuugaaagaagggaccugaguuggaggacucauacugcuuaauuucaggauucccuauaaaaauacaauaaucaagacagugugguauugguuuaacaaaaagacauauagauaacuaggaauaggaaauccaauuggcccaaacagauaaggucaguugauuuuugaucaagggaucaaaguaguucacugaggaaauaguagucuucucaacaaauggugccaggacauuuggauauucauaugcaaaaagggaagaaaaggcccucaauccuuaccucacaccauauacaaacuugaaaugaaucacagaccaaaauguaagagcuaaaacuagaaaauuucuagaagaaaguauacaggaacaucuuagugauauugaguuagaaaaauacuuuuuagaucccacacuaauagcaugauccauaaauacuccaaauggaucacagaccaaaauguaagagcuaaaacuagaaaauuucuagaagaaaguauacaggaaaacuuagugaucuugaguuagagaaauauuuuuuagauaccacacuaauagcaugauccauaaaagagaaacuugauaaaccagacuucauuaaaauuaagaauuucugcucuuauauagugaaaagauaagccagagacugugaggaaauauuugcaaaucauauauuugauaaaggacucauauccuaauauauaaagaacucugaaaacucgauaauaggaaaaacacucaguccaagaaaaugggcaaaaaauuugaacagaugcuucuuuaucaaauaagauauacagauauucaauaucuuugguaauuaggguaauauaaaaaccacaaugaaauaugacuaauuccagcugggugugguggcacacgccuguaaucucagcacuuugggaggccaaggcagggggauaacuugaggucaggaguuugagaccagcccugacaacaugguaaaacccgaucucuacuaaaaauacaaaaauuaguuggacaugguggugggcgccuguagucccagcuacuugggacgcugaggcaggagaaucgcuugaaccuggcaggcagagguugcagugagccaaaauuguuccacugcacuccagccugggcaacagagcgagacuuugucucaaaaaaaaaaaaagaaaaaagaacuguuacuacauuccuguuagaaugucuaaaauuaaaaagauugaccaugcaaagugguugguaccuagaacucucauacacugcuggugggaaugcaaaagaguauaaccacuuugggaaaacagucugacagaaaagcaaacacauaccuagcaaauacuaguggcauaugccucguaaucccggcuucuugggaggcugaggcaggaagacugcuugagcccaggagucugaggccagccugggugacagagcaagacucaaagucucaucucuaaauuuuuuuuuuuucuucccagagauaaggucucccucucucacccaggcuggagugcaguggccugaucauagcuccaugugacuucaaacuccuggguucaagcaauccuccugccucagccucccuaguagccaggacuacaggcaugugccaccacacccaacuaguuaaaacuuuuuauuuuguugagacagagucuugcuauguugcucaggccaaacuuuuuuuuucaaaagcuaauauauaucuguuauauggacuagccaauccacucuucaguacuuacccaacagaaaugaaacauuuguccacauaaagacuuuuuuuuuuuuugagacagagucucgcucugucacccaggcuggagugcaguggcacaaucuuggcucacggcaaccuccaccuccuggguucaagugauucuccuaccuuagccucccaaguagcugggaccacaggugcacaccacuacacccagcuaauuuuuguauuuuuaguagagaugggguuucgccauguuggucaggcugguguugaauuccugaccucaggugaucagccugccucagccucccaaagugcugggauuagaggcuugagccaccacgcccagucacgcccacauaaagacuuaaagaugaauguucauagcagcuuuauucagaauagcccuaaauuagaaacaacucaaaugcucaucauuuggugaacggauaaacaaacuaugguacauuucuacaauggaguaacacucagcaauaaggacaaacugcugauauaugcaacaguauggaugcaucucaaaagcauuaugcuaagugaacgaagauuaaaacaaacuacauaccagaaauguuuaaaaauuuuuguuuaaaagauggcaucucacucuguugcucaggcuggagugcaguggugugaucauagcucacuacagccuugaacuucugggcucaaacaauauuccugucucagccuccugacuagcugggacuacagguauacacuaugauacccagcuaauugaaaaaaaaaaauucuuuuuuaagagauaggaucuugcucuguuguccaggcuggucuugaauuccaggccucaagcaauucucccaccucagccucccaaaaugcuaugauuacaggugugagccaccaugcacggcuauuuuuggauuguggcaguguuuacacagcuauauacauuuucaaaacucaaauuauacauuaaaaguuggucaauuucaccagacacaguggcucacaccuguaaaucucggcacuuuggguggcugagggaggaggauuacuugagcccggaguuugagacuagccuggaaaacagagugagaucucguuucuacaaaaaauaaaaaauuagcugguguagcagcguaugccuguggucucagcuacucggggggcacaagugggaagaucauuugagcccaaaaaguugagguugcaacaagcuauauucacaccaccauauuccagucugagcaacagagugagaccccaacaugugugcgcgcgcacacacacacacacacacacacacaaaauuaauacauuuacuauuauguaaguaauaucucaauaaugcugauuuucaauaaauauaagaggguaaugaacacacaagucagaauaguggcuucuuuggauaaagggaggcaaagaaacugaaugggaggaaguagcccaucaguagauaucaauuauuguuaauauucucagguugguuguuucauuuauuauauuacuaaaacagacacaagaaacugaaggaagguuaugcauggauaaugauacagguaauuuaagaaccaaaaauaaugacuugacugaauucuguacuccuaauguucuaauuauaaagcaaaauaaaaaucagggugauguugaaaaugauuuaguauuagcuauuuuauaaaacuuccuuccuuagaauaaugacucauuucuuaagaguuugagcuucucucugugcuuccugugauauucaagagguuaacuguuuuuucuuuugagaugggagucuggcucuguugcccaggcuggagcacaauggcaugaucuuggcucacugcaaccucagccccgccagguucaagcgauccuccugccucagccucccaaguagcuggaacuacagguuugcaccaccacacccggcuaaucauuuuuaguggagacaggguuucgccauguuggcaaggcuggucucaaacuccugaccucaagugaucuucccgccucagccucccaaagugcugggauuacaggugugagccaccgugccuggccuaagagguuaacucuuuaagaaaauaaguaacuuuauaaggucugacucugagaugugcuaacacuuacccagggguuccaccaguuggucaaccagucccauuuucuuugcccugucugcacgaaugcuucuaccagucagcaucauguccaaagcagcaggcacacccaccuaacaggcaagcaaggaugagaauauagggggaaaaaaaucagggugauaauuauauaguuuacaaaucaucaaaugaacaaauauuaaaaugagaaaagucaagccauauguuuaugcuauuugucaacagcauagauaaguuauauuuaauauacugauauacacuuggguaacuuuggggauuagauaccucuagcugaagcaaaaaugucuuuaucucuuaauucaauauauaggauucuuauacuaauaagguaaagaauuucauguuuccuaaaauuguacauuucuguuauucugagggguuuuuuucuaucauauauauaauauguaaaauucuggccaggcacgguggcucacaccuguaauuccagcacuuugggaggccaaggcaggcgggucaccugagguuaggaguuugagaccagccuggcccgacauggugaaacccugucuuuacuaaaaauacaaaaaauuagcugggcaugguggggcacaccugucauuccagcuacuugggaggcugaggcacaagaauugcuugaauccggaggcagagguugcagugagccgagaucaugccacuguacuccagccugaacaacaaaagugacucugucccaaaaauaaaauaaaauaaaauucucauauugaaacuagagaagacugugagaaaccugauaguuuugacaaagucuuuaaaaagaauuuuaagcuuaacaaaaauagaacucagcuagggcugcuuauauggcauacuagaagaaaggcuucuagcaacauucaaauaccagcuauaguuuaagaaaaaaaaaagaagaaagaaagaaacucagcaaauauuuuugauacacauauaugcauauucauucuuucaauaaauccuuaugacauuccuaugaaggaaagcacauuauuauuauuagaaaauuaacaccauaaaccuuguuuucuuuugugcucaauugagaucaacuucccugcaaagaguauuucuguugagccuuguuuucacugaggaaucuacagugccagaagcuauaagguucagugggcccuugaguugacauuaagauugcucugcagcauccaggucugacuguccuucccuucuccuuggaauucaaagccugcugagccucuuuugguuccauacaacacagcagugagaacauccaaaucagacaaugagggaaaaggucugccucuuauauuuguaaugaaauauuaauaugacucaugguuuugaaaaacuguuaagaugguauuauguggaaaaggaaccaauuaaaccauaagcuccagaaaugcaagacaugcaucuuaguuaucuuuauccuuccucagagacuaacaaaggaccuugaucaauaauucuguggaauuaggccaggcauggugguucaugccuguaguccuagcacuuugggaggcugaggcgggaggauuaccugaggucgggaguucaagaccagccuggccaacauggcgaaacuccaucucuacuaaaaaauauaaaaaauuagcugggugcaguggugcacgccuguaauuccagcuacuggggaggcugaggcaggagaaucgcuugaaccugggaggagaagguugcagugagcugagaucacaccacugcacucuagccugggcuacagagcaagauuuugucucaaaaaaaaaaaaaaaaaaaaaucuguggaauugaaaaaauaaguaccaggaauaaagucugucacugauccuguacacucauauuuuauuugguuuuuuaauucuacaaugaaugcccauauuaugcauuuuauacaagaaaacagaucuaaagagggcauauagcuucacaaaggggauguuagacucaccauuuugggcagccuuugugugccuccugcuccugguaaggcccccagcaaaacuucagggguaccuaauacuguuuuucugucuuuuguugcuauucuguauuggcaugaaauggcaaccuuugaacaaaugaaagaaaauuagaauguuagaaaauguaacuuaguagcaacuugagauggauaagggucuaaagauuauuuauaaagcaggaaugugcucacagaauaaacugaaauuccuuaggcuggcauuuaauaauuucuagaauuuaccuuuuuagccuuuuuuucauacuuuuccucuaauuuacuaaccucuuuuugggccguagaucuccuaaaaaaucuacugaaagcuagagaagcucucaagagaaaaaugcacacacaauuuuauauggaccccagguuaaaaagccccggacucuccaaucaagcacgucuacuuacaguguccuaguuggcuuugcuuuugccuuugcucacaccauaccauaugcggaauuguuuuucccuccauauucugguuaaucaaauucugcuuauaguuuaggaccaggcacagguuuucuuaauuaauauagucaugugucacauaaugagggggauauguucugagaaauguaccauuaggaaauuuuguuguugugugaacaucgcagaguguacuuacacaaacccagauggcagagccugcuacacaucuaggcuauaugggauagccuauugcuccuaguccagcaguccccaaccuuuuugacgccagggacagguuuugugaaaggcaauuuuuccaagaacuggggguggggugggagggagugguuucaggaugaaacuguuccacuucaaaucaucaggcaauagaggccaauggagugcgcaaccuggaucccucucaugugcaguucacaacaggguuccagcucuuaugagaaucuaaugccacuguugauaugacaggaggcggaacucaggugguaauguucacucgcccacugcucaccuccugcuguggggcccaguuccuaacaggcuauggccugggaacuggggaccccuguccuaaggggcuacaaaccuggacugcaugugacuauugaauacuguaggcaacuguggcacagugauaagcauuucuguaucuaaacacagaaaagguauagaaaaauguaguguuacagucuuauagaaccacugcuguaugugcaauuggucauugaaacguuaugugguaaaugacugcauaugugaaagugucuggcacagaguucagcaugugaaaagugcucaaugaauguuuccuuuuccccuucuuuucuuuccuacauguucgggucuaguaagcaucucuucucucaaaucuucuauuauuuaccgucuuuacuacugacaaagcacuuauauuaugcuuuaugugucucaaccagacuuaaguagcuuaagagccuagaucacacuucugaaucuuugcccugcaaacuugaacaagauuuuuacagcugaaaaggacauuagagaugcaguucaaaugaaaacaucacaccuucauuuacuugcuuugugccacuugcucugugucauguggauuaaggauuaacaccuauccagaaguuugauaacuaaaaacaaagcuauuuaggcacaguggcucacaccuguaaucccagcacuuugggaggccgaggcgggaggaucaccugaggucaggaguuugagaccagccuggccaacauggugaaaccccaucucuacuaaaaauacaaaaauuagcugggcauggugaugcacaccuguaaucccagcuacuggggaggcugaagcaggagaauuguuugaagccaggaggcagagguugcagugagccaagaucgugccauugcucuccagccugggagacaagagcaaaauuccgucucaaagcaaaaaacaaaaaacaaagcggauucuccuccagaaacuuuuuccaggcaaagcaguagccuaaggguuuacagcugaugaaugccaccaaugaguuggacagugucucaauaacuuuagaauaucuauaccucaaguccuccucccaggcaggauccauugauggcagccacaauaggcuuuguggacuuuucaaguuucucaacuauucucugugcuucuugugauagcuguguuacuucuugaagggucuugcaagcggcuaacaugcugcauuauccauaaaaguagagaacagagaaaaagauaaaacuauaauuuauuugguucaauacuuauucacuauacacuuauccuaucaugcaucaauauuugaugacaaaucuucaaauagaagguuaagaaugauuuugcuucaaauagcacaauagcagcaacaucauuucuccauaaagaguguuaaacuucuggauccaugagaccaucccggcuaacacggugaaaccccgucucuacuaaaaauacaaaaaauuagcugggcauaguggcgggcgccuguagucccagcuacuugggaggcugaggcaggagaacagugugaaaccgggagguggagcuugcagugagccgagaucgcgccacugcacuccagccugggcgacagagugagacucugucucaaaaaaaaaaaaaaaaauucuggauccagaaaacauaaauguguugcauaauuuauuuuuacuucuguaauaaaucauuaaauuacaaagcuugguacaagggaaaaucaucuuugguaaauuacuucacuaucagauuaaacauuucacuaucagguaguuaacagcaauaaaaaugacgcaaaagaaaagcuuccagguuguuuagagaaaucuaaaacauuuuaacagaucccacuaaugaauaaaaaugaccagguaggccaggcaugguggcucaugccuguaaucccagcacuuugagaggccaaggcagguggaucaccugaggucaggaguucgagaccaggcuggucaacauggugaaaccgcgucucuacuaaaaauacaaaaauuagcugggcguggugcugcauuccuguaguccuggcuacucgggaggcugaggcgagagaaucacuggaaccugggagguggagguugcagugggccgagaucgcaccacuguacuccagccuggacagcagagggagacuccgucucaaaaauaaauaaguaaauaaaaaugaucaggugcaaugauguuccacucaauguccuuuaauuucaguuuguuucauuugcuauuuugugaacacacuuaggauauggauuuuguacuuuugaccaaggauaacuaguauauucuguaauuuuauacacugagaguugcucagcuggccucauagaagcuacauguauuuuccucuggauauagguagcuacugccagguacaucagugucuuguuagacuuuauaaauguucuguuuaauguuaauuuuuuagaagacccaaaauuaucuuaucaagugguuuuucuucuagcugaauuauuugugccuaacaagagacugauuacuacacauaaauaauuacacuuucaguacaaauuacuaaaccuacaaugcuggcuaucauugucuaaaauacaaagaacauaacaaauacccauauuuuaauggaauugacaacuuaacauuuuaaccuauuaaacugacacuaaaauaucauuuccccuccuuauguauguguaaacaauuguaaauaaguuaauguaggcaugcauuccaccauuuagcagaggaaaagaaaauacuagcugcaucuguaaagcugccuuuaacaaucaaguccuaccacccacuucauuuccccaaagcagccaucuucauguuuguagugucuccuuccagaccaacuacgauuguguccauaaauaguaucaagaauuauuccauguuugguuuuaaaacauuuauagaaacuauauacuguaugaaacauucugcaauuugcuuuucuuuuaacuuaaccuuauguuuuugaguucuaacaucauauuguggaucuaguuaauuccuuuuaccuguuuuguaguauucuauugugugaauaguccacauuuuacuuacccauuuuccuacugacugacauuugguuuuaaauucuucauuauuucacacuacacaggaccaaacauccuuguacacugguucuuauaaacaaggggugagauuucucuagaucacaugauguguguguguguguguguguauauauauauauauauacucuguguguguguguguguguguguguguguguguguguguguauauacuuuuuuuuuuuaagacagucucacucugucacccaggcuggagugcaguggugugaucucggcucacugcaaccucugccucccagguucaagggauuuucgugccacagccuccugaguagcugagauuacaagcgugugccaccaugccuaauuuuuguauuuuuaguggagacaggguuucaccauguuggccaggcuggucuugagcucuuggccucaugugauccaccugccucggccucccaaagugcugggauuacaggcaagaaccaccacacccagccugauacguacauuuucaauuuuacaggccugugucacugugcccagcacuucuacuuucuuuuaaaaggagaaauuauuaggccuaagaaacacacuauuaaccaagauaaaaggugacuucaaguuuccuaaaacuuacuugauaucagcaccugcaauaaagcagccuggcuuugaugagauaaggacggcacuucugauuugaucacuagcccagauuucauucauaacuucugagaacucugaauguagcucuuuacucaguguauuuaccugccaaagggaaauauauacagguaaggguuuaaauuugaagcacuggauguacguaccaccaucaaaugcuauuuugauuauaagaaauauacuuauccggcagaaauauacuguuagaagagaguaagaaauaucauucucccagcaagucaguagcuuucuauucaggcagcuuuggcccacuacaagcaccccuuccuuuaaaaauaggucuucucaaaggagaaacucagggucauccucagaguuugaaucauauguaggcuauaaacaaauaggucuacaaacauuuauuggcauggaaaaaaucugcauaauguuaagaaaaaaaugaaauacaaauaagacauauaggccaggcaugguggcucaucccuguaaucccugcacuuugggaggccaaggugggcggaucacuugaguucaggaguucgagaccagccugggcaacauaauggaaccuugccucuacagaaaauacaaaaauuagccgggccugacagcacacgccuauagucccagcuacucaggaggcuuaggugggaggaucaccugagccuggggaggcugaagcugcacuaaccugugacugugccacugcacuccagccuaggcaacagaaugagacccuaucuucaaaaaaaaccauauaguaugaucuuaguuuuguaaauauuauucauugaaacugaauuaaaugugauuaucccauggaagauaccaagaaaaagaugugguuaucuuuagguuugaauuaugaauguuuauuauuuucuucuuuauaauuuuuuauaguugaaaaauuuucuaccauugacauauauuacuuuuguguucaggaaaaauguccaaccuaagaaaauucugaaaaaauaucuuaagcuugaaucauugguuagugagugcuaaaauuuacucuaguaaaggggaauggcucuuauuuaccuuaauuugugauaguugucaacugcuuccaucuaggucuuauuacaucuaagccucuggcuauaaguuuguuguuguuguuuuuuagagagacaaggucuugcucuguggcccaggcuggagugcaguggugcaaucauagcucacuguaaccuugaauuccuaggcuuaagugaucuuuccaccucagccuucagaguagcuagcacuacaggugaacaucaccauacccaacuauuuuuuauuuuuuauagagacaaggucuugcuauguugcccaggguggucucaaacuccugggcugaagugauccuccugccucggccauccaguguugggauuauaggugugagccacagugcccagccuggcuacaagauuuuuaaaguaagaauacaccaaauuuagaugggggaaaagcauggacucucacaauaaagcucuucuuggcaaaagaauggauuacuguuacacacuuuauugaagcugccaaaaacaaaagaaguuucaauucgaacagaacuugauuuccaauaugugaauugcauugagucauucagaucccucaggaagcuuaagagccaaguauccacauuucacucagccaacuuacuaugaauagugacuuaugucaggcaaguaaugaagaaaauggauuaacaaccucauauuuaagauggguaggcaaauuuugagucuuauaaacaaagcuuguacucugguucuucucuaauaagucaccuccucauucuacacuauaaccaggaggcugguggcaccuaaggucaacaagaggaauucuuacgcaagaaccucugcuuuagaaaacuggcucccuuggcaaucugucaaaguuuaacauaacugucaaaacuguaaauucauguaagauuacugccagauugguagauuuggggaaauaugggauacaucuuucccauucaggacuagauucauaaugcgguuagcagaaaaaaacugcaaauuaaaugagauaccuuugaauugggagaguuaauucgaacaacugccacauccccuuugacuccauaguuaauauggguucuggcuaaaaagaaaagaaagauuuauuuguaaacauauuuauugcaacauaaauccaaaaagcaauguaagcauacacauuaaaaagaaauuaaacuuacucagcaaagcagaagacccuguaaaauugcggcauauauaaccuguaagaaaagacauuucaaaauuaauuugcgaaacaauuucuguaguaccuuuuauauauaacaaagcuguaauuuacaauaauaacaacaacaaaaaccccaaaucuguacaauguauucuaggccauaugacuacugccauauuuuuuccauuucaguuguuaggucagaugauuauuuggauacuaaaagaggaagacuggcccccacaaagggauauacauccccagaaccugugaauauguuagguuacacggcaaaggggggauuaaaguugcuaaucaguuggccuuaauaaagaaaguuuaucauggauuauccaggugggcccaguguaaucacaaaagggaagagggaagcaaagagaaccaaagagauagcaauguaagaggcacaugggaacuacugacuggagaacccagugaagguggaguggaauaggggaggaucaucaguagguugccaaggcucuugcugccuccguauuuucucuuuaucccccaguuccuuauggaaagggaagagaaggcacaaaaaauagcagcuuuauacugguuggaaaggcaaggugacacauuaaaaaaaaaaaaagaaagaaaacugugguuagcaccagaagcagaauggggugauuucagguucugccugcauuucuucuuuaagcaauccaagccagccgacuuagugcaaaggcaaaggacuuguguucaaccaucagguuuauuuacuagcugugugacugugaacaagucucuuacaagugaacuucaguguuuuaagaugggagaagccagccaucuccucaauccccagugccucuacuugacuaauaguauguuuccugcuuugcuuuuccaucauuugaaaucugugucaucuguauuuaccacucuuccuucuuuauauuugcaucaugacuccacucuuuuccacaaaaccucaucuucggauucugucuacagugauccuuccuuuccuugccugcauuuuuauuuuauuauuuaauguucuguccucuaacugcugcaucuguagcagguguuucaccaaccacauuguaaucuuuuccaacauaaucuguuauucauucaacaaaaacauauauugugaccuccaugugccauucacuguucuaggcacuuggaguacagcaggacauucagggugaacaaaaaagacaaaaaucccugucuugguggagcuuacauuccaggucagcaggggauaugauaucugggaagaaucaguuccuacucagugaagauaaaugaaaagugaaaauaggccuggcauagaaaaaguuuuccugcaaaguagaaauuccagugggaagggaagaaggggauagguaauucuagcaaaacaggguaaaguggauuagagugggaaugaacugauugggaaugcagguugagagggaaaaaccaagaaacacaaauauguuagaaaauaagcaccuaagcaaaaaaaggaaauagagugagcauggguugcaauauuucaaaaacauuuuuuuucuuugagacgaggucucccuauguugcccaggcuggucuugaacuccugggcucaaguaaucuuccggaguagcuaggauuacaggcaugugccacuaugccccacuggguugcaguuuuaaagaucaaauauuugagauaacagguuaguggucauuagccaacaguuuaaaccauuuuaacuccuguccacuaaccuaccuaugcugcccacacacucauacacaaaaccucuccaagaucaagacaaauagaaacaaauagaaaaccaguauauacaugaacauacuucgaaaauaauuccaaaccagagucaaccaaaucaagucacacugcaagguagcuuugcuuuuggagucuagccuuacucacuaccuaacugcagagcuuacccuauggcagcugagugaacuuuagccuacaucuacugugccagcaaaguagagagaaaccuuugccccacuuuuuaaucaucuuuguaauguaacccaagaauaacuacaaaaccucauaagacuacagucagcgaagagagcuggauuaugcuaacauaaauuucaaauuugaaaacauuacuuugguuguaauaaucaacagcuuuucucaagauucaacacugggagaagcgacgagauuaaggaagugagaaucaaauuuaaaaauacacaaucuauggccgggcgcgguggcucacgccuguaaucccagcacuuugggaggcugagguggcuggaucaccugaggucgggaguuagagaccagccuggcugacauggcgaaaccccgucucuacuaaaaauacaacaacaacaacaaaaaaaaaaaaacaaaaaaaaaguuagcugggcgugguggcaggagccuguaaucccagcuacucuggaggcugagacaggagaaucacuugaacccgggaggcggagguugcagugagccaagagcgcaccauugcacuccaggcugggugacacagugagacuccgucuccaaaaaaaaaaccgaaaaaacaaacaaacaaaaaaaccaucuauuaagguauuugccucuaaauucaucuccugugaaauuauuuuacuacuaauaccuauuuacuacuaaauaccuaauuaggaauuuagauuuaggauaggagugggaauuagacaacauacucuggucaagaagugauuuucauuugauauucacauucagaauuauagcacuuguagagaaggaaugcuuuaaaauuucaagaauuacaagucuccuucaagauaauuuuuuuuuuuuugagauauggucucauucuguccuccaggugugaucuuggcucacugcaaccuccaccuccuggguucaagcgauucucccaccucagccucccgaguaguugggauuacagacgugugccaccacaccuggccaauucugguauuuuuugguagagaugggguuucaccaugugggccaggcuagaccucaagugaucugcccgccuuggccucccaauauacugggauuauaggcaugagccaccgugccuggccccuuucaagagaauuuuaucauccaccagcaaaggucauaaucucauuaaauguuuggcaaagccuugcacagacuuuuacugugaaggaucuauugagucuaaauaguaauauaagggugcaggucauuuuaaauucacuuuccagacuuuuuuucaaaauuuauaaauugcuauuaagggaucaguaacuacaacgaaugauacuuucuuacuggugaaaacacaaugcaaaguauauauuuaugugucuauauauuucuauacagaaaacagaaaaauuagguugguagcuuuuuauuacacacauaagauguacaaauuacuuuuaaaaacucucagauauauacaaucguauuucuuccaggcuggaguuaauaauauuuacugagugcuuacuccaugaaaaacugcuugauaucuaaaauaacuccuuuucaucacacaaggugguauuauuccccauuuuacaaaugagaaaacaaacacagaaauuaauugcccaaggucaucagaggguaaaaggcagagccagguccaaacccagaagucagacuccaaacaauguuuuuuuuguuuguuuguuuguuuuugagacggaggaccaggcuggagugcuguggcgcgaucucggcucacugcaagcuccgccucccgggcucacgccauucuccugccucagccucccgaguagcugggacuacaggcgcccaccaacacguccggcuaauuucuuguauuuuuaguagagacgggguuucaccguguuagccaggauggucucgaucucccgaccucgugauccgcccgccugggccucccaaagugcugggauuacaggcgugagccaccgcacccggcccaaacaauguuuauuaauugcucugucaugcuacuucucaugcaaaggaaauccaucaucucaaucauucauuuugcagaugaggaaaauaaagcccauuuaguuuaaggcauuuguccaaaguaacacagcuagugacuagaaccacgugcccuggcuaccacuuccgagugacaucagcugccgauccauaagaaauaccuucaaaccaaugcagggguaagauaaaaauuacacguuacuuuucaaaaguguugugaaaauaggggaaaaaaaccaccaaaccuguaaggaaacauaaccgaaggcuaaccguagguaagcauaugaguaguaagacaaugggugauucguuuuuuuuucaucucuuuccucaauccuuacagcauuucaauguucuauaaugugcuuauguuauaauuggcaaauacaugcuacaguuuuguggagacuaaaaacagcuguugaaaaaagggagcagaaaaauauucaaucauuaaaaaaauccccuuacaguaagggauuucagcuacuugucuaaaaaaagcauacuacuucagcgguuccggaagagggaagagagguaauucauauuacaaauuaaauuaaaaguuaaaauuucuaguuaaguaacuuauuaagcacaacaugcaauaaaacguuguccacuuuugacuuuacagauuugggauggaaagaaaaugcaacguuuccuacaaccacccacuuuaacccuuucacugccaguuugaaaaggaaaaacacuagcuaauacaggcugacugggaaucaucagauuacaaaucguucucagaacgaucuaacauuuuauugcuuaagguagagguauuagcguauuuuuaaagugugucuuccaguaaguugcagaacuucccgcugaaauucaaaauacuauacguucacacugacauuacugaaacugcaagaguugagcucccuacuugauugggguaguaagcacaaaaaugguuuugagggaacggagcagggaggggcagugaucugcaaggcugauuaaucccauacaagacagcgcuuguugcgggguaaggugcuguuuuuaagacagcucuuguugcggggcaaggugcuguggagccacaaagaugcgacagaauggaucccgauucuccuggaacuccggaucaagaaaauaugaggggcgugagcccagaagugcgacgcaagagacccgcggaaaggugacagaacgaguggcaccagacucagaaaguuggggaguuaggaagccugaaaucgccgcaggagucgugagaggggaagugacagucucuucagaaggucacgggaaaccgggucccagggcaguauccccacagagggcugcgucuccgggcuggggcaggcggcagcgaaagggagacgcggcuccggggccaccccagucccggcaggaguucugcccggaggucugggaugcccucggccaggccucaccucgggagcggaggauccugaaggcagaaaagcggcugaggaugccaaucgcccggcaggccaccaucuugagcugaagaggacagcaguggagagcgccucuaacgggugcggccgagcggaggacuuuucucccguagccuggcagccaggcgccuggagcacugccugacuaaaacccagaugccgaguggccgccggccccuuagcccugccccucgcuccuggcuaacauggccgaaaggucguauucuccgggggaggacgggggcccggagaggaggg

SEQ ID NO: 14302 - RNA, 55232 nt, Homo sapiens
cccuccucuccgggcccccguccucccccggagaauacgaccuuucggccauguuagccaggagcgaggggcagggcuaaggggccggcggccacucggcaucuggguuuuagucaggcagugcuccaggcgccuggcugccaggcuacgggagaaaaguccuccgcucggccgcacccguuagaggcgcucuccacugcuguccucuucagcucaagaugguggccugccgggcgauuggcauccucagccgcuuuucugccuucaggauccuccgcucccgaggugaggccuggccgagggcaucccagaccuccgggcagaacuccugccgggacugggguggccccggagccgcgucucccuuucgcugccgccugccccagcccggagacgcagcccucuguggggauacugcccugggacccgguuucccgugaccuucugaagagacugucacuuccccucucacgacuccugcggcgauuucaggcuuccuaacuccccaacuuucugagucuggugccacucguucugucaccuuuccgcgggucucuugcgucgcacuucugggcucacgccccucauauuuucuugauccggaguuccaggagaaucgggauccauucugucgcaucuuuguggcuccacagcaccuugccccgcaacaagagcugucuuaaaaacagcaccuuaccccgcaacaagcgcugucuuguaugggauuaaucagccuugcagaucacugccccucccugcuccguucccucaaaaccauuuuugugcuuacuaccccaaucaaguagggagcucaacucuugcaguuucaguaaugucagugugaacguauaguauuuugaauuucagcgggaaguucugcaacuuacuggaagacacacuuuaaaaauacgcuaauaccucuaccuuaagcaauaaaauguuagaucguucugagaacgauuuguaaucugaugauucccagucagccuguauuagcuaguguuuuuccuuuucaaacuggcagugaaaggguuaaagugggugguuguaggaaacguugcauuuucuuuccaucccaaaucuguaaagucaaaaguggacaacguuuuauugcauguugugcuuaauaaguuacuuaacuagaaauuuuaacuuuuaauuuaauuuguaauaugaauuaccucucuucccucuuccggaaccgcugaaguaguaugcuuuuuuuagacaaguagcugaaaucccuuacuguaaggggauuuuuuuaaugauugaauauuuuucugcucccuuuuuucaacagcuguuuuuagucuccacaaaacuguagcauguauuugccaauuauaacauaagcacauuauagaacauugaaaugcuguaaggauugaggaaagagaugaaaaaaaaacgaaucacccauugucuuacuacucauaugcuuaccuacgguuagccuucgguuauguuuccuuacagguuuggugguuuuuuuccccuauuuucacaacacuuuugaaaaguaacguguaauuuuuaucuuaccccugcauugguuugaagguauuucuuauggaucggcagcugaugucacucggaagugguagccagggcacgugguucuagucacuagcuguguuacuuuggacaaaugccuuaaacuaaaugggcuuuauuuuccucaucugcaaaaugaaugauugagaugauggauuuccuuugcaugagaaguagcaugacagagcaauuaauaaacauuguuugggccgggugcgguggcucacgccuguaaucccagcacuuugggaggcccaggcgggcggaucacgaggucgggagaucgagaccauccuggcuaacacggugaaaccccgucucuacuaaaaauacaagaaauuagccggacguguuggugggcgccuguagucccagcuacucgggaggcugaggcaggagaauggcgugagcccgggaggcggagcuugcagugagccgagaucgcgccacagcacuccagccugguccuccgucucaaaaacaaacaaacaaacaaaaaaaacauuguuuggagucugacuucuggguuuggaccuggcucugccuuuuacccucugaugaccuugggcaauuaauuucuguguuuguuuucucauuuguaaaauggggaauaauaccaccuugugugaugaaaaggaguuauuuuagauaucaagcaguuuuucauggaguaagcacucaguaaauauuauuaacuccagccuggaagaaauacgauuguauauaucugagaguuuuuaaaaguaauuuguacaucuuauguguguaauaaaaagcuaccaaccuaauuuuucuguuuucuguauagaaauauauagacacauaaauauauacuuugcauuguguuuucaccaguaagaaaguaucauucguuguaguuacugaucccuuaauagcaauuuauaaauuuugaaaaaaagucuggaaagugaauuuaaaaugaccugcacccuuauauuacuauuuagacucaauagauccuucacaguaaaagucugugcaaggcuuugccaaacauuuaaugagauuaugaccuuugcugguggaugauaaaauucucuugaaaggggccaggcacgguggcucaugccuauaaucccaguauauugggaggccaaggcgggcagaucacuugaggucuagccuggcccacauggugaaaccccaucucuaccaaaaaauaccagaauuggccaggugugguggcacacgucuguaaucccaacuacucgggaggcugaggugggagaaucgcuugaacccaggagguggagguugcagugagccaagaucacaccuggaggacagaaugagaccauaucucaaaaaaaaaaaaauuaucuugaaggagacuuguaauucuugaaauuuuaaagcauuccuucucuacaagugcuauaauucugaaugugaauaucaaaugaaaaucacuucuugaccagaguauguugucuaauucccacuccuauccuaaaucuaaauuccuaauuagguauuuaguaguaaauagguauuaguaguaaaauaauuucacaggagaugaauuuagaggcaaauaccuuaauagaugguuuuuuuguuuguuuguuuuuucgguuuuuuuuuuggagacggagucucacugugucacccagccuggagugcaauggugcgcucuuggcucacugcaaccuccgccucccggguucaagugauucuccugucucagccuccagaguagcugggauuacaggcuccugccaccacgcccagcuaacuuuuuuuuuguuuuuuuuuuuuuguuguuguuguuguauuuuuaguagagacgggguuucgccaugucagccaggcuggucucuaacucccgaccucaggugauccagccaccucagccucccaaagugcugggauuacaggcgugagccaccgcgcccggccauagauuguguauuuuuaaauuugauucucacuuccuuaaucucgucgcuucucccaguguugaaucuugagaaaagcuguugauuauuacaaccaaaguaauguuuucaaauuugaaauuuauguuagcauaauccagcucucuucgcugacuguagucuuaugagguuuuguaguuauucuuggguuacauuacaaagaugauuaaaaaguggggcaaagguuucucucuacuuugcuggcacaguagauguaggcuaaaguucacucagcugccauaggguaagcucugcaguuagguagugaguaaggcuagacuccaaaagcaaagcuaccuugcagugugacuugauuugguugacucugguuuggaauuauuuucgaaguauguucauguauauacugguuuucuauuuguuucuauuugucuugaucuuggagagguuuuguguaugagugugugggcagcauagguagguuaguggacaggaguuaaaaugguuuaaacuguuggcuaaugaccacuaaccuguuaucucaaauauuugaucuuuaaaacugcaacccaguggggcauaguggcacaugccuguaauccuagcuacuccggaagauuacuugagcccaggaguucaagaccagccugggcaacauagggagaccucgucucaaagaaaaaaaauguuuuugaaauauugcaacccaugcucacucuauuuccuuuuuuugcuuaggugcuuauuuucuaacauauuuguguuucuugguuuuucccucucaaccugcauucccaaucaguucauucccacucuaauccacuuuacccuguuuugcuagaauuaccuauccccuucuucccuucccacuggaauuucuacuuugcaggaaaacuuuuucuaugccaggccuauuuucacuuuucauuuaucuucacugaguaggaacugauucuucccagauaucauauccccugcugaccuggaauguaagcuccaccaagacagggauuuuugucuuuuuuguucacccugaauguccugcuguacuccaagugccuagaacagugaauggcacauggaggucacaauauauguuuuuguugaaugaauaacagauuauguuggaaaagauuacaaugugguuggugaaacaccugcuacagaugcagcaguuagaggacagaacauuaaauaauaaaauaaaaaugcaggcaaggaaaggaaggaucacuguagacagaauccgaagaugagguuuuguggaaaagaguggagucaugaugcaaauauaaagaaggaagagugguaaauacagaugacacagauuucaaaugauggaaaagcaaagcaggaaacauacuauuagucaaguagaggcacuggggauugaggagauggcuggcuucucccaucuuaaaacacugaaguucacuuguaagagacuuguucacagucacacagcuaguaaauaaaccugaugguugaacacaaguccuuugccuuugcacuaagucggcuggcuuggauugcuuaaagaagaaaugcaggcagaaccugaaaucaccccauucugcuucuggugcuaaccacaguuuucuuucuuuuuuuuuuuuuaaugugucaccuugccuuuccaaccaguauaaagcugcuauuuuuugugccuucucuucccuuuccauaaggaacugggggauaaagagaaaauacggaggcagcaagagccuuggcaaccuacugaugauccuccccuauuccacuccaccuucacuggguucuccagucaguaguucccaugugccucuuacauugcuaucucuuugguucucuuugcuucccucuucccuuuugugauuacacugggcccaccuggauaauccaugauaaacuuucuuuauuaaggccaacugauuagcaacuuuaauccccccuuugccguguaaccuaacauauucacagguucuggggauguauaucccuuugugggggccagucuuccucuuuuaguauccaaauaaucaucugaccuaacaacugaaauggaaaaaauauggcaguagucauauggccuagaauacauuguacagauuugggguuuuuguuguuguuauuauuguaaauuacagcuuuguuauauauaaaagguacuacagaaauuguuucgcaaauuaauuuugaaaugucuuuucuuacagguuauauaugccgcaauuuuacagggucuucugcuuugcugaguaaguuuaauuucuuuuuaauguguaugcuuacauugcuuuuuggauuuauguugcaauaaauauguuuacaaauaaaucuuucuuuucuuuuuagccagaacccauauuaacuauggagucaaaggggauguggcaguuguucgaauuaacucucccaauucaaagguaucucauuuaauuugcaguuuuuuucugcuaaccgcauuaugaaucuaguccugaaugggaaagauguaucccauauuuccccaaaucuaccaaucuggcaguaaucuuacaugaauuuacaguuuugacaguuauguuaaacuuugacagauugccaagggagccaguuuucuaaagcagagguucuugcguaagaauuccucuuguugaccuuaggugccaccagccuccugguuauaguguagaaugaggaggugacuuauuagagaagaaccagaguacaagcuuuguuuauaagacucaaaauuugccuacccaucuuaaauaugagguuguuaauccauuuucuucauuacuugccugacauaagucacuauucauaguaaguuggcugagugaaauguggauacuuggcucuuaagcuuccugagggaucugaaugacucaaugcaauucacauauuggaaaucaaguucuguucgaauugaaacuucuuuuguuuuuggcagcuucaauaaaguguguaacaguaauccauucuuuugccaagaagagcuuuauugugagaguccaugcuuuucccccaucuaaauuugguguauucuuacuuuaaaaaucuuguagccaggcugggcacuguggcucacaccuauaaucccaacacuggauggccgaggcaggaggaucacuucagcccaggaguuugagaccacccugggcaacauagcaagaccuugucucuauaaaaaauaaaaaauaguuggguauggugauguucaccuguagugcuagcuacucugaaggcugagguggaaagaucacuuaagccuaggaauucaagguuacagugagcuaugauugcaccacugcacuccagccugggccacagagcaagaccuugucucucuaaaaaacaacaacaacaaacuuauagccagaggcuuagauguaauaagaccuagauggaagcaguugacaacuaucacaaauuaagguaaauaagagccauuccccuuuacuagaguaaauuuuagcacucacuaaccaaugauucaagcuuaagauauuuuuucagaauuuucuuagguuggacauuuuuccugaacacaaaaguaauauaugucaaugguagaaaauuuuucaacuauaaaaaauuauaaagaagaaaauaauaaacauucauaauucaaaccuaaagauaaccacaucuuuuucuugguaucuuccaugggauaaucacauuuaauucaguuucaaugaauaauauuuacaaaacuaagaucauacuauaugguuuuuuuugaagauagggucucauucuguugccuaggcuggagugcaguggcacagucacagguuagugcagcuucagccuccccaggcucaggugauccucccaccuaagccuccugaguagcugggacuauaggcgugugcugucaggcccggcuaauuuuuguauuuucuguagaggcaagguuccauuauguugcccaggcuggucucgaacuccugaacucaagugauccgcccaccuuggccucccaaagugcagggauuacagggaugagccaccaugccuggccuauaugucuuauuuguauuucauuuuuuucuuaacauuaugcagauuuuuuccaugccaauaaauguuuguagaccuauuuguuuauagccuacauaugauucaaacucugaggaugacccugaguuucuccuuugagaagaccuauuuuuaaaggaaggggugcuuguagugggccaaagcugccugaauagaaagcuacugacuugcugggagaaugauauuucuuacucucuucuaacaguauauuucugccggauaaguauauuucuuauaaucaaaauagcauuugauggugguacguacauccagugcuucaaauuuaaacccuuaccuguauauauuucccuuuggcagguaaauacacugaguaaagagcuacauucagaguucucagaaguuaugaaugaaaucugggcuagugaucaaaucagaagugccguccuuaucucaucaaagccaggcugcuuuauugcaggugcugauaucaaguaaguuuuaggaaacuugaagucaccuuuuaucuugguuaauaguguguuucuuaggccuaauaauuucuccuuuuaaaagaaaguagaagugcugggcacagugacacaggccuguaaaauugaaaauguacguaucaggcuggguguggugguucuugccuguaaucccagcacuuugggaggccgaggcagguggaucacaugaggccaagagcucaagaccagccuggccaacauggugaaacccugucuccacuaaaaauacaaaaauuaggcaugguggcacacgcuuguaaucucagcuacucaggaggcuguggcacgaaaaucccuugaaccugggaggcagagguugcagugagccgagaucacaccacugcacuccagccugggugacagagugagacugucuuaaaaaaaaaaaguauauacacacacacacacacacacacacacacacacacacacacagaguauauauauauauauauacacacacacacacacacacaucaugugaucuagagaaaucucaccccuuguuuauaagaaccaguguacaaggauguuugguccuguguagugugaaauaaugaagaauuuaaaaccaaaugucagucaguaggaaaauggguaaguaaaauguggacuauucacacaauagaauacuacaaaacagguaaaaggaauuaacuagauccacaauaugauguuagaacucaaaaacauaagguuaaguuaaaagaaaagcaaauugcagaauguuucauacaguauauaguuucuauaaauguuuuaaaaccaaacauggaauaauucuugauacuauuuauggacacaaucguaguuggucuggaaggagacacuacaaacaugaagauggcugcuuuggggaaaugaagugggugguaggacuugauuguuaaaggcagcuuuacagaugcagcuaguauuuucuuuuccucugcuaaaugguggaaugcaugccuacauuaacuuauuuacaauuguuuacacauacauaaggaggggaaaugauauuuuagugucaguuuaauagguuaaaauguuaaguugucaauuccauuaaaauauggguauuuguuauguucuuuguauuuuagacaaugauagccagcauuguagguuuaguaauuuguacugaaaguguaauuauuuauguguaguaaucagucucuuguuaggcacaaauaauucagcuagaagaaaaaccacuugauaagauaauuuugggucuucuaaaaaauuaacauuaaacagaacauuuauaaagucuaacaagacacugauguaccuggcaguagcuaccuauauccagaggaaaauacauguagcuucuaugaggccagcugagcaacucucaguguauaaaauuacagaauauacuaguuauccuuggucaaaaguacaaaauccauauccuaaguguguucacaaaauagcaaaugaaacaaacugaaauuaaaggacauugaguggaacaucauugcaccugaucauuuuuauuuacuuauuuauuuuugagacggagucucccucugcuguccaggcuggaguacaguggugcgaucucggcccacugcaaccuccaccucccagguuccagugauucucucgccucagccucccgaguagccaggacuacaggaaugcagcaccacgcccagcuaauuuuuguauuuuuaguagagacgcgguuucaccauguugaccagccuggucucgaacuccugaccucaggugauccaccugccuuggccucucaaagugcugggauuacaggcaugagccaccaugccuggccuaccuggucauuuuuauucauuagugggaucuguuaaaauguuuuagauuucucuaaacaaccuggaagcuuuucuuuugcgucauuuuuauugcuguuaacuaccugauagugaaauguuuaaucugauagugaaguaauuuaccaaagaugauuuucccuuguaccaagcuuuguaauuuaaugauuuauuacagaaguaaaaauaaauuaugcaacacauuuauguuuucuggauccagaauuuuuuuuuuuuuuuuugagacagagucucacucugucgcccaggcuggagugcaguggcgcgaucucggcucacugcaagcuccaccucccgguuucacacuguucuccugccucagccucccaaguagcugggacuacaggcgcccgccacuaugcccagcuaauuuuuuguauuuuuaguagagacgggguuucaccguguuagccgggauggucucauggauccagaaguuuaacacucuuuauggagaaaugauguugcugcuauugugcuauuugaagcaaaaucauucuuaaccuucuauuugaagauuugucaucaaauauugaugcaugauaggauaaguguauagugaauaaguauugaaccaaauaaauuauaguuuuaucuuuuucucuguucucuacuuuuauggauaaugcagcauguuagccgcuugcaagacccuucaagaaguaacacagcuaucacaagaagcacagagaauaguugagaaacuugaaaaguccacaaagccuauuguggcugccaucaauggauccugccugggaggaggacuugagguauagauauucuaaaguuauugagacacuguccaacucauugguggcauucaucagcuguaaacccuuaggcuacugcuuugccuggaaaaaguuucuggaggagaauccgcuuuguuuuuuguuuuuugcuuugagacggaauuuugcucuugucucccaggcuggagagcaauggcacgaucuuggcucacugcaaccucugccuccuggcuucaaacaauucuccugcuucagccuccccaguagcugggauuacaggugugcaucaccaugcccagcuaauuuuuguauuuuuaguagagaugggguuucaccauguuggccaggcuggucucaaacuccugaccucaggugauccucccgccucggccucccaaagugcugggauuacaggugugagccacugugccuaaauagcuuuguuuuuaguuaucaaacuucuggauagguguuaauccuuaauccacaugacacagagcaaguggcacaaagcaaguaaaugaaggugugauguuuucauuugaacugcaucucuaauguccuuuucagcuguaaaaaucuuguucaaguuugcagggcaaagauucagaagugugaucuaggcucuuaagcuacuuaagucugguugagacacauaaagcauaauauaagugcuuugucaguaguaaagacgguaaauaauagaagauuugagagaagagaugcuuacuagacccgaacauguaggaaagaaaagaaggggaaaaggaaacauucauugagcacuuuucacaugcugaacucugugccagacacuuucacauaugcagucauuuaccacauaacguuucaaugaccaauugcacauacagcagugguucuauaagacuguaacacuacauuuuucuauaccuuuucuguguuuagauacagaaaugcuuaucacugugccacaguugccuacaguauucaauagucacaugcaguccagguuuguagccccuuaggacagggguccccaguucccaggccauagccuguuaggaacugggccccacagcaggaggugagcagugggcgagugaacauuaccaccugaguuccgccuccugucauaucaacaguggcauuagauucucauaagagcuggaacccuguugugaacugcacaugagagggauccagguugcgcacuccauuggccucuauugccugaugauuugaaguggaacaguuucauccugaaaccacucccucccaccccacccccaguucuuggaaaaauugccuuucacaaaaccugucccuggcgucaaaaagguuggggacugcuggacuaggagcaauaggcuaucccauauagccuagauguguagcaggcucugccaucuggguuuguguaaguacacucugcgauguucacacaacaacaaaauuuccuaaugguacauuucucagaacauaucccccucauuaugugacacaugacuauauuaauuaagaaaaccugugccugguccuaaacuauaagcagaauuugauuaaccagaauauggagggaaaaacaauuccgcauaugguauggugugagcaaaggcaaaagcaaagccaacuaggacacuguaaguagacgugcuugauuggagaguccggggcuuuuuaaccugggguccauauaaaauugugugugcauuuuucucuugagagcuucucuagcuuucaguagauuuuuuaggagaucuacggcccaaaaagagguuaguaaauuagaggaaaaguaugaaaaaaaggcuaaaaagguaaauucuagaaauuauuaaaugccagccuaaggaauuucaguuuauucugugagcacauuccugcuuuauaaauaaucuuuagacccuuauccaucucaaguugcuacuaaguuacauuuucuaacauucuaauuuucuuucauuuguucaaagguugccauuucaugccaauacagaauagcaacaaaagacagaaaaacaguauuagguaccccugaaguuuugcugggggccuuaccaggagcaggaggcacacaaaggcugcccaaaauggugagucuaacauccccuuugugaagcuauaugcccucuuuagaucuguuuucuuguauaaaaugcauaauaugggcauucauuguagaauuaaaaaaccaaauaaaauaugaguguacaggaucagugacagacuuuauuccugguacuuauuuuuucaauuccacagauuuuuuuuuuuuuuuuuuuuugagacaaaaucuugcucuguagcccaggcuagagugcaguggugugaucucagcucacugcaaccuucuccucccagguucaagcgauucuccugccucagccuccccaguagcuggaauuacaggcgugcaccacugcacccagcuaauuuuuuauauuuuuuaguagagauggaguuucgccauguuggccaggcuggucuugaacucccgaccucagguaauccucccgccucagccucccaaagugcuaggacuacaggcaugaaccaccaugccuggccuaauuccacagaauuauugaucaagguccuuuguuagucucugaggaaggauaaagauaacuaagaugcaugucuugcauuucuggagcuuaugguuuaauugguuccuuuuccacauaauaccaucuuaacaguuuuucaaaaccaugagucauauuaauauuucauuacaaauauaagaggcagaccuuuucccucauugucugauuuggauguucucacugcuguguuguauggaaccaaaagaggcucagcaggcuuugaauuccaaggagaagggaaggacagucagaccuggaugcugcagagcaaucuuaaugucaacucaagggcccacugaaccuuauagcuucuggcacuguagauuccucagugaaaacaaggcucaacagaaauacucuuugcagggaaguugaucucaauugagcacaaaagaaaacaagguuuaugguguuaauuuucuaauaauaauaaugugcuuuccuucauaggaaugucauaaggauuuauugaaagaaugaauaugcauauauguguaucaaaaauauuugcugaguuucuuucuuucuucuuuuuuuuuucuuaaacuauagcugguauuugaauguugcuagaagccuuucuucuaguaugccauauaagcagcccuagcugaguucuauuuuuguuaagcuuaaaauucuuuuuaaagacuuugucaaaacuaucagguuucucacagucuucucuaguuucaauaugagaauuuuauuuuauuuuauuuuugggacagagucacuuuuguuguucaggcuggaguacaguggcaugaucucggcucacugcaaccucugccuccggauucaagcaauucuugugccucagccucccaaguagcuggaaugacaggugugccccaccaugcccagcuaauuuuuuguauuuuuaguaaagacaggguuucaccaugucgggccaggcuggucucaaacuccuaaccucaggugacccgccugccuuggccucccaaagugcuggaauuacaggugugagccaccgugccuggccagaauuuuacauauuauauauaugauagaaaaaaaccccucagaauaacagaaauguacaauuuuaggaaacaugaaauucuuuaccuuauuaguauaagaauccuauauauugaauuaagagauaaagacauuuuugcuucagcuagagguaucuaauccccaaaguuacccaaguguauaucaguauauuaaauauaacuuaucuaugcuguugacaaauagcauaaacauauggcuugacuuuucucauuuuaauauuuguucauuugaugauuuguaaacuauauaauuaucacccugauuuuuuucccccuauauucucauccuugcuugccuguuaggugggugugccugcugcuuuggacaugaugcugacugguagaagcauucgugcagacagggcaaagaaaaugggacugguugaccaacugguggaaccccuggguaaguguuagcacaucucagagucagaccuuauaaaguuacuuauuuucuuaaagaguuaaccucuuaggccaggcacgguggcucacaccuguaaucccagcacuuugggaggcugaggcgggaagaucacuugaggucaggaguuugagaccagccuugccaacauggcgaaacccugucuccacuaaaaaugauuagccgggugugguggugcaaaccuguaguuccagcuacuugggaggcugaggcaggaggaucgcuugaaccuggcggggcugagguugcagugagccaagaucaugccauugugcuccagccugggcaacagagccagacucccaucucaaaagaaaaaacaguuaaccucuugaauaucacaggaagcacagagagaagcucaaacucuuaagaaaugagucauuauucuaaggaaggaaguuuuauaaaauagcuaauacuaaaucauuuucaacaucacccugauuuuuauuuugcuuuauaauuagaacauuaggaguacagaauucagucaagucauuauuuuugguucuuaaauuaccuguaucauuauccaugcauaaccuuccuucaguuucuugugucuguuuuaguaauauaauaaaugaaacaaccaaccugagaauauuaacaauaauugauaucuacugaugggcuacuuccucccauucaguuucuuugccucccuuuauccaaagaagccacuauucugacuuguguguucauuacccucuuauauuuauugaaaaucagcauuauugagauauuacuuacauaauaguaaauguauuaauuuugugugugugugugugugugugugugcgcgcgcacacauguuggggucucacucuguugcucagacuggaauaugguggugugaauauagcuuguugcaaccucaacuuuuugggcucaaaugaucuucccacuugugccccccgaguagcugagaccacaggcauacgcugcuacaccagcuaauuuuuuauuuuuuguagaaacgagaucucacucuguuuuccaggcuagucucaaacuccgggcucaaguaauccuccucccucagccacccaaagugccgagauuuacaggugugagccacugugucuggugaaauugaccaacuuuuaauguauaauuugaguuuugaaaauguauauagcuguguaaacacugccacaauccaaaaauagccgugcaugguggcucacaccuguaaucauagcauuuugggaggcugaggugggagaauugcuugaggccuggaauucaagaccagccuggacaacagagcaagauccuaucucuuaaaaaagaauuuuuuuuuuucaauuagcuggguaucauaguguauaccuguagucccagcuagucaggaggcugagacaggaauauuguuugagcccagaaguucaaggcuguagugagcuaugaucacaccacugcacuccagccugagcaacagagugagaugccaucuuuuaaacaaaaauuuuuaaacauuucugguauguaguuuguuuuaaucuucguucacuuagcauaaugcuuuugagaugcauccauacuguugcauauaucagcaguuuguccuuauugcugaguguuacuccauuguagaaauguaccauaguuuguuuauccguucaccaaaugaugagcauuugaguuguuucuaauuuagggcuauucugaauaaagcugcuaugaacauucaucuuuaagucuuuaugugggcgugacugggcgugguggcucaagccucuaaucccagcacuuugggaggcugaggcaggcugaucaccugaggucaggaauucaacaccagccugaccaacauggcgaaaccccaucucuacuaaaaauacaaaaauuagcuggguguaguggugugcaccuguggucccagcuacuugggaggcuaagguaggagaaucacuugaacccaggagguggagguugccgugagccaagauugugccacugcacuccagccugggugacagagcgagacucugucucaaaaaaaaaaaaagucuuuauguggacaaauguuucauuucuguuggguaaguacugaagaguggauuggcuaguccauauaacagauauauauuagcuuuugaaaaaaaaaguuuggccugagcaacauagcaagacucugucucaacaaaauaaaaaguuuuaacuaguugggugugguggcacaugccuguaguccuggcuacuagggaggcugaggcaggaggauugcuugaacccaggaguuugaagucacauggagcuaugaucaggccacugcacuccagccugggugagagagggagaccuuaucucugggaagaaaaaaaaaaaauuuagagaugagacuuugagucuugcucugucacccaggcuggccucagacuccugggcucaagcagucuuccugccucagccucccaagaagccgggauuacgaggcauaugccacuaguauuugcuagguauguguuugcuuuucugucagacuguuuucccaaagugguuauacucuuuugcauucccaccagcaguguaugagaguucuagguaccaaccacuuugcauggucaaucuuuuuaauuuuagacauucuaacaggaauguaguaacaguucuuuuuucuuuuuuuuuuuuugagacaaagucucgcucuguugcccaggcuggagugcaguggaacaauuuuggcucacugcaaccucugccugccagguucaagcgauucuccugccucagcgucccaaguagcugggacuacaggcgcccaccaccauguccaacuaauuuuuguauuuuuaguagagaucggguuuuaccauguugucagggcuggucucaaacuccugaccucaaguuaucccccugccuuggccucccaaagugcugagauuacaggcgugugccaccacacccagcuggaauuagucauauuucauugugguuuuuauauuacccuaauuaccaaagauauugaauaucuguauaucuuauuugauaaagaagcaucuguucaaauuuuuugcccauuuucuuggacugaguguuuuuccuauuaucgaguuuucagaguucuuuauauauuaggauaugaguccuuuaucaaauauaugauuugcaaauauuuccucacagucucuggcuuaucuuuucacuauauaagagcagaaauucuuaauuuuaaugaagucugguuuaucaaguuucucuuuuauggaucaugcuauuagugugguaucuaaaaaauauuucucuaacucaagaucacuaaguuuuccuguauacuuucuucuagaaauuuucuaguuuuagcucuuacauuuuggucugugauccauuuggaguauuuauggaucaugcuauuagugugggaucuaaaaaguauuuuucuaacucaauaucacuaagauguuccuguauacuuucuucuagaaauuuucuaguuuuagcucuuacauuuuggucugugauucauuucaaguuuguauauggugugagguaaggauugagggccuuuucuucccuuuuugcauaugaauauccaaauguccuggcaccauuuguugagaagacuacuauuuccucagugaacuacuuugaucccuugaucaaaaaucaacugaccuuaucuguuugggccaauuggauuuccuauuccuaguuaucuauaugucuuuuuguuaaaccaauaccacacugucuugauuauuguauuuuuauagggaauccugaaauuaagcaguaugaguccuccaacucaggucccuucuuucaaaauuauuuugcucauacuaguuccuuugcauuuguguacaaauuuuauaaucauuuuguccauaucuacaaaaauaccugcuaggauuuuuauuggaauugcauugagucaguauauaaauuuggggagaauugacagcuuaaaaauauugagucauuucauccaugaacaugguaaaguucucuguuuauuuaggucuuuaaauuucucucagcaguguuugguacuuuucagugaauagaucuugaacacauuuuguuaaauuuaugccuagguauuucauacuuguaggcuguuuuacuuuuuuaacuuuaauuucucacuagaauauagaaauacaaagauuuuuggacauggaccuuguaucuugugguuuagcuaaauucauuuacuaguucuaguagccuuuuuuauuaauagauuccugaggauuuucuacauagauaauuauguugucuguaaguaaagacaguuugacuucuuucuuuccaauauagaugucauuuguuucuuuuucuugacuuaccacaaugucuaagaccuuuguacaauacuggauagaagucaugagaacaaguauugucaacuuguucccagucuuaggaggaaagcauucaguauuaaguaugauguuaguuguagguuuuucauaugugcucuuuaucagguuugcugagaaugaguauugaauuuugucaugccuuuucuccaucuacagagauaauugugggguuuucuucuuuuuuagucuauuaauaaugucagucacauugauuuuugaauauugaacuagccuugcuucuuggaauaaacuccauuuuguugucauauauuauaaaggauuuuuaugucaucaugagggauaaagucucaaggauaauuuucuuaugauauuuuugcgugguguuggcaucaggauaaugcuggcuucauaaaaugaauugagaaguguucucuccucuuuuuuuuuuuuuuuugagauggagucucacccugucgccaggcuggaguggugcaguggcgagaucuugggcuaauuuuuguauuuuuaguagaaacaguguuucaucauguuggccaggauggucucaaucuucugaccucaugauccaccuaccugccucagccucccaaagugcugggauuacaggugugagccacugugccuggccuccucuuauauuuucuggaagauuuuauguagaguugguauuauuucuuaaauacuugauagaauuaaccaguaauuccugggcuccuaguuuucuuuguugggaaaauuuuuacuuaugaauucaauuaauagauauagggcuauucagguucuccauucuagaguaagcuacgauaguaguuugugucuuucaaauaauuuguucaucuauuaacaauuugccaaauuuauugcaauaaagcuguucauaauacuugucauuuuaauguuuuuauacucuauacugaugucuccucauucauuccugauauugauaguuuaucagcugauaggacuuuaaucacuuauaaaauaccuucauaguaacaucuagguuaauguuuauugaauaacugggcuguagccuagccaaguuaacauaucugaagacuaucauacuccaccccuugucuguuugacacccauacacaucuccuaaagccauacauagucuucaaauaaaggcaaugacaggagucauacuuuauccugacauaaugcaauucuccuuuauacaaccaaaaauacacuaauccuuucccuagaagaggaugcagaguccuugggugaaauucacucuucucucauauucuguaacauaaaugcuaugauauaaaguuaaccauuauggauacaucuuauauuagaugauaaggagauagagaagaaacacaaauauuugguuaauuauauauauucauaacaaaauaagaaauccucauaaauaguacaguauucauuacuguauucagaaaugaauauuuauaauauuuccagaucaguauucagcugauguggaaagagaacugagcuaucaaauaucagaguaaauaauuaaacaacccaaaaggaaaguaacaguggagccuuuauucacuuacuuugauaguuuacacaaaaggcuaaaaaccaaagaaagugccagcuccuuuuuccccccaguaccguuuuccccauggaaugguacacugguugaggaucugguagauuagcauacaagugggggacaucucacuguugugaaagcccugaacaaaagguuccugcggcuuuauggacccugggugaggagaguggaguagacugggagaagugucuuuaagauuucccauuccggccaggugcaguggcucaugccuguaauaccagcacuuugggaggccaaggcgggcagaucaccugaggucaggaguucgagaccagccuggccaauauggcaaaaccucaucuccacuaaaaauacgaaaauuagccaggcguggugguacaugccugcauucccagcuacucaggaggcugaggcaggagaaucacuugaacccgggaggcagagguugcagugagccgagauuguaccauugcacuccagccugggcgacagagugaaacuccaucucaaaaaaauaaauaaauaaauaaaagauuuccccuuccuccuuugacaaggucucagcagaggcaccugaagaaggccucagccaaaguccccauauaaaaagaccuaggaauagaaggcaucuaggcuaggaaugcacauuuguguaagagcuuagccagccccagagacccaaguccuugacugcagcucccucagaugacaccgcagugcacuggcuguguaccagguuugguguggaaagggugauauuucuacuccccuuuucauauucccuuugcccucaggaaguaccucaguuuguccuaguucuuugccugguggggugaccuucauuccuaaaaugucuucuaggccacuagcagucccaugugaacuggguugugaucuucuacugacuaauuagaggucauguuaguacuaagggacacccuaagagaucugccacauuugagacauacucuuccuuaccucuguuguauaguagcaaccuaauauccccuugguaaucaggauuaaucaccccagccaguacaguacccgcccucugcugccuguugauuccaaggcaugaggagcccaaaguggccagauggcaguuuuaacuaacaguucaguagaaucauuguugugucuccugguggaagcauuccucccuuuggaacugagcccucuagacaggcagagcccaaaguugcagggacaagaagcagaaauuuugcugguagauuagaucacuagggguaauagugaacuggguaauuucuguuugcucuccuugauuucuggacucacgaauccuggcugugggaaaaguagcacccuauacuggaagcugacuuaaaacauagcagcauccuggaggacauugacucugcaaaauacugccacuuagcuggcacugugauggagucuucaguaguccaucccaccauucugucaaggcaacugcuucccggugauguaguaagaucaguguuucgugagcauggcccauugcugcacuucacuuacugagaagugaauuccuugauaagaagcagugcuuugugggauaccauaauggugugggauaccauaagguacucuauaaguccacaaauaaguccacuuaccacaaauugguaagugaaaguccauauugccuaagcccaugcauaaccuccacacccaccaucauggccacuguucaugaagcagugauaagagugacugcggaaagaugcugacugcuauccauagaacgagucaucccauccacuuugaucauugaaauccucggcugaggucacucuuugaugagcauuuaaugggacacaaguguuuucacauuauuugccuauucagagaggucuauccacugaccuauuccccagguguccuuguauauuaguuugcuagggcugccauaacgaauaccagacugaguggcuuaaacaacagaaacuuaacauguuuucucgcauuucuggaaacuggaagucuaagaucagguguuagcagguuugguuucuucugaggcaucucucuuuggcuugcagauggcacugcuuucuuacugugucugcacaucccuggcaucucuuuuguguuuccaaauuuuuucuucucauaaggauaccagucagauuagauuaggguacacccuaauggccucauuuuaacuuaaucgcuucuuuaaaggcccuauccccaauuacagucacauucugagauacuggaggauaggacuucaacauaugaaugagguaggggggacacaauucagcccauaacaccuugccaacaguuuuucaucuguguucccuguaaguuccuuaccacccaggcaaaccguuugccacggccuaugaaucagaguagacccuuagcucaggccauuuuucuuucuagacaaaaugaacaaccgggugcacugucagaaguacugcccacugggaggcuaucccuucaccacuguccuuaagggaugucccagaagggacuguaguguuacagcugugcacuuccaggugguaccugcguaucacacagaaauaucuacaaaccaggccugaguuuuucuuuaccaaucaacuggccauagagaacuccccaugaggccauaggugcaggcuggaagagacaaagaagaacagggccgugggguauuuuggcuacuuccucaugcagcuugugccuuuagggucuguuuaagcccagucuuacauauaccacuuccauuugauaauggagugcuaccguguacaccccacuuuauggcuuaguagguuagacaacaucuguuucaugaucagcagcucaggucaccaguaacuugaugccccaugguuaagcuuugagucucugugaagucccacuaacaagccaaacacuguuucccaaaaggagaguaguuauucacagaggaugguagggcuuuuucuaaaauccuaagggucuguguugugauucaccuaauagagaucuauuaaagacuccagacagcaccucugucugcugccgacacuucaggcgccaucagguuugaaucacguggcccaaauggcagaacagcuucucuuguucugggucccacuuaaacuagcagcuuuuuuaguuacucaguaaaugggcuggaauagcaacccaaaugaguaauauguugucuccaaaaucugaagcagcccaccagguguucuccguguuuuuuugugguaggaggggccacgugcaacacuuacccuuugccauagaagggaugucuuuguaugccccagaccacuggauccccagaaauuucacuaacaugggaggcccugaauuuuggagggauuuauuucccaccuucugacagacacaugucuuacccccaguaugucuagaguaguuaauacuucuugcucaccagauccauucagcauaauaucacaguguaaugaaccagcaugauaucuuguggaaggacaagguaaucaggcucucuguggacuaaauuaugauauaugguugaaaacaauacacccaccccuaagguaagacauugaagguauauugcugaaagcaaacugcuucugguggucuuuacuaacagauaccaagaaaaaaaagcuuuugucagaucagucacugcauaccagguccaaggauguauguuaauuuguucaagcaauaaaacgacaucuggaacaccaguuagaauugcaguugccaccugauuagauguacaguaauccacugucauucuauaggauccaucuguuuucugcacuguccagaguaggcaaguugaaugagaaugaagugggaaucaccaccccuaccgcuuucaguccuugauggugacacuaaucucugcagucccuccaggauugugguguugcuuugguuuacucuuuucuagguagaggcaguuuuaguggcuuuuacuuggccuuucccaccauaguagcccuuacucuacaagucagagcauauagugauauuacucauugcugaguaugucugcuccaauuguacauucugaaacugggaaaauaaccgcaggaugggcucagggaccugcuaggcccacugagacagaccugagcuaaaacuccauugaucacuugacuucauaagccccuacucugacugcuggaccacagcgaaguuuggguccccuagaauuaguguuaguucagaagccagugucuaguaauccccaaaaaaucauuguuuccccuucugcaaggcaaauagccauagguccuuuggggaaggguaggagaaagauaaacaggaaagucuccucaagaggacacagcuucccuuucauuaaggagauucugggucuguaaacuagcucauuucugggaauugcuuaaggggccaugacucucuucaggugauucaaguuauacuucuguuuaccagaccuagaauucuucugcuuauacagaucaaguaagaguuaguagacugcccaucuauuucuuuuuuagggacaccaugaucaaccacccaaugcuauaggucucagcaagucagacuauucugauuacugcuuuggcuccacuauuuauuaugguaacuaugcccaccuugauuuggcauggugcugcuacuugggcccugccaccccgggauuccuuuauccccauugcauuuagggaucccaguugaugguagcaguucccacuguaauuucugaccuacaaagagaagcaaccacagagcaaagaugcugggccucaccucacaaauugauuucucacagugguggugaagggugcguccucuaacccuuccagggugaccugucaguucuuugcuccuuuuuucuucuuccugcuuucuuuuggauuaauaauuuuuuauuggccgggcacaguggcucacgccuguaaucccagcacuucgggaggccgagguggacaaaucacgaggucaggagauggagaccguccuggcuaacauggugaaaccccaucucuacuaaaaauacaaaaaauuagccuggccugguggcacaucuguaaucccagcuacuugggaggcugaggcagaagaaucacuagaaccugggagguggagguugcagugagccgagaucacaccacugcacuccagccugggcaacagagcgagacuccaucucaaaaaaauauauauauuuuuugucuucauuacuggccuuuuacuuugcuuuucccuuuuaaugguugcucugggguuuuacaguauacauuuuuaacccaucacagucuauuuucuuucuuucuuuuuuuuuuuuuuuuugagacggagucuugcucuguugcccaggcuggagugcaauggugugaucuugacucacugcaaucucugccucccagguucaaucaauucucuugccucagccuccugaguagcugggauuacaggugcacaccaccacacccagcuaauuuuuguauauuaguagagaugggguuucacuaucuuggccaggcuggucucaaacuccugucuucaagugaucugccugccuuggccucccaaagugcuggauuacaggugugagccaccacaccuggccgguuuucaauugauaauauuuuccuguggugucagaaccuuaaaagaguaugcauuuauuuuguauacuccccauuuuugcuauuguuguuauacauuuuacugcuacauacauuauaaauucuuguauauauugguauauuuguuuuagauaauuaucucuuaaggagaauaaaaaauuagaaaagaucuuuuuuauaguugcccacauaguuaccauuuuuagugcuuuuuauccuuuguauagguagauccagauucccaucugauuugguuuucuugcaaccugaagaacuuccuuuaguguuuucuguaguguaggucuguucuuaccuuuugauuugucugacaaagucuauuucccacuucauuuuuaaacauauuuuuccuagauugcuaauguuucuuuucucucucuuuuuuuuuuugagacagagucucacccuuuugcccaggcuggagugcaguggcacaaucucagcucacugaaacuuccaccucccggguucaaaugauucuccuaucucagccuccuggauagcuggaauuacagucacccacuaccacaccugguuaauuuuuguacuuuuaauagaguuucuccauguuggccaggcuggucuugaacuccugaccucaagugaucugcccaccgcggacucccaaagugcugggauuacaugagccaccacaccuggccggcuaauguuuuucuuuugguacuuuauaaaugucuccauuguguuuggcuugcauaauuucugaugaaaagucuguugucacuuuuaucuuggcacuuuuuuguuuguuuguuucuuuuugagacagggucuugcucuguugcccagguuaaagugcagugguaugaucauaacucacugaagccccgaacuucugggcucaagcaaucuuuccacgucagccucucgaguagcugggacuacagucaugcaccaccaugcccagcuaauuaaaaaaaaaauucuuuuuguagagacaaggucuuaccauguugcccacacuggucucaaaccccugggcucacgugauccucccaccucagccucccaaagcacuggaauuacaggcaugagccacugugcccagcugucauucuuuucuuuauacuucuauauaugaugugccuuucccuuccucugucugcuuucagauuuuccuuuuaugacugguuuuagcaauuugauuaugaugugccuugguuuguugggauuuuuuuuaaaguuauuaugucugggauucauugagcaucuuggacauaugggcuuauaguuuucguaaaaauuggagacuucuuuggcuauuauuucuucaaauauuuuucugucucccuccccuuuuuggagauuccaauuucacauuguuaggucauuugauauugcccaaaaaugaagcucuggguuguuuguuuuaggucuucuuucauucugguuauuucuacugccauguguucaaguuuccugauguuucccucuucuguguaucccugcuguuaauccaaucccaugugauucacuuuuuuuuuuucagacggggucuugccgagucugguccuugagcuacugggcucaagugauccucucaccucagucuccuaaguagcugggguugauucacuuuuauaucuucaguuucucuucauuaucguccuguuuuccucuaccuucuguaacauacagcaugaauuuacaguagucuugaacaucacgucugcuccuucuaucauuuuuuucauuucugaaucugugucuauuuauugaucugucuccuggcuaugggucauucuuuccuugcuucauuucaugccuuuuauggugguucuuuccucagcugcagauaguuuccccucaugcacaugcagaacaauacucggccagaguuucaaggaccgcucuuuagagcucuggagcucuccuguugugcagcagcugcucuccagcauuucacgucacagauuccagcugcccuggccucccucaggauuaugacuguguuaggacuuuucuggacacugaacuuuugucacuccaaaguuuugggcuuaguuauuauuccuccuuccccacacagguucaaaauaggccaaaugguccaggcucgguggcucacaccuguaauccuagcacuuugggaggccgaggugggcagaucauuugaggucaggaauucaagaccagcuuggccaacauggugaaaccccaucucuacuaaaaauagaaaauuuagcugggcacaguggcaugcaccuguaaucccagguacucgggaggcugaggcaggagaaucgcuugaaacugggaggcagagguugcagugagccaagaucacacugcugcacuccagccuagguuacagagugagacuccaucucaaaaaaaaaaaaaaaaaaaaauaggucaaaugucuuaagggagagauugguuguaugucugcuauggguucccucaguugggauuuuguuuccuaaguaccacaguacugcacaagauugccauuuugaccccagccaccuccuccaauguggcucuuacagacuuuugauugagagccugguaggugucuguuuucacagcacuauaaauuguguucuuuggauuccuuuuaaauagagguggggucucacuauguugcccaggcuggucuugagcaauccuccugugucagucuuccaaagugcugggauuauaggcaugaaccacuguacuuguucuucagauuuuuugagccuagcucuguaaccucuugccccaagcagguucaagaucuggcagaggccuugcguggaaaaucaguugcauauugguuucaggcccccuucuccauagaaguaccuuaucuauuaaacaucaugauacuaugagagauuucacucaaccucucugagcuagccccuuccuccuuguguaccaucuuagacuuucacaaauguuccuuggggaaaacuggcuuugcacuugguuucuucuagcuucuaaucuguuguacaugaccaccaaaaacucugaugguuucacuuuccuucugcuugagucaaguccagucuucaguccaugcccaaaagcauuacacaucccugaaaagaaaaugaucagcaaucaucaguucagcuaagauaggcucuugcucucuagaauuuuaguucauguuguccuuguuacuuccauagcuccccagugucuuuacaaaugauuucaugauuucuucuuuuuucuuuccaguuuugcagcaagaaugcagguugcaguagacauaaugcauuccuuuuguguguguuacauacuacauucuacucagaaguggaaaccaaaugaaacaguuaaagaccgcguuuucuaccuagagcauauuguuucuccucuauucauugugauuucccuucuuugacuucuugguuuaugacuuugccaccuaccagucuccagucugaaauggaacgcugugcuagggccuuuggcuuuggcaagucuggguuuuucacuaccugggacuggucuaagccugauuugcauuccaguguugcauucauuuuuauaggaccaggacuaaaaccuccagaggaacggacaauagaauaccuagaagaaguugcaauuacuuuugccaaaggacuagcugauaagaagaucucuccaaagagagacaagggauugguggaaagugaguaucauuguuaaagaacaaaggcaaagcuucuuuccugagaauuuaauuuuauuugcuguagauucaaaaugaggaagugguaaaugcauuauuuacucaaagcauaaagucagccuuagguaggagauguaacaacuccucaacuuuacacuauccaguuaaagccaauuuuuaaaaccuuuuuuuuccuuaugaugacccuugagucauagaaaacuuuucauuuuagaaaauguuaagcaugaacacaaaaagacuagauaacaguguuauaaacacucauguacccaaggcccagcuuuaacauucaucacuuagcauguuuaagguagugcuuagguugaaauuuauauuguguguaucagaauaaagagcaguucuugcagauagcuagaauuacuucauuuuuauagaguuuagagcauaaacuaacaagggaaucuaggcucuuuauaguaaauaucuaaaagcauuuuauuuuacagaauugacagcguaugccaugacuauuccauuugucaggcaacagguuuacaaaaaaguggaagaaaaagugcgaaagcagacuaaaggccuuuauccugcaccucugaaaauaauugaugugagucuuacccaauauucccacuuuucucauauuuccuuccuuuauauagaucacuccuccuuauugccauucuggaccauguauguugaguacuaaauuucuuaauucugcuauuaaaguauuuaccaaaaauaagggaagggcauagcaagcuguaaggacucauauaaagugauauauuuggggaaaaucagugcuggacuuacucauugauugaugcaguuaaauguaucaguaacaaaccagaaaaccaggaaaggaaccuaagucauaucaguaucacaaagccauuagagugucaggcacuaaccaaaaaguaguugaaacaaaauugauggcucuguucuauucuuggucaacaucauugucaguaccuaaaaucccucaaggacuucuucauugcuguaauuauaaaaaagauguaaugauguagagaagcucugcaaaagaucaaugagaauaauuaaaaugaucacaggauucaagaaaucuccaacaguagacuuuaaaacuuagaacuuuucaguguggaaaguccaagauuaagagaguauauaaccaaagacuucagaauuggugaaugggucagucagcaaguauaucuugaguagaaggcaccaaagcacauaaaauaugaaacaugcccccaccugccuucgucucacaggcuggacuggggaaguuagauauauauauguguuaagguggauagccuuuaagagauauaaggcagcauaagauuaaugccagaugagugggacagaggaggcaacaauuaccaugagacaaagagaucaguaagugccucaugggaucugaccccaacccugaaagcuggguggaggauaggugaaggagggaaaguauugccaaggagggugggcauuuagagcaaaguuauggaagcuggaaaacaagcucuucaaggaacauuagugagaccaguauuugugggggauaaugagauguuagucugaagaaaggcagauugaagcuggauuuuagaagguugguaauaaugaauugagaaauuuuaccuuuguccgauaaagauucuagagagccauuuucaugguaguggguaaaaaugguuucgaaggagagacaaaguagagcagugaauuagcaaaacuguccugauaauccaggcuugagcuuugaauaaggcccugagauagaauaguaaaaauaggaaagcagcaacaggcuugccaaagagagguuaugaguuagguucagauauauugaguucagauauuuugggaaauucaagcaacaguaguuuagacagagaagucagaguuagagaugucaauuugcuuauuucuaaaaauuugucauucucauaaauuaugauagugaguaaguacaggguuauuuuuuucaucuuuuauauuugccauuguacuuaggauaguacuuaccccaaauguuacauugaauuuuguagaguucauuaaugugauaaacuaggucaugcaucugagggagaaaguguagagagugaaaagggcugaaaguggaaguugaggaucugccuacauuugaagaucaggagagaagccggaagaguaauucaagcuuugucuuuccuucucauggccauguuaugcuagauuuagcaguagccucaaagauggagaauuaagucagucgagagcagccagauccucaguccucuucucuuucucauuccagucuagacuuuugacuuacucuuugaggacuaacaacacuggcaauuuuauucagcauuauuguacaucucgccaaucuauuccaacgcugagcaagugcuuuauauguuuuuuaggugguaaagacuggaauugagcaagggagugaugccgguuaucucugugaaucucagguaaacuuauuuccuuucaauguuuuauuaucaguuaaaggaaaacuaaagauccaauccucuguauaaagcugaaaaaggaaaaaaauauccaaagccuaguaaaaauuuuuuucuuccagugcuuaucaucucuuaugauuaaucucagugagcaaguggaugcuaagaauacccuaauggggccaggcguggugguuuaccccuguaaucccaacauucugggaggccgaggugggcagaucguuugagcucaggaguucaagaccagcaugugcaacauggcaaaaccccaucuuuacaaaaacuacaaaaguuagccaggcaugguggcaugcacccacagucccagcuacuugcagggcugaggcaggagaauuguuugaguccaggaggucagggcugcagugagcuaaguaagaucgcaccacugcauuccagccugggugacaaagugagacccugucuccaaaaaaaaagaaaaaaaagaaaaaacccuauggucugcagauguuugaacuuacuuuuaguaauaagguugucucuacgaagggcaggaacagaguucuaauccuuucaaaacaagucacuuggguguuuuuuguuccgcacuugggcagguuuuauugagacaaaaugaauacaaagacagaaaaauauuuuucuuacauguuaaggccuagagaugaugaaauugaauuuuuugguaaauuggaaaaggaaaggaaguaucuuguacccacuaaaagacgaagacagaagagauguauguaccagcuuuaccuguguacuuuucuagcaacuuggugauguugcagauuuaagugauuuguguuuguuuuuaaguuuuaaacgaucaucgaagaaugguugcucuuuuauaaaguugaauaucucuuauccaaaauguuugggacuagaaacauuucagauuucagacuuugucagauaguggaauauuugcauauauaugaugagagaucuugggaaugggaucagagucuaaacaugaaauuaauuucauauacaccuuauacacauagccugaugguaauaucauacauuauuuuuaauaauuuuucacauaaaacaguuuugacugcagcucauaacauguguaauaucuugcccaugacaucauguuggcacucaaaaaguuggauuuuggagcauuuuggauuuuggauuuucagauuagggaugcucaaccuguaaaaggacaaaaaaaaaaaucugaagagcucaggacaaguaccagaaaaacacuucugguacuagaugucucauugggcauuucugauuuuuuaaaaauauaaccaagugcacauaaacauacguacagaaaaauugaggaauaaguuucacgaaucaguaacuguccugugugcauugugcucaguauuuucuguguauuccgcuuuuuauauauguaaugcuuauuggcacccacuaaauuucugaccauugaugaaucuuuugcccauguuugaaaaucacugguuuauuagauaaaacauccuguaucaagauuaguaaagcauugauuguguugucauuuuauguucuuuugggucaugaaagcaacuuuauuagagggauucuuuugaaaugcucuuuguaaccaugcaaucuuaccauuauauccuagugauauuaauaauagcuaaccuugagacccuggucauuuuacuaguguucucauuuaaucccccagaacaauacuguaaaauggguauuguuuuucccauuuuuaaggaugaagaaagcuucacaauggggcaguggcagagacaggaucugucaaauccuagauauuaugccuuuaaccaccaaguugagacuuuuucuccauaaauuaagcuacuuuuaaaagugguaagucccacgugggcagccugcuacaguggaaaaagaaccggaguucgaggcgaggcacgguggcucacgccuguaaucccagcacuuuggaaggccaaggcgggcagaucacgaggucaggagaucgagaccauccuggcuaacacggugaaaccccaucucuacuacagauacaaaaaauuagccaggcgugguggugggcaccuguagcgcagcuacucaggaggcugaggcaggagaauggcgugaaccugggaggcggagcuugcagugagccgagaucgugccacugcacuccagccugggugacagugcgagacuccaucucaaaaaaaaagaacuggaguucagagucauacugucuugguucaaguuccauuucugccacuuugaggcaguauagccuugagcaaagucacuccauuucuuuggaccuccucuucccaaucuguaaaaugagaggguugguuugagaugauuguggaggcucauuuuggcccugagacucuaguuuuaugaaaaagguuaccacaccucugguguaaagaaucugagagcuuaguuauauccaaaacuuucuucaacacaguaguuggaaagugcuccagauaagacaaguaaagacaagacacaucagugagagacagacuucugcagcacugaacccccaaacucccccgcauccccagggacucaggcuucacaugcauuaccucugcucuucagaggaaccugaacugaaggaauccauauaaccuagacugugaaguucuaccuuuucucauuccccuuuacuuuucagaaauuuggagagcuuguaaugaccaaagaaucaaaggccuugaugggacucuaccauggucagguccugugcaagaagaauaaauuuggagcuccacagaaggauguuaaguaaguuaaacucuacguaggaagcccuugugaauuuuacugugugcaaaguucacagaggcuuugaagaucuacagagcuagaucuguaucuuaauucagucuugcccucaacuucuuuccugagcacauuugagcccuuaugucuacuaaaaacuuuuuggcuuucaaaguucugccuguucugaguuuuuuccaaaccccucuggucauuccuauagaggcuuucuugucacauauugauguugccuagaagucugguuuaggucccccuucccaaaccacacacucccucugcacuguucaaugaucaucucucucccugugauuugagaugucaucucugggaacucacacuucuuccucauuaaaaaacauaaaaccucauuguaauuguuaaaaucuuguccuucuuuuagcuuacaaccuaaguauuggaaagucuguuugccucuuucauguguauugccauaagccagccuuuuuccauauuacgcugccuaauagcucuucagagucuauguuuaaugaugcaacuuguagcucugugguucucagcguggacaauuuugccucccagggggacauuugacaaugccugggaacauuuuugguugucacaacuagggagggagggaugcuacuggcaucuguggguggaggccagggaugcugcuaaccauccuauaaugcacagauaguccccaccauaaagaaauauccaguucgaaaugucaguaguccugagguucagcuguucuagcugaacugcugugggggauuuaagagaagcagcuaaugauacugccuucuccauccucucaccuuuaaugagauuacaaauacaaaauacaaaauaaaauggauaagaaguccgggugaaacagguaagauucuaaccaagagggcugauuuccaauuagaaucugaaauacaaccuuaacugcuucucucaaacauuuagugacugcuaucaaucccaucugaagagccaauugcauuuguuccaccuaaccuugauaguaccuugcauucgaugagcaggguaaauuacuuccauguugcaggaggaaaauuauggccacuuaaaccuguaucucuuuacacauucuacaaaaaucaacagauuaauaaggaaaacaaagccacccauucccugugcacggcauaaauagaaggcagagaagcauccugcaaaauuacaaaaccuagauacaccaacuucuaccccuccccaccguaucccuccauguacacaaagaaugcugucaauuaaagaaacugcacuuugcaacagaagaggguacucuuaaauuaaaaaaccuagugucuuaauuuauuaacuccagacuccuccugccugagcauuuauugucguauggagguaguauacaucuccauguaacaauaaaauaccccuuggaaaaggugguauuguguagucaguaugcaaaaaagaaagacagcacccacaaaaagcuaauauaagaaaaaaagagaaaaugagaaucagaauacugaaguuuaugaaaauucugucccccaaaaaacaaccacaaugcagaagaagacuauaacagaacuugauuuaaauauucuuaaaucagcauuugcaaaucagaaaaaaaacugccuugaaucaaaaauucaaaaacucagaacuaaaugggcagaaaaacaggauaaauauaggaguugaccuaacuugggaaagacauugaagaaaaaguuagcaucaucuuagaaaugaagaauaagcuauaagauacccaaggcaaaauauguuaaacugaaaauugaauaaugaacauuguagauagggugucccccuuccugcuuucccaguuaucaguaauucuuccacuauuauuucucuaggccccuucccccuugccuuggaugauaacuggaauuccuuaucuauugucucuuuacaaauuaaucuuucauaugaauaacgcauuccaucaguucuaauaagugaagagcaguacuuaugaaaaaaaauacugagcuacaaauuaguauacagacaagguaccauguuaugcauuccucaaaucacaacauuucuguguaaucaacccucaaaaguucaugucacccagcaguuggcuuauaaagcaucgugcaccauagauguuagccugcuggguaauuacacaagugggucauuucaagggugcugaagauguuuauuagaaggauuccguagauugugaaguguguuaauuuaacucuacauuguuguagacaaauauuaaacaacuauaaagccaucaugaaaauuuugguguuaaugaagcggagcauaacaguuaagaaaugaguaauauuuuagcuguggauucuguuauaccaaaaaagcuuuaaacacaguuuuagauuuuacuauuauuguuauuaacagcuaaaguuaacauuccagcaaaugcccucccaccaaaaaaaaaaaaaaaaaccuacuaaauaaugcauucuuuuucuccuuucaaaaaaauuaucauaaauaagauuauaagauacucuuuuguguuuaugggauuuuuuuuguuaggggaaagggguggguuuguuuuuuuagagacagggucucauucugucaccccggcuggagugcgauggcauaaucacagcucaccauaaccuuaaacuccugggcucaagcagucuucccaccucugucuccugaguagcugagacuacaggcacauaccaccacacccggcucauuuucaaauauuuuguagagaugaguucuugcuaaguugcccaggcugaucucaaaauucuggccucaagcaguccuccugccucauccucccaaagcacuacgauuauaggcaugugccaccaugccuggccuauacuuaugguauguuuuaacauaaaaggaauccuucuguauggauccuguagcuugcacuuuuuacucagugauaugacuuggagauguagauuaguacauaucagguaacuccuuccuuuuaauccccuguugacgaauuacuggcuguuacaauuuuucauuacaaacauuauuauauagcuguucaucacagcaugucaucuuguguauaaguccaucucuguaaaguagauaaugacgaguagaauuacuauguuauacaguaugcaguucuugguuuuaacaaaaccaaagaacccccccaaaaguaggacaaaguauacuuccgugaaccaugcaugaacuaauuuuuuguacauccuaacugauacuuuaaaauuuuuggccaggugugguggcuuacgccuguaaucccagcacuuugggauuccgaggugcguggaucaccugaggucaggaguucgagaccagccuggccaacauggugaaaccccaucucuacuaaaaauacaaaaauuagcugggugugguggugggcaccuguaaucccagcuccucgggagucugagacaggaggaucguuugaaccugggaggcagagguugcaaugagcugagaucgcaccguuguacuccacccugggcggcaagagugaaacuccaucuuaaaaaaaaaaaaaaaaaaauugccagucugaugcaucucauuuuaauuugcauugccccaguuauuagggaaauugaacaucuuuuuauuauuauuauuauuuucauaauagagaugaggucucacuguguugcccaggcugguuucaaacuccugagcucaagcgauccucccuccuaggccucccaaaguguuaggauuacaggcaugagcuaccgugccuggcugaaauugagcaucuuuacugacaauuuguuuuguucuuuuaugaauugcuuuauaucccuugcccauuuuauuucguugucuuuuuaaauugauauaugcauguucuguuuuuccaguaguauccuuugucugcuguauaugucacaaauucuucccauucuaugguugucuuaauuuuguggguucauuugucaaacagaauuuuuuuuuuuaaaaaaaauggagucucacucugucaccuaggcuggaaugcaguggcacaaucagcucacugcaaccuccgccucccagguugaagcaauuuuccugccucagccucuugaguagcugggauuacaggugcacaccaccaaacccagcuaauuuuuuuauuuuuguauuuuggugagguuggucuugaacuccugaccuugugaucugcccgccuuggccucucaaagaaagagcugggauuacaggcguaagccacugugcccagccaaaacagaaauuuuuaauuuugauguagcaaauguaucagucuuuuuuuucagucccuauuuuuuguuucucuacuguauuuucucauuguccugcaauuacuuaucacucaccauauaaauauuuguaccauuacaaagcugcauuuagaagaugcuccuaggacuugaaguuagauuuccuuuucaggacuuuaguaugauuuuugaacauuacaaucagaaugguuaagaaugaaacuuuaucccucauuucaacucuaauuuggauaacagugcuguaaacuugggcuucuuuuaugaagagauucuuuaaaaauuuuucuuaguuauuuacuaugggaauauggcaaauuauuccagaacuauagggaacuaaaaugaauaagcagauaugaucucugguccucaaaaggcuuagaauuuaauugaggagacaaauaauggacacgaagccauuccaggauacucugggguaaaucaagucguccugagaaguucuagaggaauucaggggcaaaaaaagguagcaaugugcauauguggaaguguuuaaggaagggauaaggucuggaagcaaagagaccauggaggagacuuugaauucauccagacgaggagugauaaaggcacagauuuugggggaaaugaaagauuacacgauggcucacaccuguaaucccaucucuuugggaggcugaugugggaggaucauuugaggccaggccaggaguucgagaccagccugggcaucauagugagacccuaucuacaaaaaaacuuaaaaauuagccaggaguggugauaugcaccuuuaguccgagcuacucaggagacugaggcagaaggaucacuuguacccaggaguucaaggcugcaguaaaccuaggauugcaccacugcacuccagccuggguaagggagcaaaaccaugucucucaaaaaaagaaagaaagaugacuggcagauagucaaaaucacuaacaaauaaguuguucaauaagaaaagagguuggucuuuuuguucgaaaaacaaaaauacucauguugacuuaaauguaaacugguuguuuugauuucagugauuucgaagcaugauugaagauuaguauaauucugucuucuuggguagaccaguucuuuuagaccugguggguuuuugcacuuaacuuuuaagaucaaucauuuauuaaagcuguguuuuuaauaaauaaaaauuauuugaaacaccuuauaguugugccugcauuaguugguuuauugaauaacuuaggcaaucuuccacuuugacugaaaugauuaagaucaguuuaccgaaagucauuucauccuugccuugcaggcaucuggcuauucuuggugcagggcugaugggagcaggcaucgcccaagucuccguggauaaggggcuaaagacuauacuuaaagaugccacccucacugcgcuagaccgaggacagcaacaaguguucaaaggguaagccugcucucucucuuugcaagaguuagaauguccuuuguuucuugguuaguuguuuuuugugguggcuugguggguuuuuuuguuuguuuguucuugccaucacggauuccuuuuuccugaacauaaugaguucuagauacuccguagugaagccaaguuucuuuugauuuuuagaaaugccaauuccuucuuugacuucguuuuguuauagauaucauagacaauuaacauccuuggagucuguagucuuugaaugcagaagggaaaaucuuaucuaguagauacuuguuaaugccauuuuacacuuucguaucaggccugcggauuuugauauaguuugcagguaauugcucuauuguuaaggauuauucaaacagcaugacugucucuguugagaagacugagugagguuaggauguaaggaaaugggcaguaacugcagggggaaggcagggccgggaucaggacucuucagacuuuuauuuccugacuggcauuacagagagaagccaugaacugaucccuccacagugucuggggcuuuacagacuaucuccaucuuaccucugaauuaauaaagggggaauauuauuccccuuccucaccaccugccucucucaccaucacacacaugcugccuguuuugcagaggggaagguggagcagcagcuuggccaaauggaggguugguuugaucaguuuucugcucacauuuaauggacaagcuggcugcacuuaaagcauccugcaugugacuuuuagcugagugagcuuuuuuguuucuuaaauggauuagauagcuuaagcauguuguuaucccuuuucugcagagaagcucacauauugcugccauaaugcuaaccaggaccuggcagguuucaucguguuggcagauuauuguaagauaacaaguuguaguagaagauucugaccaaaaaaaugaugugugcuagauagcagcagugcccugaaacuagcaugcaagcaucccaaacagcauuccauaccaucaccaaaguaagaaauuguugcucuaaaauaguuuccucccccagucucucuugaauaguguccuggguuccccuuuucgucuuagaaacaucagguucuggcgagugccgcucaccacacugcugacuugggacaauaguuccuguccucucuugggaauaguuuaaucaggcauuagaauuagagcaacugauaauguuuugaaugcugacaaguaucuuguuugcugacugcugucaugauugucaaaaacaaaagcuuugagcccauacuuuuaagaccuuauuugauguuuuuguuucuuuugagacagucucacucuauuaccgaggcuagagcacaauggugcaaucuuggcucacugcaaccucugccucccggguucaagcgauucucaugccucagccucacgaauagcugagacuacaggcaugcgccaccaugcacagcugauuuuuguuuuucuuauagagacgggauuucaccauguugguuaggcuugucuugaacuccuggccucaagugauccgccugcugcagccucccaaagugcugggauuacagaugugagccaccaugcccagcccuuaagaccuucuuugaauacuccuuuguauuuaucuuguggccuuaauuuugcuuuugguuaaggaaauuagugaaugggguuuagcuucauucuucauuuagaggaaaacuguagguaauuuauucugaaaguguggucagacggaaucuaagagaaccuguuucccuuggcgacgaaaaauaaucaguugaaugucugaauaacaggaauccuuuucugcucccuaugggaaaaaagaaaccuugaguuaauauuuuauguaaucagugcaaugugcuacuagguaaugagugggaaguagauggagaauauaggaaauaaugcuuggucucuguucuuuagaagauuacaaccacaggcugggcgcgguggcucacgccuauaaucccaacacuuugggaggcugaggcggauggaacacgaggucaggaguucaagaccagccuggccaagauggugaaaccccaucucuacuaaaaaaaaaaaaaaaaaaauuagccaggcgugguggugggcgccuguaaucccagcuacucaggaggcugaggcagagaauugcuugaacccaggagacaagagguugcagugagcugagaucacgccacugcacuccagccugggcaacagagcgagacuccgucucaaaaaauaaauaaaaaaaaaaaaagauuacaacuacagaauaacauaaaauuauauauuugcgauaagcaaauauaaaccauguggucucagacacacuuuggcugcuuccccugucauagguagagaauuaccagaacuccucuuuuguuuugccauucuaguauucauguuauuuacuccucuuggcaaauuuaacugguuuaagagugauuuaguuuacguaaauugggcauuuggaggcauucuaugguagaaagaauguguacuugggaguuaacaugucuuugaaugcuagcacccucccuuaucaagcuauuugaccacaggucccucuaagacuaaacaacuugaaagucucccucaaaaugggaguaauagaauaacuaccucacagaguuggugaaaaacacaggugugcucuggcccauggacauucaauaaacguuaguuuccuuuucuucccaucuaacuaggaauguguuuuuucuagauugaaugacaaagugaagaagaaagcucuaacaucauuugaaagggauuccaucuucagcaacuugacugggcagcuugauuaccaagguuuugaaaaggccgacauggugauugaagcuguguuugaggaccuuagucuuaagcacagagugcuaaaggaaguagaagcgguaagcaaggggcuguuguacuugaauccuaguguagugaacagaaaacacagagauuuuuuuuuuaaaggagcuauaggaaacucaugauugcuuuuauaaaaaggacuauucaaaggcugggcaugguggcucacgccuauaaucccaguaguuugggaggcugaggugggcggaucacgagguaaggaguucgagaccagacuggccgauaugaugaaaccccaucucuacuagaaaauacaaaaauuagccgggcaugguggcacacaccuguagucccagcuauuugggaggcugaagcaggagaaucacuggaaccugggaggcagagguugcagugagccgagaucacgccacugcacuccagucugggugacagagcgagacuccaucuccaaaaaaaaaaaaaagacuuuuuguuaucaaacguuaaguuuuuaugugugcucaugcacacugcauauguuauaaaggucaaaucuaaauucuaaaggaagaaaaugagggugcguucaccuuauucauguaggagcucugucacccaaacauacagauaaccucacagaguauagccagaugcuuugagauuuuuugguuagccgaaagccaaaaacaaaccucuucaggucuaaggcugcaaaggaaauagggaagacaguucguccagaugcuuguucuguggaaaugcugcuuuggcccagcucccaaauguucuccauaggcacuucuugagaugggcugacaugaacaaaacaaguacuugaaguggggaguaggaagaguaagccccgagaaggaguaauagcaguaauucagggaugagguaggaccaaggccuaagcuagucuacaguuggauaaacagaauguggguuacugaaaggugaacaugaaaugauucugacuuggcaacaugcuggauauaaugagcagugagcucauuacaaaaaauaagaguaccacagagcaaaacuccgucucaaaauaaauaaauaaacaaacaaacaaacauuaucuucucuuauugcccauagagcuaacaaaacccauuccuuggacaaucuuccacaggcaugaucucuagaccaccccguuucgguuguccucucuaguaucuuccucaugucuccguguucuacugcuguguuuacaacuaucuuuucacaauucugcaaucugggcagggcucugcagagacaguggugcuuaaguccauugauuucaaggcuggggucacuccugggcugcauuccgcaggaagcucgguuggggcaccucacugcuucccccacaucucucauaguccauccucacuuagucgucucaccacaacuucuuuguagcguggcugcaggcuuccaagagaacaaaagcagaagcuacugagcuuccuaaguuuauugucaggaagaaaaaaagauaaauaauuuaaaaaauaaaaaaagaggcuaccgggccccacaggucuagguaggccuggaacuggcaggguaacuucugcugcauuguguugauaaaaacaagucacaagaccagcccagauucaaggagaagggaaacagacucuacuucuagcugggagaaaagacauacauguccaaggaagggaagaauguuugccagccagcuuuggagacauuaguuugcucuucagaaaggauuucaccaccagcauuagacacuauauuacuaagaaaguaaccugacacuacguaagcuuucugacagucaugcuguacugucaauucauuccacuuuuguuuuguuuuuuuguuguuagagacagggucucacucugucacccaggcuggagugcaguggcaugaucacagcucacuguaaccuugaacuccugggcucaagcgagccucucacuucagccuccugaguaacuaggacuauggguauguaccaccaugccuggcuaguuuuuuaaaguuauuuuuuguagggccgggcacuguggcucacaccuguaaucccagcacuuugggaugcugaggcggguggaucacgaggucaggaguucaagaccagccuggccaagaugaugaaacccugucuuuacuaaaaacuacaaaaaaauuagccaggcaugguggcaggugccuguaaucccagcuacucgggaggcugaggcaggagaauugcuugaacccaggcggcaaagcuugcggugagcugagauugcaccacugcacucuagccugggcgaaaaagcaagacuuugucuccaaaaaaaaaaaaaaaguuauguuuuguagauauagggucucacuaugaugccgagguuggucuugaacuccuggccucaaguaauccuccauccuuggccuccugaaguguugggauuauaguuguuuagccaccaugcccacccuccacucuugauuaacuaaaaucaugggaucuuuaucacaaauacugccaagccaggucuuguccuucaaguaccuauacaguucuuuucuuuccuuuuuuuuuuaaaucuuaaggcaguacuuuacuuuuauugcauuauaaucuuauuuuguacucagcuuuucaguguguugaaugugucuuccuccuugauucucaucucuguuaggauucugccuguuccagauuugcacacauuugacaggugucccuuccacguuucucauccaaccaucugaauaaaaacaugaauaacugggaggcggagguugcagcgagccuagauugcaccacuacacuccagccugggcaacagagcgagacucugucuuuaaaaaaaaaaaacaaaaaaaaaacaugaauaaguugggaucguggccagaaugcggagacaaucugcauuagagacuauucuccagguggauaaagcuaauaguuaauaguauuuguguacuguagcugcaacuauagugguaugccguuuuuuaguaacacacuguauaaaaugagacaagcaugcacauuuuggcuuguucuuauaaaggugaagcggggagugauucagggcagauccaaacaaaagaggaggugacacccaugcuggguguugaaaucaaugaauugcaauucaaggccgucuuuucaguguuguucuaagcuguuuuauugacccaacugcugagauguagucuccaggucaggauaaggugaccuuaugaugggccauaacuagaggaaggcagaaugggaaaaggaacaaggucaacauauuccccgacacaaaacccccuaggugauccgucaaugucugggugagugacaucuacugucugagcaguugugggggacagagugggcugggcccaggugucacucauuagcuuugauguggccucuaaucaucucccaggccuaccugacacauuguuaaaugcuuuuccccugcaggugauuccagaucacuguaucuuugccaguaacacaucugcucucccaaucagugaaaucgcugcugucagcaaaagaccugagaagguaaacucggaacagagaaaaacccugagauguuuuauugcuucagauucacugauaaaggcuuacagcuugaguacagaagagacaguggauuacggaguggaugcgggugguuccuaaacacuggacacaauaaaugcuaauaccaugacuagugugagaugcaggaguaaguuaaguacaacaaaaaauauccuuuucaaggaucccaaaugggcauuauuuuucagguucaggauauaaagcccaccuguauccuagaauuaggcauugaaggauaggccuuaagaaaggaugcuccaaaauaccaguuuggcuacagagcagagucagugacuguuuagaacagguuugguuccaccuccagaucagggaauggcaggaauggugggaugugucugcccguggguuugcuuacaccuucuaccccgggacaugaaagggcuggguauagaagcacuuucugugaguauuuggaaugaugcccagaaauuuauuuuugcucucaaccagaguaauuaaggggaagugaaaucauucaaagagaaguaaaacaacucacuucucuggaggauaccaguuagccucugcuaaccagaaccagccgaagguaggcaggaauuauaaaagaacuuuaagcagcugaaaguguuaauacaaauucuauguacugaaaacacaaaagccuauuuauuccuacucuucuagcuugcuaaugcaagguaaucuaguuuccuagcacacagcagauuagaagugaugcggggaccugacagaggcaggcucaaugauggcaggcuaaaggucauagggagaaguugcagccgauagucuacagauggacagucuggccaugucauaucacucaagacaucuguguggcaucuaaaaucaguacaggcgaugccguugcuguucauuugaugguaaccucuccccgccaucggagcagagcaagcaucacacuuugcaguucugcccuccaaguaucuaggacagcuuuucucaccugcuugccuuuugucauucauuuaaaaguaaggccaaaaagacaaaauagggugaccaaccaucuugguuugcccgggagcaagggauacaggacccucagugccacaaauugggaaauccccagccauccaggaugaguuggucaucuuuggcacaacuuucugagugauguaaauauauuuugcuuggguuagugauuauauggauguauauacaguugucaaaacucauugaugugaacacuucaagaucugugcauuuuauuauauagaaauucuacaucaauaaaggcuaauuccuuuugcucaggaguacugagucugaaucagguccuaaguauuucagauguaaguaaaagaacacuuuagggguuagaaacaacuuuuggauugauaaguuuacauaacauuuacuugaucuguguauuacauaauggcauuggagauagacagaccugugauggaaucccaccccgucauaugcugacugacucuguacuacuaaccucuugauaccuuuuuuccucaucuagauaauuaggcugaccaguucauaggguuguaauggauuaaauguaaggaauaagugguaaauguauugaagagcagguagauaaugagcagccaaaaauuacagauaucacuuguuguaccuuauagcuaaagugagagggagaaagcaaaacuauaaauuaaugaauuagacuucuuucaccacaguucuguugggaagacuauguaacuguuagcucaaugagggguuucucugaaaccuuagcacgcaucagaaucaccaggagggauuauuaaaacaaaucugggccccacccauggaguuucugauucaguagggcugggcuaggccugagaaugugcaggccuaacgcucccaggugaugacagugcuuguuggguccggguacuacacuuggagaacugcugguuuaaugagucuuaagugcaucugacuguugaggaguguuaguuaaaccuaguauccugguggugagacccaucuguguaaaaugcaaauacuucucugacagcccaacacauuaauucuucugccugccccacccccgcccaaaaaaacuggauccucuuaucuaaaccaucaguaucauuaauauaaguggaaccuucauccgucguuccccaauaaaucuaguuuggccucgagcugugguuuuggcacugauuguugggaggaucagaugucuguagugaaaaaccuuagaagcaaauggaagaggaggauuccaaugugcucucccuaaacauacuaaacuuuuaucaaagacccauggaaccaaaccacucagcuaugucaagcaguauuccuauaucacagccaccuuucuuucuaguguuuuccuagcagagaaggaaugcucucagguuccucacccgcauucuccgaucuguuggcuuuugguuccccuugccaggugauuggcaugcacuacuucucucccguggacaagaugcagcugcuggagauuaucacgaccgagaaaacuuccaaagacaccagugcuucagcuguagcaguuggucucaagcaggggaaggucaucauugugguuaagguaaggggcuguauaacagagcugcagaguuuuugaaaaguucuaauaagacuccuuuuaccuccaggcuuguuuauaaauauucuggggcaaaugaccagacuuugauaugauuuuccccuggguugucuccaggauggacggugguauugacugucccacugagucaaggugggaguggggaguaucuaggauguggcaggguucucccagccaucccagaccuugaaggugaccaugaaacuaucugcuguacuguuugauucaagccaggcuaccccuaguacggcuuccccugcaauuucauuuuuaaggauucugauugagauuuuaagucaccuuaaguuuuacagugacuuucaaaugacuuugaagugacccugggaaagguagaguguuucagacucagucccagcagcagggccagggagcucauguucucuuccuuggcaggauggaccuggcuucuauacuaccaggugucuugcgcccaugaugucugaagucauccgaauccuccagguugguauugcucuccagaguguuugcggcaucuuccacuccuucagucacucuaaaacucaugaugucaagauaaggaccaagcuuccuucugauacaccaacuccugcucuugucuaggaaggucccuggugcccucucucugcacagcagucggaaguugggcuuauacugcacugaaaggggcagagcuuucccucugccccacagccuccucacuguuccagcaagcuaaaggcaccccaccccccagcaugucuucuaugcuguuucugcaccucucugaggcagggaccauccagaacagggcccgcuugguucaacuggugcugcaucuguuuccacagcacacagaccucuccaguagccaucgaggucauucuggcaggaaaggagagggauccuccucgcugggcacuuacccagacuuggggaucacagggcucugagugcuccucuuugaugauguuucuucuguuggucaugacacacucagccgucugucaugcaaucuccuuauuauugagauucagaaaugcaaacaagaagaaaaugaagaauuuagucaucucuaaacguccuuaaagugcuguagauuagagaaggcucagacuuuccacuuguggccccaaacuucuuugugcuucccugaaugaaauagcaccaguccugggccuggucaggugacacucagaaguggguuuuacacaaggcaguguuuggagccaguacagggagcccuuuggggggauuugggcugcccuuccccugaggucccugcaucgcuuccuguucaggaaggaguugacccgaagaagcuggauucccugaccacaagcuuuggcuuuccugugggugccgccacacugguggaugaaguugguguggauguagcgaaacauguggcggaagaucugggcaaagucuuuggggagcgguuuggagguggaaacccagaacugcugacacagaugguguccaagggcuuccuaggugaguagccucaaggaaacauaacuagcaccauuaguuacaaaguucuaagcaguuccugagaccaaagaguuacagaagcccucguggaagaaaguuuucuaaacacagagcccuuaucacuggcgauuucaaaaaugauuuuaugagucaggugcgguagcaaccacuuauggucuuagcugcuuaggaggcugaggugggaggaucgcuugagcccagaagugugaggccagccugggcaacauggcgaggccccuucucaaaaaaaaaaaaaaaaaaagaugucaugugaaccuucuaagggcuaggacuauagauuauggacaaaaggcagaguucuacccuucuggggcucuagcaucaccugguccaaguuaugccagauggacaagcauuuuuaucccccagagaugaaaucugcaauagugcagaagcaagcucugcauccgggcuuuaccaugcugucuggccaccugugaggagaauguauaagcucaccauacacaguauacaguugaggcccacagagaagugacuuucugucuuggcaaaacagcaaaaucagcauuacaaccuggguguucuaggacccggugcugcauauggggauguuaaaacucacccagguggccuuucucauccauguacacagaugcccaagcuccgggucacaagaucuucuuuccuucucugcccacucuucugacaaagacuaauuugcuaggguuagcuagacauacaaauucaggaauucagaagaggccagagcuuuauaauagaccaacagagacaagaauucucaggucagggucuuuuuuguuuguuuuuuguuuuuuuuugagacagagucucacacuguugcccaggcuggagugcaguggcauaaucucgucuccaccucccggguucaagcgauccuccugcuucgcccagcuaauuuuuguauuuuuaguagagaugggguuucaccauguuggccaggcuggucucaaacuccugaccucaaaugauccuccgccucggccucccaaagugcugggauuacaggcgugagccaccacgccuggccaggccaggguucugagaacaaauaguaacacucccucccugagaacaaauaguaacacucccuuuucuugccuguuuuaggucguaaaucugggaagggcuuuuacaucuaucaggagggugugaagaggaaggauuugaauucugacauggauaguauuuuagcgagucugaagcugccuccuaagucugaaguguaaguccguuugaguggcuaaugccuggaaauugacuuucucugacagcccaaagcuucccagccccucuuccauuuuuuuuuuuuuuuaauacuuuaaguccugggauacaugugcagguuuguuacauagguauacacgugccauggugcugucuuccauuuucuuugugaccaccauaccugaacaggaggaccacuccugaugcuggcauggugcuuuccaaguggaaggcccucgcacgugcuccuuggucucugcccagcaucuaggugagaaccaggccacgucuggugaaggcccuccccugcuccagccuucucuggcaaguucccagagagccgcuggaaggacagauucuccuuggccccuucacccucccagaucuuuauuaucauuugugagcagcugacuguugcugaugucaaagagauacugauuaucuucucggcaccaggcccuguucuaggugcucaguuucauguuaauuagggcaaguuacucuccacuuuuuccaugggaaaguuugguucacccaggcagcaucuucucugagggccagcaccaaccggcccacagagcuccccaugcacccaucccgacuuccauucugcaucugcggcucuggcuuuccuccccuuuuccucuucuucuaccuaaacaucucuuucuguuggcagcucaucagacgaagacauccaguuccgccuggugacaagauuugugaaugaggcagucaugugccugcaagaggggaucuuggccacaccugcagagggagacaucggagccgucuuugggcuuggcuucccgccuugucugggagguuggucucgcagguugggaaggaagcucacuuuagccuggagcccguguugcgucuccuucaacgaaguccucuuucucuauucagggccuuuccgcuuuguggaucuguauggcgcccagaagauaguggaccggcucaagaaauaugaagcugccuauggaaaacaguucaccccaugccagcugcuagcugaccaugcuaacagcccuaacaagaaguucuaccagugagcaggccucaugccucgcucagucagugcacuaaccccagcugccggcagugcugguucuccaacagaguggugucuagauuuaucagaguaacgagaagacaaacuccggcacuggguuugcucccugauuaaagugccuucagccaagaccaucucucccuccuggugaagugugacuucgaauuaguuugcacuuccuguuggaagguagagcccacugcucauuguauaagccccgaggccuagaguggcagccaagagccaucugaagccaccucucugccuguuccucccaagaggccaggguggccagggguggugagggcaguucugcacccagccaaacacauaacaauaaaaaccaaacucugugucagcaucuuugcccuucugguuuaaacgccuccuucaaaaagcaaucuggaagaaagcccugugcuuugggggaguaagaaugugugugcagaauucuaggcagcaccuuagggagggacugggaugagagaaagugggaccuggugggcucaaccacacacaccugucugugcagaugcuuugcccaggcuucucaccacgguguaccgggauauuaaaccucuuuccccagccuggauuuccucauugugugaucuuacccauuucuuuucugggugugccucauucauaggugcuucuugggaugguugugggaacguuggugcuaagcagaggcgcugacaucucccuugauguucggagauccugcauagcagggcugccccagaaaugccugugcgguaaucaggcagcacgggagcagcaugaggagugcugacccccacagcaccugcacucccccaaagcuucagccccuccccaccccacccccugggauggaaaguuccuacagaagcagugcccagucuggguaaacagcacuggggcuaacugggucuggcagaaggauccacgcugagugugugcggaaucguaauuccagucccaucacauucugcauucuaaauugucagauauuaccaguuacuccugccucugcuccaguuguacuucaaauaugucccuggucccagcucuguagcugggacuggcaggcaaggagaucaggucuggcucugcuuggucacuaggaagccagacucuaaaaccaagucaccucugaguugagguuuucagaugaccagaguagggagcugaucccuugcaccaaagccauuaaccgguuuccaaauuuggucugagagagccugaagccggcauucugccaaugcaggaagcuaagcuugggcccuggcugguggcauucagcuuugagccugggucuuucccuucaguaacaccagguaggugugaauuauguugaaacuaguggaagcugggguggggguucuugaaggguagggaggggcuggcgagggcccugcagaagggaaugaaggcugccaccagccgccuccacagacaugggaauggccacacacccacaucauuccuccaucaguccucuccugccagaaggcauauacacugugcccauggguccccauggccuuguuuucaaaagaagaaagcagcuggcacccagaaugccacuuguacucaucuucagcagucuagcauuuauuucauuaguccuugaggauucauuaaaugaucugcaagaaaacca

SEQ ID NO: 14303 - RNA, 10469 nt, Homo sapiens
agacaaaccaaauucugcccuucaucuccaauguuugaaagaucagagguuccugucaaguaagucauccuuucuucauaacuauugaaaaagaaauaaucagaaaucgcugaauaggucaauuaaaaccauuuuuaucaaauauauucauucacaacauguauuguuguaguuaaaaacugguugagaaaguuuacuuguaauuauuccgcacuuugauaucugucgauuauuucuggagcaaaggcaggcuuauucauuaggugccuuuagcuaauuuuuccugcuauucuugcuggauacuuuagaaaugagaaggggugagcuguaagauaaaugagugucacuaagggaaauauaagccugccuuucucaagggcugagcuccgggaggcgggaagaguucagagcauugggccagggcucaucugguggguucaagcacacagccucaacucccuugcaggaacauggguccgugugugguucacucugaagcaucugucuuccugugaaagagcuugcggcuggugaguggauacugagcccaacuucugcaggcugcccuccccucuggauaccaagcccacccauggcaaucccuucaaggcgugacucucaugauaauuaaaugugugauaaugugaaaaggaauuuucagagaaaccaagucaaggacuggugguggugaaacuucuugcuuucuuggaaagcaagauaaggugcuaugcuuucugcucucugacauuuccaccgucucccagccaucuagcaauggcuacccuagaaaaaccuguuuccuacccuuuggugugggcuggguauagaaagaggaggcuucucuccagcacuuugccaggaggcccuuugccacaccguccucaauccacccugcuuacgcugccccugagaaagccuaguucucaccuggcagugucgcuuccuccuuugcuguguuccaagaugcagccuucauuuguggccuaggaaggggugggaaggcccaauugcagggcaguuauuaguauugucaacucucccuugaagagguuguaucuguuuuacuuucucacaugcacuccugccugugcugcaggaauccuagaaauuuugcucucagcuacaguaacucccaugaguacugaucccacacuuuuccuucaaaugcuaacuggaggcagauuuuuagauggagaaaccagagaaaagagagucagcaggaguccaggugauaaucaggaacccaggacccugauccugacugcucugaccaggcugcucauuccacugguggggagcuggaaccggaaaacuguucauucuaaaaaacaaccccaaucuucucucagcuucuggcugugcccauguccucugaggagggccauggaaugccuucugacaugcucuuggaugcacagcugaggaucugaaggcagcaacucaccagggagaugguggagcugggggcuugggcgcggcagaagcguuugcgcaaagcuucuuguaucugcgggagagguaaaugcucugcuuaugccagccacggccccggccugcgggcugcaagugaggcaggggguuaggugggcagacuuaccuuccuguccaugaggcaaccaaacaauaggaugaagacgcccugagaagagggacauggggauaagcuggucaaggaggaagggauccacccgaaucaacaugcuccuucuguccuguguaauucacauccuaaggcuucucaucucaauuuuucuguuaccacuauuuggugcauaggauccauuucaggugcuuuucuuauuguuaugguuauaaaagggauagcaaaggauuggguacugacaauuuccugauuucuccaacaaaaucagcuauuauuuuacagauaagaaaaccaaagcucagagagguuauguaauuuguccaaaguuauccagcuacucaguggaggaacugggauccacaccuaagccuuccaaaauuccugaaccuauguuucuucugcuccaccuugguaccuccuagagaagagaucggcagugacuuagaccaucuaaaaaagcaaaaaacacagccaccccccuaucaccuaccuggaggguguugagaauggugaagauguaaugagggaccguggagacuuccucuaacagaguggccaggcccagcccccaggugaggccaaagauggguguaagaaugagcagggcuuugaucacccccagcagagcuuggcgcuucucugcugggggucccucugacagcgaaggucucagcaacuucagcauggccauggcuaguaccagcccauucacgccuaugauggccagcacuggccccacgaagguguauaacgccccucccuucccauccaaccagcauucccccucccucagguauugcccuugagguagguagagccccagggugacaccugccaaccccagugggcacagguagcccaggagcaccaugagggggagaacucggugcuuugccagcuggugaaagacaaagagcagcuggugggccaacaccagggccugcgccagcauccagaaaaagguggccagguagaggaaaugacagaggaaggcggcagcaaggcagagcgggcuucggggcccuggagagaggaauggggcgcccaggaagcaagugucugcggccagcaagcagaacaccauguugagcagggcggcguggcggaaauaggagaucuuguuccgcaccacgacucuccacaccagccaguacacacccaggcacacaagcagcgccaguauggaagcucccaagcccacuugagucagcagcgccagagcggguucuuccggaacaguguguggggacaugaggacggagaaggcagugaggugcuggcagaggcacugagcaguggggcuggcacuggccaccugugccuggcacccuucuuuggaccaacccccccugcccuggaagagacugugaucccagaagacacagugaggggaaccaucuguguucccaaaguccaugaugaccucucccuggcugaaggcccggucaccugccaugauggaaaugacaaggaccaggccaggaguggcauagagggaaucccccagcccuuguccauaguuugagggcagaaggugguccaguuuucgcagcaccaggcuaguaauacuuauuucaguuccauuacggaccaauggggccagugagugccugggaaucugagccugcagugggggccgaguagggaaggagaugcuguagucagcaggaaacguggguccaaacagcuggcucugcagcagcacauuggguaagcugaaggcgaaggggugguccugugggcacaggcugcaugccagggucuccacagccagcaggagagucgagccugcccagggcuuccgggcuugggccaggguccacagagaccugguguccauaucuaggaccuugucuguggcaaucaggagauucugcagcacccaaaagaaagaugaaccccgucugcuggcgcccacaggacugagccgggggcaaugagaacaacagaccccacaccuucccuucccaguccagugugcgacccaagguuggagagaaaagggagaggaagacaggccugugaagggagacuuucuagaugggaagaacagggagcuguuuggccaaccaccuggggcaucuucaaggauauguccccugaccugcacccagccccucugcugaaaacccuucuucccccuccaucccuaggggccacccagguucuaagaggggacuucucccauucuuuggccccuccaggucugcaaagcuaggaauggugaccagcagugguagagggcaccguguccuggaggcgacggccacacgcaugucugugcauucacacaugccauguauucccaggcauaaacgguguguaauaucauugcccuuuguuacacuuuuggcugcagcucaugggucaccaauggaugcccauacagagagccgauuuaggugagcccagcaaagccaagcauacuucagcgucuccauagaaacuuccugucuguaucauagccacacgccugcaugcgcacacacgccucgggccucaugucuccacacccuugccugccuccaacccccaugugcucccagcgccaggccuccauucugcagccucagagaguggugucugagaggagaaauggaucaggagcaggccccuggacucuggaaaggucugcugcccaacagcccauggugacaucagagggacagaaaugcccacagguggggagucuucagcccccgacugcccagcuggcccccacuguggcucagagaucucaccuucagggcucugcggucaagcuguauucuggccucugccaccaccuuggccacguauuucauggugcucagcagggucaguaagucggagggugaacuugccucugccgccugcccuggcagcugugccaggaucuguggcaccuccucagcaggacugcccuggccugccugcagcagcugagacagacgagacagcaugaagugggacacaugguggaaugaugguuugagaagagcaucccagacccauggagauuguugacccccagaagcccucucacuccuacuuccuggcucugcuagggcuccacuucagagaagcugaacagccugugggcugggccuuggggaaaagggucugcaagcuggguccuagagaggcuagggugggccguggagggggcacgugggcagcaggguggaagcuucaccuugguucuagugaacaaggccaggagccucgcaucugugcagcugcuguggaccggcccccagacuccgucagccccacagagccuccucacuaugccccucuugcucucaggacauggggccugugccacguggccagccuuggugacauuccaggugagcaccgaggcguccucagggcaggugaugucuccaucugaagaaugacgagcaggcgcuacucagcaaucacagccucaccugagccucuccuugggcagaacccuaugcgggccccgaagccugguccuguugcccagggcagagacgugccaugcaagagagcccgugcucccaaggcaagcagcugggaccagcccacugggccccaggcccugcguacccuggaugauggugauggagauggggacccugaguggagccaggcccaggcucugcaggucacaagcguacguggugucagccaucgggcagcgcugaacagccagcacaaagcacugagagccugacucguugaaggaggaagcugaaggcaaaacgaagaagggaacugucauugggccagggacaggccuggaacccagcaggcucugacaugcuguuucagucuuucuagcaauucagaaacagaggaagcaguggggaagagccaaaugaugugugggcuccacuuggacagaggaagagagcuuggauuuugcuggaggggacuguggggucucuaacaagcucuaggacucaguuuccaccauuuccucauuuguaaaauggagacuaccaucaaacuaauuccauagagaguuaaaugagauuguguagaugacagcauuuugcaaaaguuuccuauacacaugugguuauguuauggcaauagacguggcauggcucugaugggguagaaaacaguguuggccuuggaccccacucucugguugaacuguggccucuguuucucaugagcugaagacccagcugccuggaagagacagcugcccccuggucccucugaccccugacugcuggccccuucucauaccuuugcugcccucuccagggcuccaggccgcgguguaggccagguuugugcuggggaugcagcagcucagcuggaagccaggggagguggcacaggagauggacagcugguauggaagucgagccacaucugucgccuucaagggcacccucaccaccucauacagguuccacuugaagcccugggccucgaagcagcucauguacucaccugcagaaacgugugugcggcgcuauguggcuccucugggccccgcugcaccacagaaucucugcugcuuuccaagccacagccuugcuccuguccucugccugccacccagugcuuaaccccagcaagcaaggucccaggauggccccuuugguggacauucccuguccccaagaaggauuucuaggagguagaagagaucucucuuuuaucggcccaugcccgugaauuucaugcucucccuagagcagaugcccuuccugcaccaccccugccauuuuagcaucuugaaaaacauggaucuguucucagcagacauugagacgguauucuccacauucuccauauuuuguguggagaauuguaguauuuuuguuaacagaaacauuuuuaugaaaaauaacuacauuuuccaaaacauaauuagacaagugacuuuguuuuacauguuugcaaaucuugcccgugucuggguucucccaucugcauuugcauucaaucucgugauggcccuguagccucuggaaagggccacugucuacaccugagggagugggagugaaagggucaaaugacaucuuagcauauuaggacaauaguugugacuuuguaaacccugaaaagggucucagaagucccagaccacagugaaaacagcuggccauuuuuagaauuuuccacauugcaauuuuucacaccaagggaccucuuagccuuuguuuccccagaauggguaaauggaaagaugaaaagggugagaaagagguggaaagaaaagaaggaaggagaagggagggaggcgugggaagaagaggugaaggaaagcagagaaggaagacgaggaugaagggaaguaagaggaaggagaaaggaggcaaggagaggacaggcuggcuaccugcccagugaugggacauguuggagacgcugagggcagccuggccguggcuggaagucacagacaccugugucccuggcugcaggaggaugggacuggggcucccugggugccucaggaaccagcucagguugguggccuccuggcucagauggagagucaggcucagcgugucaccaggcaucugcagcugggaguucagguugaggaucccggggacugcagggaggcaggugacaggggacccuggaggagggacuuauggcccucagaugcagccgagcaauggcuucuccccugacucuggagcccauuccuccacacucccucccuagcuuuuuaacuuuuucuuuuugucccugggugggcaccugaauguggcugcugcaauccagccuggaagacucuaucuguuauuggaaaccaaagagggaaccuuuuuggucuaugccucucccucccccagguauccugggcuacuggagcugcuuccugccuccuaagguaaaaagcagucacuccagcacuuucucuccugguccuuaugucucuggggccucucucauuagucucccuacucagguuccaagcucagggccugugaucugcuaugauggcuggcuuuuucucccacccagaggagcagcugugcuuggaccagcuggccaaacuacagguucagagaggagaaaaccacugagaacauuuauuucacuuaaggccauugguuuccaaguucccaaccuuccucaccagguggcagcaacuggcaguacccggguucgggauggcugaagacaaggcagccacaaggcuggugguuguggaggcuuugacaaggaggguaauggaggcagaugcugguguuccacugguagccagagaggcaagcacaauagaaauuccccuugugguugacauuacacucugacagagagaagagaagagggggugggcaggcugucugaagaagcuaggugggcagggcagacaccugccugaugccugagaggcuuuagggcuggguaucuggaccaauccccaagcuacaggugccucagucaggcccaugcaucaggacugccuccucagucaggacucgaagcagcagaugucucgggggccagggaacaggugaagguggaggucugggcccacguugucugucccuugggccaucagccaaaguuagaagauagggggauguggcaggcaaggaagggucugucugguagggaggugaggaaggagcugggccacggagacagaaccaggcagcccuuccuccaggaaauacagaggggcucacagagucucaggcaagcuggcugcaggaggcccgggagccuauguucauucacucucagcccccuucccacgcaagugguaccuguugugagucugaggccagugagaagaggccuuggggaagaggaagcugaggcagcagggagagucaguguccuggagaguucagggggccaggucuuaucuggaaaguccagauguacauagacggagaccagcgcugauucuacaggagcagaggggacagcuggagaggacaggcagcgaggccacaagccgguccccucuggauucucucaccuagcuggccagucccaggaaugcagagcagacccccucccacagccuguccaggugcauauagacagggcucaggaagggagcaaguccuccccuaggcacugugccuucagauacacggcuucaugucauccguccagcaacaccuauuuuauggaugaggcuucaaagacaaaugaguucauuuccaggccucuccgcuagagaacuggucacagaccuguccgacugugaucagagccaguccucucucuccgccaccacucccucgcugcaccugcccucucuuuucuggguccuggguuuccaccucauucccagcucccaucuccucccccucccuccuccuccuguccauacacucacccccugcuccauucucuugguccaggagcugcccagauccagauuccccuccagccugacucugucccuggaacagaacacagaggggagaccucaagucccuuccaaaggcaccccaggggccagccugacuagucucagccagcaugacucagucucaaccagcucuucuuuuugccaggagucaaguguacacaucaggaagggaaagcaggcuucuguuagggggugccagggaugcaaccccaggaacccugcuaucccacccaagaccaggaaccaggcacgcccugggaagucaacaugcuuuguuuaauuccuuccugcguuuaccugucccugggccucuaggcuaauugaaauggcuuggucuggagcuccagcagcggagcuggacauugcuggcuggggcccaggcgcuuggggaguuuauuccuucuguaggauuugacagcagggugagcagaaggcagccucuuuccuccgucuuugguuccuguacauuauuuccucaccaacuccuccucugucagggugaggguggaggucugggcccacauugucuggcccuugggccaucggccaaagcuagaagauagggggauggggcaggcagggaagggucugucugguagggaggugaggauggagcuggcccaaggagagagaacauggcaguccuuccuccaggaaauauggaggggcucacugugucacagaccugagcccugucuauaugcaccugcgugugcguguggauaucuauccaaaaccagauauugauauagauacgaguauggauaagacgugaguauaagcuggucacaauggcacgugccuuuagucccaguuacuugggaggcugaggugggaggaucacuugagcccaggaguucaaguccagccugggcaacauggugagagcaugucuuaaaaaagauauagauauagauagauuuagauacagauacagauauauauuuacauaaagauagauuuaaauuuagcaauagagauagauuuaggcuuagugacauauagacauagccauagauauagcuaucuauugaggagaacacagauggaaaggcacccucuagacucugaugucuuuccucagauucucucccauccucuaagccaauaguuuccaaaucugcaaaauuuuucuuuuucuuuuuaaauggccagcuugacugaaugagacuuuauccaaaguacagcagguaucauaugaguuuacagggacucaaauaaggaaacaagagcuaucccccacacccaggaaaguaaaacugaguucucagagaucucauaacaaagcauccacuuuccuuacacauuacuuccucuccccucagcccuuuccccacuaccuauccuuucauuccaugcuuugucucucccaaucagggguccccauugucgccucugcagaccuucccugggucucaccccagucucacuuacagguugggaugcuugggcaacuggugaccccagcaggggaagaguuguggccaggagcagcaguggggcagccgaacagaccauggcucagugaagcagucc

SEQ ID NO: 14304 - RNA, 357 nt, Homo sapiens
uacuucuuuuuuuuuuuaaguucagcuuuuuauugaacacguuauaaaagagguuuagucaaaaagaccaaggcccaugucaucaucagacuccuuggauucuucuuucuuugcuuccacuuucuucuccucagcuggagcagcagcaguggagggggcaggacguccugcuggugcagcaccagcugcuggagcagguccaccagccccuacauugcagaugaggcucccaauguugacguuggccagggccuuugcaaacaagccaggccaaaaagguucaacauuuacaccggcugcuuuaaugagggcauugaucuuauccuccgugacugucaccucaucgucgugcagaau

SEQ ID NO: 14305 - RNA, 7820 nt, Homo sapiens
ggaggccagggcccgccccacagccacucucgcgccuccgaacagccacaggggcaaagcccugucacccccaggauccggucaucagggaaagaggacagggagaccagaagagggccagcugggacgagggggcggacgcccaggaggcaacuucugagacgcagcuccugagaggggcagggaccaggcgcgggaggccagagggggcacagagaacaaacccccucagaagugaagaggagagcggaaggaaccgagaggggacggacaggagcugaggaggaaagaggaggggagaggggucaggccaggcagccaaggagaagacguguggccgggggcuaucagaaggaaacugggacggacgggccgggcucgggcuguccuguggagcagcagcauccccggggccggcagaggcgccaguggcugggcgggaugagucucugagggccacuguggagcgccccgccauggccccccgcacccucuggagcugcuaccucugcugccugcugacggcagcugcaggggccgccagcuacccuccucgagguuucagccucuacacagguuccaguggggcccucagccccggggggccccaggcccagauugccccccggccagccagccgccacagguaagagucuggaucccagcccgaggcuuggguggugaggaaggggucagaaugccaccucugccuggcucucugcuguguccgcuaaugcagggcagagggggagugagaagcccauccaucagguggcuccucacaugcccaccuucccacggggccuuuuccaggacccccugaacacauauguuccuugggucaccuaggggguccgcucccacaugccccagggaagcugcccugaggggagcgggccaggccuuccugccagcugcccucuguauccuagccccagagccucagggagaacuuuuguccccuucuagggcucccuugaccccauccaguaauccauaauucugacaccacuccagcucuguucccuccagcccuccagccagacacagaucagaggccggagugaauggggccaggaguauagaacugcaauccccaagaggggcaggcucaucaauggcuuauucucuacuuaaccccaagcuggccugcccgucuucuccuggaggggugggguggaagccaguguucagaucacccacagggcccgggcuggcuaugcgcacacagcaugccaaucuggggacugagacaggcccagaaagggacacacaugauuguguacauucagaggcuccccgggaccccaccaccaugaggauugacugcucugugguuuuccauucugcgcgucuccccaucuugaaaagucuuuaucugcuccugcuacacaggaaagcgugggggauagggaggguggcgaugccaaagcccuugcucucacugauccccaaggguucugcaucuuuggagccuucuucagccccucugguagccccugggcccuccuccagggcauguaucuuugguccuuggacccagaggggguuguaccuacaggaacuggugugccuacguggugacccggacagugagcuguguccuugaggauggaguggagacauaugucaaguaccagccuugugccuggggccagccccaguguccccaaagcaucaugugagucccagggccgggcaacgggcccuuggugggaacugggcgagggcagaugguggguggcugacucagggagucuguaugaagcagggagcaagggcaggacaggggcuagggucacagccauuuugaggagauacugagacaacaguuuggcuggugggagacugagggcaaaccugccucacgcgccagccccagaugccuucucugggauggcucaggcucaagcagaggaguucaagguuccagcacagggcaagggaaggaagagcagggauuuaacccuuggccaaaaagcugacagcugucagcuaagcaaggccacauguuggacaguaagagggacccagccugagggacaggccaugcccaccagcagcugcccaccccugaggacagggaccagggucacugaccguacagggaggaauaaagaggccuccuucugccucugccagguaccgccgcuuccuccgcccucgcuaccguguggccuacaagacagugaccgacauggaguggaggugcugucaggguuaugggggcgaugacugugcugagagucccgcuccagcgcuggggccugcgucuuccacaccacggccccuggcccagccugcccgccccaaccucucuggcuccagugcaggcagcccccucaguggacuggggggagaaggugagugugggagcugcugcgaggguggcaaguuccaaauggugauccaaugcaaugggaaauguggggccaggcugcugggggagucccccgugcucuaugccagagagaagagaggggcagaaggguuagugagaucgcagagauucccugcccguguguguguguguguguguguguguguguguguguguguauuugugugucugugugagagagagggagagagcacgcaaaagauggagagacugagaaaaagaaggccaaaaaagagaaggugcucgcacacgccccauguggccaagauccuucaaacagcugcaggagaaaggggcauuccuuugagaagcuugguccguggggacagacaguugagacuacaaauccuagcaugcauugcaccugacuacagaucccagaccccuccguggccucuggagaccgcaggucccagcaugcagcaguuccuguggcuugccuucccuccugcgugcugcacaccggaugugcuguuucccugccccgagauagccuuacuauaauuaugcaaacaggaacuccuggccaacucucaccguccacagagccucuucuuuguccccgugguguugcagggaagugucacccagugguagcuacuguuguggcauccagagugccucccuacacucccauuucgccccucuugacagccccaugacagaagagugucauuauccuuucgcagaagaggaaagaguuuccaagaaguuaagaggcacucugggcagguggaaaggacauggaccugggggcuggauagauggucuggguuugaaacuuagcacugccauuuauuaaaccugugauccauggccaggcaccuaauaucucugguccaguuucccagccuauaugaugggaagaguucaugguaucuccccaggggaguuauugaagaacagagccaugguucauauuuggccuagaggcauucagugaauggaguuucuuuuuuuuucucuugccaaaaucacccaaaggagaggcagagccagccugggcaucugacccuugcuggagcuggggugagcaggggccuugagcucugggguccagccccucugccuucugccuuccccucuccucagguccuggggagucagagaaggugcagcagcuggaggaacaggugcagagccugaccaaggagcugcaaggccugcggggcguccugcaaggacugagcgggcgccuggcagaggaugugcagagggcuguggagacggccuucaacgggaggcagcagccagcugacgcggcugcccgcccuggggugcaugaaacccucaaugagauccagcaccagcugcagcuccuggacacccgcgucuccacccacgaccaggagcugggucaccucaacaaccaucauggcggcagcagcagcagugggggcagcagggccccagccccagccucagccccuccgggccccagugaggagcugcugcggcagcuggagcagcgguugcaggaguccugcuccgugugccuggccgggcuagauggcuuccgccggcagcagcaggaggacagggagcggcugcgagcgauggagaagcugcuggccucgguggaggagcggcaacggcaccucgcagggcuggcggugggccgcaggcccccucaggaaugcugcucuccagagcugggccggcgacuggcagagcuggagcgcaggcuggaugucguggccggcucagugacagugcugagugggcggcgaggcacagagcugggaggagccgcggggcagggaggccaccccccaggcuacaccagcuuggccucccgccugucucgccuggaggaccgcuucaacuccacccugggcccuucggaggagcaggaggagagcuggccuggggcuccuggggggcugagccacuggcugccugcugcccggggccgacuagagcaguugggggggcugcuggccaaugugagcggggagcugggggggcgguuggaucuguuggaggagcagguggcaggggccaugcaggcaugcgggcagcucugcucuggggccccuggggagcaggacucucaagucagcgagauccucagugccuuggagcgcagggugcuggacagugaggggcagcugcggcuggugggcuccggccugcacacgguggaagcagcgggggaggcccggcaggccacgcuggagggauuacaagagguugugggccggcuccaggaucguguggaugcccaggaugagacagcugcagaguucacacuacggcugaaucucacugcggcccggcuaggccaacuggaggggcugcugcaggcccauggggaugagggcuguggggccuguggcggaguccaagaggaacuaggccgccuucgggaugguguggagcgcugcuccugcccccuguugccuccucgggguccuggggcugguccagguguugggggcccaagccgugggccccuggacggcuucagcguguuugggggcagcucaggcucagcccugcaggcccugcaaggagagcucucugagguuauucucagcuucagcucccucaaugacucacugaaugagcuccagaccacuguggagggccagggcgcugaucuggcugaccugggggcaaccaaggaccguaucauuucugagauuaacaggcugcagcaggaggccacagagcaugcuacagagagugaagagcgcuuccgaggccuagaggagggacaagcacaggccggccagugccccagcuuagaggggcgauugggccgucuugagggugucugugaacgguuggacacuguggcugggggacugcagggccugcgcgagggccuuuccagacacguggcugggcucugggcugggcuccgggaaaccaacaccaccagccagaugcaggcagcccugcuggagaagcuggucgggggacaggcgggccugggcaggcggcugggugcccuuaacagcucccugcagcuccuggaggaccgucugcaccagcucagccugaaggaccucacuggugaggggacaaaaggcaugaggggaccccuuucaagccccuuauuuuucuucucccucccccagcccagcuuccaacucaucugcuuucuccuugcuuuucccaacaugaauugcagccccagccaguauuccagguguuauaguuugccugcaagagaugaugcaagguccuagcucccgcccucccucuggcugcucacuaggccuguggguggagagaggauguugcucugccagccagggauccagcauaugcagcaagggaccccauggcccccucagccugcaaagcuccaccuguuccauccaucuucucccuguucaugaagccaccacccaccuuccuuacccauuggaaacuccuuuuauggcccuccuucaacucaauuuugucacuguagggccugcaggagaggcugggcccccagggccuccugggcugcagggacccccaggcccugcuggaccuccaggaucaccaggcaaggacgggcaagagggccccaucgggccaccagguaugugcacugagacccuugcugcagucaggguugccacugcccccuccaacccugacccccgcuggcagccccaggcuugacauuccacucugaacuugacaaggggaauuggguacuaccugaccgauaagggaaaaucagaggaaagugaggaggaacugugauagucacuguguuugguuaauggguauuaggaggcuaauggauaauguuggccccacugcaguacuggagacuaaagcugagucuauuauagcugucuggggugugaaaggcugggauggcccagcaguugaacagaauggacccuaccuauuccuguuuuucuugauaccccaauuccugcuuugaaguccacguagcaccgagcacaacaggagagccucagcagauguuugcugagugacuuagugagagcugcuuuauuucucacugcucccuuuccucuucucacagguccucaaggugaacagggugagugccuuucauuugauucuggagggagaagugacuagggguuggaggauagagguccucgggcagcccugggcuggggauccagcaggggaagggggcuggcacucugcccugagcauccccuuuaacauccacccuucccacucaggaguggagggggcaccagcagccccugugccccaaguggcauuuucagcugcucugaguuugccccggucugaaccaggcacgguccccuucgacagaguccugcucaaugauggaggcuauuaugauccagagacagguaguccugggaggggcuggguugaacgguuggagaaaugggugaggugugcagugauaucuucccauucuugccuuuuccgacagugugaaucuucauucucugauuuggggagaccccggcucuuucuucauuuauucauucucaggcaguggggagaagaaguagucauucauucauucagcagaucuuuacuggggccugcuccugcccaggcacuguuuuaagugcugggaaugcauagugaacaaagcccccaguucccugccgcucacauuccagugaggugaaaagacccagagggucccuccucaguccaggaguucuggugcgcuccccggagcuucccuggccccccugacugcuauccuuguccccaggcguguucacagcgccacuggcuggacgcuacuugcugagcgcggugcugacugggcaccggcacgagaaaguggaggccgugcugucccgcuccaaccagggcguggcccgcguagacuccgguggcuacgagccugagggccuggagaauaagccgguggccgagagccagcccagcccgggcacccugggcgucuucagccucauccugccgcugcaggccggggacacggucugcgucgaccuggucauggggcagcuggcgcacucggaggagccgcucaccaucuucagcggggcccugcucuauggggacccagagcuugaacacgcguagacuggggucccgcccgacgugucuacgucggcugaagagacagcgggggcggcgggcuccuggggucucgccugagacggggcaccuagcccugggcgagcgccgcacccgggcccgcagcggcaccgcgcccagagcggccucuccccacgcccggggcgcgccggcucagggaggcucggggccgcccaugcagacuuuuggccuggcgcgaucccccaagaaccccuccagggccggccugcggaggagccgauccucgcacccuccgcucccuccacuggcccuccaggucgauucccugggcuccaggcucccccgcgcgggcgccgcccaccgccauacuaaacgaucgaggaauaaagacacuugguuuuucuaaaaaaaacuaaac

SEQ ID NO: 14306 - RNA, 26416 nt, Homo sapiens
ggacagcucggcuguuuauuaagucaguagaaaaaugacuguacagguuuaaggugcaggaaugaagauggggcagacugggccccagcaucugaggccccacccccaugccagagagcuccaguccagagccugaaguguggucagcacaugugagcuaucuggauguccaggaauaucuaagugugcugcccccguaggaggcacuggaauuccuugcccagcagcugggccuaaagagaagaggcugaggaagccaggcccuagaaacggcccagcacgguggcuaacagagccaugcggauguacaugccguucucagccuggcggaaguaggcugcgcggggauccgaguccacuuccacgcugcaaaaaaaaaaaaaaaaaaaaaggaaguguuaucgugcagcccauggauggcuuguccaggacuaagucuccucccguccaccagccccgaggcagucucugacucugaugcugcaccaccuuaucucguugacacggggcaucgggugcaucaccaccaucuucuucuuggcccgggucaugauguggggagugaggaugaacugaccaaagcacugcaaagcagaugggguccccauuagugccuugggguaggaguggcuacagaggacacaagucugggcuccacugggguccccuccacacccacaugcagcuauggcaauugacagaugugaaguuuaacagcucugacccagcccucagcccagccuuucuguccucauaucugaugcccuacggcagcagcccuggcuucuuccucaagcccagcacucacagcuucguacuccuggguagagccaaaucguuccuucuggauucgagucauguagagcacaucagugucaggcagcgccuccucaaugcucucgaauuccuccuggagggugaggagagccaugguggaugcagcgcugggcucugacugcccaacccacaucuccauggcuuccaggcagggcugugagggucucaccugcuuggugccgcgggaggccacgaaggcccgcacaguggguggcaugcgcaggcugggaggugccacguagcgcaggcugacacgauacugggugagcaggcaggccagggaauguacugugcguccgugcuucaggucacccaccaucgugaucuaggagaggaauccagucaccacagggaucccagacugagugccccccgacaucauuuccaagcuuuuaaaagccucuggagcagaaugaaggccuccuugaugcagcuguccuguaccgggguaaccacuuccugccucccucucuagaucguccccuggcagggauccaaacccugccaccacccucaccgucaugccauugacaguucccagcuccucacggauggugaagauguccagcagggccuggguggggugcucuccgaccccauccccagcauugaucacuggccuccggcagugcuuggcggccagcuggaaaaaaggggaaaauccugucuuuugcagcucagaggccccccaacugccagucccccucuucugggguccccucacucaucuggcccaaaacacagaaaacgugggcagaaggguucucaugccccuggguccagccuucuuaaccccaucucaguacccaggcuggccucaccuccacugcuccaggcugggggugccggagcacgacgacgucggcauagcagcucauggucugcacggagucagccagggauucgcccuucuggacggacgauguggcuuccgagaagcugagcacagcaccucccagccgggccauggcugcugcaaaggagcugcugguccgugugcucacuucauagaacauggaggccaugaccuuccccuagggaaagagcaagauggaagguguacguaugcguguccacccuggggaaaccccagcuaggcaccaccaccccaacugacacuugaggggugcugugaggacccuucugcacccaaaccuccccugugaccugucagagccuugacguuuccaccacuggugucacucugagcuaaaggcucugccuccagaaaaccacccaucauuaagugucugaacgagcugggaaaggaggacacacccuagcucucucccaugauugcagcagcccagaccagaagaccccacuaguggggcgauggucucaugcucagggccuccccagccagcuaaauccugcuuuggggagggaaaacgugggggaagaucuacagcagcagagggauggacuagcauaaggggacgggauggcagggggaggaagacccacucugaccacugcgcggcccugcgcugaugcggcccaagggcaggcgauggccuggacccuacccccggcccugauccugaccuucaggaugucgaggcuccgcuccuucugcaccaucauacgcagugugugugccacauugaacaggugagacaucuaagaaagagcccaaguuagcuagaaagguccuagccccagcuuuccaaauccucaaagcucuggguggucccauccucccugccccaggcaccugauccuuggugaacugcuggacggacaggauauguuggcccacuaaugagugcagcaggggugaggucugggggugcagcaagccagggguccccagguucuggggagaugccugucucgguacuggugguggaggguagcaggugccaucagggguucccaucagcucugcagugagggauggggcagaaaaggcuggucagaggguuccuccuaccaaggccagaucagagguccccgaggugagugugugucaggguggagucucaccuggcucggcuaccuuccgagaggacuucuccuuuggcuccucagcugcaaacaggacaagaggacagauauacauuuauggcugagguuuggaaagaaaccccauauucccaggaacucugaaucacaguguauauguuaaaccaauucacaacacaguaauauagcagguuaggggagggcaggggacugcagcagcucuggggacagacagguggcuucccauggggcuguguuguaugggagcaguggugcccucccggggcucucccaguuggcaaaggcauccuaggcaagaggaacggccagacucacaccaaccaacaaccuggauuuaccccacgcucugcugccccgugggaucccagcuccugggcggaggaacacagcugcccacaacaaaaaagggcaugugagaagcugugagaugucuacucacaccggggagacuuguuuaggcaaaggauggcacggcagaucagacgaggauaaagggauggagaggaggacauguaaguagagaaaggcgaggcacugggaagaaguggauccugucccuacacagucucugagucacaggaaccccacucuuaccuggcaaaccugggucggaggcucgauggauucggggcggcagauggaagcggccaucaggaagcccugggaugccacggcggggucuuucaggugucuggagggauaacguuggcccagaguuguuuuuuuuuuuuucuuuugagacggagucucguucugucgcucaggcuggagugcaguggcgugaccuucuggguucaagcaauucuccugccucagccucccaaguagcugggauuacagaugugcaccaccacgccuggcuaauuuuuuuauuuuuaguagagaugggguuucaccauguuggcuaggcuggucuuaaacuccugaccucagaugauccgccugccuuggccucccaaagugcugggauuacaagugugagccaccacaucuggccuggcccagcauuuuaaaaaaauaauugacccaaccccacuucaaauucagucccucaagaaaaccccaauuguuccugaaccaccaaugaaaauguucaagcuguucauccugcccugagacuaacaccucccagcccccuagcccaguaguguggauaccguggucaucucacuaguggcaggggcugagggugggagcugaggaacagcccccuguggccacuuccguacauccuguccauagcccggggguaccagaaccugcaggcagaaggcagggcacucaggagggagcagagagaacucagguccuaaagggguagaugucagcaaggacaaaaagcaccuugggggagcugugcccccaaccccugguccagggcaguggugcacauagugggacaguguagaugugcugggaagggaagaaaugaacguggugcagaagagggcacuacugagaucaggcaggggcuacuugcguaccugcccaucgauauaggcaaccuccccucgcaggaccacacggcggacggugcccuucacuuucugcccuucaaaagguguccagugggccuuggagaagggcauguggcugggaauuguccacucaugcuccagauccaccugcccagaggacauggguuaugcuagggaaaggauccccagagaacauauccuagggcuggagagccccccuccugcucugggccucauccccacaccuccacauagguguccuccugcgggggcaggugaaagaugcgccgaggauuguggugcaaucgcugcagcaggucguccaggcugagccggcccucgcuuacagccgucaggaguaguggcagcauggucucuaacccugggaacccaggugggggccuggacccacacuucuccuccaagguauggggagcugggagaaagaaagccauuacccucaggaccaaucaccuccaugucuaggaagucacucacaccccaggacugcacuuccaacaaccuccuuaugcucacuaccacucccaaugcucauuuuuucugggaacuagaaacaagggcaacaggacugcugccaucuucuggagcccacacuuuuacccauguauucuuucacuugcaguucuacucacuggcucauucauucuuucaacaaguauuuaucaggcaccuaucacagaccagguacccuagaggcuagggucccauacggaucaagacccuguccuaguagaguccugaggccuggccugcuucccauuuucuugcuagggcugucccacaagccccacugggcagaggagguacaugcuggauucucucaccauggucugaggcaaagcagucgaugacagccauguucucccacagggcuuccacauccuggcgggagccaagcucaggccggaccucccccuucccaggccccaggcgcuccaggucaucauggcuuaggaacaggugguggggagccaccucgcaggucacuggcaagccccgugccuuugcagcuuuaauuagcaggaucuggggaacaaugggaagauccagaagaggcaccacccauaugccuugcccuacacaaagucccaauggccaacaucccugcucaaaaaaugaugauguagaccugcaagggugcuggcucgagacccuccuccugcugucuccagacucuccuccugcugucuccugccccuaaggacuacccugaccuuugguguuacugggaaagcaacagggacagcaggaucucagguguacucuuaccuccuccuuccgugccacgugacauaugugcacugagcgcugagugagcugagccaccaugaggacagcagccacgguuugcugcucugcgugagccacaauggggaggugggagggccaugucucgaaaugcugggagcagaaagaacugaugaaggagugugcagaaucucugacugugcucaucagagcccagaguccccaggagcuccccugaauccucacugcuaccagcccacuuaggcaggggcccacaagccaggagacacugggugguggccuccugccacaugcacacucccuaccuccauccacuggaccacgcuguccagccgcagcucagagaaggucucauugagguaaagcuucagcccggcugcagacccggccacggugcccaagguuccugcauuuucagacgaggccccaaggaauagcgcaaagucgcaccgggcgccagccucugccagcuggagaggauacacagagguaaggcucacuggcacccaugcccacacaggcuagccuggcaccaguggccugggcccauagggcggggcagaaggaaaagggcucagggaagcaaggguggcugguaggggcauaugggucuccaauaccaggaagagugcaguggcucaccuucugggccagggccagagcaggggcgucaaugauggggggccggguauuaggcauggcacacaccauggugauacccccagccagggcagcggcugugccugaagcaaaguccuccuuaugugucccaccugguucccgcaggugcacauggacaucaaucaauccugggagaaaauggaagcagcaagauuacaggaagauucagaaauaggaagggugagcuggacaugguggcucacgccuguaauccuagcacuuugggaggccgaggugggcagaucaccugagaucaggaguucgagaccaaccugaccaacauggugaaaccccgucucuacuaaaaacacaaaaauuagccuggugugguagcacacaccuguaaucccagcuacuugggaggcugaggcaggaaaaucgcuugaaccugggaggcggagguugcagugagccgauaucacacaccacugcacuccaaccugggcgauggaguaagacucugucucaaaaaaaaaaaaaaaaaaaaaauuccucagacaaggccacuguggacacuguggauuaaggaaugaaagagugagaaacauucuggggucuucacagucugugcaguccaggacaaagagugggccccccagccauccuucaccacacugcaggucucuaugccaggggcugccaguguucagaagccaaguucuccccaaagacuuacccggcagucgcacaagcuuuugggaggucauacagucaacaugcaccuucaaaggaggggcuggcccgaucuggccuagggccugcaaguggaaagcagucagcuuuaagggaagggugauccugggaguuguagggagagaugugguuuucccauaaaccaggcucugcacacucuauacccaccaucucucccucuguagccacaaagcuuuauuacuagcauggcuguuccauacucacuccucccucuuucuucuucccaucaacacuggcagucucccucccagcacaugggucucaguuaccuccacaaagaguuuggugcacuugauaucgaugauuaggggcacggagaagucagcggccaagcgucgggugcgguagcccuuggugacaaaggaagagagacgccggcccccagcuccacgcauugacagguuaaucaccagcucaaaguuuuucucagcuagcugcuccaggaugcuccgcuguggugggcacucaccauccacagccuccucaaagugccaguccacagcuguuaccugccaacccggagucaaggucagggccaagcugucuggcagcggucaggaaggcuagccuuaagggagaggagcuggcccaggagcccaugaugaggagacugaggacccauagggugggcacugagggcugccucuauuugauacuggcaaaguguauuucuuggcaggaaagauaucuacacuaaguaagauggguuaccaaggacuaggugcaguaugagcucacacacauguacacagagaaaauccuggaaggaaaaauaucagaacagugguacagagauuuuaagagacuuuucucuuugcuuccuguguauucugcuuucugcauggaauauagcuuacuaguauaaugguaauaauaaaagcaggggaauaggagauaauucuuuguuuuuuuuuuuuuugagacagcaucucacuguuucccaagcuggagugcaguggugcacucacugcacacucgcagcucacugcagccucuaccuccugggcucaagagauucuccugccuuagccuccugaguaucugggacuacagguauaugccaccgugcccagcccagauaauucuuuggugcaguauuuucacccccuuggggaagggcagcagugggguagguugccagaguuccugcaccuugacgccaugcucaguguagaagucagcugugccgagacuggcauagaggcuguagcccaggcucuccaguagccgcacaguugggagcagcucgcuuuuguucugaaaccaaacagaaggaugaaauuguuuucuuccugucuuccauuucaaggucagcccuggcccagggagccacggcccucgggaagcccuccuggauucugauaccuuauagcugccaauggucagcaggauauucuucuuggggaucuuaaagccagugcuuagcauggccuugagguaugccucacagcggcucuccccaaagccggccaccuccccaguacuggucauuuccacacccaacaccacgucagcacccgccaagcgggagaaggagaacugaggcaccuaaaggggcgggagggaagagagagggccaaggugugagaggaccuccucccucaccagcagagacggacacaguacccugugcuugaucccaucugaauggcagggucagccugcccucucugugugcccuccugcuuuccaaacguacuuggggucaucccucagcuucugcuuaggaugugcccuugcaaauaaaaaaccuuaaccauccuucaaaacucaauucaaauagcaccccuucgcucaagccuucccagaucaccccuuuuggaagcagcaccuccugucucuugaacuccugcagcauucuguuuacaggucgaauauguaguuuuaccacggacuguucuauaccaaagcuuuuuuggggauccaacuucucuucccucccauuaccauaaaguaagcucuuaagggacaaugaccaccucauuacccccacgauccggcaaugccuugcagucagugccugguuuacauacugacaacucuguguggugagugaacucucucccgcuauuuuucugcuaaccccaaggguuucgauauuccuuaccuuuacucccacgacuccagaaccagucauuagccccacagguuccacuucuucccccaugaugacccgcguggccaaggcuacuagguccacacccagugucuuggaaacgaaggggaaggagcgagagacacguacguugcauucaauaacuuucagcuggucauccuggggcagagaagacuggucaggccuucugcagguuggccuugcugacacuaucuauaggccuagacucuuccucuccguccucagcucugggggaucagacugagcaggguucagggucacugacugucauaagccccaacaccaugagcucuagcuacagcccuuucccuccagcuucccugccuacuuggaugaaggcaggagacagugcagggcuucauggcacuguggccagcacagaacaugcaagagcuguggcccuuuaguucuuuccuuuagccuuauuaccuuggcaaugagcugcagauugaaggguccugugaccuguagcuccuggcccacagcaugcacaauggcuuugauccgcuccaggguuuuggcagugauaucuugugggggggucaccagcgucgcaucaccugaaugcacaccugcauucuccacaugcucagagauggcgauggcugccaccacaccaucagaggccacggcauccacgucaaucuccuagcggggggacacagacagugggacauagggccacuuucuucucucacuuacucuaggauugucucuuccuuuaacgagccccacauagcccacuguucccagcccuggugccuaugauucugcuggaccagagaaggaagucuccuccagggcuggcagcaugcccucagagacuucacugucugcagccucccaccuuagccuccuggaugaacuuggagaugaccacgggaugcucuuuggagacggcugcugcgcugcucaggaagcgcuccaggucuccauccguguaggccacauucauagcagcaccgcucagcacauaggaggggcgcaccacacagggguaccccacggucuggcagaauuggcgagcagacuacaggaggcagggagcuuagcugaguuguucacacuuucccccaagcaucauccagccuccggguaacccaccaggucccagcccaccucgaggucacugagcucccuccacugaggcuggcugauaccaauggugucaaggagccgggaaaacuugaaacgguucucagccgagucaauggcuucaggggaggugcccagcacccggcacugcugccgaugcaacgccauggccauguuguugggcagcuguccacccauggauaggaucacaccuucaggguucucgagcucauagauguccaucaccaccuacguugcagggggagaaacaagugguggcagcaaaagagggcaggaaucugagccuuccugcucacugcuucccucagccgccaccaaguuucaaagaaucuuaggucagccagcuguucuacucgacccuggccacucaagcuaccaggaagccuccaucucccucaccucaaaagagaucucaucaaaguagagucgaucacacaugucauagucggugcugacugucucuggguuauaguucaccaugauggucuuauaucccaucugcaagagggaggggaaggguacuuagcagucaggugggaggaaaaucguggagaaaaucguggagaaacuaagccaaagccccuacuucagagacugccagcacagcuuccucugaaagagcuguacaggaccccugccuugggagggaaggagguacaaaguguuggggaagagauucauauaccguguggggcaugagagauggccuaaaaggacccccaccccaaagcucuaugaccaaaguaagggacggcaauuaauaggaaaugccaggauuagugccaagcaauugcuagagaugaacagaauagcaaggaaaguggaaagaaaaugaacucucugaccuuucggagcugcuggaugcagccuacagcacaccagucaaauucaacgcuagagccaauacgguagacgccagagccaaggacuaggacaugagguguucgaaaggugaggucauggguggugccccaauacguuagguauagguaauuugucugggcuggccacucagcugcaacugugucaaucuguuucacugcuggacagauccccaguuccugacgcagcuugcgaacagccagcucugugcuaaaauagaaaaagggucugaaacacaggcccagagaguaggguacagacugauagaggguugagaccccagggcacagaugagaggaaauauccuuggaaccaaggucagaagccucuaaagcucucccacacucuccuuccucccucccaagggucccucacugauacaaagguucugccccacauuucccagccggaagcucucauugccaccucugaccucagaacugcaagggcaaucuguuugucugagaagccaagacacuuggccuguugcagcaggucuggcggcaaaggcuguccacgguguuguucuagcagcugggcaugugcgaugauacgcuucauucggugcaggaaccagcggucgaugcgugugagcucauacaggcgguccacugaauaaccagcccacaaagcagcugccaccacaaaaauccgcuuaucuguuggagucuccaacuccugauagaaaggggguagacagacggaagcuacugccagcccaucuaaaagccugagcguaaguagcugcucuugucucaggaaggggaaacuguacaccagagcacaggcuguguaacugcaaaaaccuggauaccaauccugggucuaccucucauuggcuauguggcuuugaguaauuucuauaaccuaugucucaguuuccucaucuguaaaaacaagucuaguaauacacccuugcgugcuaaugagacaucucaaaauucucagcaaaguggaaacaaagcaaauguccaaugaugacugcugcuaguguuacugguaacaagcucauggucugggggcgaugagaagcagggucuauuuuagggguauugccaggggaggggagcuacuuaccauaucgcugacugguuucacugugugaucaaagcccacacaguucucauccaccaugcgcagggccuucuggaaggccuccucaaaugaacgcccaaugcccaugacuucaccuggaagaacagaauggaaggaaugaagguguggagguggaaggggugggaagaaggcacugcccauaaugcuuaugguuuauagucaagacucugggagauucucaaggcaagucacaugauggugggauucaugguguuucacaacuaagaaaucuuaauggccgggcgcaguggcucacgccuguaaucccagcacuuugggaggcugaggcggaaggaucacgaggucaggagaucgagaccauccuggcuaacauggugaaaccccgucucuacuaaaaauacaaaaaaauuagccgggagugguggcgggcgccuguagccccagcuacuccagaggcugaggcaggaaaauggcgugaacccgggagguggagcuugcagugagcagcgaucacaccauugcacuccagcccggggaacaaagcgagacuccgucucaaacaaaacaaaacaaacaaacaaacaaaaagaaaucuuaacuuauagcucuuuucccugcuauuuucauggauaagcucaggcuuugugcuuauugaugaauauggaaucaauaugccuaaaacgggcauggggauacuggaauauauccccauacacuggauacuggaaguuuaucacaguggcccaaaccacugauggcuguccaguuauuggguuugauuuauucacauaaucauaacaccaacuggaauucuuuaaaacuuuuuaaaaaaguguagauaauaggaagaugauccuuacuacucauccaugcagagcaaaucacauuuacaacaaucauuuuagaguuucucuuucuggacuuuucuucauagguucauagguuuuuuuuuuuuagauggacuuucgcucuuguugcccaggcuggaaugcaauggcacggucucgacucacugcaaccucugcuuccuggguucaagagauucuccugccucagccuccugaguagcugugauuacaggugcgugucaccaugucuggcuaauuagagacgggauuucaccauguuggccaagcuggucucaaacuccugaccccgugauccacccgccucggccucccaaagugcugggguuacaggcgugagccaccgugccgggcccuucauagguauguuuuacauaucaucacagcauacauauaauuuccauccuguguuuuuuccucaucauacauuuucccacauugccacauggccucaucaacaccaacuuaauucuuucuugagacggaguuucucucaucacccacgcuggacugcaauggcaugaucucagcucaguguaaccugugccuccuggguucaagugauucuccugccucagccucccaaguagcugggauuacaggcaccugccaccaugccuggguaauuuuuguauuuuuaguagagacgggguuucaccauguuggccaggcuggucucgaacucccaaccucaggugauccaccugccucggccucccaaagugcugggauuacaggcgugugccacugcgcccaaccaacuaacuuaauucuuguaugaucugccauaauuuaacuacuaacugaaggacauuuagcuuuuuuuuuuuuuuuuuuucugagacguagucucacuguguugcccaggcuggagucaguggugcaaucucagcucacugcaaccucugcuuccugaggucaagcgauucuccugccucagccuccugaguagcugggacuacaggugcgugccaccaugccuagcuaauuuuuguauauuuucuagagaugggguuucaccauauuggccaggcuagucucaaacuccugaccucaugauaugcccaccucacccucccaaugugcugggauuacaggcaugagccaccgcgcccggcccauuucgcuuuuaaguguuuacaauuaggcaguccugguggcucucaccuguaauccaacacuuuggaaggcugaggcagaaggaucaccuaaggcagauugagaccagccggcacaacauagugagaccucccucucuacaaauaauaauuaaaaaaaaaaauuagcaagguguggugguguacaccuguagucucacuccucagaaggauggggugggagauuacuuaagccuagaagauccaagcugcagugagcuaagucacaccauugcacuccacccugggugacagaauaaaacuccguauuaaaaaaaaaaguuuucauaauuauaaguuaggcugugauguuuucuuucuuuuuuaacgagacagggucggccgggcauggugacucaugccuguaaucccagcacuuugggaggccgaggcaggcggaucacgagguuaagagaucgagaccauccuaagcaguaugaugaaacccccgucucuacuaaaaauacaaaaauuagcugggcgugguugugcgcgccuguagucccagcuacucaggaggcugaggcaggugaaucgcuugaaccugggaggcagagguugcagugagccgagauagcaccacugcacuccagccuggcgacagaggaagacucugccucaaaaaaaaaaaaaaagaaaaaaaaaaaagaaaagaaaaaagagacagggucucggccaggcacaguggccuguaaucccagcacuuugggaggccaaagguggguggaucaccugagcacgggcguucaagaccagccugaccaacagggagaaacccugucucuauuaaaauacaaaauuagccaggcgugauggcacaugccuguaaucccaguuacucuggaggcugagacaggagaaucacuugaacccaggaggcagagauuguggugagccgagaucacaccauugcacuccagccugggcaacaagaaugaaaauccgucucaaacaaacaaacaaacaaaaaagacagggucuuagccuggcacccagacuggaaugcagugguacaaucacagcucacugcaaccuugaacucgugggcucaagcgauccucccaccugagcuuuccaaagugcugggauuaauuacaaccaccgugccuggacuggauaugauguuuucuguuuuggauaaucuccuuaggauaaauuuccagauauguagaggcaauagguaacacaaauuuuauagcccuugaugaguacgaauaacuuuauagaagucugugcuucauaauacaaaguuuaagcaaccuucuaagaagugggcauaaacagagucucauuuaacuagauuucuauuuacuaaugagaggaaccgucuuuucucuagguuugcuuauugauuucuucuucuguaaaguguuguucaucuccucugacuauuuacucuaggggcuuaaguauuucuuaccaaguguauuuuucuauuuacaauccuaacauuuacauuucuuuaaaaaaguuuuaaaaacacuacgauguuaacaguagugugacugauuuuguucaauuucuuuguaacugugguuguaagacuuuuuauuuugagauuuguuaaaaaaggagaagccuaauacaugcauacacauaugccuagaaauguaugcagucguagauacacggcugaauuaugcagucgcagauacacggucgaauuaaucaaucucuguaaggcaagauuacaggugacuacuguucuuugguuaaacuaucuuuccucguuuuccaugauucauguuucuuacuuguauaauaaaaguuacaaaaaguuaccaaagaagaccacauuccaagaauacuugaacagauguaaaacaauuaaaugucucaucuaggaaccaaucuuucauuggccuauuuucaauccacuucuuuuugccacaauuuaauuauggcuucauucccauguuuauucuaauuuucauauaacagagauucaucuccagaaggaaaaaauuggcagucuugcagaauuucuaaaaauucugaaauaauaucugagcuuagacuuacuuguuuaaaggccacuacugcucuaaauggaaaucuggagcaccacaaaaugcucuuauccaucaggcugguggcgcugugucugguacacguauauuuuuguuuugguugaaauguguuagaggacggucuucggcaacuaaagggauaccacaaagaaacauacuaacucaauucuaacaugcucugccacugcuggguaacguuacggccauucaucauucacuaauaaauuuccuuguuaccaaaaagguuuaugaugcccugcucugauguaaacaucauacuaaaaaaaaaggucauuuagugaccaaagcacaaagugccagaggaggagauacugcaaaaaugagaugagauagucugauggcuugcaccuaucccagagauucuguauuccaacacagauuuccagaugccuccccaacuccugacaaggacuauaaucuuaguuugaaaugucucaagcaccugcucccauaggacguaaaaggccaugccagggaacucuugacauuuaagauucuuggucaugguggggccccaugggggugcccagggcaugagucucaccaacgcucuucaugcagcucccaaucuuugugcugacucgcaggaacuugcuaaggucccaucgaggaaucuucaccacacaauaauccacgcuggguucaaaggcugcuguacccccugucacagaguuccugggguccagcaggugggaugccagaaggacagugaaggaagcauaaagggugagcuuccggauagcucuuuccauucccacaaauccaggccaauguccuuuucauauucccugucccaucaauauuuuccucagcccccgacccacuuccccacugugauaucucccucauccucguaccugagcucaggcaaagggaugcccaaugcuagcuuggcugccacauaagccaguggauaaccuguggccuuacuggccagggcagagcugcgagagagccuggcauucacuucaaugauguaauacugcaaagaaggagaauaaagucacuggccuagaagacccugucuaggagaggucucagaaaggagagaaaaguaaccuaguaaagaagauuccagcuuguacuccagggacuguaagcccaaaagaccucaaccucaagggccaaaaauuauacaagaagaggggguaacaacuagacuaucaguuccagggccuagagcuuaccugcucagacucaggguucaaggcauacugcacauugcacuccccaacaauucccaggugcugggucaccuugauagcugucugccucaggagcugauacucccugucauucagugucuggcuaggggccaccacuauggacucaccaguguggaugcccaguggguccaaguucuccauguuacacaccugugaaggggggugccauggaggucacugccaagcagagucaggagaggcagaaggcugcaccccaggguccuguuaccucuggggcugcaccuaaccugggucugagggacauacaacucucaaagaccuuggccugggccucugcucuuccaaaagcucauccugccugacacgacgcccacccuucccccauucacucaccgugacacaguugccauaggcgucucucaccaccucguacucaaucuccuuccaucccuucagagacuugucuacuagcacuuggcugguaugggcaaaagcuggggccacgagagcagagagcuccucccuguuagaggcaaagccagagcccaggccacccagggcaaaggcugcacgcacuagcacaggguaccccagccguucagcggcugccugggccugcaaugaguggaagagaugaacaaacagguuauuuccuacuguccaaggugugccugucccacauaaaaaaagauauaaagaaaauaacauggcugggcauaguggcucacgccuguaaccccagcaauuugggaggccgagggucggggggguggaucaccugaggucaggaguucgagaucagccugaccaacauggagaaaccccgucucuacuaaaaauacaaaauuagcugggcaugguggcgcaugccaguaaucccagcuacucaggaagcugaggcaggagagucgcuugaaucugggagguggagguuaugaugagccgagaucacgccacuguacuccagccugcgcaacaagagcgaaacuccgucucaaaaaaaaaaaaaaaaaaaagaaaauaacacuaccaaaaaaaacaccaccauucuuccuuuacccaaacaccccuccaaccuguucaagagaauuugcugccucgcucggggccacaugcucuccgaucucugccauucuggcagcaaaggcccgucgauccucggucagcucaauggucuccacuggugugcccaggacccggaccccauaccgagccagcaccccggccuuggucagcuccacaccacaguucagagcagucuggcccccaaaagucaguaacacaccaucggggcguucauuacguaucaccugaggauggagaggggaguuacaggcaucagaaccuuguggguagagaggcaaucaaaguuuaauaacccacagugaccacugggccccccugcccaguccucuuuucauuccagccuugccccagucauaccuggguuacauaaugagguguuaugggaagaaaauagaccuugucggccagccccugggaggucugcacuguggcaauauugggguugaucagcaacgucuggauguuuuccuccuucagggccuuaauugccuaaaaggacaagaauggcaucucagccucugcugaagaagcaaaauugcaaacagccuuagaguagcauucuccucuucuuucccucccuguacucuuggccccuaauaauugacuucuauuucuuacuacaucuuucucuacauuccccaaaucugguucauuuccucccugcaaccuuagcccuucuccuuaagacccuuuccauucuugagggucacacgcccagaaggguggggaggaacaugccucaccugagagcccgaguagucaaauucuccagcuuggccaauggagaggcccccugagcccaggaucagaaccuuucguggugguggaaguccagagccgggagugggaaucccagggggacagaggcgcucagucagccgcucucuaacuguggaagcaaagaaggucguagaauguuagagcugagcuggacccaagaggucaacuggauuagcucccucgcuuucagaagaguccagagcaaauuaugcaccucaggaggagcagagggaggaccagaacccaggacccuggaguuccuuucaacagaagcuuaaacgguaucuuggguugguugccacccauccccaauacccuuaaccuccuagacaucuaggaguugcccagggcauguccaccuuaugcccauccuggagccaacccuguucuuagguccacaacccaguucuacucaggaucuuaccugucuggcccccaggguucccagcuguggccucuuucacaguuuccagaaagauaucgaaaagcaguuccauaucugaagggccagcuuggugcucugggugaaacuggacacuauugaagagauugcaucaugaaaaccaucauggucccuggcaugacacuggcagccucgagguggguagugggacaggggacucggauccacugccgugcuuuacuuuuccaucaucaaggcccacagggcuucaaauuuucacagacccagucaaccaggcucaccugaagaaaggcaagcuguugugcacaaugccuucauuggaaccaucauuggcguuggugaagagaggagcccagucugcuggcagugagucugucuccacagcaaacccaugguucugggaugucagaaagcagcgcccagagcccaccaacaagcagggcugguuauggccucgguucccauaucuggagguagaagcaugccgagucacaggcccugcucacccucucuucacuacugaaccuaccccagcucucaccgaucuccuguucucaguagccucacuccuguuuccuuuuuguuuuuuuuuuuuuuuugagacggagucucccucuguuucccgggcuggagggcaauggcacgaucuccgcucacugcaaccuccaccucccagguucaagcgauucuccugccucagccucuggaguagcugggauuacaggcgcacgccaccauggcuggccaacuuuuguauuuuuaguagagacagaguuucaccauguuggccaggcuggucucgaacuccugaccuccagugauccgcccaccuuggccucccaaagugcugggauuacaggugggagccaccucaccugcaacccccccgcuccuauuucaacacgaauaaacaccaacucucuucucauuccugagacaccccaccccucaugccacaaguaugggccccuucugcuccccacaagucccaccucaucuuguaagucuuggccccaauggcuaaggccaauagcuggugucccaggcagaucccaaagacaggucggggauuaggcucagauaaaacacggcucaguguggauacgacacugggauaggaggcagggucaccaggcccauuacuuaagaagagacccucauacucuggagugggcagaaaagaugacaucaaaaucaguauuucaauuacaggagacacaccugcagcccccccagcccaugagaguguuaagucccaaugucuaucuucuucacugcaacuccuacugacuuuuagcaauuggaccaagggauagaucuuccacccaagcugcuugucugaggcccugaacaggccccagcuacucaccuuggcugucuagugcauggucccaggguaccacagugaccucagccccacgcuggcagaggcaucggaucugauuauacuugaggccacaguccaaagcaaggauccgaggggcacccccuguauugaauacccguggagucugagaaauagacgaauaaagggcaacaguuggcagcugugcucaguggguauaagauaugccugcaccaacuccuaccuucaaagccuccuuugauucucuccuguguucaccccccaauugugggcagaauauaacuacugugcuagagcuugcaacacucucccacucuaccucuguaccuuaauggagaccucugguaccagggggcgggcauugggguccaagaauggcagggaugaagguucuguuccauucuggaccagcuuccccagcagagaccccuguucccgcaacuucuuggucagcucccgagugucuacuccugucaaaauagcacagucuuagggaucacauuccuacaacucagucaucugugagguuagacuuccagaagcacuuccauuccagagccccagucacacacagcuguucuaugugcaucaaaauccugggccauugugacagaaguauacuaccaugaaguauuccugccaaaaauaucacaucugaauugaacaacucuaaaucuauccauuuauagaaaauaauauaaagggaaaaaaagaauacgcuaaguaacacuacaggaguguaaccaaguaagugcagacuaugggauacuagauacaggaaaaaugaccuguuuucaaauagguuacaagguccacagauuaagagacuuaucaaccaaaugcaaugugugaacccuguuuagagcaagauucaaaugaacagaaaaaaaaaaaaaaaaaaaaaaaaaaauugggaaauuuuaaacauugccuggacacuuguauuagggaauuauuaauuuuuuuaguguaugacguuauuaugaucauguuuuuuaaagauuccuuuugcauagauauugaacuauuuguagaugaaaugauaugaugucugagauuugcaucaaaauaauccagugguggugaugaaauaagauuagcccuaagcugaugauuauggaaggugggaguuccuuccuguguuggaaauuuucuuucugagugauaguucaauucuuucucccagcccaacuccaaucuaaaccuuccaacuaucacaaucuuagagucaggucccagcagauuacagaaaccuugauucuuuccauccaggcaugcugugcucugcccaaauaugccccugcuugccaccauaccuugcaagccagggaugccaugcugcugcagccacucaugcagggugcggguggcacuccaguggcugggaguaggacagcacucucccacuaccagugcugcuacguggaugcccgaggauucaaaccacuguagauggaaagagauugugagaagccucaggccaaguuauuucuuugcagcauuuucccgauuguguggccacagacccuauauucagccacauugaauggccuucaauauaccaaacuuuuggugcuuuugcauagguauuuccauuuaccaacaacgcucucuccuauacgaaacacaacccacaggcccagggugccccgaugaucacugaaaaugacauuuuccuuuuuauuuauuuauuauuuauuuuuuuugagacagagucucacucugucacccaggcugcaaugcaguggcgacaucuaagcucacugcaaccucugccucccggauucaagcaauucucuugcuuuagccucccgaguagcugggacuacaggcgcccgccaccacacccggcuaauuuuuuguauuuuuaguagagacgggguuucaccauguuagccaggauggucucagaucuccugaccuugugaucugcccaccucagccucccaaagugcugggauuacaggagugagccaucgcaccuagccauuccuuuuuuuuuuuuuugagacagggucuugcuguuauccaggcuggagugcagaguacaguggcacaaauacacgguucacuacagccucaaucuccugggcucaagugauucucccaccucagacuccugaguaguugggaccacagguguggaucaucacaccuggcuaauuuuuugaauuuuuuguagugacagcgucucaccauguugccaggcugcucucaaacuuccugggcucaagcgauccccccaccucagccuuccaaagugcugggauuacaagucaugagcuaccgcgccccgccucuuucuuccuuuaucuaaaacugaaaucacaaauccuuucucugugaagccccucccacucacccaauacagcuugugccuccaucuuagagcuguuuuaauacuuuauuuccucucuugcuauuuacgucauaugaugaauauguauuugugucuuugucacgaaacagagaacucaagagcaaggcacauggugucagucagacauuuauugaggugcaggcauugcaaaagaugcugagaaaagagcaaugagcaaaaaaagaugagguuccugucuucaugauguuuauuucugacuuagggagcuagaaaacaagguaacacccauauaaauauuaauuauagagugugauuaaaaacugaguaagauagggagguacaaaauaccccauuaccaaauaaaaaacaaagguucagggcacaauacuaagcaugccucccaaacuucauuugggauuauuuaaaaaagaaaaggccaggcgcgguggcucacgccuguaaucccagcgcuuugggaggccgaggugggcagaucaccugugaucgggaguucaaaaccagccugaccaacauggagaaacccugucucuacuaaaaauacaaaauuagcugggaaugguagcccaugccuguaaucccagcuacucgggaggcugaggugggagaauagcuugaacccgggaggcggagguugcagugagccaagguugcccauugcacuccaaccugagcaacaagaaagaaacucuaccucaaagcaaaauaaaaauaaaaaaaaauuaaauaaaaaaagauaacauacaagccugggcaaugugacaauacccggucucuacaaaaaauacaaaaaaaguagccaggcauggcggcaggugccuguagucccagcuacuugggggguugaggugggaggacuacuugagcucagguggcagaggcugcaagugagccaugauuaugccacugcacuccagccugggugacaaagugagaccuuguccccaaaaaaaaaacaaaaaccauaaacuuguuacucaauagauaagcguuuaauagcuacauagaaacagaaaguuuaugugggagggaucagcauauuuaaacugcauucagcugggugaugaacaguuuaaggaaccugcauucugagacuguccagggaucugaaggauaguuuggcagaacccucccuggccagguggaguaauccauuuauaugugcgaguggcuccaagaggccuuucccacccugauccuaaucaggccucaauuuuguaguuuuauaaacucaauuuagucagugugucuagaguugacaaaggugaugacugacaaagguuaaccaaauucacaagaauucacuaucaacuagaaugcaguguauuuguagguuugugaugaaccuagaaauucuuuuccaggaagaacaacauguacguccuuuauccggagcucacucuccccagcgucaggguggcugggaaggcaaauuaagaauuaaaggcuuacaccugcagugaggccaaacaaauuuugagagauacuacucuaggccagauugacuuccucuauuaccuuaauuacuauauguuggguuuuuuuuaaugcuugaacugucagagggcaacuuaguuuccaaauuucagaggugaaggaauaggggaaaccucacuguaggaagaaacucaguuuucucaccuagagguaagaacacaacugaaaagcagagaaucagacgaggccaugucaguaggucuagaagauaaugucacugguuuuguagguaaacuggcacucacugucacagagaaguaugugacccuaguuuccagucucuuuccacuaauuuauguaguccuaaaaagcacugcucccaucugacucugcugcuaaaaaaaaaccuucaauggauccuuuaccaaacuaagcugacucugcuuuggcuucaggucccuccaugcccaccggauuuaacuuaucugcaggcuuuuuucuccugacuucugcaugccuaacaaguuggacaaggcuguucccuuacaccucuuuuacuuuuccuugauccaugccuucacuacauacagaaugcuuucagcuauaccuggagccuugaugcccuuaacaaaggcgguagcuuuuuccugaggccuccaacacucugugccucccaaggcacuuaacaaccccuaacuacaguuacuagugaucuuaguccuugacuuuacuacuucaguggguauguuuucugcaggaugcccagcagggugucaacgucuccuacuucacuaauaguuaacaauuacugacuugaaaaggaauguagagaaagcacuggguguggcuaccuugcagagaccgaacucauccauuucaucuggggggaugccauaguugccgaucagaggauaggugagcacuaagaucugugccuuguaggagggaucggugagggccucgggguagccgaccaugccgguuugaaacacugcaagaaagaagcagggcugggcuccgguagggcacccuucggaacacuccccgcgcgaugagcacgccccaguggaggcugccuuggucgcgagggguuuauggcgcuggggcccaugggcaccgaaugggggaaggggguacgcuggcgggaaaauggcggggucuggacggggaagguugggaggagaggcgcaucacagagugggauaaggucugcagccuaaccgggcuugcuuacccacuuccccggcagucgacacggcggccccaaagggcuggccccgcaggaccgacccguccuccaacacuagggccgccaugggaagggagcucagaggcgggggcgaguacggagaagcgggaaggacugcaaacuccacuggaaccacgugaggacggcgcgccggagucgguccacguggcuaacggcgcggggcgcuggagagaagccgggcgcggcagcguaggagccucgggcgcgcuuggcggcagcagcagagacugcg

SEQ ID NO: 14307 - RNA, 7047 nt, Homo sapiens
auuggaugaaagcucuuuuauuuacugacauucuuuagccuuucuccuaguccagggagagaaguuugaggaauuaguaggcugugacccugagugggugggaaauacacggugugaggaggauacgaaacagcagcacaaagaggcaagagugggaaaagaguccagaaaguacaaucuuuuccagaucacauauuucaugccccuauuuuuaagaacaaauuauaugucaauuggccugcauaauaugugaaaaggauggaggcaagcuggcacugauguuugaacuucaguuaaccuacaggaccaaggcuaaugcaugcugugcugguagcugaaguccaaggauaaucuaaagauggaaugacuaccccuaagccucaaaugcacucgcaguuuuccugaguugacucauaguggcauggaaugaggcuggcaaugccaauggccgugggcaccagaagaugaaaccaacuccauacaggcguuauuggcuuaggaaugaggcugaugcuagggguucuugguacacagaguugcaacaagggagaauuaaugggugcagcagcuccagggacaggauccacccugcucaguuaucaggcucuugguggugauaucgcaaggggcucagggauccuaccagcuggcauugguuccaauaacaaggcagacacaggaaaaagacucuucaggaaaaaucugccaccacugccugagaccucauaaggggagggaggggagggcugcuuucugacggaguaaaauugggacugcaacugaaaggaagaguagcugggcaaccccauacagaguugugguaccaaggguagaggugauguccuuacugggaucaacgucaucagugcuucugaagagauucuugagauccuuauaagaagaggggucaaaucagggucaaugucaggacagggcuacuugcuccucucuucaauguguccaggggacugggcagcagaaggcacccucacugggucagcaccuaguggcggaagaagguggcgcuuuauuaaucagaaggaauaauuaccuagaacuuaaagcaaaccccuacauguaaggauauaaacacauaguccauacuauaaggauguaaacuuucuacuaaugacucaucugacguuagcuuacaugcuuuucuuaucugauaacuguugcugccuuucgguuuacauaccucauccuucuucaucucuuaaaaaucaucuucgcuauuuuccucgcuucuaaaaucacauuuggcuccuaugauggaauuauauauauguuuacauauacaaacguuuaguaacuuuucguaguguacugaugagaaaaccguuaccuugcaguuacucauuagcaucaccagguggcgcuggugucaaguucaaucagcuuauaaaaguucauuugggggggaaugaucucagacuuuccuuuucuuuucuuccucuuccucuuccccucccccuccuccuccuuuccuucuucuucuucuucuuuuuugauacagggucucacucugucacccaggcuggagugcaguggcaugaucacagcucacuguaaccucaaccucccagacucaaauaauccucccaccucagccuccccuguagcugagacuacaggugugcacugccaugaccggcugacuucuguauuuuuuuuuuuuuuuuuguagauacuggguuucaugauguugcugaggcuggucucaaacuccugagcucaagugaucugcccaccuuggcuccccaaagugcugggauuacaggcacaagccacugcaacuggcccuuuccuuugaguagauggaaaaaauugcaucccgccaggcacaguggcucaugccuauaaacccaacacuuugggaggccaaggcagguggaucacuugaggucaggaguuggagaccagacuggccaacauggcgaaacccugacucuacuaaaaauaaaaaauuagccagcuaauuuuuuaguaaucccagcuacucaggaggcugaggcaguagaaucgcuugaacccgggaggcagagguugcaaugagcugagaucgcaccacugcacuccauccagccugggugacagacugagacuacaucucaacaccaccaccaccaacaacaacaaaacaacaacaacaaaaauugcauccucaaaucugucuuaaccuaacuguccucucuagacauacucucccaccccauuccuuagcuuaacaggagcugacacuacuaccuucaaacugucaguuugucgugugaugcacagaaacauauugaucuuuuuuuuuucuucacuuugucccagugccagacuugaagacuugaaauugucauauuuagggauuaaccugccauuuucacaggucuuucucacccucaaccauuucuuucuuucuuuuuuuuuuuuuuuuuugagauggagucucacucuguugcccaagcuggagugcaguggcaugaucuuggcucacggaaacuuccgucucccggguucaagcaauucuccugccucagccuccuaaguagcugggguuacaggcgcccgccaccacaccuggcuaauuuuuguauuuuuaguagagacaggguuucaccauguuggucaggcuggucucaaacuccugaccucgugauccgcccgccucggccucccaaagugcugggauuacagguuugagccaccaugcccagccucuuucuuuucuuuucuuuuuuuuuuuuuuuuuuuuuuuuugagauggagucuugcucugucucccaggcuggagugcaguggcgcgaucucagcucacugcaaccucugccuuccggguucaagcgauucuucugccuccucagccucccaaguagcugggacuacaggugggugccaccaugcccagcuaauuuuuguauuuuuaguagagacaggguuuuaccauguuggccaggcuugucuccaacuccugaccucaagugauccacccgccucacccucccaaagugcugggauuacaggcaugagccauugugcccaaccccaaucauuucuuucauucccaauccagacauuucuuaccucacagucccugcuugcaguucucaccugaccuuggaggcugacucuggacauucugcugauauuuucucccacuauccugcucagguggugguuuaagugcuccacagcaaaaacagcagcaacaacagaaacagcaacaagugagcagaguacacaggaugacaagugucuaaaagguaggcgagaauggccucaguccagcaguuuucuauaugacugcucaagcuucccucccucaauccuccuggcacccagaaaaugagacaacagaagcauuugucauaaggaaaggaaggucacccuucuuuccuuauucuuaaaggaccuggagaauuguguaccuugaaccaacaacuauucagaauaaaauaguaucugacgccuucuucaccaaagugaucauacagauauauucccaaugagccaugcuggucguaaauuuuccgcuucuuagagucgcucaguauggcaugagcugcguugaucucuuugaauauuucugcugcuugagcauucccuggauucuugucgggaugauaccgcaaggccaguuuccuacccaggugauacucaaaaggaggguggggaagcaaugcggaauggcuggggaaggagacuuacgaugaaugacauggauuagucucuagagagugcagaaggaaugcaugagaugugguacaaaggauggaggcaagcauccaaggucuaaacuccuucccauacuauaaugaagagggugauggugccauuuggccccaaagugagggcuuguuggaacuuaaaaaugggucauagggcugggagcacuggcucacaccuguaaucccagcgcuuugggaggccaaggugggcggaucaugaggucaggaguuugagaccagcuuggccaacauggugaaacccugucucuaccaaaaauacaaaagauuagcugggcauaguggcaggcaccuguaaucccagcuacucgggaggcugaggcaggagaaucacuucaacccggaagguggagguugcagugagccgagacugcaccacugcacuacagcuugggcaacagagcgagacugucucaaaacaaacaaacaaacaaacaaacaaacaaacgggucguaggccaggcacagugguucacaccuguaaucccagcacuuugggaggccgaggcagguagaucaccugaggucaggaguuugagaccagccuggccaacauggcgaaacccugucucuacuaaaaauacaaaaauuagccaggcgugguggugcacgccuguagucccagcuucucaggaggcugaggugagagaauugcuugaaccugggaggcagagguugcaguaagccaagaucgugccacugcacucucaauagucucugucucugcucugugacaggacgagacuuccucucaaaaaaaaaaaaaaaaaaaaagagucagauagcaaaagagauacagaaagaaaaagguuuaagggggaaauuccaaggaucaauaaagggcugaggucugaaccuguaggauuuuuugaagucuucaggugaggcgcccuucuuaagauccagcacugcauagaggcucaucucacuuuuggacagccggugugcugcuuccuucacaguagacaugaucugagccagaggagaagcagcaucugugagaacuucuacaaguaaggguaccgagaagugcacuuccagugacaggaaacucacuaccuucagggauuaggcagguaaacgaugacagaaggacaaggauaagauaagagugagugggauuuguggcuagcaggagaauucaggugaucagaaagauuccaauuuuaaggaggaaacaucuucuccucacauuucccagcauccuccagcuacacagaccucuagauaucccacauccuagagguguuguaagcagggagaggucuaagccaggaaaagagccugauuuugucuagagcuccuauuaccuggaguaaacaccucugggucuguccaagcucacugcuggguuugaaagaccagggcggccccagccugaacggacaggaucaggaaucagacagcuccacaacuucuucuucuuuuuuuuuuuuuugacggaguuuuuugcucuuguugcccaggcugaaguguaauggcgcgaucucggcucacugcaaccuccaccuccugggugcaagcgauuuuccugccucagccucccgaguagcugagauuacaggugcacgccaccacgcccggcuaauuuucuguguuuuuaguagagacagaguuucaccauguuggucaggcuguucuugaacuccugaccucaggugauccacccaccucggccucccaaaguccugagauuacaggcgugagccauugagccucgccgauccacagcuauuaagagagaaacacuucagaccaaaccgugugaggccuaacagaagucaaguguccuagagccuggcgggggcgggggcgggggcgggggcggggguggggagugcuugcagcuaggccuggacuugcuucuucccuccagucuccugcucucaaaccaccccacuucugucccucagaggugggacaguggggagaggaggaagaggacucagaggcuggagaaggaagagaaaaggcguugcugugggaaagaccuggcaaggaaaaggcagcggaaccccagagagcaggguagacgccugcggcccaggagaaccgagcaaggcaaggagcucaaagggagagcucugagugugcagggcaccucuggcccugugccgacuccucaccugggucuggcccuuuaccugggagucguucucuuaagccaggugggugcccuucauccuuuugggugugaaacuucacaccggccggguccagcaguugacugcgcuugugcgcagcgucgacgcugagggucugggcaggucguuuuuuggcgcccccggaagcacuggguggggaggccacauuggcccugggacuuauuucgcgcgcagggaagcgagagcggagggcuuagcaggccugcggcccaaggcagcguaggagcguugcugccaggccuuggggcagggauucccaccgagccccucuuccccagcaggagggcaccacccaucuugauggcccaacucacuccaggaaacacaauggguuugcugaccguggcggaugagagguauggcugcugcaugcccuucuuaagagguguguuaccuucccaguugucuucaggacuuagggcucuccgcuuggucccuccuucucuuccacccggaaacaccuccacaaccuggaagacccaacucauaugccccuguuccugacacuccaucauucacucucccaguuguucccacuucgucugucaaagcauuucuccuaguauaucguaaugaugaguuugcacgucucauuaaaaugauguauugagccuuuuccaaaagucacuaccgugcuucaaaaacgucacuuaaauaugaugccaucaugagcaugucccauaauguaacccaacuuggcuguuucaguuguuucuauuugauaauauaauaaccuuauaaggaaaauucaacagaaauccuugaacaaaugucuaauuuuuuuuccuaaggauacauucuuagaaguggaauuauugggucgaaaugauuuuuuuuuucuuuuuucuuuucuuuuuuuuuuacgcucuugaucucuauugcuaacuuucuucuggaaagguagcagaaggaggauuuguauccccaccugcuggcaugggagcaugccucuaccuggcuucccuuccugugaguuucuacaggagguaguguuugcaucacuuauaauuuacuacuuuguagugcugguuuucuuugcaagagcacucaauggcuccuguaacauguaguagaaaaagcuuuguuacuuggaaaaugcuuaucuguuaaccuuuuuguagcuuuuaucacucucuuccuuuuauuac

SEQ ID NO: 14308 - RNA, 6670 nt, Homo sapiens
ugcugaauuggcaauggcaggcaauuuggccuuacccuuagcauaguaguccaugcugugaugggggaagcaggggcagugagagggaaccagagguaggcagcagucaggcugaguuuaaugauggggaacugggccagaccaaacacagaccucugcccauccccuuggccuuuggcccauggcuccaagaggccagaagcggcccagagggagauaugguuccuccccaaggcaggcagccauggucccuuagacuuugugcaaaauacuaaaugcuaauuuggcaucgagggccagcucugaaaagagaaggggcaauccucugugcagccagcccaggggacaaggaaagguaggauacgaggccccuggccaagagaaaagggguagguaggaaagaagaaggaaaagaccccuccgccccuagcaugggggacacaggcacagggcaaguuucuguaaauuccucugggguagagggcagacauccaagcaguggagauuacagauccucaucuccaaugcccucgaaggcgaaauugccguggacaucacuggcacuggcaucugugcugggacugccaauuccccgcaagcucacggcacucagcuuacucuguaacaaaggcaggguggggucagagaucuugggcgugcaagaucccccaacaaacagcaaccucaccaacgcuggaacucacugagaguuugaccauagacucccggguggcaucaggugacuccuggggaagaagaggcagaggugucagaaacucacuaggagaggugaggcagggcugagagccaggguucugaccaggagguaauacuuacaagcagugguggggacuucacugcuugcuggcugucugagcgucucagaguaccccccacccgccggcgcagcaucuggggacagacacaaggugccggugagggcaggaucacuuccccucccucucaagacaagccucacaucuaggacaaaaggcaaggggagcacaccugcucacugcucaguccacacuugcugccuaccuuccugauacugccgccagauuucuucaccaucaguucaucaaccauggacugcaagcagaugcucaucaugauagccugagggcaagaagaguguccagcuugaugagaguggucacucugagcccagcaccacuaaugccucccauauugaguacuggaaacucuacacuuuaaggugcuccagaggagggcugaggguagguucacaccugggggcuagugauggugacccacuguagccgguccuugcucaugagguauucaaaagccaguuccaggcgcaccucaccccggccccggccugggcugcucgugcuuccacugggcaaugguaccugggagaggaaggggaauucgguugaguucacucugaccaaccugucuggcucccugacccgcugcagcccauaccuaagcucaaggcuugccgggcccccaacccaggcccuucccccuccuaacccgacucacagaggaggugacccgccagcaucgcaugcgggugacccggaaggagccuucucggaguugcuggccaggcaggcggagcugcaggcugagcucacuguugcccgcgcucaccaccacaggacaguccuuuucugggaagucagccacacaggcaucaaagcgcaaguagccauagugccgcagcgucugggccagucucaggaacugaaaaauggucaucacauggggguagauuaggagggagaauggggcagcucagaaaaagcaaccccggucgggcgcgguggcucaugccuauaaucccagcacuuuaggaggcagaggcagacagaucacaaggucaggagcucaagaccauccuggcuaacauggugaaacccugucucucccaaaaauacaaaaaauuagccgggcgucguggcgggugccuguagucccagcuacucgggaggcugaggcgggagaauggcaugaaucugagaggcagagcuugcagugagccaagaucgcgccacugcaagcccuuagaggaagacagagaggaggcagggcucaccuccuucuuggagacuuucucuugcagagauuugaguugccggugcuguuccuuggugaccaagauccacccacgcucaauaucugauaccgucuauaguagagacaaggggcaggcaguaggaggucccagucagcaauccaaggaaagcgucuaccauuaccucuguccagccugaccccuagccccacacuugagcgaccucucugcaguaaguccuugaucuugucagcuuaauaaaaguagggagaguagauauugugccagcagcacugauaguauucuaggaacuuccccacaaauugggaacaaagacacgacagcaguuuucuugggagagugagucacccguuauuuucuucaggggaaggguucugaggcagcuccaagcucaccugagcauaaagcagguucaggccaacccgguucuccaugacaucgucaucauaggcagagucccaauaacugugaggccaagggguggaaagggguaauggggcuaagcuggguuaaggcaagagguagaauggaaaaugggcaaaacaggagcaaucuggaacuaucaggggcuaaugguauagugggaggaagcuugggaggccuggcagaaacacccagcacuacacccccuuguccagauuauucugucucaauauguggcccaauaauccaauccagcacagcaccucccaccccuccccuuccaggcccagcccugaccucuuccuuagcacaaucuuauacucuugacuccgaaggcuggugacagacacauaaggcagcucaaacucuugcaacuuccguacaacuacagguuaaaaaaaaaaaaaugaaaauauagugagauuuaaaggaagggaaaucaagaaagaagugcccugaggcaauguucauucuggggguggggguggggaguuaggggggcugcaaacucuacugaaguacccuuguacugcagucaaguccagagaaacucacaagaaaaggcuccauccucuuuuucucgaacuaagaauagacuaaaguauccaaucaagucaucuggaagauccagcuuugcagcuacagccuggggauagggauagaaguacagcucaucauacuggcugguuccaaucauucuccaagcccaggaccccaggauguaggggaagaaggggcagugcugaacaagcgccucaccuccaggacauccucagucugaucugaaguuagcacguugaccagaacuuucugcccguugcugagcagcacuuccaaggacacuuccucuguggggaccugcugugucuccuguugugagcacacauggggaugggaagcacugccuugucccuugccuugaccuaugcccaacucuauuucuaggucccuugugugucuuuauucucagcugcuuaaauauaggcugugauuucuuugauuucauaagaauagaaguuccauuccauuaaaaaagaugacuccucuguuauuaagaugacauggccuggcugggugugguggcucacacccguaaucccagcacuuugggaggccaaggcggguggaucaccugaggucaggaguucgagaccagccaggccaacacggcaaaaccccgucuccacuaaaaauacaaaaaugagccggacaugguggcaggcgccuguaauucuagcuacuugggaggcugaggcaggagaaucgcuugaauccgggaggcggagauugcagugagcugagaucgcaccacugcacuccagccugugcaaaagagcaagacucugucucaaaaaaauaaaagacaugaccuuccagcaagguccuuuccuuaaaucuuggucccacccaaagcccuaccuguugugcccgacgcaggaaacuguugaaagucucgcugcucccaagcaaugggucuugccgaacuacgaggacaagagaacauuauuacaggaacuuagcacucacucuuggcuccccaguccuccucucaguagguucccccgaccccauuuccugggcugaugguggccugccacaucccccagcuggccucaccucacucacuguuugcauaaauucuucaccugccccacccuuggcugccaucuaggugaguccagucuauagaacuagggaaauaacaaugauguuaaucuaaagcacaucagauacaaauuaaguucucuccacugauauuaagacuaguguuauacuaguauuucucauagauguuagugcccaaauuguuuugcuaguacacagaguuacacauccucguacacuauuuacuuugcuaacugcauaacagaucaaacaagagccuuccuagaucuagaaauuaaaucaggcccuuccacagaaccagcuguuuuuaagucucuccccauaguccucaauauagucaaccuaguuuccugcaaccacucaccagcuugcauguacuucucuaacugcucucuccucuguucuaccucagcaggagucagagagaaaagcuucuuuggggggaaugcaggaagcacauuggccccauacuccuuccgaagcuauuuagagaaagagauacaacccuucacauaaacacagaaaaugagaugaggcaaucuacauaugcucauaauguucucuugggugccccucccuucccucagucccuguuccccugucuacccuggucaucugagaaacaauuccuuugacagcgguagcaccucaagggagcuguccuagauauaaguugugcucuauuuuacuguguacaagucagccccuccacaguacggggaggauuuguacugggccaggaccuauagggagccccuugaccaccuagcaagacuguucacugaacccuuaaaggaaggaaagggcuuuauaaagugcacaguuaauagcuaagucuguucacaaaauaucuuaggacuuaaagggacuuugcagaucaaagaauccaucuuucaguuguagaaacugaggcccaaagaaaucaguuucuacaggccucaugccuguaaucucagcauuuugggaggcaagguggguggaucaccugaggucaggaguuugagaccagccuggccaacauagugaaaccccucucuacuaaaaauacaaaaauuagcuggguguggaggcagccgccuguaaucccagcuacucaggaggcugaggaaggagaaucgcuugaacccaggaggcagagguugcagugagccgagaucgugccacugcacuccagccugggcaacaagagagaaacuccgucccaaaaaaagauaucagguaacuuguucaggguugcacaacuaauuaucaguggagcucuacugaguuaaauagaguuuaagaucugguaaggaaggaggagaaacauugcaucacagauacauaacgauaauuggcacagcuaaacacacugaaaugagccgaagaacacaaaaggaaaucggugaaucguuuguauaagcagggaaaagaauuucaaguugccgcucagaugacagaaggaaugugcuuugacagccuggguggagguaguggggggagggguugguuuguccaugcagggguaaaggcuacuagagcaguaagacuggacagaaaaccagaauauaagaacaggaaggagcaguuguugcgcggacauuaagcuucuuagggaguucccggaaaugucagacaagauaaaccagggcccuacccuguggcagugauuaaaggggaacuacagccuacgggaacaagaagagcggguaaagggagacacugauguccacguguagggaagggcuugaagcugucucaaggcaggggugcuagucccaccugcucgugcagccccaggagcuggcuguagcgcacccgacagugcaggacuccauucacgugaauguuauaggccugaggacacaaaaguagucaagcauuuuaggguugcggucugcgcaaccccccugagaacccuggccggaaguugccuggcaacucgccggaguaacgcgcuaaucucccgagggauaguucgcuuguuuucgccagggccaagucccaaagcugaagagccaguccgggggaaauucggacgcuuguguugcagucucacugcccaagaggccagugacgcccaccagggcagcugcggccuagcucggggaagcgacccggccuaagggccuacaggagcucgggcgaccacugcacgaaucacacacaugagauaagcucccagagaggccgucgggagucggcggcccaggaccaggcccgaaggguggcggucaggccucagaggccgcuccgagauggcucgggcccguuauccccgccccugcccggcccggcucggcuccggccgcuccucaccacguaggcggagccgccgcuguccccgcugcgggacucgguuucgggaauggaaaagugcauguucccuacggcacggcacggccgggcuccggacugugagggccgcagcggcucugcacgcucccccuccgcugcucagcgaguccccgcagccucacucgccauuuugggagcccugcgauccgaugugggaaggcggugggacgucgguucugggacgcaaucgccugggcaugcugggaacuguag

SEQ ID NO: 14309 - RNA, 920 nt, Homo sapiens
caggccgccgggccgcgaccgccgcccccgcccccgcccccacccgccgggccccgccucucgcagccggaguuccaagcgaacgccagggccucccgacccgcgcccgcagaaucccggggcgccgccgccaagccagagacgccagggagggcuaagcagcgacugcggggccgaagcggccccucggcuccagcaggcagggcccgaucgggccugggcuacugagugagcagggccgccuucagcacccgacuggcgggucccaccgucccgggccucggaggccgauccuuccguccucucgcgaaccccucccucccgggcccucuuuucccugggcgcucaccucccgacuccgcgccccgcagccugcgcuucagcuccagcucggguuccggggccccggaucacagcgacucccucacagcugcgcuccgcagcgcaaccgaacugcgggccccgcccucgcggcgcccggaccaacgaugggcggugccgcaccgccggcagguuuccauugggugacguucugggugggcggggcccggcccucgggcguucgcuggggugggcuuccacccgcucuccuccccuugcgccgguccggccgagaccucucggaggggucgauguuuucggucccagcuggggcucgucucucuguccaccccaccgcccgguccaggugccccagaugguucugcuggacgcagagagggccuccuaccucuucuugaaggcgccaugacaguucuaaugccuggaaaagacaaaaggagcgaaagacauagccucaguccgagaggagcgcccccaccccagcccccgccugcauuauuuuggaacgagacuggugugcaggacgccaauucuccggaaagcuuuuaaaauuuaccuaacacugaaaauuaguaguu

SEQ ID NO: 14310 - RNA, 12002 nt, Homo sapiens
ugccuuuacaguagaagcagcaaagugugcuuaauggacugcuguccucugaugaccaagcaaaugcaacaaaugaaauaugcacaaggcuguccuuggacaguacuuguuugcuuugcucacaaaggagaaaaggaaagaaacaauugaaaauauguauauggugaaaguaugugaguccgagcagaaauaacaaaggcaaaaggaugaggagagauggaguaagucuagagaagaaaauaaauggaugagauagagagcugucuaagcaaaaaaggugucagaccucugaucuuauaaauaagacacuucaaaaguagcaaaaacaguuuuaagaaggugacuaauagauaagguguguuguguuuagcuauuuccuguuagguauuaguaauggguucccaaugaccugagccaaaaaugaaucaaguuaaaugaaaacugacaucugauaugagcauauauuauuagucuauucaagcacaguuuugaaguuagcaaacaucuaaauccucacaucucuacaagguaggucaaaguaugauucuucucaguuguacaagauaaauggcuguauaacaugucuagucauaguuaagacaacaauuggggacagugcuuuggucugauugccaugccagcaucauauuuuaucugugaaggguggcuugguuguggaaaacuauaaaaacuggaugcaaaaguaaaaugcaaccuuguuuggugacguccaguuccucuggaauuaggaaaaaccacuuguguuuaagaacaggagucaaaucaauuuuuaaggaaacagauucuaauacaaaaaccuuuucuguugggucuaguaggucuggacaaaacaucucccucuuuuccuuuuauauuuuccucauccucuucuugcagcgcugguugaaaacaggggaggaccccaugaggcugucaguggagugggaaccauagcugcuaucugagucaucagggcucugaggaaucccagcuucacucaugccugacauaggcuccucgaagacaucacugcccagcacaccaugcccagagacauugccuucuucacuuucuugaggcuccauuuucacaugggccagauuccaaagaggagaagcauuuaccucugcaccuagaaacagaggaaagauggacauacaccaaguguauauguguagccaaguguagaacaaagaguaaauauaucacucagaaccaacuaauaugcuuugagcucaguuuucacucugauucuguacuuggcuggagaauaugguuguuacucucugcuucaaaaaguuaaccaucccaaaaaauuaccagcucugauuaucuucuuuuccauuucuucuaccuuucuuuccucuaccucacccacccccauuuccccuaaaccagggaagugaaacuaggcagguggaaagauccccugucucacagcccaaagacaugcacaaccacaggacuuguucaguuguuuaguuugccuguccuuccuuccuucuuuuauggggccaucuuguuuuccugccuuuuguuugggucucuggucaucucuugcauuaugaaaaguuaauggucacuacauaaugcuaacagcaguucucuaccuggucuucuuugaagagacauggucccgaaguccgcaacaauuucucuuuggcccucgcaucucucuauguauucuagcaaugcuguucucuuaugguuauucuuccauagugaaaggcucucugcccaacacuuuuaaaaguaugaccuaauuccauuuagaccacauuugaggauuugcuauuugagucauuugugcauugaugacaauuuauacuuguaaacaacugaguguccagacuaauuugcaaccuaacugacacguaaccagucaguuguccuggcuccuaagguaaucacagagucuggaaaaagaagccagcuaccucuaacugggaagcccuauuucuuuuuuuuugagacggagucuugcucuguugcccaggcuggagugcaguggugcaaucucggcucacugcaagcuccgccuccuggguucaugccauucuccugccucagccuccugaguagcugggacuacgggugcccaccaccacgcccagcauauuuuuuguauuuuuaguagagacaggauuucacuguguuagccaggauguucucgaucuccugaccucgugauucgcccgccucagccucccaaagugcugagauuacaggcgugagccacugcgcccagccggaagcccuauuucaaugucuuucaucuucaguuuguuagaauacucuagcagggaagccaaacucugagaacauccuugagcaauuaacacucccccaucuaucuggcagcugucuuauucaaugaaguacaagcaucaggaaggaccaauacagaauacuaaaaauaaaauacuaaaggaggaaggggauaucuucccaaccagcuggaucagcugaaucagccuugguaaucaacgugacaacacauugcaucuacaucuuaacuagggauuauuuuaaagaaugccuguaaagcugugcuaauccucucuucacuaauuagaaagagaagaaugcugggaucucuagauaggugaaacuguauucguuuuaggacuuuccauucugcccacugcugcuuuuguucuucuaccucuugagcuugauuccaaaaagcaaaaaguacugaaauuggcagaucucccagaaucaaagugaguaaguuuauuugucuuacuugaagccuguggugaagcuucaaccuccagguuagaugggaagcguucgcucugagccccaagcacucccauaggcagugacuggucuccagaagcaaggucagccuccagcuccucacugacaggaaaagugaugucgcucacagguuccuccuugaucuucacagguuuagcguccucuguggccuucucaggauugacaauccuuucauauucuucagagaguugcuuacuaaucuguuggcaagcaagagucaauuuuccaaggaaauguuaaaagcaaguuggauagucagcuugugacgucccauggaaaagccaacagaacaugaauaacagaauuuuaaaacauucacugccaaugggagggauuuguuuaaggugcugaguuugcauuuaugagugauagagauauguaaagaaaauugguuuggcagagaauguguaugucauuaauuaaaaguuacauaaagguaaaaaaauguguuagaacugggacaaaagauuacauuuuuuuggcuauaaaaauuaacaguaggcugggcacggucauucacaccugucaucccaguacuuugggaggccaaggugggaggacaacuugagccucggagucugagaccagcuugggcaguaucuagugagaccccaucucuaccaaaaaaaaaaaaaagcugggcauggugguucacaucuguggucucagcuacuuggaaggcugagguggaaggaucgcuuguagugagcugugauugugccacugcacuccagcccaggcaacccugucuaaaaaaagggaaaaaaaaguugacauauguauccuaggugaauaaucaauggugugggaaaucuggaucacuuagcaaagacuuuuuucuuggguguuaaaaauuccuaaucauauuuuagaccugcagaaacugaaacagugaacaaaugacuuaagagcacaagggcugaagagauuagauauuucugguuccaagcaaaaucaucaccccccaccaacccauccuccaggcaauaucauuuuacucuguuuuuuucauagcacuuaacauuauccaaaauuguauuuuuuuguguaugugcuuagagacagggucuugcuauguugcccaggcuggucuuaaacuucuggccucaaacaauccucccaccucagccucccaagcagcuauauuagauauauauauuacaauuccagucaaaccauuauauuagcugcuugagaggcugaggcaggaggauugucaguaggucuguguucucuuuuuuuuuuuuucagacagggucuugcucugucacccagguuggagugcaauggcacaaucauggcucacagcagccuuaacuuccuggucucaagugaccuucccaccucacacucccaaguagcugagaccacaggcaugagcuaccauguccagcuaauuuuuauuuuuuaauuuucuguagagauggggucucacuauauuguccaggcuggucuugaacuccuggccucaagcaauccucccaccucagcuucccaaguagcugggauuacaggcaugugccaucaugcccagcuccugaaauuguuuugauuguuauuuauugacuuguguuugucucccuucaaaaacaauguaaacucagguaacuuaguaacugcugaaucccacaaugcucgacucucaacaggcacucaauaaauacuuguugaauaaaaucagacuaacugcauucucucagauuccauauacuuguggauaguuucuuccagaggaaguaucagugaauguggccauucacugacuaaaggagacccaugguauuuggccaggaacaucgcuagggccaucauaaaaguauguuaaguucacucuguuccaagacucugugcucugcacucuagaccaaguguugugggauccugcugaacacuccgagauugcacagacaucugugcccacuuuucaacagggucgccucaccuguagcauguaacugugauaguccuugaugcggugcugccagaacuucuggagggagagcacacugccaauacccacuucauggaauaccugcuccaucacaucaggaaaaggagucugucccagccgggccucccgguccacagcaaaacgcagcaacuugguaaacuuaaggcaauacucaugugccacaucaguuagggucuccaggacacucucauuagcacagucaaagcccgcgugggccaggauuguggccacugccugguagaggagcugccgacaggagugccagcugaguucagucacagguuccccuuucccacugaaaguggagauacggugguguuauuaauguucuugcaaaggggugaccccuccugucuuccccaggaguuuuacaauuccagucaagccacuggccuagcuuuccagggaaauuccauccaaguuacauagcucaguuucauccugcugcuaucugggcaugucuuagcaacccauggucauaucuuugagcuccuccaaagacauaguuugaauaggcaauacaugucuauaauacacaauccaaaaggauaucuagugaaaagaaaguuuccuucuagcaacuguucaauuuugaucacuuuuaggauuaaguuuaacaguauagcccagacacugcucaaugaugcucuaauuauuuuaccauaaccuaguuuucauacaugcugggcaauauauuaauacaaacuuuuagaaauucacaguuccaauaaagagauucuucacaguucccaggaguuuaagauucuuagauucuuauaaaguuacaagggaccauuucaaaacagggaagucaacucaauuuuauaaaagcaauuuaaaacauauauagcuuacaaagcauuuucauccuauccuguguugugcaauggguagggucuguauuauuauuauuucuauuugccaggagaggaaacagguuuagaagggcugacuugccaaaauuuguuuacauauaauuaguaagugguaaagcuucugacuccagaaaccguauccugcauaauacaccauuuugccccuaaucacuacugcagaaaucuuaauuuuccaagaaaaaaauuaagaaagcuauuugaucuaaaaauaacuuaagaagcuuuuaauaauuuaccugucucuugaaauuuccuacuggcuucugccuaccccugacaaaggaauuuauuuuaccaauaaaaauaaaauagagcacagaaaaucauuuuuccuugguucguacuuggcaugugucaucacgcacuguacaaaagugccugagugguuauccacccacuaaacucugaccuguucaauagcaacuauugcaguuuacauaauaguuugacaauaagauaacuaauugccaaguaacuuuucauuuacuaucuucaucauuuccauggccagugucucugggccaaaagcuaaaggccucauaaguaccuaauaaacagagacaacuaaaccaauaucacuuuccuagaauaauaucuggaccucuuucaaaggaaaguaauuuuuuggugcccccauaacugaugcaaauuauuuuuguuauacaguuuccuaaauauguauaaaauaaaaccagguacaaacuuuugauggucauggcucuuacuauauaaauuugauacaaaacuaaaaaugaauaaacagcaucaauuuaauaugauagauaacauuauauuguugaaauuaaauugcccucaauaugugaauacaguauugaucaccacagagcaaguuuuuugaguugggcgugucuaugcuagcauaugcugugcauguaauaacacaguuaugccuccccuuuucauuauuccagugacuucagaaccuuugauuacaauggaccuugauauaaucuggccuucaccuggcccaacugcaaugcaaccccuguguauuuagucuauuucuguacuuuucucauuaguuugggaaccacuaaaauaguauuaccagcaacagguagauguaauaaauaacauauaauaucacuucuguaguauucuugccgaacauauuuaaucugaaucuaaucuugaggaaauaaucagcaaauccaguaauugggacauucuacaagcgaccugaacucauaaaagacucuaaagaggcauaacaaccagguacaaugcaugaaucuuuguuagauccuggauucgagggaaaagacauuuacaaaagauauuuuguaaauauacuuacaaaagauaauuggaagaaugugaauaugaacuuauuaaaugguacuuaauguucauuuacuuugguaaugguauuaugauuaugcaggaaaauuuccuuauucuuaggauaugcaugcugaggaauuuaggggugaaauauggugaugucugcaacuuacuuuaaaaugggggaaaaaaugugugcauauacaaguaugcauauauguauguuuguauauguguguauauauguguauacacacacauaugugagaaaguaaauguggcaaaauguuaaacauuagugagucauggugaagguauuuggauguuuguugacuauuacacauuucuguagguuuggcaaauuucaaaaugaaaauaaaaaaguaauuggcauuaaauacaacuugcacacugacaucuaguagcagcucuagguuauaaggcagucacguucagaggauguggagcagagcuucucaaacuuaaaugcacauacaaaucuccuggagaucuuguuauaaugcagauucugauucagcaggacugggugaggccugagauucugcauaucuaaaaaacugccaggugauguugaugcugcagaucuuggaccagauauugaguagcagggaucaauaacauuuuuauauuauuauuucuuuuuuuuuuuuuccagacagggucucacucagucacccaggcuggagugcaguggagugaucugcaaucucugccuccccuggguucaagugauucucgugccucagccucccgaguagcugggacuacagaugugcgccacuacaccugacuaauuuuuguauuuuuaguacagaugggguuucgccauguuggccagguugauuuugaacuccuggccucaagugauccacccaccguggcuucccaaagucuugggguuacaggcaugaaccacugugcucagcuuauauuauuauuucuugaacuauguuaucaaaaugaaaacacacaauuuaaagauucuuguguagacuugcggauuccuaaaaauaccagaauaaguccaugaaucccaauuugaagacaacgagcuaaacccauaauuuuuuuuuauauuaaauagaaagacuagauccuaagaacuaugaggccauggccuuuuuuacauaccaguguauuacccugcuccuaguaaagugcuuggcacauaguaagcacucaaaaaauuaaaaaauacagacccugaauucugaagacuggcauucaaaacuuagauaucccacuaauuaccuggagaaaccuuggccaagucaauuacucuuauccucaguuuccucgcaugaaaauggaaaugcuauuauaggcuuaacaggguuguugggaagaugacuugagaaaaguaagauacagcaaagccuugccuuaccgauaaaagucacucucugggucacugugccggaucuggaauggugcauugggauucuuacaaucuaaaggcaggaggucaucagggagaggaggugacccagggcacgagggaagagguucacucucuucaguuuuuacaccuucugucugcugcugauucugggccugagcuguggcaauaagguugcgaagacgucgguugugcugaaucaacugaaucguauggauggugagacuacauggcucugaggggauguccagcauaguggggggcuucggcuuguuggcugaggguuggugcaggggugggucauggacuuccaccagacggaacucccgugggagcaaaucgaaggaacuucuguuggucuggcuugaugauauugguaucucuccccaguaucucaacauuuuggaauaagaagagaagaggucucaggauaaauguagacaauaaccuaaaaguaauguguuuaaauccuggcaacuuuagauuauaggcuucuguagugaaaaauacgaggucuagccaguuauuuauguaaaaaguaggcuauuugugaccacuuagaaaaaugucagugucagcaaaacuguaggaccaaagguguucucccuaaauaaauuaagagaaauguaacuguuagaugcugguuauugucauacuaugacaauuccuacuacacugaaccacaggguagaauuugggucauuaguggaccaauagcuacaacagcaucuggagcucuaguaucccuauuucccaucucacucacuaacucauuaccagaacuaccaucacgcucaauccugaacaauaagcaaggcaugauaagguaucuugauacaucugugcuggaucaauaggagaaaaacuaguaggguuaaagauaauaagaagugguucuuacucugugugucuuaggcaugauccugguggaaaaauuuaugaaccauuaaucuaaauggcauuaugcuuucaacuuuugacauauagaacgugagagauuucugcugccuucuaacugguaucccuuccuccaaucucucuuuguaugucaucuauucucuacacugcugcuagacuuacucuuuuuaaaacuuaaaucaaauggcuucccauugccuauuggaaaaagucagaauuccuuggcuuaccauucaacaaaauucacaaucugguuucaacucaccuuugcagauucauuguccauaugucucuucaaguucaacaaacauuuaucaaaugccaggcauucugugucggucaaagacugauaaugugagauccuugcccugaagugaggaagagaaacagaagcagaauauuucaauaugaaacaugguaaguacuguucuagagguauauggaccugggguacuggaagcacaaaggaggagcuuccugggugaaaugacuaccuuuguucuaacaacauuauacuacucaguuucuugagaaugcuguacauuuccacaauugacacuuucagcugugaacucugccagaaaugcucugccaaccuugcacaucccuggcagacucauauucauuuuuaaguacagcauaaguccccaccguccgucacuucaccagugcaucucccuuucucuauucucacagugcuuugcaagucuaugucacagcaguuauccuuggauuuuaauuaguacuuaucgcaauagauuuuuucugcccgucuauuucuuauggcuguggucuuguuacagggccaggcacacagaaauaucuggcauuuguugaauguuuacuauaugccagacuucaccuuuuuuguuuguuucuuuuuugagacaggguuucacucuguagcccaggcuggagugcaguggugcagucaugguucacugcagccucaaccuccugggaccaagcaauccucccaccucagccucuggaguagcugggacuacaggcgcgcaccaucaaaccuggauuuuuucuuuuuuuuuuuuuuuuuuggcgagacagggucucgccauguugcccagccuccucuggaacuccugggcucaagcaauccucccgccucagccucccaaaauguugggauuacaggcaugagccaccggucuggcuggccuuuauuguuugauucaauucuuccaacaacccuaugaggcuaauaaucuuauccccauuuuucagagugagggcugaggccuagugucuugcccaaugucacaaauggcgaggucaaaaaucgacagucuccagagucugcucucuuaaccacuuaacuauucugccuuaauaauuucagaaaaaaaauaaaugaaugaacgaaauaacaaaaaagucgcccucuucccuuacuuuaccgaaaggagcacgaagaacaggcacggagcccaaggaaugcccaagucccuccagggguuuccucggucacgguccgccggcgcaggcgccaaucacaggguccugaggucgccugacguucagggcagccggaagacggggaggucuggaccugaaccgagacaaggagguaccacacuauucacugcugcgucgcagagcgggcugggcggcugucuggaccucgagaggccugaggcaaggaucgcgucagaccccgaaagcugguuuguugauuagugaucuaagaccgccggaagcgcuucuucucaaucaagcuaugcaacaggaagucauuacgaucccguuguaaccucuaaauauguccccguucugcacagcaucccgauaaccguuuuguuuuucucauauuaugaccuucucauguuagcaccacuucgcaacgcuccaggucgugaaggagcaacuucaccaucgccgccuacagacgccacugggagcuugggagagugggacguggacaggaacguaaagaccgaaggguggguuucgaaggagcggauuucgaaguugcaccgguugaggauggcugacauucucucucagucagagacccuggcgucgcaagaccucaguggggacuucaagaagccagcucugccgguguccccagcggcgcggaguaaggccccggccagcaguucuucaaacccugaggagguacagaaggaagggcccacugcguugcaggacuccaauucuggggagcccgacaucccuccuccucagccggacugcggugauuuuaggagucuacaggaggagcagucgcgccccccgacagcgguuucuuccccuggcgguccagcccgggcuccccccuaccaagagccuccaugggguggcccugccacagcccccuacagcuuagagacccugaagggcggcacuauccuuggcacccguagcuugaaagggacgaguuacugccuuuucgggaggcugucuggcugcgacgugugccuggagcacccuucggugucucgguaccacgcagugcugcagcacagggcguccggcccugacggagaaugcgacagcaacgggccgggcuucuaccucuacgaucugggaagcacccauggcacuuuucucaacaaaacucgcaucccaccucgcaccuacugucgaguccacguugggcauguuguucgcuuuggaggcagcacccggcucuuuauccugcagguagguagaaaaaccuagaauugaaauuucggguucauug

SEQ ID NO: 14311 - RNA, 12002 nt, Homo sapiens
caaugaacccgaaauuucaauucuagguuuuucuaccuaccugcaggauaaagagccgggugcugccuccaaagcgaacaacaugcccaacguggacucgacaguaggugcgaggugggaugcgaguuuuguugagaaaagugccaugggugcuucccagaucguagagguagaagcccggcccguugcugucgcauucuccgucagggccggacgcccugugcugcagcacugcgugguaccgagacaccgaagggugcuccaggcacacgucgcagccagacagccucccgaaaaggcaguaacucgucccuuucaagcuacgggugccaaggauagugccgcccuucagggucucuaagcuguagggggcuguggcagggccaccccauggaggcucuugguaggggggagcccgggcuggaccgccaggggaagaaaccgcugucggggggcgcgacugcuccuccuguagacuccuaaaaucaccgcaguccggcugaggaggagggaugucgggcuccccagaauuggaguccugcaacgcagugggcccuuccuucuguaccuccucaggguuugaagaacugcuggccggggccuuacuccgcgccgcuggggacaccggcagagcuggcuucuugaaguccccacugaggucuugcgacgccagggucucugacugagagagaaugucagccauccucaaccggugcaacuucgaaauccgcuccuucgaaacccacccuucggucuuuacguuccuguccacgucccacucucccaagcucccaguggcgucuguaggcggcgauggugaaguugcuccuucacgaccuggagcguugcgaaguggugcuaacaugagaaggucauaauaugagaaaaacaaaacgguuaucgggaugcugugcagaacggggacauauuuagagguuacaacgggaucguaaugacuuccuguugcauagcuugauugagaagaagcgcuuccggcggucuuagaucacuaaucaacaaaccagcuuucggggucugacgcgauccuugccucaggccucucgagguccagacagccgcccagcccgcucugcgacgcagcagugaauagugugguaccuccuugucucgguucagguccagaccuccccgucuuccggcugcccugaacgucaggcgaccucaggacccugugauuggcgccugcgccggcggaccgugaccgaggaaaccccuggagggacuugggcauuccuugggcuccgugccuguucuucgugcuccuuucgguaaaguaagggaagagggcgacuuuuuuguuauuucguucauucauuuauuuuuuuucugaaauuauuaaggcagaauaguuaagugguuaagagagcagacucuggagacugucgauuuuugaccucgccauuugugacauugggcaagacacuaggccucagcccucacucugaaaaauggggauaagauuauuagccucauaggguuguuggaagaauugaaucaaacaauaaaggccagccagaccgguggcucaugccuguaaucccaacauuuugggaggcugaggcgggaggauugcuugagcccaggaguuccagaggaggcugggcaacauggcgagacccugucucgccaaaaaaaaaaaaaaaaaagaaaaaauccagguuugauggugcgcgccuguagucccagcuacuccagaggcugaggugggaggauugcuuggucccaggagguugaggcugcagugaaccaugacugcaccacugcacuccagccugggcuacagagugaaacccugucucaaaaaagaaacaaacaaaaaaggugaagucuggcauauaguaaacauucaacaaaugccagauauuucugugugccuggcccuguaacaagaccacagccauaagaaauagacgggcagaaaaaaucuauugcgauaaguacuaauuaaaauccaaggauaacugcugugacauagacuugcaaagcacugugagaauagagaaagggagaugcacuggugaagugacggacgguggggacuuaugcuguacuuaaaaaugaauaugagucugccagggaugugcaagguuggcagagcauuucuggcagaguucacagcugaaagugucaauuguggaaauguacagcauucucaagaaacugaguaguauaauguuguuagaacaaagguagucauuucacccaggaagcuccuccuuugugcuuccaguaccccagguccauauaccucuagaacaguacuuaccauguuucauauugaaauauucugcuucuguuucucuuccucacuucagggcaaggaucucacauuaucagucuuugaccgacacagaaugccuggcauuugauaaauguuuguugaacuugaagagacauauggacaaugaaucugcaaaggugaguugaaaccagauugugaauuuuguugaaugguaagccaaggaauucugacuuuuuccaauaggcaaugggaagccauuugauuuaaguuuuaaaaagaguaagucuagcagcaguguagagaauagaugacauacaaagagagauuggaggaagggauaccaguuagaaggcagcagaaaucucucacguucuauaugucaaaaguugaaagcauaaugccauuuagauuaaugguucauaaauuuuuccaccaggaucaugccuaagacacacagaguaagaaccacuucuuauuaucuuuaacccuacuaguuuuucuccuauugauccagcacagauguaucaagauaccuuaucaugccuugcuuauuguucaggauugagcgugaugguaguucugguaaugaguuagugagugagaugggaaauagggauacuagagcuccagaugcuguuguagcuauugguccacuaaugacccaaauucuacccugugguucaguguaguaggaauugucauaguaugacaauaaccagcaucuaacaguuacauuucucuuaauuuauuuagggagaacaccuuugguccuacaguuuugcugacacugacauuuuucuaaguggucacaaauagccuacuuuuuacauaaauaacuggcuagaccucguauuuuucacuacagaagccuauaaucuaaaguugccaggauuuaaacacauuacuuuuagguuauugucuacauuuauccugagaccucuucucuucuuauuccaaaauguugagauacuggggagagauaccaauaucaucaagccagaccaacagaaguuccuucgauuugcucccacgggaguuccgucugguggaaguccaugacccaccccugcaccaacccucagccaacaagccgaagccccccacuaugcuggacauccccucagagccauguagucucaccauccauacgauucaguugauucagcacaaccgacgucuucgcaaccuuauugccacagcucaggcccagaaucagcagcagacagaagguguaaaaacugaagagagugaaccucuucccucgugcccugggucaccuccucucccugaugaccuccugccuuuagauuguaagaaucccaaugcaccauuccagauccggcacagugacccagagagugacuuuuaucgguaaggcaaggcuuugcuguaucuuacuuuucucaagucaucuucccaacaacccuguuaagccuauaauagcauuuccauuuucaugcgaggaaacugaggauaagaguaauugacuuggccaagguuucuccagguaauuagugggauaucuaaguuuugaaugccagucuucagaauucagggucuguauuuuuuaauuuuuugagugcuuacuaugugccaagcacuuuacuaggagcaggguaauacacugguauguaaaaaaggccauggccucauaguucuuaggaucuagucuuucuauuuaauauaaaaaaaaauuauggguuuagcucguugucuucaaauugggauucauggacuuauucugguauuuuuaggaauccgcaagucuacacaagaaucuuuaaauuguguguuuucauuuugauaacauaguucaagaaauaauaauauaagcugagcacagugguucaugccuguaaccccaagacuuugggaagccacgguggguggaucacuugaggccaggaguucaaaaucaaccuggccaacauggcgaaaccccaucuguacuaaaaauacaaaaauuagucagguguaguggcgcacaucuguagucccagcuacucgggaggcugaggcacgagaaucacuugaacccaggggaggcagagauugcagaucacuccacugcacuccagccugggugacugagugagacccugucuggaaaaaaaaaaaaagaaauaauaauauaaaaauguuauugaucccugcuacucaauaucugguccaagaucugcagcaucaacaucaccuggcaguuuuuuagauaugcagaaucucaggccucacccaguccugcugaaucagaaucugcauuauaacaagaucuccaggagauuuguaugugcauuuaaguuugagaagcucugcuccacauccucugaacgugacugccuuauaaccuagagcugcuacuagaugucagugugcaaguuguauuuaaugccaauuacuuuuuuauuuucauuuugaaauuugccaaaccuacagaaauguguaauagucaacaaacauccaaauaccuucaccaugacucacuaauguuuaacauuuugccacauuuacuuucucacauauguguguguauacacauauauacacacauauacaaacauacauauaugcauacuuguauaugcacacauuuuuucccccauuuuaaaguaaguugcagacaucaccauauuucaccccuaaauuccucagcaugcauauccuaagaauaaggaaauuuuccugcauaaucauaauaccauuaccaaaguaaaugaacauuaaguaccauuuaauaaguucauauucacauucuuccaauuaucuuuuguaaguauauuuacaaaauaucuuuuguaaaugucuuuucccucgaauccaggaucuaacaaagauucaugcauuguaccugguuguuaugccucuuuagagucuuuuaugaguucaggucgcuuguagaaugucccaauuacuggauuugcugauuauuuccucaagauuagauucagauuaaauauguucggcaagaauacuacagaagugauauuauauguuauuuauuacaucuaccuguugcugguaauacuauuuuagugguucccaaacuaaugagaaaaguacagaaauagacuaaauacacagggguugcauugcaguugggccaggugaaggccagauuauaucaagguccauuguaaucaaagguucugaagucacuggaauaaugaaaaggggaggcauaacuguguuauuacaugcacagcauaugcuagcauagacacgcccaacucaaaaaacuugcucuguggugaucaauacuguauucacauauugagggcaauuuaauuucaacaauauaauguuaucuaucauauuaaauugaugcuguuuauucauuuuuaguuuuguaucaaauuuauauaguaagagccaugaccaucaaaaguuuguaccugguuuuauuuuauacauauuuaggaaacuguauaacaaaaauaauuugcaucaguuaugggggcaccaaaaaauuacuuuccuuugaaagagguccagauauuauucuaggaaagugauauugguuuaguugucucuguuuauuagguacuuaugaggccuuuagcuuuuggcccagagacacuggccauggaaaugaugaagauaguaaaugaaaaguuacuuggcaauuaguuaucuuauugucaaacuauuauguaaacugcaauaguugcuauugaacaggucagaguuuaguggguggauaaccacucaggcacuuuuguacagugcgugaugacacaugccaaguacgaaccaaggaaaaaugauuuucugugcucuauuuuauuuuuauugguaaaauaaauuccuuugucagggguaggcagaagccaguaggaaauuucaagagacagguaaauuauuaaaagcuucuuaaguuauuuuuagaucaaauagcuuucuuaauuuuuuucuuggaaaauuaagauuucugcaguagugauuaggggcaaaaugguguauuaugcaggauacgguuucuggagucagaagcuuuaccacuuacuaauuauauguaaacaaauuuuggcaagucagcccuucuaaaccuguuuccucuccuggcaaauagaaauaauaauaauacagacccuacccauugcacaacacaggauaggaugaaaaugcuuuguaagcuauauauguuuuaaauugcuuuuauaaaauugaguugacuucccuguuuugaaauggucccuuguaacuuuauaagaaucuaagaaucuuaaacuccugggaacugugaagaaucucuuuauuggaacugugaauuucuaaaaguuuguauuaauauauugcccagcauguaugaaaacuagguuaugguaaaauaauuagagcaucauugagcagugucugggcuauacuguuaaacuuaauccuaaaagugaucaaaauugaacaguugcuagaaggaaacuuucuuuucacuagauauccuuuuggauuguguauuauagacauguauugccuauucaaacuaugucuuuggaggagcucaaagauaugaccauggguugcuaagacaugcccagauagcagcaggaugaaacugagcuauguaacuuggauggaauuucccuggaaagcuaggccaguggcuugacuggaauuguaaaacuccuggggaagacaggaggggucaccccuuugcaagaacauuaauaacaccaccguaucuccacuuucagugggaaaggggaaccugugacugaacucagcuggcacuccugucggcagcuccucuaccaggcaguggccacaauccuggcccacgcgggcuuugacugugcuaaugagaguguccuggagacccuaacugauguggcacaugaguauugccuuaaguuuaccaaguugcugcguuuugcuguggaccgggaggcccggcugggacagacuccuuuuccugaugugauggagcagguauuccaugaaguggguauuggcagugugcucucccuccagaaguucuggcagcaccgcaucaaggacuaucacaguuacaugcuacaggugaggcgacccuguugaaaagugggcacagaugucugugcaaucucggaguguucagcaggaucccacaacacuuggucuagagugcagagcacagagucuuggaacagagugaacuuaacauacuuuuaugauggcccuagcgauguuccuggccaaauaccaugggucuccuuuagucagugaauggccacauucacugauacuuccucuggaagaaacuauccacaaguauauggaaucugagagaaugcaguuagucugauuuuauucaacaaguauuuauugagugccuguugagagucgagcauugugggauucagcaguuacuaaguuaccugaguuuacauuguuuuugaagggagacaaacacaagucaauaaauaacaaucaaaacaauuucaggagcugggcaugauggcacaugccuguaaucccagcuacuugggaagcugaggugggaggauugcuugaggccaggaguucaagaccagccuggacaauauagugagaccccaucucuacagaaaauuaaaaaauaaaaauuagcuggacaugguagcucaugccuguggucucagcuacuugggagugugaggugggaaggucacuugagaccaggaaguuaaggcugcugugagccaugauugugccauugcacuccaaccugggugacagagcaagacccugucugaaaaaaaaaaaaagagaacacagaccuacugacaauccuccugccucagccucucaagcagcuaauauaaugguuugacuggaauuguaauauauauaucuaauauagcugcuugggaggcugaggugggaggauuguuugaggccagaaguuuaagaccagccugggcaacauagcaagacccugucucuaagcacauacacaaaaaaauacaauuuuggauaauguuaagugcuaugaaaaaaacagaguaaaaugauauugccuggaggauggguugguggggggugaugauuuugcuuggaaccagaaauaucuaaucucuucagcccuugugcucuuaagucauuuguucacuguuucaguuucugcaggucuaaaauaugauuaggaauuuuuaacacccaagaaaaaagucuuugcuaagugauccagauuucccacaccauugauuauucaccuaggauacauaugucaacuuuuuuuucccuuuuuuuagacaggguugccugggcuggagugcaguggcacaaucacagcucacuacaagcgauccuuccaccucagccuuccaaguagcugagaccacagaugugaaccaccaugcccagcuuuuuuuuuuuuuugguagagauggggucucacuagauacugcccaagcuggucucagacuccgaggcucaaguuguccucccaccuuggccucccaaaguacugggaugacaggugugaaugaccgugcccagccuacuguuaauuuuuauagccaaaaaaauguaaucuuuugucccaguucuaacacauuuuuuuaccuuuauguaacuuuuaauuaaugacauacacauucucugccaaaccaauuuucuuuacauaucucuaucacucauaaaugcaaacucagcaccuuaaacaaaucccucccauuggcagugaauguuuuaaaauucuguuauucauguucuguuggcuuuuccaugggacgucacaagcugacuauccaacuugcuuuuaacauuuccuuggaaaauugacucuugcuugccaacagauuaguaagcaacucucugaagaauaugaaaggauugucaauccugagaaggccacagaggacgcuaaaccugugaagaucaaggaggaaccugugagcgacaucacuuuuccugucagugaggagcuggaggcugaccuugcuucuggagaccagucacugccuaugggagugcuuggggcucagagcgaacgcuucccaucuaaccuggagguugaagcuucaccacaggcuucaaguaagacaaauaaacuuacucacuuugauucugggagaucugccaauuucaguacuuuuugcuuuuuggaaucaagcucaagagguagaagaacaaaagcagcagugggcagaauggaaaguccuaaaacgaauacaguuucaccuaucuagagaucccagcauucuucucuuucuaauuagugaagagaggauuagcacagcuuuacaggcauucuuuaaaauaaucccuaguuaagauguagaugcaauguguugucacguugauuaccaaggcugauucagcugauccagcugguugggaagauauccccuuccuccuuuaguauuuuauuuuuaguauucuguauugguccuuccugaugcuuguacuucauugaauaagacagcugccagauagaugggggaguguuaauugcucaaggauguucucagaguuuggcuucccugcuagaguauucuaacaaacugaagaugaaagacauugaaauagggcuuccggcugggcgcaguggcucacgccuguaaucucagcacuuugggaggcugaggcgggcgaaucacgaggucaggagaucgagaacauccuggcuaacacagugaaauccugucucuacuaaaaauacaaaaaauaugcugggcgugguggugggcacccguagucccagcuacucaggaggcugaggcaggagaauggcaugaacccaggaggcggagcuugcagugagccgagauugcaccacugcacuccagccugggcaacagagcaagacuccgucucaaaaaaaaagaaauagggcuucccaguuagagguagcuggcuucuuuuuccagacucugugauuaccuuaggagccaggacaacugacugguuacgugucaguuagguugcaaauuagucuggacacucaguuguuuacaaguauaaauugucaucaaugcacaaaugacucaaauagcaaauccucaaauguggucuaaauggaauuaggucauacuuuuaaaaguguugggcagagagccuuucacuauggaagaauaaccauaagagaacagcauugcuagaauacauagagagaugcgagggccaaagagaaauuguugcggacuucgggaccaugucucuucaaagaagaccagguagagaacugcuguuagcauuauguagugaccauuaacuuuucauaaugcaagagaugaccagagacccaaacaaaaggcaggaaaacaagauggccccauaaaagaaggaaggaaggacaggcaaacuaaacaacugaacaaguccugugguugugcaugucuuugggcugugagacaggggaucuuuccaccugccuaguuucacuucccugguuuaggggaaaugggggugggugagguagaggaaagaaagguagaagaaauggaaaagaagauaaucagagcugguaauuuuuugggaugguuaacuuuuugaagcagagaguaacaaccauauucuccagccaaguacagaaucagagugaaaacugagcucaaagcauauuaguugguucugagugauauauuuacucuuuguucuacacuuggcuacacauauacacuugguguauguccaucuuuccucuguuucuaggugcagagguaaaugcuucuccucuuuggaaucuggcccaugugaaaauggagccucaagaaagugaagaaggcaaugucucugggcauggugugcugggcagugaugucuucgaggagccuaugucaggcaugagugaagcugggauuccucagagcccugaugacucagauagcagcuaugguucccacuccacugacagccucaugggguccuccccuguuuucaaccagcgcugcaagaagaggaugaggaaaauauaaaaggaaaagagggagauguuuuguccagaccuacuagacccaacagaaaagguuuuuguauuagaaucuguuuccuuaaaaauugauuugacuccuguucuuaaacacaagugguuuuuccuaauuccagaggaacuggacgucaccaaacaagguugcauuuuacuuuugcauccaguuuuuauaguuuuccacaaccaagccacccuucacagauaaaauaugaugcuggcauggcaaucagaccaaagcacuguccccaauuguugucuuaacuaugacuagacauguuauacagccauuuaucuuguacaacugagaagaaucauacuuugaccuaccuuguagagaugugaggauuuagauguuugcuaacuucaaaacugugcuugaauagacuaauaauauaugcucauaucagaugucaguuuucauuuaacuugauucauuuuuggcucaggucauugggaacccauuacuaauaccuaacaggaaauagcuaaacacaacacaccuuaucuauuagucaccuucuuaaaacuguuuuugcuacuuuugaagugucuuauuuauaagaucagaggucugacaccuuuuuugcuuagacagcucucuaucucauccauuuauuuucuucucuagacuuacuccaucucuccucauccuuuugccuuuguuauuucugcucggacucacauacuuucaccauauacauauuuucaauuguuucuuuccuuuucuccuuugugagcaaagcaaacaaguacuguccaaggacagccuugugcauauuucauuuguugcauuugcuuggucaucagaggacagcaguccauuaagcacacuuugcugcuucuacuguaaaggca

SEQ ID NO: 14312 - RNA, 2037 nt, Homo sapiens
ucauggaguccuccugccagcaccgcguggugaaguuccauuuugcagaggaggaaacugagaucaacuggcuuguucaaguucacgcaccuaggaagugguggagccagguuugacucaggccggcugguuccagagcccaugggccucaacucagccaacgagcccauucgccuugccagggcuugguuucgcugaagcggggcuccaggcuggaguuaguuuugugaaggggauuagcccugguggccgcuggcugcugacagcuggcaguuggagugggcgaggcugagggggccccugggccugggcagcuugggcaggagccggcgaggaaggggaggugccucagggggccgccugggugucggugcggguagaaaggcgggagagacaggcagaggcagccgucuggguuguacaaccugcagcccacgcacgccgagagccaccagcguggagucaggaugaggaguccuccucccaccuggugugggcuggagucccaggagcgggugcuggagugggauagcgggggaucagcucaucugaagcccugguugugggugagugcgugcacacggaugugcgugccugcgcaugugcguggcgagggaaugcgcccuuguggaaucuccccuagggcaaccuggcagugugaggcugacccuugccccaaaccuccuguccucgggcgugacaucaguccccagcugggcugugaaaugagucccagucgaauccuucccuacaccuacuugaacuuacgucccucauugacacuuucagagcugacccuggguaagcggcccucuuauucggcagaccucgccuuacucaaaugauuuuuggccuccccaggauuugcccugauacauugcuucggcugccugcaggggugggcucuccuaguucucugaagggucagaggaucgagaaggcgccgugugggaaccaccuggaacagggccuggacugucacgcauggugcuugagaagggagagggcagcugucaccuuuaacacccacccaccaccuuauuuccagauggcacccagcacccuucuacguacugcucuacuggcaccugcgcagacagccaaaagucaccgggagcugcagcguuccguuuuggagcaaaagcgagaucauggaguugaaagggacugauuuucacuuucuugccuggcuccuaggcucacucaaagggcacguuucaaagaggcucucuggaacgaggagccuucuguggagggaccugcuccaugggacuuuaagaaggggguggugggcuguuuugggggaagaugaguguaugccacacccuccacaagccauuuggcuggcucaucccaacguguugcagaggcggcuggcccggggcagggaggcucauucuggccaucccuggguugcuuguggggcuacuuuucuggccaugaugacccaugauuuauuaugaccccaagcacgaccucuuagacuugggaagugugguuccuccaaagggaucagagaauagugacagaguaaauccaagaacgcuguagaaggaagacacuucuuuaggccucuuagaguuaacugcuuccuauucaaccuggaauuaguucacggacccugcugucuuugguaauaccucgguaauuuuccuuaauaauuguaacaacuguuucaccuuguuuuccucaaauauuaggcuguuauuucaaccaaguguguuuuggacuuuaaccagagacuauggcacaaauucugaagucagguuuauuuauuuuuuauuuuuuaauuuuuuccagcugugggcuggcucuggcucagccaucugaaaauaaguuauuuauauauauguguguagccauauagauauacucauccacauauacgaagaccacuuccaagucuuuuuuaguuuguugcaugugaccccacagaauuccuuggacccagcugaccaggguuugacacccacuucgugugaucuggccagacccagcuacuccaagccccucuccucacagggaaaauggcaaaaa

SEQ ID NO: 14313 - RNA, 981 nt, Homo sapiens
ggcgagucggccacgggaaguuuauucuccggcuccuuuucuaaaaggaagaaacagaaguuucucccagcggacagcuuuucuuuccgccuuuuuggcccugucugaaaucggggguccccagggcuggcaggccaggcucgcugggcuccuaaucuuuuuuuuaauuuccaauuuuugauugggccguggguccccgcugagcuccggcugcgcgcgggggcgggagggcgcgcgcaggggagggaccgagagacgcgccgacuuuuuagagggagggaucggguggacaacuggucccgcggcgcucgcagagccggaaagaagugcuguaagggacgcucgggggacgcuguuccugaggugucgccgccucccuguccucgcccuccgcggugggggagaaacccaggagcgaagcccagagcccgcggcgcggccggcggacgaacgagcgcgcagcagccggugcgcggccgcggcgagggcgggggaagaaaaacacccuguuuccucuccggcccccaccgcggaucauguaccaggauuaucccgggaacuuugacaccucgucccggggcagcagcggcucuccugcgcacgccgaguccuacuccagcggcggcggcggccagcagguaggugcgggccccggugcaccuggcggcgcgggcggaccccugcccucuucucgccgccacugccucuuuugcuuucuuuucuuuuucuuggcgagaaaauaccuacgggccaccguuguaaguucuggauuuucguccuccccuucccccccacccccuuuuaaacuaggggauuggagagugggcuugaagagacaacaugcccuuuuccucucacguuauauuuuacccagauagacuccuggaauuguaggcccccuaccaggagccuguuaccuccuuccaagaacuacucccccuccccagugucugcccccccccccccaccccugccccgcgu

SEQ ID NO: 14314 - RNA, 2496 nt, Homo sapiens
ugcugucugcaccuucaccauuauguagucacugguggaaaucccacaaaacagcaaacucugacuuggaucugccuuaggcugucugcggaccugguuucagcgcuggugggacugcagccggaggucagcccagcagagacugcagcuggagagggcagugcaacaccaccaccggcagcugcugcuggaggggcuggcccgguggaagacgcaccaucugcagugugucaggaagagggugaggcugacgguggcaacucuccaaguucugccugccuggcaagggguguccaggccaggagaccauuucucaggaaggggucuuuccugacagcacuccaugcagccgguaugaguggugggugguuugggguccuguaagacaaagcugcaggagccuuucugggcguuugguggagccuagcgaguagccagccccagaauccagugucucccagggaagacggcucagcggaaaaacccgguucaugcugacccguggcuuaucagugcugggggaccuacagagugaguccucuaggcggcacucccugccuaugcaggagaccccuggcaccauccaggacuccuagcaaugggaggacauucagcugggcagaggcuggguuagaucaggacccaccccaggcugucuaggcugggucaggacgccacucucugugcacuugcucucccccagcuccugcacaggcagagcacccaacugcuggcacagagacucagccggaccugcuuccgccaguggagacaacaggugggaacccaggagauguccccucugcacuuccuucuccauccucuggccugugaggccugggcagugaaugaccuucagccuacaccucuaguucaguauuuuuacuaucacccuccccagggccaccuccucuaccaccuuccugucauuuccaggcacaucagcuuccuuccgucugcagucugcauaagaacaguuacuucaaggccaguuucucucucuacaguguuguauuaaaaaauacaucaguggaggccgggcgcaguggcucacgccuguaaucccagcacuuugggaggccgaggcaggcggaucaugaggucaggagaucgagaccauccuggcuaacacggugaaaccccgucucuacuaaaaauacaaaaaaaaucagccaggcgugguggugggcgccuguagucccagcuacucgggaggcugaggcaggagaauggcgugaaccugggaggcagagcuugcagugagcugagauagcaccacugcacuccagcccgggcaacagagcgagacucugucuaaaaaaaaaaaaaaaaaaaaauauauauauauauauauauauauauauaaucagugggccgggcaugauggcucacgccuauaaucccaggauuuugggaggccgaggcaggaggaucacuugagcccagaaguucaagaccagccugggcaacauagugagaccccaucucuacaaaaacaaaacagaaaaauuagcuggguguaggcagugcacaccuguggucccaacuacucgggaggcugaggcgggaggauugcuugagcccgggaggucaagguugcagugagcugugaucaugccacugcacuucagccuggaugagagugagauuccaucucaaaaagaaaaaucagcauaauaucuuaaaaauuaacaugaaauguguuuuaaggcuuugcugggaucuugcuuuuuaaaaagccaagagggaucacacagagcagcauccacacguccccagcucccucuucccguucuguuguccuguuuucaccauuccccggaccucaggccgcugccuccacgcaucccccugcaggagcccuuugccaccuucuuucaugaaggucauuccucaggccacagauggagcguguguugagcaucucaccgccaggcacaaggcuggcccuuccuaguggaggaagugggagccucgacuagagagggagccaagagggacgagcugggcagggccccgugaucaccacggccuccuugaaggggcuauagggaaaugaucuggucuuucuggcccuagcuggcagccaggaggcaggagcagcgggcgacagugcgggcccugugguucugggccuucucgcugcaggcaaagguaauuggggcucugcauccuaccaucccugccucucccucaggccuuagcccugccuuggguggagggagggcaccuggucugugggggagcucuaagcagggagaccugggccucaccuccugcccucccuggaggugugggccacguggcuggccuuuguacuggaaaggaggagaaagaaggcgcggcugcagugggcgcuccaggccuaccaggggcagcuccuccaggagggugccacgcggcuccugcgcuuugcagccagcaugaaggccucccggcagcagcugcaggcccagcagcagguccagguaggcccagggccccuuccugugggga

SEQ ID NO: 14315 - RNA, 2496 nt, Homo sapiens
uccccacaggaaggggcccugggccuaccuggaccugcugcugggccugcagcugcugccgggaggccuucaugcuggcugcaaagcgcaggagccgcguggcacccuccuggaggagcugccccugguaggccuggagcgcccacugcagccgcgccuucuuucuccuccuuuccaguacaaaggccagccacguggcccacaccuccagggagggcaggaggugaggcccaggucucccugcuuagagcucccccacagaccaggugcccucccuccacccaaggcagggcuaaggccugagggagaggcagggaugguaggaugcagagccccaauuaccuuugccugcagcgagaaggcccagaaccacagggcccgcacugucgcccgcugcuccugccuccuggcugccagcuagggccagaaagaccagaucauuucccuauagccccuucaaggaggccguggugaucacggggcccugcccagcucgucccucuuggcucccucucuagucgaggcucccacuuccuccacuaggaagggccagccuugugccuggcggugagaugcucaacacacgcuccaucuguggccugaggaaugaccuucaugaaagaagguggcaaagggcuccugcagggggaugcguggaggcagcggccugagguccggggaauggugaaaacaggacaacagaacgggaagagggagcuggggacguguggaugcugcucugugugaucccucuuggcuuuuuaaaaagcaagaucccagcaaagccuuaaaacacauuucauguuaauuuuuaagauauuaugcugauuuuucuuuuugagauggaaucucacucucauccaggcugaagugcaguggcaugaucacagcucacugcaaccuugaccucccgggcucaagcaauccucccgccucagccucccgaguaguugggaccacaggugugcacugccuacacccagcuaauuuuucuguuuuguuuuuguagagauggggucucacuauguugcccaggcuggucuugaacuucugggcucaagugauccuccugccucggccucccaaaauccugggauuauaggcgugagccaucaugcccggcccacugauuauauauauauauauauauauauauauauuuuuuuuuuuuuuuuuuuuuagacagagucucgcucuguugcccgggcuggagugcaguggugcuaucucagcucacugcaagcucugccucccagguucacgccauucuccugccucagccucccgaguagcugggacuacaggcgcccaccaccacgccuggcugauuuuuuuuguauuuuuaguagagacgggguuucaccguguuagccaggauggucucgaucuccugaccucaugauccgccugccucggccucccaaagugcugggauuacaggcgugagccacugcgcccggccuccacugauguauuuuuuaauacaacacuguagagagagaaacuggccuugaaguaacuguucuuaugcagacugcagacggaaggaagcugaugugccuggaaaugacaggaaggugguagaggagguggcccuggggagggugauaguaaaaauacugaacuagagguguaggcugaaggucauucacugcccaggccucacaggccagaggauggagaaggaagugcagaggggacaucuccuggguucccaccuguugucuccacuggcggaagcagguccggcugagucucugugccagcaguugggugcucugccugugcaggagcugggggagagcaagugcacagagaguggcguccugacccagccuagacagccugggguggguccugaucuaacccagccucugcccagcugaauguccucccauugcuaggaguccuggauggugccaggggucuccugcauaggcagggagugccgccuagaggacucacucuguaggucccccagcacugauaagccacgggucagcaugaaccggguuuuuccgcugagccgucuucccugggagacacuggauucuggggcuggcuacucgcuaggcuccaccaaacgcccagaaaggcuccugcagcuuugucuuacaggaccccaaaccacccaccacucauaccggcugcauggagugcugucaggaaagaccccuuccugagaaauggucuccuggccuggacaccccuugccaggcaggcagaacuuggagaguugccaccgucagccucacccucuuccugacacacugcagauggugcgucuuccaccgggccagccccuccagcagcagcugccgguggugguguugcacugcccucuccagcugcagucucugcugggcugaccuccggcugcagucccaccagcgcugaaaccagguccgcagacagccuaaggcagauccaagucagaguuugcuguuuugugggauuuccaccagugacuacauaauggugaaggugcagacagca

SEQ ID NO: 14316 - RNA, 313 nt, Homo sapiens
cccuuuuaccucguugcacuccugagagcaagaugggucaccagcagcuguacuggagccacgcgcgaaaauucggccaggguucucgcucuugucgcgucugcucaaaccggcacggucugauccggaaauauggccucaauaugcgccgccaguguuuccgucaguacgcgaaggaugucgguuucauuaaguuggacuaaaugaucuuccuucaaaggguuauccaaggcaucuacucaaugaaaaaccaugaucauucuuuguacauaaaauaaacauuugaaaaacccaaaaaaaaaaaaaaaaaaaa

SEQ ID NO: 14317 - RNA, 1469 nt, Homo sapiens
gugaaauuaagcuucagagggaagcccgagaaacacaggagagcgagcgcaagcccccaccauacaagcacaucaagguggcgugugggagcugcgugcacgcguguggagggagucuuccccgagggccgugagagguucuuaggcacacccaggcuauggcuggggagaggacugucaccagccaggaucuguggugccuggcauggauggccacacaagagaccaugagcaaauggcauggggggaucugcauggggguucuuggauccgccuuggagugugaggcuuggcuugguagcuuagagaaggguuggggugacaguccugaccgggcugcuuggagcaggaggagcugagggaugagccucccaccugcaccaggcuguugccaagugcugggagucagucacauacggccagggcucagugacugagccccaaacacguagauccuguaccucagagagcaagauggcggggcggcaggggagcuugccaguucuguguuuauuccagugagcucgagagccccagcaggaggaagugcagccagggcagggcucugugagagcuccaggccccucagggcugccugcgcucagagcuggugcggcaagccgcauccccaggagccucguggccguuccugacgaguguuugugauaagugugugccggaggucaggugcucugccuuugcuuguaaaaugugggcugcagucaauaucuuuguauguaaagaaagugcucuguauucaucuuuauauaauauuuucuuugggauggauucccagaaacagaaucacagggucagagaguaugaaauguuuagauucuuggggaauauucccagauuguucuccaaaauguacaguuugucauaccacagcagugaaaagagugucuuucgccaccucuucccuaagauuaugcauuucuaccccagcugauuuucagcugucucuacugcuuuguuauuugguugcuugucuuucacuaauaguaaaccacaaggucaugagagcagaggcuaugcccuccugccuagcacugcuccuccugggguggacucccauguggcuugcugcuggugcuugguaaaggaagagucagagagaugggucgggaagcugcucagaagagcucuuaccagcguuugcuggacacccugcaguguacuaagcaaucaacacgcuuuuucucucuucaucuuacaauggccuggcuggauacgugucagcucuuguucaucagcgaugugcacagacacuaagauaaaauaaugugagggggcguuguguugcccugccugccucuugugcuaagaaggcagaggagagcuccucugggaucuggggagggcuguucugaguaguguguccuagccaggacucugaagcuuucuaaaaggccaccuggaggcuggguaaggagaggcaguggugggugugcaaggguauucggaag

SEQ ID NO: 14318 - RNA, 3407 nt, Homo sapiens
cgccgcaccccacccaggccaggucagagcagcccaccaugggauggggaggggguggaggcugcaccccgcgcccacccauccaccagcagccgccggagcgccgcguggucaccguugucuuucucggccuccugcuggaccuccuggccuucacgcugcugcugccccugcugcccgggcuguuggagagccacggccgugcccacgugaguccuugcccugcggcccacagugcccccugccccccaggcccaucagaccuccccagcccuuaucgugauuccucauccccuaggacccccucuauggcuccuggcagggcgggguggacugguuugccaccgccaucgggaugccaguggagaagagguacaacaguguccuguucggagguauggcuggcucugugcccuuggcgggcucucuacgguccuauguuugguggacgugguccagcccaggccccuccccaauucucgguccuugccuucccacucccugggcuggcaugucuggugcccuugcccacauguccuggcuucugggcaugaucccuugccuccgcgugucacguucagauccuuccucaucucuccauuggggcccccucggcucaagggccauggccugugaguguagggcccagcaugacuggacccucaggacggggcuggacauuggccuugagggccccaagaccacagcucauggugccaggcagccccaugauggugacaucugucucucaggucucauuggcucggcauucucuguccugcaguuucugugugcgccacucacuggggccaccucugacugcuuggggaggcgcccggugaugcugcugugccugguauguuccugggccugggugcccauggggaagccuccucccacccagccaguagccccaugggguuagguggggagagggagguggcugugggccccucauggccacugguuggcccucaucgcauccuggaggggguucucgggggaccaguggcuccuguuccagagccaggcuuucaaggagcugcuccuggccccuaggaaggcacugagaacgcaaguggcccucagaugcuucgaaauagggcaggguugagggguguugucuggguugccaagcccuacucugagccacuccuggccuuaagcgaccgccccugccucuuggccccugccccugggcagauggguguggccaccucauaugcagucugggccaccucucggagcuuugcggccuuccuggccuccaggcugauugggggcaucagcaaagggaacgucagccucuccacggccaucguugcugaccugggcucgccucuggcccgcagucaaggcaugguaagugcacaggcugggccuuugggguccugguggugacuucugggccugggucucccugugcagcucggguggucuuuucccuaggcggucauugggguggccuucucacugggcuucacccugggcccuaugcucggagccucccugccccuggaaauggcacccugguuugcccugcucuucgcagccuccgaccugcuguucaucuucugcuuccugccagagacgcugccccuggagaaacggguagggcuguggucugggacccacaggccuaggggcuggaggcuugauuccauagcgauguaaagugccccugugugccagccccagaugccagggaggcugggccgcucucuugguguugggacccuugaggccacaguccguggguugccaggccagcagccgcuccugcaggcucuccaaugccauccccacaggcgcccucuaucgcccugggguuccgugaugcggcugaucugcucagcccccuggcccugcugcgcuucucggcugucgcucguggccaggacccacccucuggagacaguaaggacucgaccaacccaagcguggagccugcucuccccugggcuuccccgggcggcgcccuucccugcuguggucgccuucucagcacgcgccaccucuccccagggcucagcagccugcgccgccugggccuagucuacuuccucuaccucuuccuguucucgggccuggaguacacgcugagcuuccucacacaccagcgcuuccaguucaguagguggguccccaucuggcgacggccugcugucucccugaaauaacgccccugcuucagggaagcaacccccauccccaggaagccuuggcagccacucucgcccuggcccugcccuggguggcccugccccgggugcccugcacuaacacacccgcucccagccuacagcaggggaagauguuuuuccucaucggccucaccauggccaccauccagggugccuaugcccggcggauccacccuggcggggaaguugcugccgugaagcggguagggggcucccuccaaagcggguggcaggcaguccccugaguccugcagggcacgggcugugcugaggcugccgugcccaccugcaggcccuccugcugcuggugcccgccuuccuccucaucggcuggggacguucucugcccgugcugggccuggggcugcugcucuacuccuuuggugaguggcccugcccuggcaggggauccgaugggcagcaggggcugggugaugcacccuccccugggcugacgggcaccuccucgaugucucccaccagccgccgccguuguggugcccugccuguccuccguggucgcuggcuauggugagcccccuucccucggccgaagccaccugagcgggagaagggcaguggugccugacugugccucuucccacaggcucaccagggcagaagggcacggucauggguacacugcgcagccuaggugcucuggccagggccgcggggccccugguggccgcuucaggugagggcgcgggauggugcuggggcaggcugggggccaagcaccugcccucgccucccaagugccagcccccucggggacugggugacgccaccgucucuccgcaguguacuggcuggccggggcccaggccugcuucaccacgugguccgggcucuuuuugcuccccuucuuccuccugcagaagcugaguuacccggcacagacgcucaaggcugaguagcugagccacugugcccaggcugugggcaccaggcagagugggagccuaggucaggccccugcccacugccugacccccaccccccgccaguccagggagacccugugggugggggccggccccuaagcaggaagcucaggcagcuccuccagacuuacuuacuccuucagugacuccgagcugcagcacuccaaggcugucagggcuucuguuuguuuuuuaaacuaugcaccagguuucugaugaugaaauaaagcaccuguuuguuuuauaccaagugccu

SEQ ID NO: 14319 - RNA, 2682 nt, Homo sapiens
auuuggagaacgcuugugguuuauacagcgcuugcaccgccagacucuccugggugccccgcugggccccugagauggguuuucuggucccagcagacucaugaaugccggucucgggggaaaggggcuccagaacgucucugugaauugucucaacauucuugugaggcagguaugaucauccccauucuacagauuagaaaacugaggcucagacagcuggagggcuguguucaccgucuuugcccucgcugcuccacaucccgguggccaccccagacuccuccggcuuuucccgggagcuuuugccuggcauauuuugcucuccugacuuugagcacaccccaagacuuuccuucugcucauuaccagggcagcggagggucuggggugcaaggagagagagggacccuguaguggcugagacauggggggggacugcuccgaagcccagcagcccuuggagaaugugaccaaagccccagaccucuccccggaaauguccagggauacgugcuugucauacacaccuuuggcagccacccccagggacuccagguugagaagcucuggccugagcgagacccagacucccacccccggcuguuggcaagagguaaugacccuacuagugaugggcccucgaagccuccguccaccccugccuccgcucaccccggccaugaccccagccuggcucacagccagauguccauccagcagaagguaaaggggcaccugagcccaugggcaggcucucaugggaccaccggcaacaucucagccuuggagaugagagggcagccuuggcugggucagggagcggggcacaugaguguguuccgguccaguagagaugcuuucaagggcaaagcugugcggcaccguuguuaagagagaggcuuucgggaucaggaauacuugguuuugaacuucagcucugcuccuucccagccucccuccucagagcuucaguuuuucauuugugaaauggggauggggaaagcacccaccucaugggccucgcuagcaggcucugggucucuggcagccacggucacgcguguuccccagcguggaggugcaucucuuuccauacaugcuucuggcaguguugcacagcguugcacagcuuggcggccuccuggcuccugcaccagaagcuugggcccagggcacacuggucggugcccagcagugggguccuggggccguggcaggcccccaccuucuugcacacagccacgggguccaucauguccuugagacucucaaugagcacgggcucguacugggugacgaagugcuugcacuggaucauauagggcagcggcaggaugcugcagccacccuugaaggccaccaggaugucucgcuuggugcucuugcucuccaaguugugggaggacaccgugagcagccucuugcacccauugcagaagcugcccugguucuccgcgucccacucuggggacggcacgauggcauaggcaucauggacugcccgggcccgccuccgguugccacacagacggaugaacuugcacaccuucucuggggugauuuuggccacaagcugcaccaaggaggggcuguagguguccaccaagaugaugcacuccuucgugauagaggcaggcauuaccgagcacacgcgcuccagggcaugggugaucaugagcucagagcuguuggacaugagccagugguccagcuucugcaccacguucaugcacaccucacaggucacaccggccuucaucugcaucucgcucuguuuccuuggcaaccccagcuccagggaggggaccccguccauggccacuacuugagucaaacgggcaggugccccuagcuccucacagaauccccccuuccugcagagcuccugcggggggagaagccucagugcuuggucagcagggacaaaaaacuggaagagguaguucuugcagaggacggccaggccaggccccaaggacucacacugcuccuggauguucaagucggccaaggucaaguuggaccggacagccuccuggagucgggagaccugccguacacagucuuggcacagagcuccuucaggcgccuggcggggguggaagguaaggggcccauuggccaugaacggagccacagccucaaagguguccucuuuggagaguggccucaggguggccaggugccucugcagcggcucacagaggcugagcgcugugcacaccugugccggggcacuguccggggccccacggagcaugcucaggauggccgaacugugggcauccaccauccacuugcauccggcugaagacuccuggcuggggagccacucacaggucuucaucaccaaagccaggaugucagacuccguggcgucaggguucagcccauugccagcggcggcugcuauguccuggcauacgucgcagggcagagacuucgcgguggguuuguuccauacggccccuuggcaguaccccacagccccgcaccuggcagcugucugcagauccugacaccacaccguggagcccuuugcacacuccugggggccugagguggggcuggcccugguggcccccaggaggcugggcaggaggagcagggcacacagcaugcugcccagggacucucuggcuccagaguacccagcaguggcugcugcuauaaaccugg

SEQ ID NO: 14320 - RNA, 14116 nt, Homo sapiens
uacgccucaggccccgcccaccgggggguggggaaagaugcucuuccgugacccacaauuauuggugacuauugccuguccauaacaggaaaagcgauuacggauuggcugaggcgaaguaguagggcagaaaaguggguauagcugccugcacgcacgcuuggugcgugcgcggcgacugcgacgggcaguggcagucauggcggcucagugcgugagguuggcgcggcgcagucuuccugcuuuggcguugucucucagguaaggggcacuuggucucccuggguggagguggcagcgcgaccucccgcuccgaugggggccuuucccggccccggggccuccuucccggccucggccccggagcugggcaucuccgggcucgcgguuccccgccgcgggacgcggaccgccccgcuggggccugcucugcugccaggcugccagcucagggcuugggaagcguggagcgggcgggcgccgugucaggaggagaggaccgcagcgcggggggcguuuggcucggaagguacgguggcccacgugcgcgugugguccagggccugcggcgacgccucgcgcgcauucacggucucggcgcucacgggcgcagaggcagccgcaacuugugcgguugaagaagcgaccaaagaagcucgagcuuuguccaaggucacgcagcgaggccgagccgggccgggugugcccugggcaggagcugugguuacucauuuccgugccgcagcucgaggccggggccacagcggugcucgggaaacuucgugucgcaaggugcguguugcccguucacgggcuuuuuccacucgaccucgaauuccuucacuccgccuucuccagcgucugaggucaaaagagcagucgaaccugugcugcugcugggcgaagaguuuguuuagacaagggcacauuucgggccugagggccacgagacagugccccuuuuuuuuuuuccccucaaaucugccccuucugcuuuuugaaaguucuacuuuagaaguuaguauggcaaguacuugcuggaggaagugccuagaaccaaguuauugauuagagaagccacugagggccaaauuggccaaaagcugggcagugagauguaguucuuuccugaaggagagcaggcaggugaggugaagaucacuuucagucuaggugauuaagggguaagugcuagcuuaauaaauuauaucuuaacaacacaggagccaagagcaacgacccacguggaauacuugaguaaaaagacuuuggucaaguaauuggugguuuuguauuggaauuaauugccaggaaagugaccaccaagucagcaucauuucugucucuagaaugguaguuuuguggaaagaugcucaacuagggaaaggcaggagaacugacugguagucauagcucucagaguaacuaggcuuucugagacucaguuucccucugcagaacgagauggccccggguguggguccuguugcacauuccuggccacacuuuguguuggcugugcuucggaaaggggucugugaagagcugaccugcagaaaggcugguggcugucacacccccaggcagaacaacuggagaggaaggugggcuucacaacaguacacucaguuuuuauuuaaauucuuagcuuuuuaaauucacaagaguaaaaauauaaaauggucaucgcucuccacccccauggcaagacuguaauggaggcuuccacuccacuucuuuccacagaucuaagauauuaauaaguacacaggauuucuaguuugucuuuacaaaaauaggauccuguuuuguguauuucucuguaaguugcauuucuuaacagaacauccaaaguguauccaauaaauggcaguuuaacucauuuuuaggagcugcauaauauuccagauuguguuagcaaguuuauucaaccauuugcucgcugacaaacauuguuuccaacuugucgcucgcagugcugcaauaaacagccuugacugaguucugugugcuggcagccuucaccuuccuauucguugaagcaguuuuaaucugggaagaaaauugaauguagcuuauucucagauaggacuguggccuaauuuaaaaagagguccuggccgggugcgggcggaucacgaggucaggagauccuagaccauccuggcuaacacagugaaaccccgucucuacuaaaaaaauacaaaaaaauuagccgagcguguugguggacgccuauagucccagcuacucggcaggcugaggcaggagaauggcgugaacccgggcggcggagcuugcagugagccgagauggcaccacugcacuccagccugggugacagagcaagacuccgucucaaaaaaaaaaaaaaagagguccucugguccuggugaagaaaucuagguuuuaagacuuuauuuuaucauucguugauggcuuugugaccugggcuuaucacuuggucuuggucuauuucaccgguacauaucccaugcuuuccugucuucaugccuuuguccaagcaguuucaucuuccugaagcugcaucuaucccauugucccaccucugaucccuuuuucguaacucuuaccuauccuacaaagccuuucaugguuuuccauuccccaagcuagguaucuccuucuacucugagccucccaaagcacaaagcacuuaguucccuuuuuuuuuuuaaucacuuuuuuuuuuuuuugagacagaguuucccucuugucgcccaggcuggagugcaguggcgcgaucucagcucaccucaaccugcgccucccugauucaagcgauuuuccugccucagccucccaaguagcugggauuacaggcaugcaccaccacgccaggcuaauuuuguauuuuuagaagagacgggguuucuccauguuggucaggcuggucccgaacuccugaucucaagugauccaccugcuuuggccucccuaagugcugggauuacuggcgugagccagcgaaccugucuuaaucacuuuuaaaucacaaauuacuguucuuuguguuuagauaccuuuuuuuugcaagaucucugcugggucuaucuuugucaucaggaucagcaguaggccagccucacucuaguaguagcuauuccauaaguacgugguuaggucugggcagacugucucagucaccuuagaauggaaagaggagguuaguacuguucuguaccaaguacuguaacuuggcacauugacauguaaguuuaggcauguacuuacagaagaucuuauaaaaaagacaggcacaguggcucaugccuguaaucccagcacucugggaggcugaggugggaggaacacuugagcccaggaguucgggguuacagugaguuaugauugugccaccauacuguagcuugggugacagcgaaacccugucucuaaaaauacauggagaggccaggcgcgguggcucacgccuguaauccuagcacuuugggaggccaacgcgggcagaucacuuaaggucaggauaucaagacuagccuggccaacauagugaaaccccaucgcuacuaaaaauacaaaaauuagccggguguggugacgagcaacuggggagguugaggugggaguaucccuugaacccacgagacggagguugcacugcacuucaguuugggugacagagcaagacucucucucucaaaaaaaaagaaauacauauagauauagauagauguauagauagauagauauauagagagagaccaauccugucucuaaaaaaauauauauauguuuaucuuagaucuaauaaaggcacauuguauaugacuuacagcuuuuauauuuacuaauauagcuucuauaugucacguacagugugccuuuauuagaucuaacagaaauguuuucuccccaaguaauaguaaauaguuugaagcuauuuuaaguuucuaaagucauacaucugacuuuaauaagcacaaaaacuaagucuucguuucucacguguggacuucccuguaggccaucuccccgguuguugugcacagccacgaaacaaaagaacaguggccagaaccuggaagaggacaugggucagagugaacagaaggcagauccuccugcuacagagaagacccuccuggaagagaaggucaaguuggaggaacagcugaaggagacuguggugaggacugugaggcuccugugggggcgggcucggcugaacuguuucucuccugggccacauaaagguuccagguuucauuggugacagacuaaagccagaguuaagccguuguccauggccugcagugggcccagguggcaaguuacugccaaagcaaagacuaaaacccaaauccugugcaacucugguucuggcaagagacuaaucuuuacacgcuguuauuugucauugaaugaaaacuuaaaaucaucuuuacaaaugaggaaugcucaguaugguuguuuaggcugggacuuaggagaggaagcagaaaauugcaaguacaagaguugggagcaggagugugguuuuaugugaugcucucauaggcagguaggaguuuuaugaacuaguaacauggauuauuacuccaugugaaaacacauagguggcacaaaucaaguucuuuaaggauuugagaaagacaucaaacccugagugcuggcaccauuccaaacccguuacauauguuaauccuggcugccaggugcggagccagggcucgaacuagaacccccuggacuuggagcucuugcuccuugccacuguacagugauuaccugaagacugaaaauggaugcaguauagaggcccccacagagcaacuuaguaaauguuaaaaagagaaaagcuagcugggcgcaguggcuuaccccucugauagcacuuuggaagguugaggcaagaggauugcuugagcccagguguucaagaccagccugggcaacauagugagacuccaucucuaaaaaaaauuaaaaauuagcugggcgugguggugcacuccuguagucccagcaacccaggaggcugaggugggagaauugcuugagcccaggagguugaggcugcagugagccgagauuacaccacuucaaccuggaugauagagcaagacccugucucagaaaaaaaaaaaaaaggcucagaugagugagcuuaccggaagguggugagacaugaggaauauacuagaacucagaugaugauuacacaaggaauguuugaacugagccaccucuggguaacacagcauagcaaaagaucaugagugcagcuuuuauuaagcuuucauuaagcugcccuccuuagucacaucucaaaggcagugauauuacuucuguuuugacuuguaguuaguuacacagccguuuuccaaucaagcucgcuuuccuaugacuuuguuccauauuaauauaaaucucccggccaggcaugguggcccacaccuguaaucccagcacuuugggaggccgaggcggucggaucacaaggucaggagauggagaccauccuggcuaacacggugaaacccuaucucuacuaaaaauacaaaaaaauuagcugggcgugguggcaggcgccuguagucccagcuacucgggaggcugaggcaggagaauggcgugaacccaggaggcggagcuugcagugagcugagaucaugccacugcacuccagccugagcgacauacagagcaagauuccgucucaaaaaaaaagauauauauauauauauauauauauaaauaucccuuuuuuucucuuuuaggaaaaauauaaacgagcuuuggcagacacugagaacuuacggcagaggagccagaaauugguggaggaggcaaaauuauacgguacuuucaacauaacaugguguugauuccggaaagaagauaaugggguggggaaggggaaggccaugcauacggaagugucagagagcaaggcuguggggugggggguccagcuguugcauccccugcauuuuuuuuuaugauggcucaacagcaaaggugucuggaggagcagaaaucaaguagcugagacuagcaugaagaauuguaaauagguguguccucccccacgcagagaccuuggugggaaccugcagcaggucagccucugaugcccauccccuuagcccuccggaaguaacacuggcaucacuucagaacucccagcaugcuauaugcauugccaccuuuggauguuuuuguuacuguccuucccauuuuacaguugagaucauugagguuuagucaccugccacacaucacaaagcugguacguaaccccaggcucccagcuccacaggcugguuguuugagugcuggcucuggaucucugcgugacugacaguggguauuagagauguggaaccuaaggcucgagggaggguaaauggccuugccugggucagacggugagaggccacauggaaacuaagagcuagagucucugucgcauucacagagacugaggcgcucauugaaacacuuuuuuuccuggauacuguggccuguuucuugguauuccgccucucuuugugguaaugugcuuuguugguucuuacccuuuccgaccuguaaaugccugggcucuugggacucaguaccagaccucuucucuccccuugcugugcucccugggugacuuacauacucuuacgggcuuaguggcauccacacacaagucucagcuucaaacucggaucuuccgaguuccaguccccuaaaucuuacugcuugcuugacaucugggcuuggaugucucaaggguauuuuccccucuacugcacuccuuucuucacauuuuagugaauucuaaauuuaguaaauucugggucucaucccacaaguagcuuuugagaguuuuguguuguuuuuuaaaguuauugagccauuggaauucugaggcgauugauuugacaaguuacuaaauagccuccacaucaggucagcagugcucaguuuggaauugcccugugcgguugguauggagugcaaaugaucuucuuuaacuucauccaggcauucaagccuucugcaaggacuuguuggagguggcagacguucuggagaaggcaacacaguguguuccaaaagaagaaauuaaagacgauaacccucaccugaagaaccucuaugaggggcuggucaugacugaaguccagauccagaagguguucacaaagcauggcuugcucaaguugaacccugucggagccaaguucgacccuuaugaacaugaggccuuguuccacacaccgguugaggggaaggagccaggcacaguggcccuaguuagcaaagugggguacaagcugcaugggcgcacucugagacccgcccugguggggguggugaaggaagcuuagcugcuguugaugggguggguguuuuuaaacucacuugauguaacucucaaggcugguucauuguuucucaucuaugaguacgugugaccuuuucccaaaccuuauuggaaaccuuaaguaaccaguggcuaaacagaaaagccgguugcccaacugcauuaaugaacucuaauucgggagucuguucccuuuuagugccacgcguugaauaguuccacauacuuucagaagagcucagcagggcccugccuggucucccgagcaucaugaguaacgugucugcucagacucugcugacaccaaaguauuuuaaacaaauaaaaggucuuggggaauucuguuuggcuaccugggcacgccagucugcaccaugugucccugcggcgcaugagugacuggcguauuuagcccgucacauuucauucgcugaaggaaaggcaagagaguugaaacauuuuucuuacuuaaaaaaaaugaucuuugugaagaacauagugaguucguuugucuucagucaacagcggcugaaacugaccacugagaaaugggugugggcacugacaguucucccccauuauuuggccaggaauugagcuuggcuuggcaaaguuccuuuuacccuguucuguucaucuaaaugcagacauauuuaaaucauauucaacuaguuacuaaugaccucaaguuguauucccuggcaaaauggacuuucucaaaauaggacugcacgcuugguguacuuuaaauguuaauguuuaauuuaaaauuuuuauuuaagaggauuaaagcccuaauguuuauuuuccuacuuucugaaaacaauuuuguguccucucauggagauccuugccgcugaggcaagcauggcuuagccuucccauucucuacuccagcccagaagcugucagcuugacacgugcgugcgugcacauucacguacacacauauacaggcuucuacacagaaagggagagccacacucccccagugcagcugcagcccguccgguaagaauacgaaacacccaggagccacagcaagggcacaggauuugcaaaaucaucuugccaaagggcuguuccucauuuacacggucauccagggcuuagaaaaaggcugaaugauuggcgucuguuacaaaaaagagaaaagaaccuuucgcugccuuugcuucuagaauggaagauacuugugaaagccauuugcugcacaggaaagauggggcaguuuauuucacuucuaauuuuaaaagacgcaaguaauggucccauaauacuucaucuugggauaccauucccaaacauguuccaccuuuaagaugccuuaaguuaauuuggucagaaacaacuaaaggcagcaucguguauugaagaaaacaugacugggagcuccagcgcugccuguuuucacgcugugggguugugagugcaucaucaccccuggagcucccgaguuaaauggaggcuaagaaaaguaauuuaucaacucauuucugugaauguuugcagucuccuaccgucucaacuacagcugcaguugcuaaaaagcacuuaacucguaaccuagaggcaauauagcuuaaguagcaaaauauuuuuuuacaguaagcuucagucauccauagucacuauaaguugguuaucaucugaaaugcuuagaaccagaauuguuucaaacuugggggguuuucggauuuuggaauauagucaagcauggcuuaaccacagggauguguucugagaaaugcgcugucaggcaguuuuuccugugaacaccauguguaccuacauggaccuaaaaaacaggugguggagccuccuccacaccuaggcuauaugguguauguagccuguugcucuagacuggagggcacguuacuguacugauacuguaggcaacuguuaacacaaugguaucuguguaucugaacauaacauaguaaagguacagugcaaacuguguucuaauauguggccccucauugacugaaaagagauucucugcuugacuauuugcauuguauuugcugguuaaguauccccaaucccaaaauccaaaaugcucuaaaugagcaucuccuuugagcaccauguaggcacucagaaaguuucagauuuugcagccuuucagauuuggggauacucaaccuguaauaggaaaaugucuuuuaauuaugugcauauuuacaguaggaauuaaagauuuguuuagcuaccuucuaguaguuacuggauuuagcauaacugcagcaugagugaagugucacgugugaacagugaaaaccagaacuggaagucucagaggcaucugaaaagucggccuggcuuccugaaagacucagacccauuuggcuuucucuggcuguacugcugcuuugagggaggagagcaccuggcacgaaagggucucugcuuaagagaaagcaacuuuaggucgggugcaguggcucacgccuguaaucccagcacuuugggaggcugaggcaggugaaucaccugaggucaggaguucaaaaccagccuggccaacauggugaaaccccgucucuacuaaaaauacaaaaaaauuagcugggugcgguggugggugcauguuaaucccagcuacuugggaggcugaggcaggagaaucgcuugaauccgggggggcggagguugcagugagccaagauugugccauugaacuccagccugagcaacaagcacaagacucuuccccaaaaaaaaaaaaaaaaaaagacaaagcaacuuuaaucuucuggaggaaaaacuggguugauacaaaguaccaaaaguacgucaugugacaaucuguaucuguguuugaacuguggcucaccccuagcucuguguggcuccaagaagacaucugauuucagaaccagagguaagaagcaagcggugacacucuuuuguucucaacuuguuuaauauggaaaaaggucaucaaaacgguaggcaggguugcuguuuuuaauacauucuugggauguuggccauucagacagcauuauuucaaauauagaugaguuauccaacuuuuuuugacucaaagauaguuugcuuagauuuuuuuugagauggagucuugcucugucaccaggcuggaguguaguggcgugaucucagcucaccgcaaccuccgccucccagguucaagcaauucuccuaccucagccucccaaguagcugggacuacaggcaugcaccaccacacccagcuaauuuuuguauuuuuaguagagacaggguuucaccauguuggccaggauggucucgaucucuugaccucgugaucagcccgccuuggccucccaaagugcugggauuacaggcgugagccacugcgcccggacuagauuuuaacaagaccuaauuccaugggauuaugguggcuaauuuaucaugagaauuaaauauaaaaauguggaggcucugagcugccgacagagguaaggacuaccgugacgggaauagucgaugggcuaacaggcagccaaucacauuaccauuccuuugugacaaaggguuaauacuuuaacauaaauuaauuauacauucauuaugguguuuuaaaacagucaagccuaaauaaauucuucauaccaucaaaaagauauacauacuaaaaaccugcuucagcacaaaguuuuucauuugacagcucuuggccugggccauacacauuaacagggaucuucugcuucuucaagcuuaauauaguacgucuggcaaucauuuuauauaaaaauaagauuaaauuuaaaaccucaccaaacuaggauccuggcgcuguagaaaaucagggagacaccagaauagcuaaaacccauaguucucaagcaagcuuacauccagucaccuggaggccucgugaaaacagcucgcugcacccugccgcacaccauuuugauucaggaggccagguggggccugcgcgucugcauucuaacaaacaaguugcugcugcugggccaggagccccaccuugagaaccacuggggcuaagacaacuguaaaaacuuagcaccaucuccaucacuguucagugguagacagcauaagcuuucugucauccgcauuuauucugcaggggacaauguggagguggcccucaugauaccacugcucaguacuuuauugucaaaagagaaguucugggcuuagcuaaaagagcgcuucucugucagcaugcaguauaguuuacaacuaaagccauauacaauauauuugaaauguuuuauuuaaugcugaaaauuuuacccuaagggacaguaggauguguaaaaagaaaggaaaaggcacaguaauuaagucauccuuagaaaugaugagguuuucuuucuuucaaauaacuucacuuuaauguaacuucaagcccaaacauucugggagguaaacagucucuugguaccuacggggcccgagaggcaagucaaccuccuugaagaacggagcgcuggagucugagcacgccaaagacucucuuuaaagcagggucuuggaccagagaacccugagcagcuggaagacaaaagacuuccucaaguuucaggaggaagguaccguggacauccuugaaagaggaccccagagaaaaacuuguaggcagggcugggaagaagccauuucugagucugauucaagacagugacagagagcagcucgaggcucagggcaccacccgggcucccucgugcuccaccagaaccaccgccagccaacuggucagacggcucuugccuggcuagucugaggccucagcuggcgcgggccuggcgacacucuuacagaugccuacuagccaggcgggcaugcucauauuuucaguggaaagguacuugcaacugaagaaaauccugaggaagcugacgccagaauucagaacucuuagccuugaacuuuguacaauggguucuuccaagugaaaugcacucacgucuuaacagcagcaccgagcagccccggaaaauggacugagagggccuggcgguccacacguguccuacgucccucccacuaacgugcuuucccauucguggggacguggucacuaugggagccugcccaagaggcacggcucuacccaaagugaaccagcaggcucuggccguauucaaauggggcgcagggucagcuuugggguuugggaacugcacgcugaaacugcugccgccggugaaauggaaggucaucuggucgcuguguucaacagauuccucuucaguucccaacaaaacgccagccuguuguccucuggccugauuuuccucaucugcuacacagcggaggagucugggcccaagcugcccccauguaaagugccgcgugcccggggcugcgcuggggucagcugugggcagcgugggcucagaaaacgggagccugcaggcagccccgccugagaagagcuugugucaccaggaaauagcugguggcuugcggguccagcaggaaaacacugcuccugucacccacaauagcuuuuguaccaaagagaagaacacucaaaaggaaaugauccaaucucacaauaagcucccaacugaacggguaaaggcggagcaucaucgcaguguaugacucgcaggaacucacuuaaaauacacacauuugcuucccccaugauccaauauaagauuguuacuauugcuucuuucagaggaccaugaaaagaauuucuaucuuaaaaaaaggaacucaauuuguuuaaaaaagagcaacaguggggaagcggcuccccucccccaagucauuuuggcuggcacacugucugagcaucacccuggcuuucaaagcgucucagcuucaagacgcgucccuggagauccagccgcuuucugugaggaaauucaaaauccuuuucuuuaggacuuuguccagguagcuaggaaggcggcuuuuggaggggauuccuugccgcuucuggagguggucuuuaauuauaauagucuucacagucacguagcgggcuggacucaaguuuaaagagcugcagagcaccuucucgcgaucugacaggagcucgaagccuggaagguucucaauggcggcgaacucgcugucuuugccguccuccuuuccccguuuggagccggcuagguuuuuguucuccuuccucuucucccguuuaugccgcgcugccucguacucugccgacucuuccaucuuggugaucccguuucgccgguaccgcugcaguucucggaucuuggcccggagcauuuuuucuuugugcauguuuucaaaaaggucaucaaacuccuugcaugacaugaacugguacagcggccucagcuucaggcgcagcuccuucuccuccuuggugaucuugcgcuucagcgccuuuuccuucuccuucuuguccuuccccaggaaggcuggcaccagauuguagucacgggcgauguucuuccgccgcugucucucuuucagcuuccgcacguacauguccacgugggcgcgcuucagcucgaucuccacgucgucgucaucauaguugacagagagcccgcugaugagcgucucggcauccuggucauacucgaucucguaaucaucccgcagcggcauguagcccagcugcugcugcucagccacagagauguccagcgggggcagcgggguggugaggcugggugagagggggccuccgcugggacagguguggucugucacgcgguuggggauggugucggggaugcaggccuuccccagguucccguggauguacaugcucacguaaug

SEQ ID NO: 14321 - RNA, 1598 nt, Homo sapiens
cagcuuuucacauuagcucucuaaaggagguauacucaagccccuuuucuuuaucccacuacuaaaaaagcacaugagcaguacgucuauuucaaacacacacaaggaaauacguaaagcucuuuucagaaggaaaucauuuccaauaaaacucaaaauuucuauuaacauuuaaauuauaaaccaaacauuggcaacccacauauauauauacacacacacacacauauguuugcuauggacaaaugaagacugugaggucauacuuucaaauacaacuuuggaauuagucacaaaaaaucaacauauauucucagaaauuguaccauuuccuuuggucuacaauccacgcuauaggagguuuaauauaauauuaaauaauguaccauuuacccuaaaaguagguucuagaaaacugacuauuaggauugaauaacaaggcuuuaauggcucaauuuucuuaugauuauacaaacauauaaaucuugaaaagguaacgccauuuaguaaaauccauaaaaauaacaguuuugccacagugcagagaaaaguucauucaguuugauuccccaugcccucgacaagcagcuuucugauuagagcuggaagacacaggcugggugcaguggcgaccccguagucccagcuacuggggaggcugagguggaaggaucacuugagcccaggaguuuccgaacagucugggcaacauaccaagacccugucucuuuuuuuaaacuuggaagacauaaagucuauacauucuacacugaaucaugaauauacuacggagaguuuguagaaaguaaacuuuaaaaucccacacuccaacaucauauauguccauaagcaggauuugcaauucacuucauacuggagguaagcaccccagcugggguccucuugccgcaguggucaggccgucagagcugaggccuuucacugcaacaagggaaguagucuucgguccgaaacaggacgggggcuucguagccggcuugcuguggccucgagggagcagacuugcuaaagagcgagggcacguucaucgugugcaggagcuucuugaacgcccuggggaaggugcccagcucggccucggccuuggugaccugcuccuccauccuggccacgcggccccccaccauccucacgaaggccuccagccggucgauccugcuguagaugcgccgcaucucggcggccuucgcguggaugcgcggcacgcccucgcugacgacgugggacgagucgccgcgaagcauguccagcaugcccacgaacucguccacucugguaagcagguccucuaggcucgcguccagggccucgaccucgggccgcgccccggccccgggcagcaggcaggcggcguagcccgcagcggcgcggcgaagcagcggcaggucgcggcccggcgcgccguccuccgcgcccucguccucccacggccccgaggcgcugcuguggcucugggaaacagugccacuguccccgcuccaggcggcgcccugcggcucggccucuuccgcgagccccuccggcagcgcuccgccauccgaaaagcuacccuccauggcccgcgaccacccgacugc

SEQ ID NO: 14322 - RNA, 1598 nt, Homo sapiens
gcagucggguggucgcgggccauggaggguagcuuuucggauggcggagcgcugccggaggggcucgcggaagaggccgagccgcagggcgccgccuggagcggggacaguggcacuguuucccagagccacagcagcgccucggggccgugggaggacgagggcgcggaggacggcgcgccgggccgcgaccugccgcugcuucgccgcgccgcugcgggcuacgccgccugccugcugcccggggccggggcgcggcccgaggucgaggcccuggacgcgagccuagaggaccugcuuaccagaguggacgaguucgugggcaugcuggacaugcuucgcggcgacucgucccacgucgucagcgagggcgugccgcgcauccacgcgaaggccgccgagaugcggcgcaucuacagcaggaucgaccggcuggaggccuucgugaggaugguggggggccgcguggccaggauggaggagcaggucaccaaggccgaggccgagcugggcaccuuccccagggcguucaagaagcuccugcacacgaugaacgugcccucgcucuuuagcaagucugcucccucgaggccacagcaagccggcuacgaagcccccguccuguuucggaccgaagacuacuucccuuguugcagugaaaggccucagcucugacggccugaccacugcggcaagaggaccccagcuggggugcuuaccuccaguaugaagugaauugcaaauccugcuuauggacauauaugauguuggagugugggauuuuaaaguuuacuuucuacaaacucuccguaguauauucaugauucaguguagaauguauagacuuuaugucuuccaaguuuaaaaaaagagacagggucuugguauguugcccagacuguucggaaacuccugggcucaagugauccuuccaccucagccuccccaguagcugggacuacggggucgccacugcacccagccugugucuuccagcucuaaucagaaagcugcuugucgagggcauggggaaucaaacugaaugaacuuuucucugcacuguggcaaaacuguuauuuuuauggauuuuacuaaauggcguuaccuuuucaagauuuauauguuuguauaaucauaagaaaauugagccauuaaagccuuguuauucaauccuaauagucaguuuucuagaaccuacuuuuaggguaaaugguacauuauuuaauauuauauuaaaccuccuauagcguggauuguagaccaaaggaaaugguacaauuucugagaauauauguugauuuuuugugacuaauuccaaaguuguauuugaaaguaugaccucacagucuucauuuguccauagcaaacauauguguguguguguguauauauauauguggguugccaauguuugguuuauaauuuaaauguuaauagaaauuuugaguuuuauuggaaaugauuuccuucugaaaagagcuuuacguauuuccuuguguguguuugaaauagacguacugcucaugugcuuuuuuaguagugggauaaagaaaaggggcuugaguauaccuccuuuagagagcuaaugugaaaagcug

SEQ ID NO: 14323 - RNA, 46416 nt, Homo sapiens
cccgcccccgcccgcagccaaugggccgcguccccgcccgcgcggccgccccgccccucgcggacccggaagugggccuggcaccuucccggccugccgcagggauggggcagcugugcuggcugccgcugcuggcaccgcuccuguugcugcgaccgccagggguccaguccgccggccccauccgggccuucguggugccccacagccacauggacgugggcugggucuacacugugcagguaggugccgaccacgccccgcgcgccccugaggcugcagcuucccucuccccgcgggaucugaguguggguuugcgucccggggcccgaugccggcgcagaaggaggcucaguggguucaggaccccacgcugccauugacugguugcgucgcuaacuucgggccagucacuuccugccucugaacccccauuuccccuucuggaggguggugcagauuggagggaccccugcauucccggcuggggaggggcuuggggguugacagugguaacccauuuuccagggaagccuggagcaggagaggguggggcuggcuucagagcagguggaugucaggugcccgcugggaaggggccgggcugguccccugcggggcugaauauuggaggccagcucagcguccuccgccccccaggacaggggugaagguggaccuguggucaccuccugguucugcucaggaccuugggcgaggggcuuuggucccuaagccucaguuuccccaucuguaaaggguaggggaagcaugcccacuacagccaguuuccagaggagaaaaccgaggcccagagaggguugcugccuugcccaaggucgcucgggaauaacccucaugccuccugacucccugcucggugcuccuuccauucauguaagcacucugugggcacccugugugcagggcccucgggacucggaugggaacacacuacagcugugguccuuggagcucccagccuuggggaggcagacgccuagacgccagggacagccuggggagcucuuccucucagcaccagcuuuccucauuucagccccagcaggccccuuuggggucacuggaccacaccccgacugaggccuaagacuuuccugugcugccccucaauggcacacucagggcccagccccccaaauugcacacucaaggcccagcuugcucaccccucugagaaacugucccugaccccugggcugggagggcaccugucucugcccauguagggugucuguuuccccgucccucucccccaggagagcacgaucccauccaguggggagagccugguauggagcgagugccuaauagcuguguggggggugagcagcagggaaggaagggcagagcccccaaccccaugcagacacaccuggcgaauggcaggggccccagggacacuuggucuuguuggaccggggcuggcaugaugcuguccccuccccaggaaagcaugcgggcguacgccgccaaugucuacaccucagugguggaagagcuggcccgcggccagcagcgccgguucaucgcuguggagcaggaguuuuuccggcuguggugggauggcgucgccucggaccagcagaaauaccagguaaugaggucaccaggugacacaguuggcccaguauccuggcaaagacccagguggaaaacucaauggggcaguucuagccagggccagggccaggcuggcauaaaccacagggccaaaaccccaccgggcuauucacagccuuguuuagaucaagguucacggugaguuccaugccugggagagauugcuuucaauuuaauccugaauuucugucuauucuugaaaaaacugccagcucuggcaacccagcugugcacuuccgugccagcuggcacuaagucagcagugcccccugacaccaggcaucccagguguccccaagcccucacccucuucucucauuuguguuaucugccuggcccccgggcccagggucuggugacccuugaugagggugcgauagucccugugguuugaggguaggcagcagguugcuucauacagcauggagagucagaguccccgcugcacagugaggcagccugggucccauccugcucccgcaccaggggacacgacuagccccugcgagccacagauuccacuucuauuaaacgggggugaccgccccauugcagaaaagucaugccaagaaugaagcccuggcgugagcacccaggacgauacucggggguucuuaguuuccucccagguauccaccugccuucagaauaguugcugaacauaaaguucagggacgccaagugacuugcucaagggagugaagcggagaagggagagcagggcguccaccaggccccgccagagucacgggaaggagccggacauccaauggccacuugaugcugccagauagugggguucuuaccucaaguuaaagagacauuccagguucagagagggcacgccacuggccugcagucacacagcuuguaagcggcaggugggauucugagccaggcaugccugacucgaggcaggccuuuccaggauauccugugagcgucccaugcuucuucagguggaccccaccaaacccaguggucugucuccuagcccucaaagagaagcauggccugcauggcccagugaagaccuggacaggaaacuuguggcagagcucccuggaggcaggaauuguugccugcuucauucacugcugaacccccagugccugaacagugcugguuguguaguaggugcucacuuaacauuuguugagugaaugaucuacauauagugcaccuuaagaaacaaaccaaaggcacagccuauaaacagcuguguguacacauacugagguguguagugucuagggcaacaaagguguuauguguguagagacggggauguuaagcaaauagguuaaaaaugguagugaugagugaaccuugggaaaggauaugggagcucuuuguucuauuccugaaacuuuucuaaaguuuagaauuaguuaauaaaauaagauuuaagaaaaucuuauauauacaaauauauaucucaaauaccaccugagggcugcaugauuucuagguggugggaacacaguguggaccaggacagacagugcccugcuuuuauagaguaagcaaggguggggaguuuuaugcagggcguguguggcgcuguagguguguuccccacagacccagccaugcucaggagccguaacuggcuuuuuucucucugccugcccaugucaagguccgccagcuccuggaggaaggacgccuggaauuugucaucggaggccaggucaugcaugacgaggcugugacgcaccuugaugaccagauccugcagcucacagguuuggccacccuacccugcacccagggucccucaggaccuccaguggggcugggacaugguaucagaacccccagguucugagcucugucugccccucuuaguggggucggggaccuuaaccagugaaagcagugauuugcuagugccauauucaugccucaccaaggaaguugaauguagggguuaagagcauggaugcuagagucagauggucucaauauauccuggcucugccaauucccuccucugugacccuggaaaggaauguaacuucaguuuccucauagauaaaaugaguuugaugguaauaccuaccucaaaggguuguugugaguauuaaaugggauaauucaaauaaagcacuuuaguaggauguggguucccuaguaaaugcucaguaaguguuugcugccuuccaucacaauuaccaccuucagcaccauaaugaccaugacuacuaccaucaccaccaccaccacgaugaccaucacuaccacuaccaucaccaccaccaccaccaucaccaucaccacuaccaccaucaccaccaucaccaccaccaucaccaucaccaccaccaccaccaucaccaucaccagcaccaccaccaucaccaucaccacuaccaccaccaccaccaucaccaccaccaucaccaucaccaccaccaccaccaccaucaccaucaccagcaccaccaccaucaccaucaccaccaccaccaccaccaucaccaccaccacccuucaccaccaucaccaccaccaccaucaccaccaccaucaccaucaccaccaccaucaccaccaccaccaccaucaccaccaccaccaccaccaccaucaccaucaccaccaccaucaccaucaccaccaccaccacuacccuucaccaucaccaccaccaccaucaccaucaccaccaccaucaccaccacccuucaccaucaccaccacccuucaccaccacaaugaccaucacuaccacuaccaucaccaccaccaucauaacuaccaucaccaccacccuucaccacugcuaugaccaccacuaccacuaccauuacuaccacuaccaucaccaccaucaccacuaccaccaucaucuucaccacuacaaugaccauuacuaccacuaccaucaccaccacccccuaaacacuaucaccaugaucaccacccaucacugucgccaccaccaucaccacauccauuacuaccauccccuccacaaucaucaucaccaccaccaugaccaucucccucaccauuguguccacuguccucagcaccaucacccacagugccguggggcacucuacucaccauuuaccaaaugccuuucacagugacaccccagccaauccuaauggcgggcugauggugaggcauggugaugcccaguuucauuuugcagauguagaaacugagauccaaagaaaugcaguaacucucuccaggguagauggccaggacuugaguccaggccuagggacugaagcuccgaguccacagucacuccacuacagcaugggcccugauuuccccauuuguaaaacauccaggcagagagcaauguugucaaaggauguuuuuggcacucucccuuuucucaucuguaaucuggaguguuccccugucucaguuucuuacugccuuacaucuggacuuugcucaaacccuagacuugcccuuccaugagaaggaggcgugauggacacagcccuacagacagagcuccuccuguggccaggagcucagccccugcuugucccccugcauccccacaggcccagagguaacaggggaggacagcaaggcucagagggagcaccuugcccucagccgccugcuguggcucccugacuccagagccccugcucuuucacucccccaugugaagugugggcaagggaucuaucccaacagacuucccccacaccccuucacaagcccacugccagggaaugugugacacuguaggcgugucccccaccugccuccugccccgugccagcgaggaggcucuggggcuguuucucaccugugccauuucacgcagugcucccccucauucuccacccuccuccucaagaugcagcugagaagccccucccgcaggaaaucucugagucucugcaguucugugucaccuccccacuuaaccgcugaaccucaagaugccccuggcagggacccccaucugacucaucucagcacccagcauagggucuggcccagaccacugcuuacugggcaaggcugggcaaggggugggcgcugaacugcccugcccugaggguacccaccacugggguaccucgccucuggccucagcccaccgugccuaagugcugauaccccagcgcugacccugcaggucugaccuggcaacuggaagccucagggaagcugaggcugugucgcucuggggcaggaagagccuccagagacacaagagacagcggcuguugugaggcuccauuuccaaaccuguccaagcucauggggcccucaggguacagacauguggguuucuuucaugauaaccaccuuguucuagguacaagauguacacguauuuuuuuuucaguccucagggcaaucugguagauggguaaucuuacaaaugcuuauuuguagagaaguuugaggcucaaaugcuauccaaaugugcccaccaccagcuaagugaugggacccagauccaacccuagcccggccgagucaggaagguuacuuguggcugagccccucucacuggcggcugagccaagcccuuucccaucugcuaucucuuaguugccucagaacagccugguagcaagugguacuguucacagccccauuugacagaugaggaaacugagguacugagagaugcgggauuuauauauaugcaguagguaacagaacuggcgcucaagcccaugugugccuggccugggcucuuuccuuaacuuguagucccuagggcgggggcagaguguguguaucagaccacccaucucagaugucccaggcauucuggcugugaauuauguccacauugggcugguuuucucagauauguugggguaagaggggcuggaucaccccucacugcuuccgggcccuuuauccuccaucucaccuugguggagccccugccucgaggcaggcccuggacagcaaaggaagacaggagcaggcuggugcagccucuagaccucugaccuucuucuucggguaucuagggugccaaagcaucuccucaaccaagacccacuccuggcugcccgccagggccuggggcacugggccugcccguaagcucaccuuuccagccuuuaccuccccaacuccugcucccggcagucacgccaacaccaccuuaauuuuagaugugacauuucuagugaggggaaaagcauuuguucccagcacugcagugucagggaaaggcugggugugggcagcggcccccggggguaagagcuuucaugccccucccugaggggacacuuucccagcugggauguuuagcggaggcccagcagaguggcaggugccagagggaaagaaccccucaccccuauccugaggggagagagcccagcucccgccucagaggugcugagaggcaaaggguccaggugagagucaaggagacaccuugggccauccuggaugaccacugcuguccuggccauucaaacccaagcucucagcccugucccccaaccccacucccuucccacugaauccgcgaucccucuccugugucacagacucucuuccaccuucucuugucucucugacuccuuccagcaguauuuaguuguuguuguugccguugcugcuguuguuguuguuguuagacagagccucacucugucacucaggcuggagugcaguggcgcaaucucggcucacugcaaucucuaccucgcagguucaagcaauucuuaugccucagcauccugaguagcugggaguacaggcgugcaccaccaugcccagcuaauuuucauauuuuuaguaaagacagggaucucaccauguuggccaggcuggucuugaacuccugaccucaagugauccgcccaccuuggccucccaaaaugcugggauuacagaccugagccaccaagcccggcccccagcaguauugaaaacacacuuaaauugucucucuucaaaaaaaaauuuuuuuuaacaugggguccacuguguugcccaggcuggucuugaacuccugaccucaacaucauaaagcaagacccuccagcucaggcuguaauggcauuuauucccaccacccccucaccccccaccaccucccacuacuucacccucagccccugcauccuggccucugcccugcaugugcuagugagcuugcuuguggccuggucauuauacuggugaggauacugguucagcagcuugaacagagaccaagugacuccaacaagaaggaagguguguuucucuccuguggaagucugcagugcaggccacucuggugauuggguggcucugcuccauggagugacccagggauccacguugcuuccaucuugauguucagccaucccccacaguguugccugccugaguugcagucuagacuggcucaccccacugaguuguccuuccagcagcuaggggauagggaaugguggagccagggcaggcagcuuccuuguaaaaggcgaccuagaaccugcccacaucacuccucacauuuccauuggccagaacuuaaucauauggccucccucaacugcagggacugcuggggaauagagucuauuuugcucccaguccauuggccagaguggugucaugugaccucuaccaguugcaaaggaggcuggggaauguagucucuggcugggaguccauuugcccugcuaaaaccaagaaggagugugugguucuguuacuaaaaggaagaaggacagaauguauaucggacgccaauuaacaguuuuggucaugaaucacccugaagucucaggaaugcuuucugcuggacggccagaaaaccuaaguaaagcuguuagugguggaagguauccaaguuaccagcagcuaauccguacgggucugcagcaaccccaguucuugccuccucggaagaaagaauucgacugaggggcauaaggcagaaaaagagacugaggcauguuucagagcagaaguggaaguuuauuuaaaaaggcuuuaaaaugagaaagaaaggaaaauaugcuugaaagagucccaagugggcacgugaaggucaagugcuguauugauccuugauccuaggacuuuauaggcugguccccuuucccaugauucuucccuuaggcugggcuacccgcacucacagugcccuccuuacccuugggaggugagcacacgcacuguguuuaggaaguugcacacaugcccaucugacgcuuucuucccuuuuccaguggagugucccuggaaggucaaacuccgccauuuugucucuuaaugcaccugcucgggaagucacgucucccuggcaccugcauucaauuaacauguuagugcaacagguguggaccaucaggaaaugcccucucccuagugcuggcugccaauuucucacuucuagagaggcaaugugauaauugccaaaccaucacccaacauuccuagugggugggggaagagcccuccccugccccacucaugcuugucuaacuaccuguaacaaagcgacuugagucuuaagaacauuuacuuaacaagauggggauaguuugggacugguucugcaguaccuugauaucugugauucucauguccuuacccuuguggucacgauauggcugccauagcuccagccaucauguuaccagacaccacauucaaggcaguaaaaggaagagagggggcuuucuauacccauagucuauucuguuggauaaacuuagacacacuaaaauguuagcauuuauuugaacaaacagugauuccugaaucaggaaguacuagacugugagcaguucauggcuccacuaagggaauaugagagggaaacgucuauaaggugcuccugaaagcaagacaaagaaaacauuugccuacagugaacagucccuaguuagagguugguuggcaguuuccgaugggucaagcuuaaguucucuuuuccuguuuccaccaaguuagauuuggguuugcugacagaggaacucgaggccuggagccggcucagccugauggccucccaguucauuacuuaacaaugccccuccagcugccagacagagagaaccaauaucugacaggagggaguaagcgugccacauuuggcuuagaucaacugugauucgucccuugaggcugggcauggugcacccugaacagagggaagguucugcgagugaaaaaggggugcugacuuggcagccuucagccugcccccaccggcugcccugucuggugcgaggccguacccuccagagcuccuggcuccucucagugcggugcuguugcccacucccuccuucauccugcagcuggcacucccccugugcuccccccacccucuggcugcuccuucuccauccucucugcuuacauaugcacagccuccacccacacuccuaguccacgcucccccugauccccucucaccucugcugugcaccugaugccagccccacuccucaccucccacagucauccccugcccugucuugcuuggccuugcucauaggucugacugcugcucggucccagcaucccaggccucaucugaggcucagccaggguccccaggacugcaaguucaucagugaaaggcaguuugacucuagaucaguuaugagaguucucugaggcacuguucaccaaucuuaaagugcagauuauaacacccaucucucaagguguuagaaagauuauauuuggggcaaggacuuggggaauguuaaucaaugccuuauacaagucugggguuuucuuuuucccugcagcacugaacccaauaucugguucacuauggugacucuuaaguaauaaaugaauaaaugaaugguugggugauucuggcauggaguccuuuguauucaugaucuauuuccguguagcaaauugcccccaaacuucugagaacaaacauuucauaucuacagcuccugugggugaagagcucaggagugacuuagccaggggguucuggcucaggaccucuugaaaaguugccaucugggagucagguggggcagugucaucugaaggcuggacuggggcuggagggucuacuccaggcuggcucucgcggcugugagaggaagccucaguuccucgccaugugacuggucauggcacagcagcuggcccccagagcagcgacccaggagagcaggcaagggcagccacaguagaagcugugugcccuucaccuucucuccucaaggguacacagguacuucugcuucacuguguuuguuagaagugagucacugagucuggccacccucuaggcccuaagccucaccuguugaagacgcagcaauaauuuauggacaucuuuucuugugguuuuuuuuuuuuugagacagagucucacucugucacccaggcugaagugcaguggcaggaucauggcucacugcagccucaaccuccugagcucaagugauccucccaccuccaccucccaaguaccugggacuacaggcaugugccaccaccacgccuggcuaauuuuuuaaauuuugugugcauguguagagauggggucucacuauauugcccaggcuggucucaaacuccugggcucaagcgauccucccaccucagccucccaaagugccaggaugacaggcgugagccacauugcuggccuuggacgucuuuugaaccaccgcacacuuagguuugaaguucaccuuuaaccuuuuauuguuggugauguccaagaccuccauagcaucaucaaaaucagugcucuauccaaguucacacaaaaauccucaccccugcacgugcuguaacaugcaggaaccuuaaggacauuacgcagagugaaauacgccagucacagaaggacugaugcugugugauuccgcugauaucuacaggcaucaaauucaugcagucagggaguagaaugggggugcuaggggcugggggaggggcauagggaguuaguguuuaaugaggccaagagcuucaacuugggaagaggagaacauucuggaaagggauggugguggugguuguauaacagugugaauguaguaacacuacuuaacuauacacucacaaauuauuaaggugguaaauuguauguuauauguacuucaccaugauuaaaaguuaauaauuaacacccucaccucugcaguucugcaugacccugccuggcccaguagcuggcacugcaacccacuggauaggcaggguccccuggggugaggauggggccgggaggcacaggcccgcccuccaggcaccagcaggguguugcugucuuugcagaaggacacggguuucucuaugaaacauuugggauccggccacaguucuccuggcacguugacccguuuggcgccucugccacgacgcccacccuauuugcgcuggcgggcuucaaugcccaccucggcucccggaucgacuacgaccugaaggcagccaugcaggaggcccgggugaguggugugccgcgucugcugccgcccagcgaccgcuccucccuuccuuccuugaaucagagcacgguagaaagcugcugcucuaugccgaaguguucggaaauucuuggcagcugcauagaccgcggggcuguccccuaaccuuugcucuugucgccuccuccaccaggagggccccccucccuguaccccagcuucucacagagcugcaggcacagcuuggcugccucccgcuuccagaccccuaucuccaucagcugggccugaggcggggcugacucuuucuuuaggccccucacagggacuagagcagaauggcacucaguaagcaggggugacaacuagaggaauggcaggguguguucagcugggagaacaguuaccagagacgcugugauucuucaggugugagggcaacuguuacaagacuuaaguagcaacaacaaccaugguagacgcugccuucgauugugcccuugggagucccaggccugguaccaggcccuacucauccuucauuucuuuuucuuuucuuuuguuuuuuguuuuuuggguuuuuuggggucuuuuggguuguuguuuuuuuuuuuuuuuuuuuuuugagacagggucuugcucugucacccaggcuggaaugcaguagcacaaucuuggcccacuguaaacucugccucccggguucaagcgauuauugugccucagccucucaaguagcugggauuacaggugagugccaccacgcccagcuaaauuuuuuguguguuuuuuguagagacgggguuucaccauguuggccaggcuggucucgaacuccuguccucaagcgauccgcccaccucagccucccaaagugcugguauuacaggcgggagccacuggugcccagcuucauccugcauuucuuuuaacccucacagcaaccuuaugggacggugucaucauuugcuagggcugccauaacaaaggaccacagacuggugacucaagcaauagaaacauauugucccaugguucuggaggcuggaaguccagggucaaggugucagcagggccacgcucccucugaaggugugagggaaggggcugcuccaggccucucuccuuggcuuguggaugccccgcuucuuucagugcccccguaucaucuucccugggugcauguuugugucucaauuuuccuuuuuucugaggacacccauccuauuguauuagggcccacccuaaugaccucauuuuaacuugauuacuucuguaaagaccccauuuccagugggcacaguggcucacgccuguaaucccagcccuuugggaggugggcagaucacaugaagucaagaguucgaaaccagccuggccaacauggcaaaaccccgucucuacuaaaaauacaaaaauuagccgggcgugguagcaaguggcugaaaucccagcuacucaggaggcugaggcaggacaaucgcuugaaccagggaggugaagguuucagugagcugagaucgugacacugcacuccugggugacagagugagacucuguaaaaaauaaaaaauaaaaaaauaaacugcacacuuggugagaaguaaugagcuuccugcaccugggggcauucaagcagaguuagaaggugcuaauucuacaggguuuggcagagaaaagccugcaucgaggaguggguggggugaaugagcacuccuuccggagggcaaaucccacaaccagucuuagacggaaacggcaggggagagcucauccuugaaccacugagggagggccaaggugagggcaggcgggagacacccagauggggcugagggaaguggagcuggggcagccauguggccccuccagccucauucuucuccucgguuugcaggggcugcaguucguguggcgaggguccccaucccucucagagcggcaggaaaucuucacgcacaucauggaccaguacagcuacugcaccccgucccacaucccuuucuccaacagguacgugcccuuccgcagugccuuugggaucucagacagcagggucugcccagccccugcagcuguucugcaguuuuguuuuuguuuauugguuuuaagacaagagcuucugcucuguugcccaggccggagugcaguagcgcaaucuuggcucacugcaaccuccgccuccuggguucaagcgauucuucugccuuagccuccugaguagcuaggauuauaggcacccaccaccacacccagcuaauuuuugucuuuuuaguagagagggaguuucaccauguuaucuaggcuggucucaaacuccugaccugagaugauccaccugccuuggccucccaaagugcuaggauuauaggcaugagccgccgcgcccagcccuauucugcaguuuuugacaagagcuccuuaagcacauggugucccauucuucagccuccccagcagagugggugggguuaucaaccccauuuuacagauguggaaacugagguucagagaggguaagugaccagaucagggucacccagcugguaaguaggggaggcaggauuugacuccaguucugugugacucugaauugcuucuuguuaugagucccugucccaaaagaggauuguuuaaaggaugagaucuuggcugggugcggugccucaugccuguaaucccagcacuuugggaggcugaggcaggacaaucacuugaguccaggaguucaaaaccagccugggcuuccuagugagaaccuaucucuacaaaaacuuaaaaauuagcugggugcaugcaguccuagaugcuuaggagguugaggcagaagggucgccugaauccaggaguuggaggcuacagugagcucugaugguaccacugcacuccagccugggcaacagagugagaaccugucucuauuuaaaauaaaaaaaaaaauaggccgggcacaguagcucaugccuguaaucccagcgcuuugggaagccaaggcagguggaucacuucaggucaggaauuugagaccagccuggccaacauggcaaaaccccgucucuacugaaaauacaaaaaaagaaaaaaaaaauuagcuggguguuguggcgcaucccuguaaucccaacuacuugggaggcugaggcaggagaaucacuugaacccgggaggcacagguugcaguaagccaauauugcaccacuugcacuccagccugggccacagagcaagacucugucucaaucaaucaaucaaucaaucaaugaugaggucuuuacaucaguguucccaagaaccuccuuccuggccaugacagguccccuucugcucucgccucgccuguccguaccugccaggugaggaaguugaaugugcugacuuccaggagccauccaucggcaccccaucccguccacgguccuccagggcacuguccagugucucucuaacacccuccaagcucaccugcccucaaccccagugaucucccugccucuaucccgccugggccuggagagcaagcuggguuccaggcugcaggugcagggauaggggugcuguggaugcagggggaaggcccccggacauggguguuuccccacccguuccugacguggccuggcuuuguuguuggggcuuuggcacaaggcuucguccccacccacccuuuccccuccucauccuugucccuaucagggaucacaaugaagaaggccggaggaggccaggcgcaguggcucacaccuguaaucccagcacuuugggaggccgaggcaggugggucacuugagguuaggaguuugagaccagccuggccaaccugguaaaacucugucuguagucaaaauacaaaaauuagccaggcauggcagcauugccuguaaucucagcuaccugggaggcugaggcaggagaaucacuugagcccacaagauggagguugcaguaagccaagaucaugacugcacuccagccugggugacagaaucagacucuaucucaaaacaaaaaaaaaagaaggcuggaggagugggagagggaaggggccuggagacccuugggaauaaaucgcuccucauccuugucuugcggagcugccucuuguccaaucaccucccguucaccccguggugagggagggguccucacccuaaaugguagaugguugaauacacaccacccuacccagcacaggugacguccauagcagcuucuguuuaucacauacaaucacagcucacaccuuacucgccaaggccccgugggagugcacuguggagcggacugaacacgcaggggcagcuggguagcagcaagggggcgggugcccuccgacuccugcagaggacgugaguggcucauuugaauaauuucaccagcuggcagggagguggaaacuguuggguggaggaccagguggggugcagcuggucugacugauaguggaagagcuagacaagaggacuuuucugcuggugggggcuaucaggugacagcaggggacuccuaggccccugggggccuucaaggcucagaugucaagaagcacaugggauuuuagccucgcuguacaccuucuuccccagaaggcuuugggugaagacucaguggggaccaggaguguggagccauggaccaggaccccccgggggcagagaggauaggcagugaacccacauucacauuccuggcuugcuguuccaagcacccaccaugagccaggcccuguuccaagcauucucccugugauaccucacagacccucgcagcagcccacugacggagaugcugugagugccccaucuuacagaaggaaaaacugaggcacagcagcccgccccaggucccacagcuggcagacgugguggagccagcguuggauucaggccaccagcucugcagccuccacgugguggcagcagucagccuuggucucugugcagucagacggcccuggguucaaauccgcacucugcccuggccaggugcuuagccucucuuggaagaggaaagacaacaggcaaggcagagggggugaagaacacuggccgggauuaauuagcggucacugccauuugucagcccuccuuugugcccagcacuguuucuagcuccuuuccauaaaugacuuucauuuaauccucacaacaaccugcuccacauucuaccagggagcuuggugaggcuagagguggcagugcugguggcugaugacugugaucccaaugcuuugggaggcugaggugggaggauugcuugagcccaggaauucgagaccagccugggccacagagcaagaccucgucucuacauaaaauucaaaaacaagucgagcauggugguagucccagcuccuggggaggcugaggcgauggcuugagcccgggaguucgaggcugcagugagccgugaucauaucacugcacuccagccugaucaacagagcaagacccugucuguaaaagaaacagaggugggaaugcuggaaggggcugcccagguuggagagcuccagacaaggguuccauggcugcuaccccgaggcugcacagugugagcaaggaaggcacuuaacuggggguucuccacacccccagccuaaggcaaacagagaaagauguuaaauacugagccugucuuuauuuaaaacucugacauuuuguuccucauggguuuuuugcauuaauuuucauuuuuuaaaguacugcauuaaaauaucauuuaucucaacuacuaagaauugaggcacccccauaaauuuugugcccuaggccagggccucacuugccucaccaagcccccggccucuuugggguccugagacccggggucugaugggcgagaaguuggccugcgugaaugagcaaacaaaucugugacccaccgucggucauggagugggagaauucagucucagggugaaaugaugugccaaggucccaaggcugggagaacauggcacuugggugugagcccuggcuguccacagaguucgugucuucugcccuaaccuucugcccucgcacaggucaggauuuuacuggaauggcguggcugucuuccccaagccuccccaagaugggguguaccccaacaugagugagccugucaccccagccaacaucaaccucuaugccgaggcccugguggccaacgugaagcagagggccgccugguuccggacaccgcacguccucuggcccuggguaaggcagagucccaggugcugugcccucaacacagcccaaggagcacuaugcaagcccuggucccugcacccagggccacccuauccagacccagcuaggcagccaugcucagcccaguggcuccauccuccuucccugcagaccccugggccucucccacucuaccagccccucccccaccuggaaaagcacccucacccacgcuggccucuccagcucccacucagcucucuucccugccugggccgggcuggcucccggcucgggcacugcgugccuuagaguccauugagcuucaguugccuccgcuguaaaauggggaugguggcagcaggcuucauaggcuuggugagaggugaagcguucccgggaagccagugcccggcacgucguggccaucgucacagcuaaccuuuagugagcaccugcugugugcugggcacugccccgugggauauauuugucucagccaucuaauuugcaccacugggccuaggaagcaggcugguauccauuucacaguugaggaaaccaaggcccagagagguuaaggaauuuuccugaggccacagaguuccuuaggguggcuaggaagggguggaauuuguguucagacccagucaggcgggccccagagccugccuucuucauccgugacugcccuugugaaggcaagcuuaagaucaguaacucagucaugguuauuauugcuguuauuaaucauuauauuaauuauaauaauuaauaaucauuaauuauaaugauuuggauaaguaguaacacugaugggccuuaagagaugcccagggccgggcgcuguggcucacaccuauaaucccagcacuuugggaggccaaggcaggcagaucaccugaggucaggaguucgggaccagccuggccaacaugguaaaacccugucucuacuaaaaauauaaaaauuagccaggugugguggcgccugcagccucagggaggcugaggcagaagaaucacuugaacccgggaggcggagguugcaugagccgagaucaagccacugcuaugggagcugguuuggggccccuguuggccgccuuggagacugggagggcagcugguggagggcagcgaucggcccacccccacugggcgagcgcccugcucccacggcacaggauguugcucccaugucccugcagggaugugacaagcaguucuucaaugccucggugcaguuugccaacauggacccgcugcuggaccacaucaacagccaugcugccgagcucggugucucggugcaguaugccacgcugggcgacuacuuccgugcccugcacgcucucaaugucaccuggcguguccgcgaccaccacgacuuccugcccuauuccacagguacaggcuuccaggggcuggggugguaguuugguggcagggaggguauaguccacguacccucugcccacuucaguggcugcucggcacugcucuccaagcccuggagggguuccaggcagguucuguguggggcgcaggggcagagacugacccucucugcucacuccaccuggacguccuggccaccacaugcaccaccugauucccacaggguucagccucucaccauugcccaccacaugcaguuuccugccucuggccuuugcacagguggugccuccugcugggagcggccuccaucaccuucucuuccugcaugaguuccacauaaaccucuucuacgagcccuuuccugaugcugaggcugacucgggcuuccuuucacugcacagucauuacugggcaccuccugugcaucaugccuguguccucaggccagaacuggguuggccaccagcagcacagccugagagcuaagagggcuggcugugaguaagccucuacucgcugccugugugcaagucaugaaaccacccugucuccaaagggggacauuuguggugccucgugcauagauaggguugcugugaaaauucaaugagaagaagugcucucagccuccugcccagcacagaggcagggcucagcagauguccuagaccucugggugcugcuguaacaguauaccacagaaugggucauugauuaggaaacgaaguuucuuuggcucacagauguagaggccgggaaguccaagguggagggcuggugucuagagagggccuucuuucugcaucacccauggcugaaggcugagugcaaaagaacagccggacaaggggguugaacuugcuuuucuaacaaucccagucccaugacaaugacauuaaucuguucacgagggcagagccuucauggccuaaucuccucuuaagcaucccaccucuuaauacagucacaauggcaauuaaauuuuaacauggguuuuggaggggcauucaaaccauaacauuucccuuccaaagagaugccacagaugaacuccagcugcagggcucauucuggccugggcacugccuugacucacccaugaccuggcuuaguccugccucucugggccccagccucugggucugcauggugaccaguggggcugcauaguccccggcuccugcuguugacaccacauuggaggcagguggggcugcacacacggguugggggauguccguggaugugggugugguuauagucaaggcaggaggagauauguuaaugugggcauggcuaauggugaggugggugggguagugacuguggguguggccacaucuagcagguagggauauacccgagucaaguuggguguggcucuguccaggugggcgugguguccaggugggcgugguauccaggugggcgugguauccaggcgggugugggugggcguggcguccaggugggcgugguauccaggcgggcaugguaucgugaugaccacugaggauguggagccccugccagacugaauggaaucgggccucaccacccacucucaacauggcugcaaagcuguggaggaccccaucugacccacaggguguggccuguccccugggccaugugaccaccccucccagucugguucaggaccagugggggaagaacagggaaucaaggcaaaucugggcacaucccagacgccgaggagcaggaaagcaaaagcaauaggaagcucccuucugagacagacagccacucccugggaggguucagcccuccugccuccugcaugggcccugggcauccucauccucucugucuugcaucaggacacuggcucccuggggucucugagcccuugcugccuccuaccauccauccucccuggacgcccagagaaucccugcugaaacgcaugccuguccuggccuccccaugcccacgucacacaugaaggccucugugcagucuaggcccuucucagugggguccugcccaccuggcuccuccucuuccccucugggucucccaggcccuuugcucacacagcuguucuguguuuccuaggcacccugggcuugccuccgaucaggauccuucagcaccccaccccaccugccccagugcagccugucucucccacccugcccaaggcccauccaggguuuucugggcaguuccuagucuggcuaugggaggaggccugaguugggagccguaagcccugggcucgcugccugcccggccugccuccuugggugacccuggcagaggcugccucugcagccccagcuucucagcucuuccagggcuggagcuuagcagacuucugggucaugccgucucaagcucaccaucuucccuugucucccagaaccauuccaggccuggacgggcuucuacacgucccgcagcucacugaaggggcuggcccggcgagccagcgccuuguuguaugccggggaguccauguucacacgcuaccuguggccggccccccgugggcaucuggaccccaccugggcccugcagcagcuccagcagcuucgcugggccgucuccgagguaacaccacauuuagccacaguggcaggauuggaaccucccaugcugcgcaccuccccucccuuguccuagccaauccuuccagcccuggggcacuagaggccccacuuuacagaggggaaacugagguucccuuugguuacaaggccagugcauggugaacccaggccaaggcugagaccacagccugauccauccagcugguggccucauuaagcuuuguagcaguuuagcaaaagggauaaaggacaagguggaguggcauuuguguccgacagcccugccugcauccauaucucggcucagcugugugaugucaggcacaugauucccacacccacccaagaccuaauucccuccuguacaaugagaacaacgagcuugcccaggaggacgguggggcaauuggaugugcuggugugcacagccugcuuggugcaguggcugcugaauagccaguucaugaguuuccgucuccacccauccccuacuguacugaugggaaaacagacccaagacagccuguaacuuguccucagucaccuauccaaaaaagggucacaccagccaugacacuguaacaguuccccaaaaggagcugcuggcagaacaugucauuauguugugggagaaaugaggugacuucaggguccuucagagcaggggguccagagaugggggacaaugaguucccacaagggcaggaaaaguugggcgagcuccucagcuucucuuggccucaguuccuccuucuguaaaauggcggggacugcccccuucuccacuggcaccuggcaagccagaaugagagccagcgccuaguaggugccuuguaggugcuuugcagagucagguccugauccuguucuuccuccccucuggggguugcugcagguccagcaccaugaugccaucacugggacugagucccccaaggugagagacauguacgcaacgcaccuggccucggggaugcugggcaugcgcaagcugauggccuccaucguccuagaugagcuccagccccaggcacccauggcggccagcuccggugagcagggcccugcagggaggcuguggccccuuuaugaagggagagccugaggaggucaggggaggggcucaacgaccccagcuucagacucugaguccacaucacccauaucgcccuuccccauggugagagcucggacagguggcuucaguccucccagccucuguuugcucauccgugcaaugaggaaggguugcugauguuacaagaagagccagaaauagcagcuaacauguuuugagcauuuacuaagcucaaaauacccuucaugcaguauugaauuuaaugccucacaaaaucuguacaaaauaggaaugguuacuguccucauuuuacagccgaggaaacggacucaaguuauaugcuagcccagggccacucggguaggaaggagcagagcagggauugaaccugaacacggugcugcccagccuuggcagagaguacgccgguguccucaggggcccggucccuuccuggcuccuggcacucccucccgaacuccacuuggcugacaucacagcagggcagccgugggaccagccucuuugacugugaguuuucccacguguagagugacugaucacaugccagugugccugggacugagggguuuccaaacugggaagauccuggacaaaugaagacagguuggcggcccuccgcccgcaugagacuuuugugugcauaggccgccaggucccacccacagccugcaccuggucaucuugcacuuccuucuuguuuuuuguuuuuugagacagggucucgcugugucaccuaggcuggagugcaguggugccagucauaggucacugcugccuuagacuccugggcuugagcgauccuccugccucagccucccaaguagcugggacuacaggcaugcacuaccacaccuggcuuauuguuuuauuuuuauuuuuuuuggagagacagggucucaccauguugccaggauggucuccuaacuccugggcucaagugguccucccaccuuggucugucaaaaugcugcuaucuggccaggcaugguggcucacaccuguaaucccagcacuuugggaggccgaggcggguggauuacgaggucaggagaucgagaccauccuggcuaacacggugaaaaccugucucuacuaaaaauaccaaaaaaaugagccgggugugguggcgggcgccuguagucccagcuacucaggggcugaggcaggagaauggcgugaacccaggaggcggagcuugcagugagccgagaucgcaccacugcacuccagccugggcgacagagcgagacuccgucucaaaaaaaaaaaaaaaaaaaaaguucugggaucacaggcaagagccaccaugccuggcugccuuguacuucuuggugucccagcuguggccugcccacugcccuagcaucuaacaugcccuuccccucccaucucugucuguguguaaucccauccaaccugcaggcucuggaaggcccccuggccucaggaacaccagccagguggaagagacaguggcagaacgggagcucucagcuggggucuggcuucacugccagguggggacuuuugaggagcugucauuccaaugaacacacaggagaggcuuccccaagcugugaauagguagagaagaccaggaaaguguccccagcagagggaacagcccaggcagaggcagggaggcuggaaguaugugcuggguucagggauccaggaguucucagguguggccagaccucacacacaugggcugguaggaugcaacagaaagagaggccagguccucaucacagggaccuaaaaugccaggcuaggcaauggacuugacccucugggcuccagagaauucucugguggcucacagugcccagcacucaaagcuuugcagccaggccuuagaagcugggucaccuugggcaaguggcuguacuucucuggaccuguuuccucaucaguaaaaugggcugacagagaugugugaggagcgaauagaaccucaguucuccagggcgacacggacaccuuauguuccgagccccuccgccugcccugcccuggaagccagacugcagaauguagcccacgcugugucugugggaaacaccuguuggccugcccccuuccuggcuccccugggaguucuggagggcugcaucucaccuaccucaguuucccucauacugaggugcagccagugagcaccccauuccagaaggugagucacauggcacaagcaaagccucuucucugugugcagaugcaggaccugcaggacauuuugccucggucuacaacccgcuggccuggacggucaccaccaucgucacccugacuguugguuucccuggaguccgcgucacagaugaggcgggccacccagugcccucgcagguauggacacaaaauccugcuggaggggccuuagcugcuugcugaaccugcucugggccgggcacauugucucuucugacccugcaagggaggccuuaucaccuuuguuuuacagaagaggaaacugaggcucagagaagcaaagugggguuuuuuucccaacaccacccaauucuccacuuuucugacaccaacugaguguccuaaaaucaauucauuccugaauugaguaccuggagugagcacagaccccacgaguuaggggcccaaaaucucacaagaccccuaauuucagacaccagccacaaaugggguuccugggcuaccacacuuguguccugcugacugaauucugggguucccaugauacacacacacacaaguuugauaauucauuagaacagcucacagaacucaggcaagugccauacuuaccaugacaguuuuguuagaaaaguuacaacuggcugggugugguggcucacgccuguaauccaaacacuuucggaggcugaagcggguggaucacccgaggucaggaguucgagaccauccuggccaacauggggaaaccucgucucuaacuaaaaguacaaaaauuagccaggcgugguagcaugcacugguauaauaauugggaggcugaggcaggagaaucgcuuuaaccuggaaggcagagguugcagugagcugagauugcgccacugcacuccagccugggcaacaagagugagacuccaucucaaaaaaaaaaaaaaaagaaaggguacaacucagggacagcugcagggagcacuggugagguggaagcagggagggccuagcaucccagcccucuaacccgggcucgcuuccuugggagcagccccauccugaagccaccuaugggccuugccagaaggcaccuccacagcauaagcucagauaagguuggaaggggcuuguuaugaacuuuagaagacacuccuaucacucaggaaguuccaaugguuuuaggagcucuguggcaagagcugcagacaaagaccaaaucuaucuauguuuacuguaccacacagagucccugaggucacacagcugcgagguggcaaacucccaaccuccaaaccuuccuuggucaaucaaagccgugguucgagugaaagugugacagucugcccuuguaggaagacaucacccagggacacacagccguugaggggaguuggaucuacccagcggacugauacugggcuuggggcauccaauguggccagaagccgagggccaucugugucaucaucccugucauccccucaugcacucggaggccugcugagacuaagggacuggucaaagucccccagugaggaagagguggagcaggcuccauauucaagcaccaccagccgugagcugagccuuccccugcacccaggccuugcacugugcccagcacuaauggggucacgcuaugggagauaagggccucaucugucgcagccugcuugggcugcuaugacaaagucucauaggcuacauggcuuaaaugacauacauuuauuucucacaguucuggaggcaggaaguccaagaucaaggugccagcauggccggguucuggugagggccucuuccugcuugccaucuuccuguguguccucacauggcacaagaggccaagggaacucucugaggucuuuuuuacgagggcacuaaucccauucuugagggcagcacccuccgaccuaaucaccuccccaaggccccacuccuaagugaugacuuggaauccggacgucagccauuugaggggacacagacauucaguccguggcaucacucaugccaagugggaguuaggagguggcauuagccuuucaacuguugugcccugcuuacacuuuuuaaaacaauuuuuacugucaguuuuccuuuuuuuuuuuuuuuuugagacaaagucucacccugucaugcaggcuggagugcaguggcacaaucacagcucacugcagccucaacaucccaagcucaaguugauucucccaccucagucuccugaguagcugggaccacaggugcacaccaccauacauggcuaauuuuuuuguuuguuuuuugguagaggcagggucuuacuauguugcccaggcuggucucaaacuccuggccucaagcaauccucccaccuuggccucccaaagagcuggaauuacaggcaugagccaccacaccaggccuguucacacuccuguuugcugggcccccuuguaugggcugaucccuagaaaggccucacaugugggaagcuuuccgucacuccccugccuuugggaauauuugugaucuaauaugaauuuccacccuggcaugugggaaagccuucaggaaucuuaaaggggugcuuuaauggaggugccgauguuagguauggggcuggacugcuuuuguccacaccacccagacaccccacaugggucaggccaacuccgguuccagagggcgccagacacgccacccagcugacccuucuuggggaggcggaggaggggcugacaucacucauucacucagcaaagcucccgaacgcccauccugggcccagcccugggcugggugcugggccccuggaccugagcgaggccaggccccaucccaggacacagacauggauggugacaguguggaguggugacucgggagccaggggaggggcccucggcuggaacugagaccgaggaggaguuuguccagcacagggagaggcgaagggaggguaugggucugagcagacccccacacacaccccuuccccacucagaugcaguauccguuaggaguagauucccucagcauacauuucuggagcuccuacugucugucagccccuguucuaggcgcuggggaugguguacuaaccaaacagacaaaaucccacugccuggggcaucuauuccaguaggggagacaggugauaaguaaaauaagaaaaauauggaauaugauaggcgaugaccaccgugagggggacagucacuacagcaaguugcaggggcuggggacacauuuuaaauaggugggccaggccgcaucaaugugggaucaggcagacagggaacagguaucugcuguauuugggauaaaggcugggucgggaggcguguacaccauuauugggggggccuccccacuggggcacaggaacugagggggcacagugcccuccuccagccucccucuccaaaucagacaccuuggaggugagcagaggccaggaggguuaaccuggaaaaguccguccacguggggaugagaagauugggggauggccccucccaggagaagguaguccagguggagggcacagcguggcacaggcucagaggcaggaaacggcaggagugucaggaaggaaggguuggugaugcuggagccccaagggccagaggacagaguaaggucaccgcagggaggaggcugggucccagaggaggcuuccuuccccaguugcagcagacaagagucucgaaaagcuugcuuugguugcugcaguggauggguugguaggcacaggaguggauguggggacagcagugcagaugcugggcaguuaccuagggaggggccacagcagcugugaccaggcagaggccacagggaagggagaugaaaggccucaagaaggcgguggggggccuugguggugggugggaguggcuggaggaugggggauggggauuccugggggauggggaaggggagugacugagggaugggaugacuaggggguagggguggagaaagccggacagcggggagcagaaggugcaggguaggugcuggaagggccaucguuggauggggaugcugcagggagcagauuugggugggaugggguagcuggugaggucagcuguugacauccacguggaggcgucaaacaagaagcuguauucguggaucucggguuccagaagaggucaguggauuuggguuugcuuuugggagucaucacuuugguugaugaaggaugauuaaaggagcuggggguguucaggagcucccaguucaggaggugggaguaagagaagcuuuggggaccccaagaaccagcuaucuucaggucgcugaaggguucucccaggacugaugugguuuguggggguccaaggggagaaagccagaacugggggcagggaggagaaaucggcaggauccgagagauggaaagacacugcugccucagcaaguagugagcaccccauuccagaaagugugagagcugacaguuaacaagucucauccugcuggccuugcagauccagaacucaacagagaccccaucugcguaugaccugcuuauucugaccacaaucccaggccucaguuaccggcacuacaacaucagacccacugcaggggcccaagagggcacccaggagccggcugccacuguggcgagcacccuucaauuuggccgcaggcugaggagacgcaccagccaugcgggcagguacuuggugccuguggcaaacgacugcuacauugugcugcucgaccaggauaccaaccugaugcacagcaucugggagagguaaggugcagccauugcugucucugaggcacaggcaugccuggagccugggcaugucaggccccuaccuggauucuccauuugcucacuugccugggggaaggacagaugguggugaaaccccuuccugcuauugugaucuuuaauuuuagaagugugagccugggccagugcaggaaaggcuuucuuauacuuuuucauuccagggcuauugauccauagaaaaaaaugagcacugagggacucacucugggaaaaaaaaauuaccacuuuuuuuuuaauuuagagaaacauaaaaucucuauucaguaaauaguguuacugucuuuaaagcaggacgggacuuucaaaaucaucuaaucccacccacccaccugucuacuuacccaucuauucacccacccacuuaucuacccacccaguuauccauccauccacccaauuauccacccacucauccauccacucacccacuuacccauccauccauacaucuaccuacccacccauucaucauccauccaucuacccacccaccuauguaccuacccauucauccauccauccacucacccaaccacccauucauucauucauucauucauucauguauucauucagcagcuauuuguggacaucagagugggcagcugaccucccaagaaagaccucguggcugguuuauccuuccuaggccacguccgguggagucuucaucaggcccagcugccucugccagaauacucaccuugucuccugaugugaccuucuaauggagagggguacauggcagaaagugaggggacaggaaaggggagaggggagacagaaaaagaggagggagagaagaagggagaggggcauuuguacugagguggguaucaggggagcucagcucaaggucacugucagcagcucccugcccacagagcuccaggacuucucugggaauggggccccagucaggucuguccucaucuuuccccaguggcuccugagggaaaguggggcaggugcaggggugacagcagccagcauggguggcuggcaaggggggaguugggcagaggagcugcagaaaugggagaaaccccagcaugguccaagccugccagguuaggccaggagaggcagaaugugcccuguccguuccucacucaggccccaugcccccucuguacaugccccuuagggcagcccacggaccccacaugccuaagccagggucccacccggcauuuccagcacuggagcucaggcuguccugucccguuuguggcccugucugucucucuuguuuugaacuccagugaggacaaaggaguucuuauugggcucccaaaaccccaccagggguaagccuugcaaaaccagugccugucaccugagcagaaaggaggagcuguugguauucagaguaggggccaucgggagacgacaccuggggccaggccccaggccucgaagggcauaggggagguugcuccauaggaaggagacagccugugcagaggccuggggugggaagccaagggugcagacaccaaccccagggcaguguggguugaagggagcgcuucuguuccuuauguaacagcuugacugagaugcacuucacauaacacacaauucacccauuuaaagugggcaauucagugguuucuggugcauucacagaguugugcagccaucaccacaaucaauuuuagaacguuuucauuacuccagaaagaaacuucaugcuguugagcaaucacucccccacgggcccuggcaauccuagacuauuucugucuauauggauuuaccuguucauacaauaugugguccuuuugcaacucacuucuuucacuucacauauuuuucccccuuuuuauugauugauugauugauugagagagucucacucuguaaucuaggcuggagugcaguggcacaaucauggcucacugcagccucaaccuccucuggggcucaagugauccucccaccucagccucuugaguagcugggauuacaugugcauaccaccacacccagcuaauuuuuguguuuugcagagaugguguuucaccauguugcccaggcuggucucaaacuccugagcucaagugauccaccugccucagcuucccaaagugcugggauuacaggcuugagccaccaugcccaacccacaacccacuuagcauguuuucaagguucaucaguaucguagcacguaucaguacuucguuccuuuucauggcagaauacuauuccaucgcauguauguaccauauuuuguuuauccauucuuuaguugauggacauuuggguuguuuccacguuuuagccacuaucaauaaugcugcucugaacauucauguacaaguuuuuguguggacauacauuuucguuucuccuggguacauagcuaggaguagaauuacucagucacaagcuaacucuauguuuaacucuuugaggaacugcccgaccguuuuccaaagcggcugcaccauuuucuguuccucccagcagcagaugaggguucugauuucuucacauccucgcccacacuuguuauuuucugucuuuucaauuauagccauucucgugggcgagaaguggcaucucaugaugguuucgauuugcauuucccugcuaacuaaugguguugagcaucucuucauguacuuacuggucacuagcauaucuucuguggugagaugugucuuuagauccuuuaccuauuuuuaaauuggcuugucuuuuauuauugaguuguaagaguucuuuauauauucuagcuacaagucccuugucagauuuaugauuugcaaaucccuccucccauuccauggcuugucuuuuuacucuuuugauggccccugggggagcuuuuuaaaaggaucgugcggggaagggguccagggccagaggccucaauucuuuucuuucuccuccuccaccagcacucaguagaacccuccacagccugccucccuuuccuuccccacccucaccacaaucccacagagaagugggugcagaggccauccaccucauuguccgcccacagccaggccagacucagauacaaauacaucacuugugcacuugguuaggccaaauauugcauuuuacaauuaaaauacuugacccccuccugcucuucucccauccucuguccuaacacaaacauccuaauagaagggagggagcacagaauuuaaagucggggcugaauuugaguucuggcuugcacacuuccuagaugugugaucuuggguacaugaugucacaacuuccagccucggaugccucgggagugggauggguuaacagucccugccuuuggggguugggagaauuuaaccaggugaagucagugaaggcucuggcccaugacauggggucuguacacauggguguccugcuggacagcucagagucagcaugacaaaagcccguuccugcacugguuucgcuugcagaccacagccugggugagccaguuccaucucuugggggugcccucugcugacggcucacgguuccugucugcaggcucuguccgucuccucguuugugacccauucugggacagcauggagucuaaggccacacuggcuguggguggggucucagggcuucuagaugagcugagucacauggccucgugagugcuacgcaggccacucagauggcaucuggagagagaggcuugccagccggugucuguaagaccuugugcaggaugagaaugacaucuucucucuccugccucugcagacagaguaaccgaacggugcgcgugacccaggaauuccuggaguaccacgucaacggggaugugaaacagggccccauuuccgauaacuaccuguucacaccgggcaaggccgcggugccugcgugggaagcuguggaaauggagauuguggcgggacagcuugugacugagauccggcaguacuucuacaggugcuuccccuggggugacccccacagcccggcacacagucagcgcacgcgugcaggcagcucagugaaugagggucugucuuugcucugaaccccagcuuccgggccgugguugacacguggucugaugaagaaaugaauugcucuggugucugcaugcuggcugcguuugcgugugcugugucacguugguugggagcuaaguucagagcugggagagagacccacagacccuggggcccacagagcaccuguucuuccaugaucagagcagacguaaggcaggcccggcauggcagcccugcggugucggggaaccaggcugcucccagccgcucgggguccuggguggugcuauuguccacauggcccaagaaggcucccugccuuucggcguacccugcccugcccacccugcccacaugaaggaagggaagcaaaaaggaagcaucuagaagguuccuggagcuucacuuacugaugcucccuucuccuccaggaacaugacagcacagaauuacacguaugcaauccgcucccggcucacccaugugccgcagggccaugacggggagcugcucugccaccggauagagcaggaguaccaagccggcccccuggagcugaaccgugaggcuguccugaggaccagcaccaaccuaaacagccagcaggucaucuacucagacaacaacggcuaccagaugcagcggaggcccuacguuuccuaugugaacaacagcaucgcccggguauguccugcaaugcccacaaggcacgcucccaauggcgccuuuccuggacccauuaagcaucaaauugcagcaguagaggccaguagaggccuccagugagaauguuuuuuuccuuuuuuuuaagauggagucucacucugucacccaggcuggggcgcaauggagcgaucuuggcucacugcaaccucugccucccagguucaagcgauucuccugccucagccucccgaguagcugggauuacagccgccugccaccaugcccagcuaauuuuuauauuuuuaguagagaugggguuucacaaugauggccaggcuggucuugaacgccugaccucagaugauccacccgccucagccucccaaagugcugggauuacaggugugagccaccgcgcccggccuccagagagaauucuuuuaaagccuguguaucugcccguucagggcuugagcgugcaggcugugagucagacuggugucugaauucuggugcuaccacagacaagaauaguaugugccuuggcuugugccucgguuuccucuccuguaaaauggcuccuucaucaaagggucauucugaggauccaugagaugaugcguggccagggcuuggccagggccugcacccaugucagcugagcuguaugcuaggaagccacagagcuggugucugaaccccagucuguuggucuccaaagucagggucccagccccaugcugcugcugugccuauggggagcaccagcugggguggccagagggugaugccugaccuaccuugcccuuugccccaaucgcccaccuggcgauguuucugucugcagaauuacuaccccaugguucagucggccuucauggaggauggcaaaagcaggcuuguguugcugucggagcgggcacauggcaucuccagccaagggaaugggcagguggagguaggaggcacggucuguccuacagcagccccucgcggcccccuacaggcaugcccaggugcaagccgggccucucggacaaugccuucccgcaggucaugcuccaccggcggcuguggaacaacuucgacugggaccugggcuacaaccucacgcugaacgacaccucagucguccacccagugcucuggcuucugcugggauccuggucccucaccacugcccugcgccagaggagcgcacuggcgcugcagcacaggcccguggugcuguucggagaccucgcugguaaaggggcacccuuucagaguaacaucaucacugccucagcaccagccaggccagggcgggccuugggaggggccugugcccucaugacucugggcagcuuuugggcaggaagcgaccucagggaccucuagcccaagccccucauuuaacagaugggcaaacugagggcaaacaguggcucacuuaaggucauacaacuaggagguacagagcugggacucacccauuucaccauaugccucuucccuguaucuucuccauuuucuucucugauguaucuuuuccuuucuuaauaugacauuaugucaccaugucacuuuaggucuggaggcuuagcauuuaaaagacugguuuguuagcugggcaugguggcgcaugccuguaauccuguaaugccagcuacacgggagacugaggcaggagaaucgcuugaacccgggaggcagagguugcagggagcugagauugcaccguugcaccccagccuggguggcaaagcgagacucugucucaaaaguaaaaauaaaagacaaguugggucugaaucuaggugugcugucaccaggugggggucuuucuaaucuauagucuaaccuaaaggacuuauucuguaccuccacugagcuucuguagaucagaucaacaaccauguaguucugugucucuauaaaguagcagaacaugagaaacauuaaacaaugauuacauuuaaagauggucuuuuggagcugcaagaccuagauacaauuugcugccauucucacuaauccuuaaacucuuuucuuuuucuacucaccuauggagguuuugauuagcaugugcuuuuaagguucucccugcuuugguuuuagagccagaacccagggcaguagccagcaggcaggcugucacucacccaugcaacaagcauauacugagcacuugcagugugccugugccauacacuggagaugcagaagagcagcccggacccaggagaguuuuccugggcuguuggacaggggaggcaugcucguauagagccaggauucaggguggagaaggagccaugccauagagggccugguguuucguggguguagaggagugugagaccacagcugggaggaggucagggaucagguccagggggugucaauuaagguucuuuggaaguaacagagccugaaggggcagcuauuugggcagagccuggagaagcucauggaaucuaaggaggagcuggauacaagguccagacaggcauggggcagggcagcucuaggcauaucaggagcagaggcucacagccaugucucccaggacggccauugagccaccucugguucccuugcuucagauucccagaagaggaaaucugauuggccuagcagggucagguucugcucccagaccagucagugguuccuucuguguagcuggggcuuuuccugcaaagggagaugaggccaugucugagaaagccccauggcuguugucagcuccaucccaccuggccucacucuggucucuguugguugcaaguaacggaaacccaacuugaacuagcugagcccccagggagaguguauggugaggcccacauaaccaagggaagggcaggguguaauugggccucagggccuggagcccucgugaggcuguccuuguucgucucucaccugcacuucucucugucugcagacuuuccuucaccucccaccugggaugugacucugaacagcucuggggcugcucucaaagagcagcucugucuuccccacucaaaaggaccuaagacuuggacuuuccaguuccaagugcaaaaguccuagggaaagauucugauugguccuacuggggucagguggcccaugccuggaccaaucagcauggccugggguauuguaagaagaugguagcuccagcugaacaucuagaccugaaaggaguaggggcugaggugccuucugagcagagagaccaguagaugacaaaacagggguggaacuggcaucccagaucuugaguagaaaacaggguucuggccggacaugguggcucacacuuguaaucccagcacuucgggagggcaagacgggaggaucucuuaagcccaggaguuuaagacuagccugugagacccugucucuacaaaaaaauuuuuaaaaauuggccagggugguggcccauagucccagcuacuugggaggcugaggugggaggauaguuugagcucaggaguuugagacugcagugagcugugauugcaccacugcacucuggccugagugacacagcaagucccuaucuacaaggaaggaaggaaggaagggagggaggggaauggaauggaagggaggggaggggaggggagggaaaagaagagagggauggaaggaaggaaagaagggaggaaggaaggagggaaggaaggaaggaagugagggagggaggggaagggaagggaacggaagggaggggacgggagggaaaagaaaagaagagagggagggaaggaaggaaagaaggaagaaaggaagagggaggaggaaggaaggaaggaaggaaaaaagagggagggaggaagaaggaaggaaaaaaacgaaggaagaaaggagagagagaggagagggcugugccugaacuugccuuguuaucuugaauaagcuuugugcccucugagcucuuuccucgucucuacuuugagaugguuaggcugaggagagucaggguccucccagcucuuaagcucuauggucugagcaaaggcagggaaguggaggccuggggcauugggagcacaaacacuuugggcuggugcgggguaggcuacccacaaggaugcaugggaaguggcuggcaggggcaggggcauguaaugugcagagcucugagugccaggaggaggaguugagccccaaacccucuccucacucuguccaucugccuugcagggacugcgccgaagcucccaggaccccagcagcaagaggccgugacgcugcccccgaaucuucaccugcagauccugagcaucccuggcuggcgcuacagcuccaaccacacggagcacucucagaaucuccggaaaggugaggcaggugcccuggcgucucagaccugcuccucccucccugagucaaacaggccaccgggcccaccaccagacaggggcucaccuuagagcuaucauggcucugcaaggucaccugguuucuuaucuggcacauggggagagugaggcccagggagagucagugaucagucacuuggcaagcuggaggcgaggugggccuggcccccagcccugugaccccagcgcauucugaauggaucccucucagccugccacccccagcugagacuaaggaacuaguuaaagucccccugacccccagguugccugccaguccuacuucuuccagggaaaccuccuggagcccccaaacacccaaauucccacucauccuccaaguucaggcagccuaacucuugggaguuuccacucacucauucaacagcacgucucgugccaggcuccggggaaugagcaaugaccaaggugggcaagguccuggcuuucugagcgcuuggucuagagcagaagcaaucaagucaccaggcaguaaugacaaggacaagaggaaucccccugcacagcaugauggggggcuccccgaggaggcgacaccugcugggaacugacuuguccuguugccagagccccagcugcaccuccucugcccccucuacaccgugagcaguggaaaggcagggucagacugugccucagccauccucagguccccaaggccuggcacaccugcagaauuaagaauacgaggaaaaggguggggcgcaguggcucacaccuggaaucccagcacuuaggggauccgaggcaggcggauugcuugagcccaggaguucaagaccagccugggcagcauaggaagauccugugucuauaaaaauaaaaauagaaaaguucucuggucaugguggcgugugccugagccugcuuucccaggcaccugcagccgccuugugaaaugggaucccucaccauuccugcugugugggacacaggaggccuucccugacuuuggagcuggaacuccucaccaccacaccaggagauguagaagcacuuucacaaaccucuuggcuuuugugaucuugggcagucauuccccugugccauucugaaaaccagcuaccccauagccccaugauagcuucuuaaaaaugggccaggcaagguggcucacaucuguaaugccagcacuuugggaggccgagguagcaggaucacuucaggccaggaguucgagaccagccugggcaacauagcuagacucugucucuacaaaaaaaaauuaaaaaauuaggcggguguggugaugcuugccuguggucccagcuacucaggaggcugaggugaaaggaucacuugaggccaggaguucaaggcugcagugagcuguaaucaugcuacagcacuccagccugggcaacagagcaagacccugucucuaaaaaaauuuuuuuuuucuuugagacagagucucaaucuguugcccaggcuggagugcaguggugugaucuuggcucacugcaaccuccaccacccagguucaagcaauucuccuaccucagccucccgaguagcugggauuacaggugcccaccaccaugcccagcuaauuuuuguauuuuuaauagagacaggguuucacugugcugaccaggcuggucucaaacuccugacagcaggcaauccgcccuccuuggccucccaaagugcugcgauuacaggugugagccaccacacccugccaaaauuuuuuuuuuaauacugaugccucaauucuaaucccagacagauugauuuagucagcuuugaggcauagcugcagagcugagguucuaccagccaggguuuaggaagcaccuguguuaaccagguccucucuccaggaccuugaacucagugcuuuccucugagccucggucuucccaucuguaaaacgggagcaauggcaaugagccuuucugagugggaagaucagggaugggacaggagaucacauacaucauguggcaaaugacagcauuauaucagucaggguggcuggcguaugcugcaguaacaaagagccccgaaugcccacggucuuaacaguauauauucauuucucccccaugcugugcauccagugggguuagcaggaagguuuuucuugcuguggccaccacgccccccgcugauggaguuuguauugcagcacgugcuuccucacucaccauggcaagaaaaagcuucugccgggaaguacugcgucacuucagcucacuuugcauuggccacagaggccacgcagccuccccugacuucaaagggggcaggguaggagagacuggaguauuugaggacaugccccaauaugcccacaacaguggacgaggauggaaacauugcagcuggugucauggugggcagccuuacagucggccagaccugggugggaauccucccucugccgcgcaccagcuguaugccuugggcacgugacugccccucucugagccuugguuuccuugucgagugggggccaugucagcugucucacauggagucuauuagucuguucucaugcugcucauaaagacauacccgagacuggguaguuuaugaagaaaaaagguuuaauggacucacaguuccaccuggauagggaggccucacaaucauggcagaaggcaaaugaggagcaaagucacgucuuacaugguggcaggcaagagagcgugugcaggggaacugcccuuuacaaaaucaucaggucucaugagacuuauucacuaucacaagaacagcacaggaaagacucacccccaugauucaauuaccucccaccaggucccucccacaacauguggacauuaugggagcuacaauucacgaugagauuugguuggggacacagccaaaccauaucgaggagguuacagauaggaaauggagcugaguguguaaagcagcggguauagaccagggacauugggguugguugaugagggucuucacugccaccuuccuucuguccccaaaggccaucgaggggaagcccaggcugaccuccgccguguccugcugcggcucuaccaccuauaugaagugggcgaggacccaguccugucucagccagugacagugaaucuggaggugaacuuccccacccccauccagaccauaagccagggaagcaaacccuagaugaagccccaagaaacugccuuggcaaagagauccacgagggcuuccucccaaauggacgcugguaugggccccaccccgcccuucuucauggucuucuggguuugucagguauuacaacuggccugguuuuuuaggguuuuuuguguauaugugagacaggaucucacucuguugcccagucuggggugcaguggcacaaucucagcucacugcaaccucugccucccuggcucaagugauccucccaccucaaccucccaaguaacugggaucacaggggcgcgccaccacgauggcuaaguuuuuuuuuuuuuuuuugagaccgaguuucgcucucgucccccaggcuggagugcaauggugcgcucucagcuggcugcaaccuccaucucccagguucaagugauucuccugccucagccucccgaguagcugggauuacaggcaugugccaccacgcccggcuaauuuuuuuguacuuuuaguagagacaggguuucuccauguuggucaggcuggucacgaaccccugacuucaggugauccaccugccucggccucgcaaagugcugggauuacaggcgugagccaccaagccuggccuaguuuuuuuauuuuuaguagagacacggucuugcuguguugcucaggcuggucucgaacgucuggccucaagcaaucugccugucuuagccuccugaagugcugggauuacaggcgugaguggccuguauuuucuuucuuauuuauucugugguaaaacuuuuaaaacacagacaacaucuguguaauccaaaaacaaaacagauuccccauagaguugcuuugaaaggugacuuagagucagacaauccaggguccacacccaggccccucuacgggggcaucuccggcaccccaugccucugggccucaguuuccccccauguaaaauggggagaggugagaguucuuugcccagaagguugcugagaggcccuggcacuaaggggccucgugcagugucagggcccccaggccucguccccuuccagguuccccucuuggcugauguugcccucucagcucuacuaucaggcgaggcuuccgccaccuggccugcccacgcucccuccccagaaggcaugaccugagccgccucauuucuuucccaguuugcauucuuucuauuucauuuccugcucauggagaauuucugugaaucucuguguuucugccuugggccuccuucgacaucugagucuucaggggaauccagagaagccccaguaccuuuucgccaugaugucuuacugggccacccaccuccucuuucaugauccucgccacggaggauccuuuccucacggucccuggccugccugagagcaggucuaggccauggcggguaccagugcccagcacagggccagccugcccugggaagcaaggaggccagcgugggaccuggaaguuggucaucugaugcucccccguuucacagauggaagcaccaaggcccugagacaaggagacgguugggauggacaccaugacucccugcccaacguggacgguggugggguggaaagaccauugaguuaggaacgcagugaguuuggcugcaagucacaaaacaccuaacagaugugcuuagaacagaggacagaguguuuucucaccgaacaggcauguccgauggaccccaagcgcugucaccgugggcccgaucacugucaucuucccgccaucgccggcagacuggcuuuugucuuuugccgucugcuuguuugcggucacaagauggcacaggccucccucaugagcaaauuucaaggcaggguagggcucagcaguaguggccagaaaggccuugcccuagcguggcucucucccuccgucagcacacagaagcuucuccaagagccacccccagcccuccugcuccacagacuuuuccagaccccuaagggccuccugccuccccuagguguaagggaggcugggacaaggccuauugggaaagggggaugggguaacuguggcuggcuuccucccuggacugggcacggggccaccugagcaauguggggagaggagaacuccgcgguggggugggcagcucaaaaugccacaccucccgggcugcuccuccagcucggccaccugguaaagcaugcaccucccgcuucaguguccucaucuguaaaguacacggccaguccuguccucgcagaugugcugugagaagcagaugagggagcugugucaggcaccaggggaggaccugggcuccugaggacaccgaguucguggugugucugcccugcugcugucuugguucucugcucagcucuggaacuuggugcagcucacucucccucugcuccucucccugcaggcugugcugcaggcgcugggguccgugguggcaguggaggagcgcucgcucacagggaccugggauuugagcaugcugcaccgcuggagcuggaggacggggccuggccgccacagagguuuggggacccccgcuucagcucccuacccaggacucccagccaggcucagcagcuggucagacccggugcacauccaaccaucugccugucccggccugugcgaccuugcgaggcugcuuuccuacucugaacccgcagcccucccaaaucuacuacagucgguuaagaaaggcuuuggguuagucucugccugccagggcuccacacaggcgugugugugcacuuguacgugugcacacgcagaccacacgcccugccugugcccugggugacagcuaggggcccaggggcuucugcccaccuuggcccugcugaccucagcccaucagccggucccugccucauacgacaugugccaccgugagcuccugcacuacaggcagcuuccaggcuccacucccuguccgcaccaugcccucugccugggacgcacaggucccauucacucuggccagcaccugcucaagcuccccaggaugccuccccagagucaccaaccaggccaagugccuccuccacucuccuggccccagggguuucuucuguccugugcagcucguuguccacuacacacagcaugguggcgggugcauggugcacgcucaguugguggugggaggaaggaagggacggagggagggagggagggaagaugauguugguuggaaagaaggaaggaagauggaugagugauagauaaguggacggcucccucccaagaucgaagcccaaccccagggcaugccuucaggggagccuggugaggcaagggcagacucaccagauggucucagaaagcucuugggcuuugagggcaacacccaugaggaauugaggccacuagggccaggaccaaccuaugaauugcccucagggugggcagaaacgccaagaggcccacaggaguccuggcagaaggggaugccauaggccguugccacggugggagccacagcagacuguagccaggugcaguguggugagaaggaggcugggagccacagcagauuguagacaggugcaggagggugagagggaggcugggagccacagcagacuguagacaggugcagggggugagagggaggcugggaggaggcaucccaggccacacuggacagaucaccucuguuccccuaggugacaccaccucucccucgaggccaccaggaggccccaucaucaccguccacccaaaggaaauccggacguucuuuauucacuuucaacagcagugagcccugggcagaugccccggccccagggcuucccccaggaacuccauguaacagaacagacccaggacagggaaaagcagugcggagggaugggacuggggagucagcugcucaucugcaggcuaauggcaggaaauggucauauuugggguuuuucccuaauuuuuuuaaacaaaaauuacauuacaagauccagguucuucccccccacacucaaucaagccagcccucuccucu

SEQ ID NO: 14324 - RNA, 124786 nt, Homo sapiens
cguugccggggggaggcguguggggcaggaccaguccuucagcggccggguucgcgccgcggucgccggcugcuuacgugggcgggccuaguguggggcugagggugcgggucgcuauggcgguggacaucacgcugcuauuccgggccagcgucaagaccgugaagacgcggaacaaggcgcugggaguggcggugggcggcggggucgauggcagccgggacgagcuguuccgccggagcccccggcccaagggcgacuucuccagccgggcccgcgaaguggugagcugguugcuauggaaacggcggguugaggagggggcaguccugcgacagggaccccgggccccaaaccagaccccgucccguaagcauugugugaaggggguggcucuaagggggacagaagaguuggccucagagacccuacagcuuuuugggggaaggaacagccuuauuuugaggaagggggacgcauauuggggaacagauuucuccugcggcgacagggauugggggacaagaaaggagauccucagaaaucucuaucuggaaagugcaugggcggcuuugugaggucaugaguucgccgucacuacagacuugcacucaggggaaaccuccugacaguccuucgcuuccuguugcagcacugaccacaccauauuugccuguucuauuuacuugucugccucccaccccuaguugagauuaaaaacuguauucagccgaacucuuucuucccuuugucucugcaauaaguaggacucaguuccucuugagacggguuuaggguaaucuuucgcaaacacaguguuacagucaccucaacuacuuucuguucccugaucagagcaggugucccuucaucucccugggaacaggaaccuuuuccuuaagggcagggacaguguuguuuucaucucagaaugcaugacucauagcauugcuuaguaaauguuuguugaaugagugaaugaacaaauggcugucuuucccauuaaacagaaaacuccauaaggggagagcuguuugucuuguucccuuuuguguucgugacaccaaggagguaucuagguuuuguggggccuacagcuuauauaguucugucugcccucuucaagaaauaaaaaucaccaagaaagauucagagcuuuggaagauugaagagagggacccuaaagcuuaagccucauuaauuucacaguaaauccuucucugcuuggcauacacuuggcacuguauagacacucagauauuuuugaaugaauguagucaugcaugcauuaaugacaguuagcagaggauacuuaaacauuagaaaggggauuggaccagaugaauacacucgcccuauugaugaccgucuaugaagcaccuaccuucugaccagccucguguuagaguaauaugauguaaaagcagugguggaguagacggacauagacauaaaacaagugccauaaagccuugcagguguuguguagggcacaaaaagaauguggucaguucuaccugaggaccagaaaaggcuuuauagaggcgaugaugccuaaaacaaaucuugaaagaggauuaguugguuccagugcagaaggacaucucaggcuaagagaauaguaugcgcuaagcuguggagguagguaacagucugacauaaguugguucaauaaacauuugagugagacuggaaugugggacucucauaaaaauuggacgcggagaucuuaaagggcuuuguguaucauugcagaguuugaauuuugcccuguagauggucagauguuaucugguagagaaagcaccagagaaggagccaagagacgagguuguugucugaacccugcaacuauuagcuauaugauuucauuaagcaaguuuuaagaccucaguuuauuuaccuguaaaugguccuuuuuuucuccuccuccuuuuaaaaaacuaccuugguccucuauauguaacaaauuaaagugggagcuuccuagguugaaauaagaggaagagaaacaggacacucucccucccaguuuggcccaagcacuucuugagauuccuuuuguagaacugugguaugaauaucacaguauuggcuuuuuaagggucccuucuaacucugaaaccacugauuuauuaacacugugcuaauuuugaguccugcucagggaaaggggggauuugggaaugguagagacaggaggcacaguuggguuggcaagcccuuuggagagcccugugaucacuuccaccucucccugaguggugaaaauguguuugaguuuugaguuaaugggccucagggacaguaacagucccauagggugcugaguucccugucacuggaagugauuaaacagagugaugacugcuuuucagagauguuugagaaaagcuuugugcauaugucacaggguuggaccgcaugacaaugcaacuugcaguucugcuauguauugaugugaguaggugucacaucaccuuaagugaguucaugggcuguguuguucagggacacugucccccugacguagaggaaacauacauucuuuuaagcaauuuugauuuuauguugucauugcuuuguguauuaucuccuguucuugcaaccguuccccacuccccaucuucucuugugggaaguuuaacuagaagagcuagugauggauguccugugcuuuuacuacaauuagaugucaaaaguuuggcuguuauuuuguuuggccuggauuccuuauagagaaaagucugguaaauaccagaagcacauauucuaauucagguuuagcccugguugucagacuuaaugaaauguaauaaguuauaguaugccuuuugguaagugccuuccuugaagcauuugcuguuacuucuaggaugcguuuuaucugguucaauuucuauucuuccauuccauuccucaaauauaugccugaugccagauuuccaucucacugaauuguuguagagguuauauuaaguugaauaaaauugcauugaaacugcaauuuuauugcagucccuaccuuccaacaacaggcugauugcuucugcaucauucuuuuaaacauuuaacuuuuaugcucaauuuuacuaaauuuauauauacucaaaugcaugucuacccauuaaauuacaaauggagaguaacgacuuuucagauuauuugggggaggaacuuauauuauucgaacaacuccaaauaauaaugaauaugucacucugcaaugggaauuugauuaguuaacucauuugaagugugggacuagugaggaugaugggauuggaaagagaccugggccuuggguucaaaucucgcuucugcuacuuagaaaugggugaacuugggcaagucugacucucguuuuccauuucuauaaaguggacgugauaauacccuacuuaacucacaagcuaaguaggguagcuucugaguuacccuacucacauagucuauauguauguauuuuaaaaaaacagacugauuauuauuguucccccaaacuaccuccccccuccucauguaggccauuuagacauauuuucuuuaguggcaccaagcuguauuuuccaaaccacuuaguuuucuugcacuuucauuccuuaauuuaguuaagugcgugaggaaugagugaaaauccugagcagguacugaugaaucagcgguggugcagaaguacugucugcauucguaaaagaugguaacauuucuuugccaaggugaaacucuuucagugauggcagauguguggcagguaugcagcuuuuacuuucuuuucuuccuugugaucauggaagccagugcuaauuucuuaguggaucccuauagcucagaauccuuugcaacauuguaccccaggagccguuaccuguuauuaggcuugacauucaaguugaaaucuacuugacauauaguaacaguagaaucuguaugcuuaaagcagacccauguuuguuuguuugugguuuuuuuuuuuuucacucaaaaggaccuuguguucauuuuguuaauagauaagaaaacuaacacccaaauaaaugaaauuacuugcccaaagucguagcaguugaggucauagcacagagccauaaguagaagccagguccuuugaccugguuuaaugcugcucucccucugcccacuacauucuccuguaauuuuuaaaccagaauuuguuugguuucugaauggcagugaguuucuucuucuugaguuaauucugaauacugcauacugaauggaaccuggggcagaaagacuuggauuugaaugugucuuaucuguuauaugaacuuggggaagccacuuaauuucaguuaccuuauggcuaaaauagagugaguaauagcaaccuuauaaaguuguuaggugaaauaagaaaagguaugcaggugccuacaugaguccgaguucuuuuguuugcaaguaauaguaaccuaauguaaauuaaccugaacaaagugggaauaccuuagcucauauaacuggaaaauucagggauagagcuucuuucucuagcucuuauccauaaagcccaggaaggaaaucuaguugguucugcuugauccucugcucucucuuacaguagucauuauagccagaggaauguuucuuuaauuggucaggucuauguccaccucaaucugugguuaauagguggcuuggaugcuauguagcccccaccagaaucauggaaaaggcagugcccugucugggaauagggaguaaggaauguugggcaagcaaaagcaacaaaaacaucccucacagugccugggacagugccugaugugccuucaccuugccugccuggcugucuucaacucuguggggaaugagaaacuagaaaaugcaggaguuuauaaugacagguucuggggugaggauaggccuagagaugccucauaguggcagcucuucuauucucuuacugacuuauaaagguuacaggagccagggggggcuaccacacagguaagcaagaaacccguaagcaccgaacugcugugcagaggcagcaggggcuacugaagagcaccgcacaggaaagcaggaacccauguucuagccgcaggucugccaguaagugggcugcucaugugauuucucugggccucaguuuccacauuaguaaaacugaaagcuucgauuagauaacugcagagauuucuuguagaauaaggacacuuugauucuaaauaagguaauaaugauccugaauugcugggaacucuauuuucagauuaggcaugcagaugagauuuuguucuugauaauacauucuuuuguggaagcuaaacuucguuuuuuauuuacuuauuuuuaggaauugauuaucuugaaucuuuggcugaaauucagaguucuuggaguggcccaaagccagaugaucuggcccugcucccucucuggccucaccuccucucccccuccuuuugcucacucuacuccagcuauucuggccucuuucauuuucucacaugcaucaggcacauuucccgcuuagaaccuuugcaucccucuaccuggaacacuuuucuccuagauuccauauggcuugaucucucaguuccucaggucucugguuaaauguugccuccgugaggccuuccuugaaugcccugcguaaaguggccuccuuuuucugucccuuccccuagcagaucauauauccauuuauuuguuguuugucuacucgaauauauguuuucugaaaaugaagaacuuuguguuguuagcacugaaucuguagcuucuagaacaguguggggaugcaggugcuuaauaaauacuucuugaauuaaugaauaacuguuaaucuacugucucucucaguuuuggggcuaggugaucucuguccaaggcucauugcaguucuaaagcucugugauacucacaugauucuugaauauuacaugaugcacauuuauacuuaguccgguauuaagaguaaacauucaguaaauaguagcuuuuauuacuaagauuccguuccucccucaacacauuuacauucuaguggaaaagcagacacagguagcacaacaacucagguaugaguaacaacuguaacuuuuuuagcauugauuccccagguccuccuugauuuccuuuucagaggcaguguugacuuucugugccaguguugggacccaaagguugagcugggaccaccuggauuauaaauuuuaccuaaggguugaguauaaucauaguuaggggauuucaguugagggagcaugauucaaagaagcaguaucaugcaacagguacagugaguccaugagaggcaggaaggacaggagauagggccaaaccauacagaaguaggauugggaaacaauggagguuuagaaugcaagcugugaacagagcaugagugugcugaaucauauagauuucuuuuuaaauauggcaggaaccuuuuagcuaaugaaauaaggagcagcuuugguaaaagcuggagugagagguuuggggagagagguucauucgccagccuacuacccuucuguuaccuucccccucuccuugaggaaccccuaggaaccaaccagagggcccagagacacacaguuuaaaaaccacugcuuuaaugcucuccagggccuguuuuagcuucaugaugcuguguuuuuauggauugcaauaacugaguguguacuauaaggagagcucagcacugcagaguuuucaugagauugugaguccuuuguguggauuacacuucugaauuuugcccaagacuuaggaggacuguaaguuuugaaauguauuuauucaauaauugauuuauaccaucauccaauaaacacugaacaucuggugugucaggcauuguggggccauaaaaaaacuaugaggcauauuaaccuguucuuugaaaagauagauaaaggauaccuaaaucucuuuaggggagaaucaguggaaaccucaaagugaucaucaaacuuggcuuuuaaggagaaaaaccauuccaccagacguagguagaagggaugggugugagcaaaggcaguggcacacaacaguagggcaguuuggggccagaggcaagacuggugugacuagagcccuuuucuggaggaggcccgggugagggucagagugucagggggugagguuguacugaaguagguuagagcagggguccacaaacuggcccacaggccaaauccggcccacugccuaguuguguaaauaaaguuuuauuggaauaugucauuuucauuuguuuaaauauaggccaagaaugcuuucaugcuguagcagcagagcgauagccugcagaggccugcaaaacuuaaaauauuuacuguaugacccuuuagagaaaaaguuugccaacucuuagaugagagcguuguuagcagugcugaggaguuuguacuuuaugcucugggcuaugcggcagaggcacgaaaggaucauguuuguauuuuaaacuaauccgcaguguugaugauggguuuggaauguaacaagacugacauggagagcuaagcaggaugcuguugcaguaauucaggugaaacugaggagccggugacaguaggguuggaugggagaaaaauagaugaaguagguauuuaguauuuaguagguaggcucaacaaacuuaguaaaacuuaguaacuaauuaguggaaauagaaagaggaggagguagaauaauuuccagcuuucugguugaaaaguuaaaugguagaagauuacaauaacagaguuuucaggguuagaguugagugccaguuauucaugccuucuucuuaauucuaaauaguagagaauagauccaaggagcccauggacacuggaguuuuauuaagacagcaugugguggauaacuccccagcagcagugcuuacugauaaaccuggauugaggaacucaaugggguccuucagcuuugccacauuuagaccuuggagacaguugaguacaaaauagauacccagugccuauguaccuaugcccagccaguugcauggagauugagaccugucucagcaauacggccaucacuaggcugggacuuaugguggcgagaaguacaaggagguagaaacuuaggauggcccguguggaugccagguucucuccuguuauucucaguucugcuuucuuuauucuugaaugaaacucaucuugggguuaaugauuauaucacauguuguagaagcaugauucucagggauaguugauucauuuucuccugcauuccaugaagaaucuggagugugucaaagaguucccucuuuccucacuuuugaguuggcaguugaccaauuauuaugugucucaccuacuaggguagggcugcagaaacacgucuucucagugugacguuuuuagugaauucuucccaucaggggcuggcuucauuuuggaggcccaagaaccagauuuuucuacauauugaggcuagagccaucuguuagggcagauaucagccaagcucacgucaacuuguguguaagucagaauaccaguuaauuuguuguaagcacuguaacuaaugugcagaagaauacagauuuuggaaacucagucauuuuugagcuucugcuauaggucaggaacucgguuaaggacuuuaugugcccgaucucauuuaauuuuucucuuuuucaggggauagaaauauauuauugagugauuuuauaauauugauuguauuaugaauaaugugguuguugaauucauguaaacuugauguuugacgucucuuacuacauggaaauccacauggacucccucugguggguaaaguaucagugaagucuacacauguuaauuauggcuuaugguaugaaaaccauuuuauguuuaaagcguauuacauuuaauauugacuuaaaaagaggcaacuucaaaacuccucuaaaagaaagugaauaaaccagaggaaugaaaguaugauauauugaaugaacccaauaacucagauauggaaagcuugcagcacaguugaaauuuuaaacccggcaauacuuuuuucuuuguuacagacuuucagauccucaaagacuaugaauacuaaaguuugccagcuucuacuuaucaccaucuaacauaugucuguuugucaaaauguucuuaccauggaauuuguaagcuguauuuaaccaagagagagacacuuccauuucacaauauuguaacauuucuaucuaauuuguagucaaaugauaagaaaacucuggugaaaugaacacuugccuuuucuuggacauuuucuccagcagugaauucuauagucuuagcagaaguaacaggcuacagcauaucuuaacucagaggaauugagaaaggaauuaaaaaguguacguuucgaauuguaaauacuuuuggccuuugccaauagcuuacuaugugaucuuggagaacucaccuaaccucucugggugucacucuucugauuuuuuuaaugagagguuuugacuagauaauccauaaggaccuuuucaaugagaugguugcaugacucaguacucuuuaucugaaagucccaggauguauuuuuaaauacuuuuugcagugauaacugcccauuaccuugugauauuuucccugagucucugaaagagugagguuuuuuuuuuguuuugguuuguuguuguuguuguuguuuucaaaguuagcauuuuugguguguuuucacaaauguauuugauuuaaaaguggugauauaauuuuauaauggaauuuuauuagcagggcacauuuuugaaguugacuauuuuaaaaucugauuauaaaauuaguaagugcucauuaaacagaauaaagaagaaaauaguucacauuuaguaccagugucaggaaauagccauaguuaaaauucugguguuuaacuuuccaaacauuuuuucuguuaaauaaaaucaagauucuucuacaauacgguuauguaaucccucuccauaugcccuccccucuuccuugggggaguagagagggguuacauaacaguauuguagaaaacaauguauuuuggaaauuuuuaaauaucaguauguauugcucuuaccaccaguuuauuuggcugcauagcuauuaaaaauaguaauaaauaauugauuuaucugaaccccuguugaaagcuauuuaggcugcuucuaguuuauuaguauuuuaagcaaacaguauauuuuuaccaaauuuguuucaaauuuaucauagccucuuaaaaagacaaaaaauguaguuuguuuuuuguuuaaucuuuucucaaauguaaaaaauugaauguucuaguauugauaaaaggaaaauuauugcuauauuauuugaaaguauuaaauguuuuaggacuuauuaccaguucuggaugaguauagaaaaaggcauguaauuagaggcagucuacuuaggaaagcuuugaccugggagcagauccuugaagagcaagucaaguggauggauggugaacaugagccuggugugcucagugacaguaaggaaaccagcguaacaaggccagugggggcuucuuacucagcagugugaaacggggaggugcuguggccugauuacagaggccucgagagccauuguauaacauuagugggcaaacaucaauggcgauccuauauuuaauuaauaaccauuuagaauauaacgaaacauuuauaguagcaacaaaaagaguuucuaguaauaaccuuaaaaagaaauguaaaugaccuaguugaagcaaacugcaaaauuuuguagacagauacagaagauuuggauaaauagaaacacguauuguguaccuggaagugaagaaaaaguguugucaacacagcaauuauuacuuuaaugcucacuuuggcagcauauauaccaaaacauuuuacaccaaaaaauaauauaugcauauaugaauuuuuuagugaaacccauuaguccaggguguguguguguguguguguguguaaauuuuauccaugccaaaggauguguuguaaaucaguaagaaaaggaagauuuauucagugauuggcgguaauugguuagcacuuugggaaaaaaauaaauuuuuaguuccuuguuucauacauacauuaaaauaaauuucuagauggacuaaagauuuaacuguaaaaacaaaacugaagaaaaugaagaugaauguugacauacuuuguagaagugggaagucuuucugaguuuuaaaaguuugaccggguaugguggcucaugccuguaaucccaguacuuugggaggcugagguggguggaucgcuugagcuuaggaauucaagaccagccugggcaacauggcaaaaucucaucgcuauaaaaaaauacaaaaauuagccugccgcuuuggcacacaccuguaaucucagcuacccgggaggcugaggugggaggauugcuugaacccgggaagcagagguugcagugauccaagauugugcuauugcacuccagcuaggaaaaacaaaacaaaacaaaguuugcagcagcaguguuucuuuucuuuucuuuuuuucacaaagccuuagaaauguucacagaacagcagcagccuuaauaauacaauaauaaugauuuugaugaugauggugauggcagcugucacaaguaccuuacauagagacacuacagcauuauucccaaguauagagaaauuguuagguaaaugugacauacugaagaguaugucaugacaugagaauuauauauuauuauauauaauuaauauaugcuuauauuauuauguuagcuuaaaaaaauaacuacccaaaccaauuacaauuaaaacuauguaugcaaacccaaaaaacucuaggcauggaaaugacuggaagggaacucaccaaaauguuaaccauggcuuuuucugagugaugggacuugggugauuuauuuuucugcuucuaucauccagaauuucuuuaaugagcacauuuacuuuugaaaugaaaagcaaaacagaacaaguaaaacuccuggcagaugaguuuuuauuugcugugguaggaaauggagaauuaauagcuuuugauuagaaaaauguuaugagcaagcaauaucuaauucuauauuaaaugugcaguggaggggugggggcuauuuaaaggaagucugugguaaaaucuuuuguaaagggaguaauuuuccuguaacucagcuggauuuccaauccagacuuucuuaaucuauaugagaaaaucauccacaaauguugcauugaugucuuaguuucugguuguuauucuaaagcauaauaaaugauaauaauggcuaccacuuguugagcaccuacuguaccuggcccugugguaaaagcuuuauaauuuauuugacuauccuuucaaguuaggcuccuuuauucaugaagaaaccgagguucagaaggguaagcuaucucccaagaugacgucccuggugcugugagaugaguaguccuggcacgugugugcugugcuucuccgguugccugcugccuccccagcucuugggcaugcacagguguccuguggcaagugugucccaggcugggaacugugcuccacuuggcauuccacagaccacgccucuggggauuugcucuuuaguauguuaucacaucaucugcugucuuuaggagcauauuuuggugcauacauuauauauuugaaagugcuugacuaacuuuuggggaaauauggcugcuuccaaaccaaccuuuuucuuuuaaucaacaauuaccuugugaccgugcauuucuuuucuuucuuuuuuuugagacggagucucgcccaggcuggagugcaguggcgcgaucuugauucacugcaagcuccgccucccugguucacuccauucucgugccucagccuccugagcagcugggacuacaggcaccagccaccauucccggcuaauuuguguauuuuuaguagagacaggguuucaccguguuagccaggauagucucgaucuccugaccucgugauccgcccgucucagccuccgaaagugcugggauuacaggugugagccaccauaccuggccaaccaugcguuucuuaaagauaaguguugugguuugcuuuuggggaaaagagaaaaggauuugugguuuuaguuaguaaaaucauugagagggaaggagacccaauuuauggauuauagacauuugaaaaaaaauuguaauucccuuuucuguuguugggauaccaguuuuugauuuuauuuguucauuaaauggucaguuccguggagaucucuggagcugagauggcuuuuuagaauugcccaauugaggcaaagggccagggcuuuuuaaccacugcauuggccagccauugucugugggcuucucccagggaagggcccuaguguugggugaggcaccuuccugcugcuugagacacacucggcugugagccagcagcaggcaguucuccuaguaccugggggccucaauccgaaagaugcaguuuagccacacaaccuguauuaguucauuuuuugcauugccauaaaggaauaccuggagcuggguaauuuauaacgaaaagagguuaauuuuggcuuaugauucugcagacuguacgagaagcauggcaucggcaucugcuuuugugaagccucaggaagcucacaaucauggcaggaggugaagggggagcaagagugucacauggugagagagaacaagaagagagaagggggaggucccagacucuuuuaaacaagcagaucuugugugaacugagcaagaauucacuuaucaccaaggggacagcgcuaagccauucaugagggaucaacccucaugauccaacaccucccagcaggcccccccuccaauauuggggaucacaucaagaggcugaucuuuaugggcugcauagugggguuuccuugcccccuggcuucugauaggggucaacuaaugggaggcuccagcaggagaugggaaggcuggaaaagaggaguuggcuugggaacuggguagaagcuuugcauccacagcccaugacucagguuaggugucugcccaccagcucuagaauuuuuccgcuguguaagucuagcauccuggggguuaggaugauuuagccaguaggcuaguaccagccagcaauggacaaggcagcauugcagccucacucagggugacccugaaagacaguggcuaagggaugucuuccccaugcccagaacuugggccaaaucaucacugccuuuuaauuuaagguaguuuuuaauauauauauauauguguguguguguguguauauauauauaaagacauauauauauaaaauuauauauauauaaaaacauauauauauauaaaauuauauauauauaauuuuuuucucuaucuuucuuccuuaggcucagcauuacagugggaaaagucaaguauuuuaggcucacacagauuuuucucucagugacguggcaguucauacuuucccuccaaauaugaccugguaaaugacucuguggcauguugacugcaaaucugaacugaaauggaaucuguaacccauuaucagauccugaaucaagcugccuuguccuucuccaguuuuuguuucaguggaaauguguguuuuuauucugucaauggacaguuuacauaccuaauauuaaaagggaauuauauaaugaacacuugauguaaaagagacuaguuaaauacuucaacuccaaaaguuuccauuaaaguaauaaggaaauuacauuuaauuuuaacugguagaaaguuuuaaaaaauguuauugcuauuaagcauuuauuacccacacucaacccuuuuuuugugagugaauucccaaagcacaauucaucuuuauacagguagaaaggaaauauucuugcaaaauauguaguuugaugucaucuuaacuguggagagaagcauauuuuuccaaagaauagaaugugaugguugauuggaaacuuuuggaguuacaggcuagcucuaccucuugaaauaagaaaauauauauaaauagguccccagaugaaggcgucgugggguacuuuacagccccaauuggcuccagacacagaggcagugauuuguaagcaagcaaugacaagaggaaguuaaaucaaaauuaaauuaagagaaggaagaaaaagaagagcuaucaaggagaggugaugaauuuccugaaagcuucuaaauaccuaucuguggguaaaugauugaaaaucugugaauauaucucacuuaugucaaaagaugaaaucuggaaacauuucaguccuaaaaaaauaccuuacuuguuaucuuugaagccuuuuuuuauuuuuucaauuuuuuuuuuggagauagagucucacuauguugcccaggcugaccucaaacucuugggcucaagcguccuccugccucagccuucugaguagcugggauuaugcauguacaccaccaugccuggcuucagaagucuuuucaaauauucauuacuugguacaguucaaccaguacaagcauauuugcuucuauacuuucccguugacucaacugcgauaaaaucagcaucuuccauggugcacaugaagucguauauugggaggauugguuuuccuguuuacauuuugacguuuuguuguuguuccagcuuguguaaauaaaaauuuaggaauucgaacucaccagagagcuccuccacccugacugccauuuuugcaguuacaucugucauucucccuuuuccuguccucuauccaguuaauuaccaagcccaagaagauagacacuguguuccacuccccucacagcacagagcacaguucaguacauaguauuuggaaaucaauuaagugaauaagcaccugcacuuucucuccgucucauccauucugcugcuaccauaggaguucagacuccuaccaucuugugccugagcugacacaguaacggugagcccucagucccucuccaagcuaagccacugcacggaagauguugcuuucaucauuacuuuggcucagaagcgcucaguaccgcucauucuccacgcaaagauucucagauauuuggucuuuauaaagcuagccuacccaccuccaguguuaaaccccacacuucccccaucaucccaccaguuuucaccaugcugcucuguuagcaguccccucagcuucuugccuccuuccuuggcuccugcuauuucucuugccuggacugcuugcucuccuucacuuucucaaauuccauugaucuugaaaggcacauucuagccuauacuagucuccucuugaauugaaagcauuugcugccuguauucuuacuauggaaauauguauggcuugugacaucccuugccuuauuauuuuguguuuuuaucuaguaauaacauugucacuuaaccuuucagcugcgauuguguuaucucucaaaugauauuguuuauuugugggcuuauauugggcacaggggauggaaaaggagagagcaggacucuauuuucaugcuucuuuguauuuagcacaguggcucuuguacccaguaauacagccuuuagacagaacagacaccauaucuucuuggucuuuguauuccuagugccuugcagagcaucuggcccauaguagggauucauacauggcauuugaauaaaugaacagaaggcacaccucaaauauuuguuuaguaguuuuacccccaaacuaaaugaaucaacacagguaauuuuccaucuuuuaaaagccauaaaaauccaguuuuccauuuaguuuuuuucaucauuaacaguucucccucaagcacuucuccuuugccugccuugagcuucauacugaaauuuaaaucaauuuccucucauucuuuucccugugaaauuggagaacagcuguuuagucaccuccuuauaaauaacccuucaacaaguuaaauugccucuaggauuugcuuucuccagauuaaauuaucccaaagucuuuucuuuuuucucauaaaggccuuuucaaaaagaaacauugguuacuuuuaaaauuucuuuuucuagcucuuuauaaaacuuuauucuuuucauaaauguaccacaggauaccccuaugugggccugacugaugcugucuggaauggaaagcuuuccuuccacaucuggaaucucauucuucuauuuuguguuguaccuuguuagcuucuuuucuuuucuuuucuuuucuucguauccuaucaaauuuaauuugcgguccacucucacccucucccuguuugucuccuuuuucuguacauuucuucaaauguguggcuugauuuucuucccauaaacacuaacuugcuuuaucagaagucuuacuaagguuauaaguuacagagaauccaacacaaauuagcuuaagugaucaaaggaauuuauugauuuauaucacugaaaagucuagugguaugacuuaaccucuggcauggcuggacucggugaaccaaacagugucaccacaggccugguuuuucuuacucccucuguucugccuugcacacacaguguuggcgccuuuaaggcgccucuaacgcccuugcuuuguggcagccacugagcugcagcacuugcaggccucacuuucucauaaugcccccucuggaggaagagagaggcucuuugcuugacuggguuucacuuucucuuacuggcucaaauugagugauauucuuauccucaauccacuccuguugccacuaaaaggauauacugccuagcuugguccauuuaggacccagcucugcaucugaugcaguauguuacuuccacccaauacauuuggcugagaaucagggacgaauuguuuccaaaggaaauuuggggagcuguucccagaaggaggggagcaaugcauggggguggccaacaagagauguacauugcauucaaaauugugcccauucacucugcuuuaggcauuauaaauaccacuuugaacugaagguaucucugagaaugaauuauuuauucacuuacucauagucacuuacuguuaagcaccaacuauaugccaggcauacaacuagguuagguauuagguguacaaacgugagugagacaaugucugacuuugagaaacacauaaucuagggaaaaaaauagacuuagaggcacauaacuaaagcauguucuaauaagugcugcuaucaaagugucuguggacacagguggaagugaagaacucagugggagggguuaaagggagagggcauaacaggagaggugaguuuugaguuaagccuugaaggguaaaaagagauuccccuagaaugggagaggaauggcauuaucucgaaggccauggugcacuagaaaaaguuuucaguaggggacuaaugugguuagguauguauuugagaaagaucauucugcuggcaguugguggauucggcagaggugagaaggacuggcagcaaggaggaggaccaguugagcuguugcaguaaucaagucuagucaagauacagcaaggaccugaacucagcucguuacuauagagcuagggaguagacucgauauauuugagaagagcugggacuuguucaauguaggagaugugaaucagugguuauagaugacuuugagguuuucauugugauagguagguaguuaagaugaguucagguuuguaguuacuugaggugccugcugaacacccaagggacacguuucccaggcaguuguaaauauagaaauguacuggaggaaagauuucuaagccaggaauuuagacuggaaaagacaucagaauguaaauggagauugaagccuugaggaaagagugggaucacccaaggggaauuucaagucagaagaaaagagggccucagaguagucccugggaaaagacuacauuugagaagccagcagagaauaagaagucugaggaggcagcuauggagaacguaggccuguggaucccuccaaguaauaagcuuguuuuuacuuggauuagagguaaugucaccuggaaugauuugugccaugaugguuaagagcauggacucugggcucuaccaccuccugcaacugaucuguggauaaaauauuuaaccucauuuccucaucuauguaaugggaauaaaguaguaccuaauuuuggagaauuaauuugaguaaagcaccuugaaagugcuuagcacauaagaagugcuauagaauguuugauaaacacauacgccaguaaacacauguguuuguacauuucugucucucugcacucacauagcugcuggccaguuaaucugaaauccaaaauuaguuuauuuguacuuaaauaauuugauuuucuggaaacucugcuaguuccaaugcaacaaugcaaguaucuugacuucuugaagguuuuccagauuauuugcuggauuauuuuuuucuacugaugauuaauuuuaccucugacuuuguuauacuuuucuuuguuucuuccacacuucacauauuuuuuauuguuccuaauacuuuauagcauacagcuuuuauuuauuuuuaaaauuuacuuucucagaauuauuccuaaaguucuggagugcucugugaguugcuccuccacauuucggucaguuucuaguguguuacuuuuaaucaggcuaguuuucucaugcaucuaaaggaauuggcaauauucucaacuccuccccauuauggucagggauaugaacuuacugucuucuucuuucauuuucccaaguaaaugucuugaaccacugauuagaucugugugcccacaauaacauaagcaggcacgaagcuuaaaucugauuuaaaggagagggcuguauagucuauuacuccauuacguuuuuuuaagugucuagauuaaaauagaucaguauucagggugugaguauauugcuaagucucuuaacacucauugaaccagacgucguguguguucauuuuuaaaugaugggguggauuacuuuuauauuuauuaugaacacaaacacugaugcuaacaacugacaugugaaaggaaagcaggcaauagugaugaaaaccauuuaaugauuagugaggaaacaaauauuguuuaaugaaaauaaaaaccaugucuaaagggccuaaugcugacuuuuggaaauauaaccauguugcggucuuuuguguacccucuguccuguacaguagauauuguuuaaaauugcuugggaacuggagcuugcaauugugagccuggaauguccugcagauaauuaaguuguggucaggcuuuggaaaaauaaaaaguucucgaacuaugauuuuauaaacaugcuacaauaacauuucuuuauauuuaacaguuucuuauagaaaguugauacucucaugaggcauugauuaaagguaaaacaucaagaaagaaaaaauauuaaauuaaaacuucacuuaggauguugacaguuggcuuguaauauuaaacagauguguauguuccuggggauauucuucuuucugaacugaauugcuaaguuguauuuuuuuuuuaaugacaacuacaaauauuugaucaguuaauaauuuuaaauacccuuucuacaaucaucuguauucuaacuucaucuguaguuugagcccucucaaugauauaaugauuggugaaaccuuugcugccucuucuuaagucuuucauuuucuuucuuucuucuuuauccucccccgcucuaaaagcuuaacugggcucuucugauuucaugaugcauacuuggagauugauuccuugaaauaauuuuaggaucauuggguggaauucuacccuugcagauuuaugucuguaguuuacuucccuauaagcuucacuuuggcauuugagugcauaagcugaccuacauugugguauuguguuuguguggucaauuguaaaggcuucauaauacgucuguauagccagccaugcagaucggccuguaccccaugcuguggggccaaagaaaugucagugaggggaccuaaaggaaaccaggccuuggagucaaaagagauucaguaacuuuuucuuuuugccuaugaggauuuugccagacuuuugcauuuuauuggacaaauaacagagucuagugagagcuguagaguggguuggagggguggguuagaugggugaguagucuuugguaaaugaagucaggugggauuuuguaggauguggugaaaauguuuuucaucuucaaagauuguucaagucuuuuuggaagacuagauaaauuguacaauguuguuuuugggaugaugaauuuuuuuagauacuaaagaucauuuugauuguaagucuuaaacauguggacaucuuauguuuucugaaagauauauuucacuaggcaggagucuuugauuaaccuggaggaaguuuuguugcuuugaguacauuuauuuaucuuggaacuauguauuguuugcacagucuucuuuuuggaaucaguguuuuuuuuucucugcagauuccauuugggaagcuuugguuuggggccuuaaguauauggaaggcauuuucaguaaacacaaacaaaggccagcuagacugucugaacaaguacaacgauguauuuuauaauacaaaacuuuaacuucaagaauaaugaauucauuuuuaauagcacauuauuuaaaaguggcuauuuguucuuuacaucuaauaguauagcuuuuuagguaucuuauuccuuuaagucugauauagaagcaaaaauauuuaaagugcauuuuuaugugaaaggauuugaugaguucacauuucaugucuucaacuuuuguucucuagcucacuguuuuagaauugcacuuauuauauuuuguguguguggaaggaaggagaccaaauuucuguguacagugucuuaacagauuuaaucgaaucacugccauauucuccuggaauuugagauacuccuuaacagcacccuauugggaaagaguugggaucuuugagcuauaugcaaaaauacuauuuaauuucagcauaauucguuaugagcaaccauuuuaauguaagagucugaaaagcaauaaaauguaucuguuaagguuuguacuaguuagcuuguuucugggcuucauguuuauuucacuucaauucucuuccaauguuuuacugugaaggaauguugcaaauauuuuaaaucauuuguuguaacuggaauuuguaauuaugaacagguuuaaguagaaaaugcuguuuuguuuuacuguuauuacugcaucauaagauaaaugauauucuuuuauagauauuuuggcuuggcucaccaauccuaauuucaguaucaugccugacuuagcaauaaacugcugcgaucagcuacagggaauuguauuaggcaggcuuuauuuuucuguaucagugugguauugcaguuucauccaccuuuaaguuagaaaagcaugguuuuaguauuucaauuuucuuguucaauaauucuaccauggggaaacagaaaguagaaaguuuuccagaguagaugaugauuuaacaacuacaccauuugaacuagucguccuuuuaaaaucucauuugagcauucccuuuuuugccuauauaguguucaguucuucucagcuguuuuacagcuaaugauuugguucuauuagggagaagguaauacaugcuuauuuucgcagcauguuaauucuauuaacuguucaguaacugacucgggaauggaaggcaccuauuggucccuaguggucugaaaugggaaaugcauucccugaaaauuucauuaggacuuuccauaaagcuuaacauuugacuagaaacaaaaauguuaguagcuuuagauagauugauuagguuauuuaaaguguuccuugagcuacagaugaaguuaauaauuuucuuaaucucuuauuaaaaauagaugaacuacauauaaaaacuucaguccuagauuagcaccuguauuucaagucauuuagggaaugguggaaaacucuguaaaugcuuguguguuaagcauauugaguaaacugucaagauuuuucucuuugucaucuuuuugucagcuuuaucaugcuuaauuuucaagaaaauaauguguuuguuacuguggucacaccgugauuuugcauuggcuuauguaugauauuuuauugucucuguccuagaaaauuauagcaguuuuuaugaggagugguuuguggguucacacaacccacuuggagugccauuuacuacaauucucuucuaaaagaaccauaaaacaucauguaaauuguuuaaaaagggaaagaccuuuuucgagaaaggcuaagaagaaaucuuuccaggcuuucuuuuguuucuuauagucaguuuuaugauuuuaagcucccaauuuauuuagagcguuaaugucauaaaauaaagugcacguguguauaaguaaaccguugugagcuagagcuaggcuagaacuggguguuguugaugcagauaauaucaaauucauuauuuuauaaucuuuuaagauauguuuucugugacuuuggaaaugaaauuaaagaaauuaaggaagaaaggaaaagagagaggaaggaauuaauuuauagcuuguauaucuuuuuuuuaaaaacccuuauguuuucuuaaguagugauguguuuauaaucuacauuaaggcacaauuuuugguaaccaguccugugaaacucacauuuaaauucacaaauagauuuacuuagagaaacuuuccucccuuaggaguuuuaccauuuagauuggcuuguugcacucaguuuguauacacccuuucgaagaaagaauuaaacagcacaauaacaaggccaaaguucugucauaguuuucuauacaaaugccuuauucugauauuaucuuggcuuugugcaugagcucucaggagaguaaggacgaacauuguuaauaauuuucuacaacauuuacaugguucucugugcuuuuagucacuuaauacagguauaucuuacguuuaacaaaccguuauaagaaaauccacauauaucugaaauauaaauuggggcaguuguucauuuugcauaaagauuuaacacauuuauaauagauuuaaguuuuaaagccacuuccuuagcacaugcgagaucauuauauuugcaacauuuuauaagaacacauauaggccgggugugguggcucaagccuguaaucccaguacuuugggaggccaaggcaggcggaucacaaggucaggaguuugagaccagccuggccaacauggugaaaccucgucucuacuaaaaauacaaaaauuagccaggcgugguggcaggcgccuguaaucccagcuccucaggaggcugaggcaggagaaucgcuugaacccaggagguggagguugcagugagccaagaccacaccuacacuccagccugggcaacagagcgagacuccaucucaaaaaaaaaaaauaaagaaaaaaaaaacacuuauaaagggaaugaugauugcuauauucauguagguagugauaugaacauuugucucuguaaaauauuaucuucuuuugaaauuagugguuuuuaaaaacacaagauuaucugugugguuuagaaacuccuugguuuuaugacaggaagagguuauaaauaaaucacguuuaugcauuuuguaaagaguguuaguaaaauugcuagauuuucuugaacaugguuguaaaucuuuuuguuuuaauuauaaagcuuucuacauacaugugugacuuuaugaagaaugucaacuuagguuuuaauuaugugacuguaaauuccccuuuuccuucugugugaaaacacaacaccaacaagaaaccaacuuccuaaaauauacaaacuuuuugggauuauucuuuauucuacacugucuuacuauuuuuauuuuucugauguugggguguuucuauuuaguaucacaguagcuaacugaaguaaauuuugggaauagaaaaugaagcuauaauuggaaaggagauuuugaaaaaacagaagcaccuaaugucaugaugugggugggaaucaggggaagaauguacugacgagccccaauaccgcugguucagaacagcccugggaauucuauagcuguuuuccaaaggauuguuugauacagucgggagcucccgugaccaaaucuaaagccugagaaccaacuuucugugauaaagcauacuaagcaaagaagacucuguggcauuguaaccgaugcuacugaguaugccacaaauguucauacaaauuuuguguauagcgcuauugcauaaaucguuuuaauaugggauguuuggaaauaagauagguacuacacugaagggaccaaauacugaauucuccaaguuagauacuguuuuucacuaugaauuuauaauauguuguuauauaacaacaucauuguuacugcaagugauacaaaauguuauguuuggaguuuuucucuuuuuuuuuagauuggaaaauaguuuuaauguuagcacagacaaaauauuuccuauuuauuuauaguuauuaaauaaaaaugcauagcacguuagucaagaauguauuguuuuauaaauuauucaguugcaaguaucuaagauuacuuuacuuacaacuuaaaugcagaauguugauguuuccuuguuucuguuuuucacuugagucaguuagaaaauauuuuucauggacuuuguauauaagcuaaagauuuuuuucuuauaugaaaaucaucaauauggccaauuccugucggaaaagaggcauaauuuuucaauuuuuuccuccaaaacugcaacuucagaaaauauguacgagauguagcaauuaaccuacaugcacauuuauaauacuagaaaauaggcagcuaguuauauucaaagacuggaucugauaggcccaaauugcuuaaaacaucacaguuauugaagauauaccccagggaauuugagaaaccauuuaacagaugaaaguacauuuugaaaagucugaccuuacaggcaaucauaaaaugaaucaaaacagugcuuuuuucccccugaaauguacagagcccaucugugucuaauccaguaauuauagacuguguucaauuaccuuuucaaacuuggagcagacuggagacuaggcaaugaacaaacauaggguuuugucuagaccucaauugaccacagucuaaaaguugaauuuauaucuaauuuuauuuuuuguuugguuugauaguucuuaaaggauucauuuuugcuacuugguguuuuaccuucuuagauuugagguacugccuuuucucaucacaaaagcuuuuguaucagcuauagcuuaugcuguaaucagaugcuguuuucggaauacuuacucuugccugcaaaucaauaauuugcacugcagaaaagacugcaugggguuggggaggggauuuuaccagugaguaguauuuuuuuaaguagccuuuaaaauguugcugcugacuauaacucuuuuuuaugugcuaggaaaaaauaauuuauuuuccucuuaaauuuagaaaacuauagguaauuuccaguuggguuguacacuuaaugucuccaaaaauacauguagacugcuaaagcacgugugucucucuuuugucagaugucuuaucguuuuuuucuagguacacauuuuuauugcauuuacuaaucagacugguauccaguauaaaauacaguguauaguauucaaaguccauuucaaaucgugucucuuaauaaagucaguuuaugaucugaugaaucuuuaagugagaauuaauuaccaugaaccaccacagccaguucaaaguauuuaaauuuuauccaggaaccuuggcuauucaaguuuuucuuaaaacacaaagcaaacaaaagaugaccacaauuuuuagaacugcuuaugugguagucaaaguucuuuuuuuccauuauuuaguauuuacaguuauucacauuacaauuaucacuggaaacaaauguuuugagguauuuauuagaaguaaucauugcauauuagaccaugaauuuuucuagaaauuuuacaaccauuccuaguauauuauauuauuauuuuuuaaaguuuuauucauuuaggucucacuauccuuuggaacuuuuaaggacuuugucauuggggagagaagcaguuuuauuugguugcaugaauguacuuucugagaauuauauggagaaagugaaacuuaaagaggauuacaaguaccuuauguugaauguuuucaugagacauuuacuugugaaacuuggauaauaugauuuccuucccuccuuccuguccccauaguuuauggaacuauuguuauaauuagccuccauuguaugcuucuuaggaucuucauagagaaggcaaaagauuagucuuccuaacuaggaacuugagagacccuuuggauccucucucauauacccccuuaucugauccaaagaaagaauucucuagucuuuuuuuuuuucccacagaccagaggccccuccuaguuccugcuuucauuaccuaauguauggguaccuccuuuggugguuuggauuuuauauucucugauuaaccuguuuaugccacuuucacuggauuguaagcuccuucggaucaaagacuagauggauguuauccuauccuauuguauuacugcuuaaaacacagugccuggcuugugacaggcacuugcuccuuguugaccaaaugaggacagaguggaucauccauucggaaucuuaguauugaaagguaggagugaagaauuuuuaaaaguuaguagaaaucacaucuaaauaacauauaacucucuuuuuugccauaacgaaauaacugaaagauagaacuuuuuaaaauuucucacuuuaaauguuuuuaaugagaccagugagagaaugaauuuuauucaugaagucuccauuuuccauugaagcugcacuaucuguugcugugcuuaacaaguugauagcuuuacuuauggcaauuuuuauggaacugcuuucuccaucugcagugagaagacugagaagcauuuuucugauucauauaucuacguguauccuuuucuucaugauucuuggagaagccuugcagaaauagucaguaaacaguauugaauacuuacuacuuucaaggugccgcuugauacagugaagccaugauauacaaguccuggccauguggauuuugaaguaugugguugaugucaugucuccuuuaggcuggauucucuccugcaauggaagcugcccucucgaguucuuucuccaguauugacucuuaacguaauuacauguccuuacccccgcuaaggacgucagugucuuuaucacaccccugcccucagguuaaaaggggaagaaaucacaucauuuauaaaagcagugauggaacaucagucuuuuuaagaaaaaaauagaaguuuaugauugucucaucacagucaacuggcaauucauuacugcaguagcaaggagauaucccagaccucuggcuuugcugucaagauugagugcugggguaguuuuuacucagcauuaaagauuucauuggccaugcuguuuugucggguaucuguuuaagauguagcagugugauuuuuacuaaccugauuuuagagauuuucagugugucacauuuaaauaaucuacuuuugaaaacaguagugucuauuugaguauguugcucaccggggaauguggccucuaaaagcaaccauaagauccaagaacagagcagugagggccaugaccauuagaugacuuccacgaagcagucugugacucuguugguugaaaucccccacacuuuccuuuccuucuucaaaccuguuucucuauccuuugguuaugauuggcuccuggcuggauaaaguggugcugcuucugggauaaagcuguaaucaggcgcuugagucuacuucuacuggaagaucccagaugaaugggaaaccccaugagcucuggcuugccuaaggcaaagcugagauuugagauccaggccagacgagggucccccccucuaucagaaucuccacucucaaaguacagguacuucuuuacuuaacauagaaccgaauuucugagguuuccuaaagagacaaccagggaaggauuuccugugucugucuccucucauucucugggaagucuuaaaauuuuucagcuuagacugcuuccuucuuuaaauucuaaauugaauacccuuauguccguuugauauguauauuauuauuauauuccuggauuuuauucuugaacccaguuggaguuucaaggcaaacauuugguuuucugucagcccacaaacugagcaaugguuggucaauuauggucuucuguugacugaggcagagucgcauguuaaaaguauauuuuauuaauagcccacaaagcauaccaacugccagcuuuuugccaugucuaacuuugagcaauauuuaguaacaauauucccaguuuucaucuguggguuacuuaaaugugucauccaggaagucacuguaagauacguuggugaaaaagccuucaagcuuagauauuguguauucugcuuaccugcuuaccaacucaugcuucccagaguaccuaacucacaaacgugccucaaaugcagaaaagcaaaucuaguucaguauuauacaggacugguaauguccuggcuguuugcucuauggugugcuuguuaaucagcaguagaugauuguggcacauaccuauucuugguccugaaaccacccuucugucaacaauagugccugccuucuuccugggaacucauccccacucuggcuucaaucaagugguuucaguacaagcugcuguguuuccauaguaucuucuacucucuaggucauggaccagggguagcaaccagacucaaaucaggccaaucagaauccuuuccuaagauuuuuuuuuuuaauuggaauuaggaaaaagaauuauucuuaguccagaggccuggauuucagcaaacaaagcucgggagcuguugguggccaguuuucauugcugagcugcaaugagaaaauuaaggcuaaaaugcagacaaaacaaguaggaguuaagagaguucuagaggaguuuuaaauaucugguuuaguuguugcagaggcuagcuguauccuugccguucccaucuuuugaucauuuaaaccaguggcucgugcaauuuugcuucuaggggauauuugccaauaucuggagacauuuuugguuauuacagcuagggggcuacuacuggcaucuagcagaaagaggccaggaaugcugcuaaacauucuacaauguacagcucucccacaaacacccccaccuccgcccccagacaaaguauuauccagcccaaaaugucaauagggcuuagguugauaaaaccugaacuuuaacccauccuucauacauuaccuuaguauuuuucaaaucuccucuccuucuguuuuggaaagcuagcuagaauuaguuuaugcuuaagaggaccuuaaccuaggggcauacacacacacacacacacacacacacacacacacacacacacacacacuaaucaugaguguuguuuggugauuguauguauuuucagucccauauuuaagauuuuucaguuuauagcugcccuaguauacaaauacgccaucacccagguuuagaaggacuauugauuccccuaccacauagauucaaauagcuacuucuagacugccuuggguaccuaaacaauacauauuccaaacuauugaagcaaaggcuauucagaaauugcuacuaggauugcaucaaaauuaugcuguccucccuaagauuuguuuuacgauuaauauucaacucauguauuagagaugaaaucacuauuuuuaggaaugauuaugauaaaaaucaaguguucaguuucauagaacaaaacauagcugucauaugaaguccuugauaaagcauugcuggcacaaggaacugugagaguccacauuagcguaggcuggacaagcugcauuccucuuugaaacugucagaaugcauuguaccuuugauucaucuuccaaccuacauucaagccauggcauggauuucuuuuuuuaaauguuuuaaauuuuacuuuaaguucuaggauacaugugcagaaugugcagguuuguuacauagguauacaugugccauggugguuugcuguaccugucaacccgucauauagguuuuaagcccugcaugcauuaggcguuuguccuaaugcucucccucccccuugucuuccaccccacaacaggcuccaguguguguuguuccccucccuguguccauguguucuccuuguucaauucccacuuaugagugagaacaagugguguuugguuuucuguuccuguguuaguuugcugagaaugauggcuuccagcuucauccaugucccugcaaaggacgugaucucauucuuuuuuaugguugcauaguauuccacgguguauaugugccacauuugcuuuauccagucuaucauugaugggccuuuggguucguuccaugucuuugccauuguaaauagugcugcaaaaaacauacaugugcaugugucuuuauaguagaaugauuuauaauccuuuggguauacaccuaguaaugggauugcugggucaaaugguauuucugguucuagauccuugaggaaucuccacacuguauuccacaaugguugaacuaauuuacacucccaccaacaguguaaaaacguuccuauuucuccacagccucuccagcaucucuguuuccugacuuuuuaauaauugcaugucauggauuucuugauggacagauugaugaaaagaauguuaaugaauaacuugacaaggaggaucugagacauguagcagguaccugcaguuaaucaccuagauuaagacccagauuuaagauuacuuauauuuuacacacaaucuuuuuuucuuaacuuucuuugacuaauuuuuuuaaaaaacuaugacuggggaugaucuguguuucucuuccucugccuuccuccauugcuuugguuaaacuaaaauuaaacuagcagaguauuuugugaagcugaguuucucuuugugucucucuccuuugcacacaguugacacauaguaggcacccauuauaaaaugcucauaaaacgaugcguggugauuuccugcagcccccuaguucuaaauauucucuguaguccagaaacucccagauuuauauuuccaggucagaccucuuugaaacccuacacuuagaaacaucuauaguugucuaccuaccugacauuauuucuguuaccugaguaucuaauagacagucagucuccuugcuguucuucacgcaugcuugauacacaccugucuuagggccuuuguacuuauuguuuccucuccuuggaaugauuuucccuaaguauuugccuggagauaccugccugcauaacuuuuacuucuccuucaaacauuuucuuauaugucaucuuuucaguaaguucauccugaccacccuguugaaaauuagaauucaccuuuuucccuacacucuuccuagauuucccuuacuuugcauuacuuuugcuuuuugucccguaacacuuucaccacuuaccauacuuuguuaacacacuuauuauugauuuuaauauauugauuauacuuauuauuauuugucuaaaauauggcuggauuguaaccaaaacccaugaucauuuaaauuagggucuuucgacuccaaguuaaauuuuuguuacaagacagccuuuuugucacaagaaugggugaaaauuuucguaaucuauccaccuggcaagggucuaauauccagaguccacaaggaacuuaaacaaauuuacaagaaaaaaaaaacccuuuaaaaagugggcaaaggacaugaacagacacuucucaaaagaagauauacaugcagccagcaaacauaugaaaaaaagcucagcaucacugaucauuagagaaaugcaaaucaaaaccacaaugagauaccaucucaugccaguuagaauggcgauuacuaaaaagccaaaaaacaacagauguuggugagguugcagacaaaaaggaaugcuuuuacaguguuggugggaguguaaauuaguucaaccauuguggaagacaguggcaauucuucaaauaacuagaggcagaaauaccauuugaccuagcaaucccauuaguggguaucuauccaaagaaauauaaaucauucuguuguaaagauacaugcaugcauacauucacugcagcacuauucacaauagcaaagacauggaaucaaccuaaaugcccaucaaugauagacuggcuagagaaaaugcaguacauauacaccaugaaauacuaugcagccauaaaaaggaacacgaucauguccuuugcagggacauggauggaguuggaagccauuauccucagcaaacugacacaagaacagaaaaccuuauaacacugccuguucucacuuauaagugggagcugaaugaugagaacacauggacacauggugggggagcaacacucacuggggacugucgaaguggggacuagggagagggagagcaucaggaagaguaguuaauggaugcugggcuuaacaccuaggugaugggaugaucugugcagcaaaccaccacggcacauguuuaccuauguaacaaaccugcacauccugcgcauguaccccagaacuuaaaauaaaaguugaagaaaaaaaauuguuuguuguuacacagcagcuccuucuuguuaacuucaaaauaauccugacauuuuagaaucuggcacuccuggucuccaaguaacaaacuucucauguauauuuuauauauaaucuuugugcaacacacaaaaaaaaacaagauuuucaccagauuuuugggauccucucaagugaaauauaggauauaugccauaaaugggaggcaagaagggacaguucaaagagauagguuguuguauucuagagaagcaaaaacgggggauauguggugagguccacauaugacauacuuaagacaccaugaacagacaaaaaacaaaaacaaaguaacagugguuucagauaugagcccuaaguugaaguccuaaaagcaggugcuuuucacacgggcacuucaguguccugugcacuagggggagugucagccaugauccauuuuauuuaauagugauuaauaauucuccugagcagugauggaaggccagcuaguguugaaguuaaaaacauccuauaauuggacucagaauaccuuuuacuuuuguguuaggauagccaaggucauuuguucugaggucgccucuguggcauggugaccgaucagugguaagcaggcaguaaauacggaaugcuuccuuucuaggcuagaacauaagggacuaggaaacucguauauuuuucuagcuagcugccgcuuuuuaacuuuuuuuuuuuuuuuuuuuuuuacugugaauauauuuuauuuagucauuuuuguuuacaauugaaacucugggaauucaaaauuaacauccuugcccgugagcuucuuagagacaccagaaaaaguuucagucuguguuccacguuguucugcugggcuuuguccaaacgaaccuuuaugagccggcugccauccaguucacgugaauucucuugcccacaauuucgcuugggaagaucaaguccucaaggcuugcgucgugcacagcugucagagugcacuccugggacgcuuuugcuuauuuuuugugcggcuuuuucgaauuggcuuaggcagaauucuccucugagcgauaaagauaauaugcuuuccacugaacuuuuucuccaguucgcauacuagccggacuuggauuuucuggaaagauuucaguggaggaacgggaacaaagauugugauagcuuucugaccaccaccaacuucaauuuccuuggcugccauaauauucagcucugugagcugagccuugagguccgaguucuuuuccagcuccagaagagccugggagaugccggacucuuuauaguacacuguaaaguauggguuguuuacccucauaauugcauggcugacugagagcugcugcugagcaucaagagggagugucaugccgucuuguacuguguugcuagcauucuuuggaacucaccuggcuucuugccauugggcuucacgaucuuggcgcuccaacugaacauggccuucuccuugcugagcacuggcuuaggaagagcugcuuuuuaaaaauuuaaguguuauuuguagauuagcauacaguaagcuugaccuuuuugcuaauacaguucucugaauuuuagcauuuuauguacaauagucccaucccccauguuauccacaguuuaauuuuccaguuucaguuacucauggucaacugugguucgaauuuuauccucucacuucaucacaaaaagaaaggugaguacaguacaauaagauacuuggagagaaagagaccacauucacauaacuugugagaauucuucuauuuuauuauuauugcauuuauucucuaacucuaccuaauuuguaaauuaaacuuuaucauagguauguauguauagaaaaaacauaguaucuauagaguucaaugcuauccuugguuucaggcauccacggggggucuuguacucucucccuguguguguauguguguuuuguauagccauuucccuauuaggaugcagaacaguuccaucucccuucagaaacucccaugcuguccguuuguggucacacccacucccgugaacccacaaacgguucuccauugcuauaauuuugucuuuucaauaacaucauauaaaugagaucauauauacccuuugaaacugacuucuuuuagucggcauaaugccuuuaagguugauucuagauguguguguaucaauaguuccuucuuuauuacuaaguaguauccguuacaugaaguuacuacaauuaucuaucaccuguugaaggacauuuguguuguaucuaguuuuugacaauuaugaauagaacugcuacaaauguuuguauacagauuuuugcaugagcauacauuuucauuucucuagggcaaauaccuaggggauuccuaaguuaucuggugaguguauguuuaaugguauaagaaacugccuguacacaaauguucauagcggcaucauucauaauacucaaguagugaaaacaaucugaguauucaucaacugaugaauggauaaauaaaauguauauccauacaauggaauauuauuuggcaauaaaaaaugaaguacugguaccugcuacaauauggauaaaccuugaaaauaugcuaaguuaaauuaaaaaacaggcacaaagggccacuuauugcauaaguccauuuacacauggucuccgacuuacuaagguucaggacaugauuuuucaacuuucacagugcugcaaaagugauaagcauucaguagaaaccauacuucgauuuuucguuuuuguuuuuguuuuuugagacagagucucugucacccaggcuggagugcagugcuugaugucagaucacugcaaccuccaccucccagguucaagugauugucaugccucagccuccugaguagcugggauuacagaugugcaccaccaugccuggcugauuuuuuuuuuuuuuuuauuuuuagcagagauggaguuucgccguguuggccaggcuggucucgaacaccuggccucaagugauccgccugccucggccucccagagugcugggauugcaggcgugagccaccacacccauccccauacuucgaguuuuggauuuugaucuuuucccaggcuagcaaugugcgguaugacacucccucuugaugcucgacaucagcucucagucagccaugcaauuaugaggguaaacaacccauacuuugcaguguacuguguugccagcauucuuuggauaugauuuuguucaacuguagguaaauacaucuguaaguguacugagcacacuuaagguaggcaaggcuaagcuaugauguuugguagguuagguguauuaaaugcauuuuugacuucccauauuuucaauuuauuauggauuuauugggacauaaccccacgguaagugaaggaacugcuguauaugaaauguccagaacaggcaaauccauagagucagaaaguaaaucgguugcccagcacuggggguguugggggaaauggggagugaccacuaauggguaugggauuuugggggugaugaaaauguucuaaaacagauuguggaaauaugauugcacaacuuucaaauacacuaaaaaccauggaauugcacaauuuaaauggaugaauuguuugcuaugugaauuagggcucaauaaggcuacuauuuuuuuuuuaaacagcuacuuauuuucuaaaguggcuguacaauuuugugcucccaccaacaauguaugagaauucuaguuauuucacauucucaccaacacuugguauuuuuaguauuuuuuauuucagcuauuuuaauagguguguagugauacaucauuguuaauuagcauuucucuaauagcuaaugaagccaaacaucuuucaugugccccccuugccuucuuuagugaagugucuguucaagucuuuugccuauuuuuaauuuaguuuuuuguuuucuuaguuuugacuuugagaguacuuuauacauucugaacaacaaguccuuugucauguguauaauuugcaaauauuuucucuuagucucccauuuaacuucacuuuuccuucucugaaaguaaauacuucuugcuaaguuucgagagguaucagagcuuuauugucuguguacuccuguauccugagugccuaauaaagucuggcacaaaacagauauucaguuaagauuugauggaugaaugaaugaaugaauucccuguuuuuacugauaagcaacagauuuuuucugagagauaauaaauacauaagaaguaaaucugaauagaucauuuuccugauuaaaacacucccuuccagguaucucuuuagaaaaaaaaauaaguaaucucuacucuagauuagaaagcauggcaugauccagcuugauuccuugaacauuuuauguucuccuccaccucacagccuuuacaaacgcuguuccucuguuucaggcagcucucaugguaugcuuauguuuuugcuucauagaauuuuauuuguaaauacguguuuaguguuuuucucccuaccagauguguaagucagugaccuuuacacauuuuuauucauguauccccuaaaagaauuuugaaaaaaacugaguaaccgcucauauguaucuauuaaucugacaucuauaauucuuuaucguaaguuuaaauaauugcaaaggauauaguuuucagugugcuauaaaacuugacauuuuaaaguggaaguuuuuaucacucuuuuaaauauaucucauggaaucugaauaccauauuugauauccaccaucauuuguugaaaaaaacauucucaaaaaacuuuacagucaucaauuuuacaaccuuuuccuccuugaacucacauuuccauuucacuuuccccacauaauauccuaucccgguuuaugcuuggaaauauuuuuaaaauuuuuauuucaguaauuuuuggggaacagguuguuuugguuacguggauaaguucuuuaguggugauuucugagauuuuggugcuccugugacccagaaaucuuuuauugaucauuuuaucauaguucugugcgacagaaauagauaugcaaauugaaauuuaauuuuuaaaaaaauuuccagugaagacugaaagucucuaaguguuguauguugaguucuguguugaguuaccuuuguaauuauuacuaguguguguggauuaaacaacaacaauaaaaauacacuauuuuaucagaagagccucucaaggugaugcauagguuuaguuuuuucuacugauguugugugcaaguagaugaauauuacuuuuuuaaagaaucugacaagguuuaauaucaauuucauucuuaacuuucauuucuuagugacguuaagagcugagaacccucauuuacauaaacaaggagauaagaagggagcuuuuguuagggcacugccaccccacgcaguucuuggaacuuccucugaauuacaugccgaaacugucauuaacuuuuuuuagugaccugccagacgacaacucaguuagauucucuauuaauuuuguuggauggaaaaaaauugggagcccuugacuugugagaggcucuguuguccagucauuagagucauucacguucucagcuuccccaggauuucugagcguuguuuuguuugagguuuuuauauccgggacagcgcagcauagugggguuggguuuggugagaacucuguguuuucugaaguaggaggagauugcaucgggcaugugggaaaguagagccgaugaagugugugucauggcagauucucaugcagaucugcauaggaagacagaugaagguuagggaccuagacaucaguucccuugaaauuacaugugcugcacacacaccuuagcaauucagccuccacuuccagggauacccaucccuccguuguguggacugcugcugagagcuacaacagggcaaagagcuguguauuuuuuuuucuucaacacaguuuccucaacucaaggcauccaguaagaacucaauauuuuuuuuucacugauaaugaauacagggaaaaacuuuuuauguaaaauuugacuccaaaccugugaaccuuuucaguuucauuugaaaagauauaaaaggaaaaguuuuauccuugaguagucuuuuaugccaugaauuuucaagaacagaaauauucuuuuacaaggacaguuuuuauugacuccuagcuucuugcuaacuuaguaacacugcccauuucccuaaauucuuuuucucuguuuucccaauuacauuguuuuagguaauuuuuacuguuuuucagguaauaagaagguuccacucaaauucuuuacuaaaacaauguuagggugguuuugguacauuuuauacuaauguaauuuucaccaaauuaaaaaaaagugcugucauuuguuucccuuuugccuauagugcuuucgagguaucuggcagauacuuuuagguauauuacaccuaauagaggucuuuguguguacaucaaaugaguauguucuaugcuguuuagacauauuaacugcagauuggcagcuucaucuuuccauuaaugugcagguucuuaaugcuuaggaguauccuggagcuuucuguuuuucugagaaaaucuaauacagauuuucaguugccuuuuaaaaugcuauacuucuccaggaaaccuuaucuuuaauauagcaucugguuuucugugaaguuacaaguuugaaucagaauuuccagcuguggcaucugguuuuauggagccugaauugagaaucaaaaacuggguuauguauuuaaauaccagaaguaaauguuaucuuucuuuuuauaaaacaguauggcauucguauuuaaguauuuccaauuugccgaguuauuguucaugaucugcuuccagagaagcaagauuaaauaacagcugaacagcuuuaagugaauagguuacauuuuguuauucuguuaguguccugugaucccaaacacucggugucuccacagcaaaagauaagaaucauaaaauguuagaacgcaaaacagucugagaggucauguagugugacuccccucauuuuccagaugaggaaacugaggucuuauuuucccucauauagauuuucccucacaaaauaaucacuaacgagugaaagaauuggguuuaauugcauuagaauaaucauguuguuuacuguuuuuaaaaugcagucauucugaccgacagugagagagagguggcagcaaugguccuggaguguggccugccugccuaggaggcugggaggggugcugugaggcaaacagaaugaggaaccaugucgcaaaaauguggcuauauuuuagaaaugcuccuaacuuuuaacuuuguaacuccuuuuuaaagcuguuauguuaaggaaugacaaaaucagacacagguucagugaacaaaaauacucugguauaguuuagcaaaaagauguucauuacagcauaauuuguccuugugaaaaauuagaagaaacaaacuagguguccaacaacagagaaauuguuacauuaugguaaauuuuuuauuuuacuuuauuuuuuuugauauggagucuugcuguuguuggccccagcuggagugcaauggcgccaucucggcucacugcuaccuccuucuccuagguucuagcaauucuccugcuucagccucccgaguagcugaggguauaggcgcccgccaccacgcccagcuaauuuuuguauuuuuuaguagagacaggguuucaccauguuggucagccuggucuugaacuccugaccucaggugauccacccaccuuggccucccaaagugcugggauuacaggugugagccaccgugccuggccaaauuaugguaaauuuaagcaaugaaauguuauguagccauugaagguaauuuuuuagaagaauuuguaauuacauguacucaugguguugaguaaaguaaguagaauacaggaauuacauauaauaugguuuaacuuauaugagggcuauauggucaucccuugguauccucaggggauugguuucaggacucccucuggauaccaaacucuguggaugcucagguugcugguaaaaaggugcaguauuuguguauaaccuacagacauccuccuguuuauuucucuggauuacuuauaaaacccaauacaauguauguacuauguaaauaguuguuauacuguuuugguuagagaauaguaacaagaaaaaaaucugcacauguucaguacaggugcagcauccuuuuuaaaaaaauauuuuccguccaugguugguugaauccacggauguggguguggaacccauggauacacagggucaaguuaugugcauaaaauggaaaagcauauauuauuacagugauaaaagaguuucuuucuaggugauguuauuauggacugauuuuauuuuccuccuuauauuuugcauaucucguaaacucuccacuauaagcagaaaauaagguuggagaaaauaagaauugaagagcuaaauuuuuuuuuaacaccaagugauagaaaacucuaaaaaucccauugaagauaggaucauagacaaauagucccugaugccugugcugggauagucacacacagcugccucaccucugcccccauggugaggaucccaguggucagggacagugacccauuuggaacaugagcaguugggucaaauccacaaauaacuguuuuaaacagcagucauuuuauuugaaaaaaaaaaagucgauuugaaaagccauuuccccccacugaacgcacauucuuuuauucuuuuauuuagcaagcaguuuggagugccuacuaguuaguuccucugaccugaagauaacauucugcuacuagugauuuuuugcccagugauuguugaaguuuucauaaaucucguugauagaauguucuauuguguaaguaacuugacaguuccuguucucaccugguucagguuuaaugauuaaguuggauuagcuauugaauaaugaauguuuguguagaagccagucagugaauaccuaugaaucugaaaaugcagcuuuaaucagugcuaggcuugcugggauccauuuugcuguuucuuugcaguacaacgugggcaagcaucugugcauaugaaaugcuguuuuucuaaaagguaaguuuuuccagagcacaguaugguuuucuuugcuuucagaaucuuugaaaaaucuuugaauauuuugaaguccuccauuccacuuuauaauuucagauuaauaacuucuuacuacuguaauuucauacauuuuauacuacccccaggaaaaaaaguauuuacuuacuucaaauuucuuguauugauuucaguuggucucauuccacauuacaauuauggcuuuccauuccacaagguacgguuuagaguuguguuucaaauuugaaauggguugugcauuaauaaagcuacuguuuuuaauuugaaagaaaagaucuuuuaaggaaaguuuguuaggcacuaggauaaauuuuugaaauguuugucuuauguaaauucaugauagccucaaauuguuauuccucuccuaagaaguggcacuuucagcuucuucauuugcugguuuggcuuaguuguauauuuuguuucauaugccauaaccaaggaauucuagagcuaguauaugcuaucuaggugaacuuugucuucuugcaaaaauaacccuaaauucugugaaacaggugaugucuuacuuauucuaaagaccuucagagaaagaaauucuguauucuuccuaguguuuaguuucuuucguuguccacaucuuucucucucuuuuuaucaaauaaaaaaaccuagaucuuuuucuuaaaacuuaaacugcuuugcuauuugauuuaugcuuacaugaauauaaucuauuuuuuauuaugcuccuuaaauguccugacugccuauuuuguauuaguugauaguuuugcucugacaauaguguuuguacaccagcgaauuaguaucacaaaacuauucuccuuggagagauaaugaagucuuugauuuuggauuggagcaaugauauagauaauccaaacacaggugcuuacuuuaauuuacuuauucaguaaauauuaauggaguaccuauuaugugccagucauugggcugaggauugaagauacaaaacaaacaaaaaccaccagugcuacuguguucuaauuuaguguuuuaagauauaguaagucuaauagggacaccuuucugauauauuggcaguaauauuauuuugggggguauauuaucaucauugaucuuauuaugcaguacuauuuugcgaagaaaagucacugcaaaucuacuugcuucuuuuugcugggagugccucccuucagggaaaaaaaaaaucuaaaaagaaaaaaagcccucaacuuuagggaagacauacauacaugaguuguaaguuuuucuuuaugagaaacaguaugcacugagugucuguggaacaagaauuccccuuaucuagaaaaggaugacuuaguuugaauuuccuaauuaauaccguuauuaaagucuuaugugacuguuuuuaguacgaaggaaaacacaacaucgcccacuuacaugaauugguaaucaucccuuucuuugacagaccauagaccuuagacggaggcaccugugaauacauucucucuggacagaggcauauuaccuccuuacauucuugugucuuggaagguaaaguugauguuaguuuaccucugcaggaacaagacaaauuuuauucuaaauacaguugauauaucucaggaaaauaggacaaggugauccugaggaucggcgaacacauuuuuuuacuggcagaccuuauuuguauuuaagguagugauaacaugguaggcaauauggacaguaauuagguguaaagauucuagagacagauuaacuggguuuuaauccaguucugcuauguacuagcugagggauauugagcacagugcuuaaccuuuaugggccucaguuuucuccuauguaaaaccaggauaaucaguuuucucauguauaaaauaaugacaaucuuauuaggucauuaaugagaauuaaaugaguuaauguuuguaggacaguauaaaacucuggugcauagcguuacguaagugauauugaaugagugaauagacauuuaguuaauucauugcuguuuucgguuuuaaucacauguuguaauaaaguaacauguucuaguuccagggccugaucagucagugaugauuaaguacauuucucccccugguuuuucugcccugauggugcauuauaagcauuuuagaaaacagaagucugugcuccuccuuggcauauuguccaguaauccugggaauucagccugugccucugagagcaaauuggaggucgagcuauccugaccccauaccaaggagaccuuguacuggggagugugugagucaucuuuucuugcccucgccuggcccuggagccggagggggagccuggacaguguccaccgugggccaguagagccaauccagggccuagauucggagccaucauccucacaaacugcucugguugaaacgcuggcuuugugggguuuguuucgcguaaaacaugaggaagcccacccugacauugucuaggcacucuacuuaagucuucuuuagaugcaggcuaguuuguccuggccuuaugaaggaguucuccccaccuccuugaaaggguguguaagucgcugcuucccaugcauaucauguaguuauuucaggcaucuguucuuuuuugcauccuaagugcuuaaagcuuacugaauuuuagucuccugcaugacaccauaguguaacaugacuggugguaauuuuuucuccaaacucauggugagacagcuguuuagcauagaaaggauuagagagaagaugucaaccuuucuacccacaguuggauugggcagcaccauccaaggcugaagaaugacaugcagaagcuccugauuauaaaauagcacaaauauguuaggccucagcuuuuccuccuuagcgcaaaggcuuggguaagcucaguggguggugugggagaguggauguugcauuagaaaggguagagacugcaaagacagggccacaagugaggaauccaagagcgaggcugauggggugagcgaaagggggugaauuuaggagcccuuaaagauguagaagcuggaggacuugauggcggguuggcugcagugguucagcaggagacagugaucagcugugagguuguucucauaaccaagacacaggaucucacuggacuguguuuggagaugggggauuaucaaguugugagagccucagcgauuuuugggugccaguucauccugcugccuaggccucucuguuaccuuaccacuggcguugcuauuuaagaaaucaguguucaucucgcuuauuggcagcuuuggcaagucccucugacacucaguuucuucauuuuuaaauggaggaucuuagauuguuugcuuuaccuuucucuuggaaauguaaagaauuuauaaaaagagaaaucucauuuuugaaaguguauauggaaaguuuaacgugucuuaaugaagguacauuacuugaggaaauauaguucaacuauaggauuaaaaaauugcguuauccgauaaucauagaugcucuuauucaccuucccaguauuucaaacaugaauaauuuuuagagccuguaaugugaauauggacagauaguaccacugcucugcuauucuauuuugcauuuuaacuuguuccauuucuuugcacuaggauuaaaaacuuguuugaguuuacucaacaaaauucauuugccuaaaaaugaauuuuauuagaucauuuuccuguuuaaaaauuuggucugggggaggugcuggagguggacuaauacaagauuaucuuuguuuuugcguuuaguuguacaauuuaaauauaaaagaaagcaagccaaggcaggaggaucucuagaggccaggaguuugagaccagcaugggcaacauagcaagaccucgucucucaaaaaaaaaaaaaaaaaaagaaaagaaaaaaaauuagccagacacgcgugccuguagucccaguuacuugggaggcugaggcagauggguugcuugagccuagaaguuugaggcugcauugagguaugaucaugucacagcacagcagcaugggugauggaggaagaccuugucucagaaagaaagagagaaagagagagagaagaaagacaggaaagaaagaagaaaagcugccaucuugcguccccaucauuuguaagagaacauuuuaacauuguuggcuuacagaaauccuucacuagacauuugaggucuuccaauauuagccuagaacuuauauaugccaggcacuuuucuaggcccuuugcauuucauccucacacacacucugaggcauguacuauaucuuuccuauuuuacaagugaggaaacugaggcaaagacagguuaaguaaguuuggaaugcuguauaauucaugaaugucagccugcauuagauccaggcagucugauuccaaaguccaugcucaaccucuuuccucuggcuccuacaucagugguucucaacccugauuguacauuagaaucauccaggggccuuauggagcaggguggggaagggauaaauaauuuuuacagggcccuacaugagaccaaucagaucuucccucuucuccugcuuucagguuaaaagucacucucucucuguuuucuagaccuuuguaaucucuucuuuccuugauuucuuggcacacguggggcuccuaaugaccuuuugcaauuaaggacacacagcuuuuugguuuagcucuguaagacaggcaccauggagacagggagaugcuucccaccuguauguaaccugcgcaaagcauuuuacagguaaccuggagcuugauuguuaauuccucagcaugugauucaauauauuguuauuuuugcaucaggggaagaacaaggauaguuaauaagagagaucuaggauuaaauagcaacucuaacauaucugagccacacuguucuuaccuauaaaaugggagaagugauaauauuagaggacuuuugugaagauucaaugaaauauggaauaugcucuguaauguagucaucagaaaugaaugcuaaauccauugccuuguaagugaagcacagcaccgagacuuggauaugaaaaaucacuugaaaguaugcuguucagucuucagucaaaugcaagaagccagggaauuuggggagcuggacuagaccuuagggaucagggaaugcagucucuucauuuuauuagcaaggauugaagccuggagaaggaacuugaccaaggguacacugugagcccaaauauauguacuguacaauauguaguguacaaauaguuaauaaauacuuucuuggugcugugaucauuaucaguuuuuacuucguagcauuugucuucucuaucacuucagugugcucauguauauguuauguaacccucaaaacaauuuuguaggccuagcuuaccugaccccaguguaagacuuugagauaaaauccuaaaggauaccaccaugggauaugggcuuauggagguacugaaaaauaacauauauuuaccuuguugacuuuucuugcaugagagggaaaagaguuaaagacauucaaaccacaugugauugaaagcccacgaaccucuuuccaguucuguuuucccaugaaaaugaggcuguuguaucuucauaauuucuugcauguauaagguuaaaaacagaggggaaugaagauauuccagcuacauuucuaguagaacaccuacauuuuguuuuucuaagcauacuguaaaaacuucaaaacagcauuaugcuuugcgcuuauuuuaaaaccauuauuaacaauauuuucuauugaugcuuuaguauagauuuagacuucuaguaucauugauuauuauaauuugaauuaaaagugaaaauucaugauagguacuguuuacuuggaggaccaauugcuguggaagugugcagccuacaaugaagauaauaagaugcgucauuugaaucaauauuucucccaccuaaacaaaaacaauuuuuuuuaaucauagaggaaucauuuuuagaacuaccaggugaauaugcuguggugucaauuaaauacaguggaaacuaccuauucuuacuauuuacaauuccuaaucacuuucugucucuuucugcaacucauuacguguaccacgaugucuugauucccugaagugccuaguaaauuuucucuuuguaggacuaugaaauuaaccaugggcaguggagggggcggggggguugggaaugccugugccuuuuccaaaaauugggguugcuuagagaaaaugauaauguuuagcauuuuuaguggugccuaaauguguguagagaaacaccuauuucaggccucuccaaagacuuugauugucugaaagcagaaauauuugcaguuugacuuuacuugguguuuacaguacacuuucugagcacuuuauggauauuuaauauuguaugacaugaucagcaauaucuuuuuuuccaaauaaguggguuuuuaaaaauauaauggaaucagaaugugaauaacuuuuaaaauuauuuauuaugcagagaaaaaucugaagccaugaauuuuaaaucucauguaaguuaaauuuggaaguacacagauuugcccagaaucugaauuuuauaagccuuaaaaacuuugacauuuuaaaaauauuugaggaguuuguuauuaccaucucuuaaaugcacacauuuuuuucagacuacuagggaagagaguggcuaagcagagcauuguugacugccccagacauccucgacugguuucuaaaucugaaauaaacuucuuagucauauggugauaagcagaauucagaacaugucucuuuuuuaaugcaugugaaauagaaagugauagucaucacaaaaugaaauuugauuuaugauguguugaugcaucgucauacuaaggcacgcugaaaaauauuuucaguuuccuaauaaaaacaaagugaccuccccaugagugauucuccuaauuguuauugucaaaugcuuuucuuuaugcuuuuuuucuugcucacacucagauaaucuacaaacacuguuugaauccuguguuucacuuucuuuucuuaugaaaaguuuucagugaauauagucccugagcgaauccuuuccaacaaaguacuuaacuuucuaugcacacaauucaaaagucaauuaaaugugcgugauucauuuaucacaaagaguaccaccuauacucuguggaaaauucuuucuguucgaaagaagguucuuauuucuaagaaugagcucugauuuuaauuaaauaaagagcauuuuaugcaauuuuuuucuaaagcuuaagauuaauuucuaugguuacuagggauauaaaucucuagauugcuuuaaaacaaagauuuuuguccaggagagaguugacagcucccuauaagagaagcuauuacuuaauuuuucuuuccuaaguuuaaacacauaaaaauauuuguaaugauaccccaaaggcaucauaaaaauguaaaauaauuguacucuaaaauaucuaaaauuacaggaaauagaccucauuuuaaaaaaugaacugagauucauggcuggguaaccggagugugacauacuucaaaaccagaaucucuugucaggauacuuuuaguuuuuuaauggcuaaaaaaagaagucuuuugucaaucauaaaaacuuuaaaauauguucauucuauuaggaaaucuuacuuuuuaguuucauuaccuuuaacguauauuacacuguggcugcgcuagaucccuuugagaggcacauuucagucuuuagaauuagguggcaucacuaggcuugugaucaacgauaucacaagacaaccguuagacuguuuuuaaugauuauuuuuuaaaaguacauagccauuuucuaagcagcuuugaaaaaaggcagcauaaaucguuuccagugucuuacuuacccaaaguauacuuccucuuucgguagaugauguuaacugguaaauuguucccagguuaaagguuugucauauuuuaauaaauguaguguaaaaucuauaguagagacacuucaaggaaaaaacccucaacguuuucaguaaaugaaauuaauauauauccuuuuuccuacguuaguauuaugguaucauuucuuuuguuauuuuuauuuacuaaaacuuuaauugagccuuauauaguaaaauauccucauguuuuuaggaaaagugaaauuagauuuauaaaauguccagacugaaguuuugaaagaaauggcauuuuguauauaauauggaugaaugcuguugaggcuagacgugcucguaguuuaaaacaugccugauccgggaaugcuuugcauuaaaugaguuuauauuuugagagcaaaacagggaaagaaaacacuuuccuucuuuuuuuuuuuuuaagagacaagaaaauuaaguugaaugcguauauugaaagugcuauaagccgaauguuugaacaacaaaaguaaacacugauuauuacaaauguacauuuggaccacguugcuuuuaucuuucaagcaaaacauuucccacaguuuuuguggguuuuuauuuaaguugggaaaacuucggaaguuugugugaaaguauaaauaaguuuggaaaugucaugauuagaguuugauaauaaacaugcaaaagcaaaugggaaacucuauuaaagucagauguaacauuaaauaauguuuucucuaaaauguauuugcagagagaagaacagugauuuauguggauuugaaacaaagacuuuggcuguaauuuaaaauaaagguuaaaugugaauucuucagccugaacauggaugaaguuuuuuguuuuuaagagcuuccuuagugauuguuauaggagccucugugcccuuuuccaauuaugggcacagaaauuaugcauguauuuauagauuccauguaaaaaaauucuuaguuuccaauaaauuuuaagcugcauuuuacgaaguaagcaucuguagagaaccuuuuggagaaaaaauaggagggaaaacguuucaguuuauguaauuauugaaauauaccacuguauagagaaugaauagaaauuuaaaaccguaaucugaaauuuguuuuaaaucucauuguuaugagauugaccucauaauugcaaaucggcauuuuguguucaguacaacuccaauucuuaaggaaauuugucuguucuauuagaguaauacuguaaguuuaggaagaugccccuuuggcuauuguuacauaugggcccuuuugaaaauaguggucaugcuaauauuugaucagauaaugcugacuaaugcuguagagcuuucgaaagauuucuugaacauugucaaguuuuacuuuccuuucuuagguacaugacuguguaucucuuaaaaguguauauguauuuguggggggcaguuaguguuacauuuuuauuguaaauuuauuacaguucgauaugugauuuugagugaaauucauugcaauaugaaugaaaauuuuuuguauguaugguguuucaaaugcuuuaccuaauuaauugucugaaaaacuguuaaaggggauuuaaauugcauauacuaguuuuacauuuaaagcuuucacacugagcugaauucagauacaggaccuuaaauuuuuuguccaaagaaaguaagaacucauguagaaugaaaagauauaauuugagucucaaaaucaagaucuuuaauauacugcucaggaccuaacuauuauuuuucuaguaguuuucacacauuuuuuuccggcaaauguuauguuacggagugauuauuuuguguuacuuuguacacuuaaggagcaauccauuuuuagcaguugagcccucauuuuguaaaacuaagcuguuggcaauuugcuaguuucuuuaaauucuagaaaccacuaaguuuuaccuuuucauuuauuuccaaacaaagaagauguuagaaaguucuguaacuuaucucuugaaauaauauuuucuggccgggugugguggcucaugccuauaaucccagcacuuugggaggcugaggcaggcagauugcuugagcccaggagucugagaccagccugggcaacauggcaagaccucgucucuaccaaaaaaaaaaaaaaaaaaaaaaaaaaaaaaaaaaaaaauuauuuugcauguguauugaagugcuuugaguuucuugccuuguucacuccaaagacgaucauaaugacuuuccucauuauaggaaaaaggaaaaaagggaucuguauauuuuugaggacagggaaugaugaagcaagacccuggacuuugcuuggaauuuggacauuuguauuauuggucaaggccagcauacucugcauuuuauucccauucacuuaguugaaagaugacuuuggaggcaaggacauauaucuuguuaccaaacccucuuucucagaacuuugagauaaaaugaacauucauuccuuugcuuuuguuuuugcuaaaagagaaaaaaaaucaguuugaguaaagcaaaaacauuucuacuuuugggguuugaaugauaacaaagcaguugagauuaaauuauugacaucugacaagcagaauggauguugaauguauguucuugcuaugggccgcuugaaguugcuuuugcuauucucuuugcugaugugaagcagaaaaugaacaagguaacaguuuugauggugagauuagagguagccaggcugacugucuccuggcucuuagagacccuuauaagcucagggccacccccuccccuuguuuagauauuacuugcucuuuugaguuucagauuacaggagcaauuggucugcaugaccuaucuuaagaacuuuaacuuugcaguagaaacuuaaaccaaauguauauccucaagagacaaaucaucuuaaaacuaggcuguugucauuuugauguacuguacugcucacugaggaacagugugguggagagcaccaccuaguggaugggacccauacuugaugggcuguguaggagauuucgucuacauugauguaacucuugcccuugucuugcaaauaagugauuuuuaaucguccuagcacauauuuuuaaguagcgcuaggaccccaggagaaugagauugggaguaguugugagauaugucgguuuucuuuguaguuuucgcacuucuauagguguauguacuggugcuugacaucuccacauucuuauaagcugauauuauaauucaaacaaaacuuuuuuuuuuaaaugucaguaggguaguauuuagucuuugggaauuuuguguuuuugagugcuuauguucaaccucgguaguaagagacggcuuuggauagaaccuguuuguugccacaaacuuuauacuaugcugcuaaucuguucaccucacgagaggaggaguugcugcugauuauaaacuguaggucauaaauuguuaccugcuugucauagagacuauaugccuuuugaguguacuaaaauauuugcaaaaauuagaugaaacaauuccacauuuaaaaaaaaaacaacuuuuaacacaucaugaccacaaauuuuagguacagccauuccuugauauuuauuuuagaaugucaaauucuugauaaaauguaucaccucuucguuuguugaauguuccuagacauuuguugagcuaggaacuaugccaggcuuugggaauccaaagugaagaagacauaguucuuuuuggacuuagaauuuuuuaaaguuuuaaaauucuucaacacaaaaagagugagcguauuccugggaugugggauguauuauguugggguauaaauacauuuuuuugcuuaauauuuucugacauuuagcaaaugcuuuugaagaaacugcuaaauaaaauugauggguuuguuuucauggguuuggcaggggggaggcgacagaaggcugcagguaacaccucuuugguuucguucuucacugaguuuuauccucggagagcccaaguuuggaggcauagagugaagaauuuaagagcacaggcuuagagucuauuccagaguauggacccuggcuuuucaacuugccaggugugugccuuugggcaaguguacucaucuguuuucucauuuguugugaggauucaaugagauagucuauacaauggguuuaacaugguguccgacacauaggaaacacuaaauguucaauaugauuuauuaugaugaugauuuggaaguuuauuaugaugaugauuuggaugauucaguguaggugguucucauggugcacucagucuccccaccaccugcaggccccagaucccugcuuagugugaccaugcagacaaacccccacugauggccagcagaugucugcgggugcugagcuagaaaguucaaaguucuuccuuaugcagaugauguuuacagaaagaguguacccucgugugucucguguguguguguguguugaacaguguuuacaaucagaggcacuuaaccugagcuccaugaaccaaaagccucugaagcucaaaaugacaggcagaaaguuuuuuguuuuuguguauauguuuauuucuuuuauagaagagaucagauucauagcuuuugucaguaucucaaaggcaucugugccccuaaaaaggucaagaacuauacuuuagauguucgugacucuguguaaggccacuggagaaauuuaaaauauaguccccucuuagaaagugaaacucaaauaugaauuuugcacuauuuguuuuugaagauauguaaauaauuuuaaagauagaguugauauuuugaggaacucaaauaugaguaaaauguuuuuuccucucgccccucuugucaagguucugaagaauuuuaagagcaaggaaaaguuaagaauacaggcuauggaguagaccuaauuucaaauacagcuccgacacuuccuaaugaguccucaagccaguuaacuuggccucucuucucuguaaaagaggaauccuagggguaccugccuccuaaguuuauaaugaggauuaaaugcaauaaucuguaaaaagcccuuacaauucuucuuggcauauaguaaguacuauaauaguguuugcggugaucauuuuuguugcauauucacucaaaaacauuuauaauguauccacauucguugucuguuaugaauugucaagguaauucuuuucuugucuauuuuaccuccaucuuauugacaugugaaugacauuucugauuucuuaugagcagacuuuccaaaguucugcagcugaaaugcccuaagucugauaaccucaguaacuagaaucccaaauguaccuggagccuuagaaugauuuuggaagcuuuggaaagcauaaaaguagaaagaaacugacgggguuggugguaggagcuuucaaauugauugaacacccaaaaauuaucuuggaauuucugagcuggaaagcauuuggggguucuuuccaugcaaccuucaaagcacacaagugaggaauugcacaucacccggugacuccaaagucagagaaccagcugggaguuaccaugugccuggaggcgcuguccccgcccucugccugcgugcugaccauccaccacucguacuucuaagagagcaaaggauauaggcugcucauggaauucuaguauaagcagugaucccagaaaaaguguguggugagucaaagacuguuccgugcaggaaaguaccaguagcaucgagaaaaaggagagcuuugggagcaggagaaaagauacggaggagagcgcauaggggacagggcagggacaggcugcacgcuguaggugcaucccacagaaaccuaaugguaggagguuaucuaugugugcuuggcagaaaagaaaugccuguuucagcagugccugccguccacccagcgugugugagcucuggggugagggugagauggggcuugcgaaucugccguucccaucauugguuuuguucccuagggccucuucuacuaagaguaucuugcuuacugccugcgagucuagcauuuucacugucaucaugucuccuaaacucaaaccagccacuuccucugauucacaacugaagaaauggcagucuuuuccaacacugggcugggggcacuggcugguuugaacccauugcaagaauguguugaaguccagaguggccuuguggccuuuuaaaauugucauuugaauuguguaugcuuuucaccuuaugcacuaaaguucaccuugcccuaugggugagacugaaauagugaugaaaugaagaagaaaacuuagaguaguugagcaccuacugugugccagacacagugucagacucuucacagacauuauuuucaucagugaccuguagucaccuucagcauuauuacugucucaaguuuauaccucagagaugaaggcuggaagagguuaagugacacaaagccaugucacuaguaaguggcagagcugggaucugaacccaggucuguuuuaccugguuucauccuuugcaguauggagacucagaagaaugcagcaugcaugcacacucuccacacacagccuccagaccagaugggguuuggauugaaacgcaaagcagugcgaaguugggucggauccuuggguuggaacuucuuguucuguucucccuccucccuuccucuuuucuuuauuaccuccguccuuaaugugccuggcccaugcugggucuuacauauuugucaagugaacaaaugaaagaaaguuuuccaagcacacagaaaagaaaguagucauuauuaaccggcagggauucagaagccugagccaugucuuuccagccuauuguguaguuuuggauuggguuguuaggcagguaggggaggagaauauuuguuuuuagacggcaguaguuagcaaagccucuccgugauguuuuuguggaggaaauguuuuuaaaauagacccuuaggguguucgugacuaguugagcuggcugucuacagggaggggucuccgguucuuuguuacuuuuuauaucccauuuucaucucauuuuuugaaugaugauuuuucauuauagaugucuuuaauggcauaaugaucagaauugcaaaugacaggaggccaggaaaaaugugcauauaaugaagaccuaguuuaucagcagcacucauggaaaaagucauuuuagucgauguaaauucagcucgacucagugacaugaaggugagcaugcccuuaaguggcauuacuagaagcccagagucuggaacaagggaagcaaugguucuguuuuccucugcacuuucugcugacacagagaguauugauucuauucuggaaacuguauuuuauuugggaggcccaugaacuauuuucagagguaguaaguauggccagaagccgcagauguauuucauauaaaaaauuccugagaggaaggggccgggcacgguggcucacaccuguaaucccagcacuuugggaggccaaggcgggcggaucacgaggucaggagaucaagaccauccuggcuaacauggugaaaccccaucucuacuaaaaauacaaaaaaauuagcugggcaugguggcacgcaccuguagucccagcuacucgggaggcugaggcaggagaaucacuugaaccugggagguggagguugcagugagcugagaucaugccacugcacuccagccugggcaacaggagcgacacucugucucaaaaaggaaaaaaaaaauuccugagaggauugggaaugauuagcuuggagaagagagaagacucagguggaguagaucacaguagcugaccucgauucagaguaagaaagaacuuuuuacugucugaggugaaauggauggccagggagaggcagugggugcccuaucaugcugcucuuuuggcaaagcaggugucuucuagauccuugcuagucuuaaccauccaagcagggagguagucacugcucugugugucaucuagccuguucuaggcaaauaguaaggucagguaaaccgggaguggacagagcuucagaaauagugggaauguguucaguaaugccaaauaauuguaguuuggggaacuagaagaaugggaaugaagauguuuaauuagauugaaguuaguaaguuggggcuggaaggagugaggaggaagaguugagugcauaauaaacauuuguuuuuuucuauggguguaagaguccuagaagucuuuuaaaauggaaguugcauugaguuuaaugggaaucuuaagcauuauaaggugccacucaacuuuugaaauuaaaucaugaguucuuugugucaucaacacuaagauucuagguuuuuguuuuuuuuaauuucuggguuucuuuaaagaugauaggggcuuaauauuagaaaggaagcuauacguuccagguuguuagaaaguuaguugcuaauaugagaaauuagacugcuaaauccaccuaccuaguguuaaccacccaugccccccuguuaaccagccucauugucuguuacuugagacucucugcaguaagaagguuggaucuagaaaagucagucuccucuuuugugcacauguuuucucuccuucugucucuaaaaagacauaugcugaauucuggaagccgcagucccguaagauuaguauugguucuuagcaauagguuauuuagcuauugauuauacuuuuccuagguuaagauggccuuauuuauuuuuucugguaagauuuccagacugauggaauaaagaacuugauauauucagcuaacauuuaucacuuacagcuugccucaaggaagguggaaagugaacccagaauacuauauuuuaaagccuccuugggccugcaauuuugaguagaaguugagugaugggaaugaagacauucugggcagagagaagcaggugccagagugcagggcagagaagaggaggcuugcuuaaggaaaggcucuguggucuggcacgcaggugguugcaggaagugcaggaacagaagcugguagauggagcuggcuccuuuagccaguguuuaacaaggugaguggaugggacugacugaccaauuucauuuguagggugaaaaagagagaagaguguaaaauggccaagguguucuaacuuggaaucuagaaaggaugaagacuuucucuuuggggccgucagaacaggagggacuaggaguaagccagagggugugaguggcugcaugaggauaccguugggacauauugcuuuugaggcgucagugggacacacaguggcaguaucuaaaaagcauuuggauacacucagcuugaacacaggagggaggcagcggcuggguggacaauucauguagacaguaaauaaagcuauggauuggaaugagugagcuuagcaagaacauguaaagaaagagccaagggcugaacuuacaagaaguuucagagauuaacaaaggcagagagggaaugaaugaaggugaagaaaaggaguuauagguuuuagaaaagaaccuagagacagugguguucuggaacccgagggaggcuagugcuucaggaggggacaaggaaggaggaggcaggagcagggaggagagccauccgaguuuggugaggccuggugaagagugucccccucaguaggaauugggggaaagugacaggaguugcuuacucaacaacugcugaaagaaaagaagaaagcgagaaaggaacaguuccuuuauguauucccucaacaaacucgcugcugugguccugagcacaguggaaugucuguggcugugcuagccucuuuugugggugauuggucacuggggagcuucuuuugcacagggauaggacucagacaguccccacugugacaucagcaggucaacaugcuccagagguguguuaguucugaacuuuuagcucugacuuaguaauugcuauugaugcauuuuucaauuaagagugaaaggaguuagacucggaauuuagucagugggcuccaaauuaaacuuggguacaugauccuugugaaaaaucacuuuaacuugucaguaguuggcaaacauacagcagugguuuuucuggcugugccuuuggcugcauacuaacugaacagcaagcuguguccacugauugaaugaaaaaaaaauaaugauuuuguguuacagggaccuuuuuacaauaugccagagggaccuacuggagucucuuuaaucuugaacaaugcuuguuucuugcagaggcaaauuaugcaaaucaguacuuaguguuccauaaucaaucaggucuuuguuggaaguguugugagugccagcagaacagaauuucuaucauccugggaagggugaggggguuugcaagucaaaccacugcugugaucagcaaaggacacuugccgacugcuuugaacucuccccacagucagaaugcggucgcucuuugagaagaaucccaucauuuuguaccaggguuuuuguuguacaguauaucgugcuuuggguaauucacaaaacacccacgaaggaacagcuagcaaggcuguucugugggugacacauaaaaacaaagcugggccugccgccugggauggcagcuggcagccaugcucccagagcucccuuuguguggaaucugccuagagugcaguguuucagaauauuccuggacucaacucaucuguagugcauauguaugcuuaaaaacaaucucauuucagcuuccuccugcacagaauggugaaccuuuauuaauccuuugauuccagaucaaaagaaucagagaaauuuuuaaaguccuugggaaaaaacugcuguuuuugagagguccuguuauuacugcugcucuaauacuuguguugccaucuaguggauaaugggaaguauguggcugccuuaguauguuuggaguuuauuguacccuauuacugauucuugaaggggauagaaaaucaauucaaaaaguuuuuuaaaaaaagaaaaucccauguggagcauuaaauaguuauugaggagccacuuugggcuaggcagacgccucagcagcuuaugucagggagacaugaaaacaauucaaaacucagaagauggugacaucucugcaagggauguauuugcaagauggauccuuaaccuggccucgaguuagcagggaagccuuuaggaggugugacaccugagcagagccucacgcauaggagugagucagaagacaggauugggaagcagggagggcuuugcgucuggagacagcagcagagcguagggcacuggcgggccuugggcaugaggaugugggcuuauccuggguuaaaggggaagguaauguacaguuuuagucaaggaaguaugugggaagauucacccuuuuugauuguuuaauaacauguuuuaucugauuauaaggauuuuacguaguaacuguagaaaaauuuuaaagugcaaaaaguaugaagaagaaagcagucuccaaaucuuaccaccuacaaucauugauaccuugccgagcagucuuuuagauuccccucuauguauguauacagcucuaggugugcauuuccuauguuucacgcauaugggucacaccauacaugcuuugggcaaccucuguuuugucucaguuuuuccccacuagguaauaugcuuaugggacuuucauccauguuaguaguuccugguguugaguccaugucaacuguguagauccacugauaggaccagcucucacaggagaccuguuugccuauugggaugcuguguuguuuuguuugguguuuccuaguaaaaccuuuauguguauaagagcagauaauguaagagagucuuuuuuucccccugucaaaugcaucucauguagggaccauacugcuguuuuauaaugaauuugguuuuaugguagauggguuuuauggagaauuucaaugucuugaugaucuaggaaauuagcgucauuaaaauauagcuaguuaaaaaguaaacuugauuuaucuuuggagaaagaaugggaugagucagaugaaugccuguaguuuuagaauggaguuuaaauaacuuguuugguuaaguauuagccuaaugaaggagccagagccuggcugauccuggauuguggcuguuaguucugugcuggcccauagcuauagacagugccuuucaccugaacaaguuagaucucacuaugucccuucuacaggucugguaaaugcgaccugcagugacuuaauuguacucagaugggacagcagagucaucuuuguggguagacuugcagaagcuaaaagcacacaggcacucgguuugagacauaccaaacaaaaauuuauuuuuguauuuauuucaaaccauuuauacaggauguguuaguuuacugucuucucaucugcaaaaggguaauaaugauaccuacccuaagggauuguuaggagaagcaaaucggaugcauagcauuuagauuggugccugccguauaguauguaguacucaauaaaaauugacuauuaacuugugccacuacuauuuuuuaaaaauaguuuuuacccaauucccuuuuguagugaagcccacggagauuaagcaacuugcucaaaauuucagcuggcaaagguuaaaaguugaguggagcuuguaaaauauaucccuuucuucccaguccaguggaacuaccugaaagaaaaauacaggagucagcaagaaaaagccaaguggagaaccugacuuuagaguuauggcccaauacgaguggggcaugggccagaauauacccucucugcuggcuggucgaucugaaaagaggagaggacagggcagcaugcucucccuucucaaaaucugaacacagcucucuccucuucccucuaagaagagugaguaaagguugggagauaggccaggaagacugguccagcugaagucccuccacaugaugcauggcaguggggaauaaggaaucccuucacaguaaguggcaaagcagggaguagaacccaggcaccuuggccaacucccuggauuucaugcccaucuuucuuuuguccacccugauucauccaggccccccacagagucuuuuccucugcccucuacccuauucuaagcuaaaaacugaauauagaugaacucaaacgggagaaugaacaauccuggauguugcuuucguuacuuguuuaaaccauguuuucagguggcuugaugauagauacucaaaaugcacuggucaccguuguacugccagucuuucugaccauucuuuuuccuugcuguauuugugaaccuucuucucaauaccccuaugggcuugccaauccaaagccccccaugucguaaaacacaaggaacaguaguagccaacuucagaggagacaaaugucaaucagugaaaacguuuuuguuuuuuuuuuuugccgaucuuucuguauccaguguaguuaauuuguuaaaaaaucaacauauacaaauacucucacaaauacucucaugaagcucaguuucuuucuaugaagaaaaauucagaccuaacuaagcuaaacauaacaugaacaccgugagucauacagaucugugaucaaugccaauucuuccguuuauuagccuugugaccuugcuuagguuuguuuccauguuuacuagguggggcaggaggagguaaugucuaauucguacgaucguuauggagggguggaaaccacagagcacacgucaagcaguuuaugcacuaccuggcacacacguggcgggugcucuguaaguagcgaucacgauugggugaaaucaagcauguacugcauguugaauagagauguaguacaaaaagaaaagagcagguugauguugauauugcccacguggaggcuuuuucucaguucccaggugcuuccuugcaaauauagcacuggaaaacuguaguugugacuugccaggauucuguguaaauuuggcaguuaagaacucaagacugguacuuagacuggcuggauuggauccaggcuucaacccacaugucccugaggaaauuccuuauccucucucugacucgguuuucucauccauggggcagccaugaugcugucacugcuccugggcauugcugggagaagugggugaguagcacacacagagcucuuuuggacuuccgccugacugggagugaggucccagugaaaguuuuguuguuguuuuuugguggcauugauccuguuacauggaauuuaagcaaagauugcaaguacuuagaaauaaaguagccagagauuguugggauuuaguuguuacuaaguaaggguuguuccuaguuugguagcagaaaaucucuaccucaaaaugacuaaaaauguuaaaagaagaaaguacuacaugaguuuguuuuguuucguuuuguuuuguuuugagaccgagucucgcucugucaccaggcuggagugcaguggcgcgaucucggcucacuacaaccuccaccuccaggguucaagugauucuccugccucagccucccgaguagcugggauuacaggcaugugcgucaccggcuaguuuuuuuguuuuguuuuguuuuguuguuuugguuuuuugguuuuuuuuaauuguauuuuuaauagagacgggguuucgccauguuggccagucuggucuugaacuccugaccucaggugacccgcccgccucagccucccaaagugcugggauuacaggcuuaagccacugcccaagccccgagauuuuuuaaaauaacauguuauuauggaaaauuucaaauauauacuaaaguggaauagcacaaggaaccccccauauaagcauguacucaccuucagccuugagcaacucaggacucauccuguugcaucuguuaccucccccugucuuauugugaagcaaauccugggcauuguauaauuuuacuuguaaguuguuccguguauaaaauauaaggauucuaaaaacagaaagauaaaugaaaacauaauccuaguacauaauaucauuauuacaccuaacugaaauuuauuauuccuuaauaucacuaaauauuaaguaggagauucuuuagugaaauaacaauauacaguggacauuaaaacgacuuuaacaucaaaugaaacuaaaaaacaccaacauauuuauuaauuuaacaguacugagggagcccaugcuaguuccccguaaugguuaaggguucuaguuccagcucagucagucuugagcuuugguuucuuuccacuaagaauaucuguuuccacagguuaucagaguuaagugaaauaacucauuuacaguaacuaguauagaggagacauuaaauaaauauuacauuccuuuccuuuuucuuuuaucuacaguucaauucuuguuuuaaacuacacuuuauguuagaaauacagaauucucuauucuuuguccauacccuuccucucugauggagacauauuuaauauggcgguguaaucaaaccguagcucacugaugaaaacucuuuuccaugauagaccaucagucugauggaagacuguucacuugugaggacagaugaucuugugaagcuguuagguugcccagucuuaguagauuuuacauggugaugcugcaccuucugaacacaccucaaguaagaggcauucucuugauguauauacuuauuccuacuuuaucauauuaagugacucuuccaaaauuagcacugcauguggaaacauuuaaaguccaaaacauaggccggauaugguggcuuaugccuguagucccagcacuuugggaggccaaggggggaggaucacuugagcccaggaauuugagaccagccugggcaacauagcaagaccccauaucuacaaaaaagaaaaaagaaaaauccaaagcauacaacuacuuaaccucucuaaaaaugugaaaauguaaugagcacgucagaauuguaugcgcuauaauaugcggucuuugccaguuuauucugaaaaauaggacugagucuaacaguaaauagauuaagcuuggccaagagucuuuauaaaguuaaugguagucaugugauuaaacagucaaaucauucucugcagagauaauuguauuaugcuauuuggggacuuagguaugccuauguagauaaaucaaagauuuguugaacuuuuuucuuuguuguugauuugucauguuuuuuuuuuuguuuuuuuuuaaagaaauuaauagaaaauucagagcucucaaauuucuaaagaaaucuuaauguuccuuuauuuuuucauucucagcauuuaaaauaucauacauuguguuccuguuaaguauugaguuauuauacugauguaauuuagucaguaauuacuuaacacaccucuuaucaagaauucuguuuaauccugaaccaccugcacucuguuuuaauaaccucguuucauagaaauuucccauuacagagcauaugaaguugggaucacauuuguuagacuaacugcaaccucuuguauaauaauuaugugcuugugggccucuguggagcuugcuugcuccuggcauucaucccuaggcaccaucccucccuuguagaauagaacuaacuaaaaguaggggugggcagcuggaucuaaccuguacaguagauuccucugcacuuuucaaaacuuuguauggaaaacuuuauggcuucuaaaaaaacaccuguuguggauaguaagguucuuaguagguguauuaguuucucauugcugcuguaaccaauuacaucaaacuuguggcuuacaacaacacagauuuauuaucuuauaguucuauaagucaaguguccaaaaugggacucccugagcuaaaaucaagguguuggcaggaccguguucuuuucuggaggcucuaaggaaggcccauugcccugcccuuuccagcuucuagaggcugcccacauucuuuggcuuccuuuccccaucuucaaaaccagcaacauuggaaugagucuuucucacauugcauuacucucacucucccuucugccucccacuuccacauuuaccgacccuugugauugagccuacccagauaauucaggauaaucucucuacuuuaaggucagcugaucagcaaccuuaacucaugugcugcauuaaugcccuguugucauguaacaccauauagucacagguucuggcgauuaggaguuggacaucuuacagggggaugggccuggggaagcuggaaaaccauuauucugccuacgguagcagguauaauccuucugggauuauucaguacccacuauuuauucaauauuuaguaaaaguuucugagggucugcuuugugccagaaacugccugacaagcucuggggaaagagagaggacucucugcccucucagaguuugcagucuggugaagggaaaucaguuuaugaacuagucauuguuaucaugaaggaacaggugcugaaauagaugcacauguagcguuuugugcgggaaugggaucugacugcagcugggaguguagggugaguaugaggaggaaaagagaaucuugaaugaggaggaagaauuugccugggagagaaugauggguagggcguuccagggaaagggagaaccauauggguaugcaagugaggggaaggccugggacuuggaggcuggaguggugcggggugugcggcagggacuuucagcgcugaguugugaagggccuugagugcugcauuugggaguuuggacuuuuucccguuguuuagacacugagaugacucauuggcuuuccuuuggcaaaucagcaugcagagcugcuuccuuuaacugcaguguauuuugaaaccagaauucaccacugucgaauguauucuacccacgcauuucccuugcuuugcucauuuaugcuguucacauggccccuggaaguaguugaguguuugaccccugguaggcaggggaaggagguaaggagauggaaaccauugaagguuuugaaacagaggaguagcuuggucaaaucuuuuaugugauggaaugaacaccuugcuugcguaucucuuaauuuuuuucccaacagacuuaaaagucagauuuccgaccgggcgcgguggcucacgccuauaaugccagcacuuugggaggcugaggcgggcggaucgcgagguccggagaucgggaccauccuggcuaacauggugaaaccccgucucuauuaaaaauacaaaaaaauuagccgggugugguggcgggugccuguagucccagcuacuccggaggcugaggcaggagaaugacgugaacuugggagguggagcuugcacugagccgagauggcaccacugcacuccagcccuggugacagagcaagacuccaucucaaaaaaaaaaaaaaaaaaagucagauuuccugaugcagccuaaguggaaagcaggaacaggauuguaaggcaggcaggcaugguggugcacugggaaacacgcugaauuuggacucaguccugagcuuuugaaaccaagcucacauacuaaauguguaaccuuggacaagucacuuagcuuuucccaaacugguuaaugagaacaguaagaaucauagcacagcaggguuguugggaagagaaauaggccauguacgugaaaguguugagcagugucagggaugguggacagucucucaguccugauuugcuaucugugaaauaaaugaauauugugaccauacuuaauucuuuuucuuugauuuguuugcuuacaaugccuuaggguguuuuucugaaucacauuuauaauaagagucuagacuaugugggaaauuuagcugaacccaaacugacauaucuccagacaaaccauggauguuucuuuugugaucaaugcuauuuuguauuuaggcauauacucauuccacaguguuuauugaucaccucugugcuucuuguugugcuuacaacuguagggaaagaugggcagccccuccuugcauaguucugccacugacaaagaaguguguauauaaaaguuaggucagaguacauggccaugaauaauugagugccaagaguguggugugcagaaguccuuuuaagaucagagcaaagugaaaauuagccuggguuggccuugacagaaaaacuuccauggaagagaugaaaguuccgcagaccuugcaaggcuggggccacguguguuuggaacgagugcaaagugugugagucggaagcuggaguaagacgucgucagaggaccagcaggccacuggcuaguaaucauucucccucuggaaacacguuugucccuauugacuguggucugagcguucuucccaccacuuuuuauuuauuugugaauugcuaguuccaugcacaguaccuggcauguaguaggugcuuuagaauagguuuuuauuauacuagaaacagccaucacaaacacagugcuuuguaccuguaucuuugaguucuuuuucuucauccauggaaauagcccauaggaaagacagagauuugcuauguggggauaaauuguuaccccugaaucuuugcuuuaacucugcugcucugcaugggcccuauuuacaaacgcaacagcuucagcuuuagaacugucccuuagaacacuuggaagaaggaauacuugcugugcaauuuuagcuauaagaaaagaaaaggaauuaaccuuauugaacacaugcuauguaauuacuagacaugcauuaucucauuucgucuuuaacuuaccuagaaaucaccuacucauagugucauagguccuaauaauuagagguggaaggaaccaucgaugagagacugaggcccaggaaugguaacuaauuugugacuguacgagaguccaaaaccgacggugcucaguuuguagcuucagaaucuuucugcaauuugcauuuuauucucuauuaauuuaaaauucauuacaugaguguaacauaucuauauaaacuguuggcuuucuuuuuuaauuuuagauuucucacauuggcaaacugagagauuuucuucuggaacacaggaaagauuauauuaaugcuuauagguaaguacauauuuuuuuaccaggacuuuggugacuguguucuuuucuacaccuauauuucuuuugcgcuuuuugcccucaccuuuuucuuaauaacucagaguuguaaugaggaagaccaguuuggcaguggaaaaaucuccucaaagcaaaaggcucugcuguacuccauguccucaaagucaugaaaucacaacagcaauaucuuccagucuauuuguaucucucuauguaccauuaucuccugucaaaugaaacuccaugaguacuuacagagcuguauuugaaguuggggacacauguauuuguaugcccucaaccuguggaagaacaaaguuuucaagccucugcuaagcuauuuuugcccaucucuugcggucccagucugugacaccaguuuugcugguuuggugacguucucaugagcacauuucaguccuuacccucacgucgcuggaucaugccucccucgccaauucccaguccucaguccugauggccauuuucuucuuuuguccuucucccaggcuuuugacaccugcuagaggcagcuacacacccacuuuggcauagccuucauuucuuacggcacuuuugcugaauccuucuguucauccccuaauguuacucauguugacauuccuucugguggcuaagucuaguuucuacucaguagccagagucuuuuuuaaacuuuaauuggauuaugucaccaccugaguaagcccaccaugaauacugcauuggaauuagcauuaauaccagccucuacacugcggucuccccacuccugaucuagccccuggccuuauuucaaacaccgccuucccacgacggugcuccagccaugccagccuuccuuaaaggugccaugcccuuuccuggugcagggcccaggccuaugcuguuccuccucuucccauggugguuuccuuuucaaacuuaaaggcucaacuuaauagucccucuucccagaggccuucucucacuacccuuuauaaaguaggucucuucuguuaguuaguuucuccacccuguauauuuucuucaguaacaaaacacaauuuguaauuauuuaauaauuacaguuuauuaucugucuuugucaccaggcuguacaugucaugaggucaaggaccuugucagguuuccaucguguuuccauaguuccucacccauauuuggcacucaguaaauacuuguugaaugaaugauuuccuccuaguccuaaaguccaugacuagcccagcagcacucaacuguggugauuuugcaccccaggggacauuuggcaaugucuggagacauuuuuguuuuucccaacuaggaagaggaguauugcgcauuuaguggguagaggccaagaaugugcacaacucaggacaacucuccacaacagggacuuacccggcccaaaacugaggaggugcugacauugagauccccugcugcagccugaccccucacuucagauuaaacuuccugguucgucacagguuuauugaauucuagaugcuuagggcacaucuggggguaaaauacaaauauuccugcccucauggcguuugcauucucgugggcuggcaaagacaagcacuacguguauaguacauuaggucauagguccuauggaaagaaaaggaagaguagaaccaagguaacagggaucgggagugcugggaaagcuugugauucuuacacagaguagucaggaaggccccaucgagguggcaucagagccuacuccucgguaaaguuuggaaccucuaauagggucucucaguuuccuccucaccucaucaccuucuuuccaccugucauagagaaaccccucucuuuguuuuuaaggauacuguccuacuuguguauaaacuaaagggaagaaaaaagccagacgaccaaaaauagcugggaaucaugaaugcagcaguaccugagaaguggugcgagugcauccuuuaugucaucacucacaccgccucucagguaccgcugugcucaugauuccuggccaguuuucaucaucuggcucuuuucuucccuuuaguuuauacauucagcgguacaagcauauccuuuaucucaucccucacaccgcuucucagguacugcuguauucaugauucccagcuauuuuuggucauccgguucuuuucuuccuuuuaguuuauacauuugaccuugcuugcuccuuaagccaacaggcccugucgcuucauuucacgucagugccaaacauggggagaaagucuaaucagggaucagccaacuuucuauaagagccagguaguauaguuuagguucugugggccacauaugguuucugucacauauuuuuuguuuuguuuuuuuuacaaccuuuaaaaaccuuuaaccauucuuaguucucagaccauagggagccaugccugcaggcuagacuuggccuacggacugcaggugacgugaccucugcuuccucaccuuuuacucugcgccaaccauauggcucgguuucccucacuuuucugaaauuuuucuccuaaugcucaucugugacuuccuaaucaccaaauccaguggcuuuuccucaaggggaauauaaauagacuuguaugguacacacucuggugugucuaccuucuuuuacuccacauguuuuugagguucuugcauguuguguauaccaguaguuuguuccuuucuguugcuuuauuauuuuuaauauuccauugugugacguuaccauaguuugcuuauccauuuaucuaauagagaauacggggcuguuuccacuuugagacuauuaggaauaaagccuuugugaguagcaucuucuacaagucucuuuguggacauacugauuuauuuccuuugaauaaauaccuaggggugaaauuagugggucauacaaaugguaggugcaugcucagccuuaaaauaaacuaccaagcaauuuuccaaagugguuuuucacuccuuguagcaaugcaugcgaguuauaauugcucccuauccuugccaacauuugguguaaauaggcuuuucaguuuuaaccaugauaauguaaccgagcccaggcuuggcugcucaccgcuugcaaagccaauaacaaggacgaaaggaaggugacuuuauuuccagagcaagcagugggaaggcaggagcgaugcugcguacuaggucugugugucucuuucugauagcuaucaucgcaggcuggcgacaugucagcaauggccggguuguagacuacccgccuugagguaaucucuggaauuuugcaguuaggucuccgugcucagucuauuucaaguuagccccugcaacuuccagguaagcacauaauuagauacauacaguuagguaaaugugcaugguguaagggaauguauggugagaaagggaggggacgugguguuucagagaaaguacguuucaaggcuguauucuaagacuaaggaggaaaaaaaaggguuucugcaguaagccuuaggauuacaucuugagacuagggagaaaagagaaaaaggaauaaaaaguuuuaaagugcacuuucaggcuagccugucuaauuccagugacaaaugugaaauggcaagucacuguacuugaaguguguccuucucuaaugagaaugauguuaagcgccuugaugguuuuuucucagcucuucuacuuugccacagccuuugauccuguugaccaucaucaguuucuugaaauuuccuauucccuugacuuccauuacaguauuuuuuuggcuccucucaccacucauuuuugccucuuuguccuucaucuaucccauaagaacuccggggcucuguuucaggcccuuuucuuuucuuugucucuacuuugcuuagaaaaaaaguucuaucuaccucccuagcuacccucccacccaccccccaugcccaccuuaucuuuccauccugaauguuuauucuguguuagguacucugauaagcaccaguuauucauauuuuaucucauuuguuccucacaucaacccuaugaggaaggcacugcuguuaagccuguguggcaggcaggcaaugaaagcauagcgauggcauaaccugaagaucacagcuggugagcucugagccagggcuggccauggaauccuugcccuugcccaccacacauucuuaccaccuacuguggcuuccucucucaccaguaugccaguagugaaaccaccuuugcaaagguuguaacagugagaaaguuaugacagcgaacgagaucugaccuaaucaacuccaucuugccuuuaaccucccagaugcccuugaucauuacuagucguaggccaaacuaacuuugggaggaaguuaauuuauaguuuaacuuugaaacaaaugugauaacagccccucuuggaaacaaacgcccuucuugcuuggggacaaggccaccuuuguaaaaccaacaaauuagccacgagauuagaaauuauggcucaggagucauguagccagaggccagaagacugcuaaccuccccauuugcuccuauagauaacauuacugcuauaaaaccuaagauugauguuagagguauuuucagaccccacauuuugauggaucagcuggcaccaugcagaccaggacacuggcucaucuggucuuauggcccccacccagaaacugacucugugcaagaggacagcuucgacucccuaggauuucauccuuaauccaaccagucagcauuccccauucccuagcccccugcccaccaaacuggcuuuuaaaaaucgagccuccaaaucuucagggaggcugauuugaguaauaauaaaaccccagugucccuuuuagacagcucuauguauauuuaacucuuucucuauuguaguuccccugucuugauaaaucagcucuaucugggcggugggcaagaugaaccuguugggcaauuacaguuguuccuaaaugcaugucauaggcacaggcuucucccaguccccauugccacuguccugcucgcccagcaccugugagcagcaccauucccaugcaugcugcccgcuccucccauccgcucuagagugcuucagugcagccuuugucacuugccugaucucuuuguucucaacucccugcucuuugucccuuccucuccuggucugucuggaaggcacagguguaguccuuaucaucguagauggaaucacgugcuucccucuucaaaucccuucucugccugcaggauguggcccauccauacuucuuagauaagcaagacuuuucauuacccucacccacuuuuccauccuaccccuuuccuucaugugcccuacagcugcauucagaauuaacauuuguucugccuccaggccucuacucacacuaucagguuggccuguugcucuucacuccaauccacacaugucacauguucacaugcuuccauccugagagacccauuuaucaccaccaccuucucgguagagccugcccuggcccugccuuccuaucugaaagccaucucuccugccucugaauacugacagcucuuuuucugugcuuuucuuaugguacuuuucacaugugccugguagaagaguaauuuguucguaaucacuucuaccacauuucuugaggugaaaaacuguguccuacucaucucugcauguuuauagugccaugauuugaucaauuugauucauuaaucagcuuauucauucugcaguuauuuauugagugccuaccaugugccauagacuaugccaggcauggaguauaaaauagugaacaaacacaaacaugguugucccugccuucauggagcugcuaagguauucaugucaacagguaacauugcagauaugauagguacugcaaaaacaguacagauagcuuuuuauuuuuccaacuuuuaaguuccuggguacauguguaggaugugcagguuuguuacauagguaaaugugugccauggugguuugcugcacagaucaucccaucacccagguauuaaacccagcauccauuagcuauucuuccugaugcucucccuucucccaccccugauccuccaacaggccccaguuuguauuguuccccaccgccucauguccaugcguucccauaauucagcucccauuuauaagugagaacaugugguauuugguuuucuguucuuacguuaguuugcugaggauaauggauuccagcuccauccaugucccugcaaaggacaucaucucauuccuuuuuauggcugcauaguauuccaugauguauauguuccacauuuucuugauccagucuaucauucauugaugggcauuuagguugauuccaugucuuugcuauugugaauaaugcagugaugaacauacaaguacuuguccaugugucuuuauaauagaaugauuuguaucccuuuggguagauacccaguaaugggauugcugggucaaaugguauuuuugccucuaggucuuugaggaaucgccacacugucuuccacagugguugaacuaauuuaugcucccaccaacagaacaaagauaaaacuuaccagaaucucugggaugcagcuaacacaguguuaaaagggaaauuuauagcacuaaaugcccacaucaaaaagcuaaaaagaucucgaguuaacaccuaacaucaaaacuaaaagaacaagagccaagagcaaacaaaccccaaagcuagcagaagacaagaaauaaccaagaucagagcugaacuaaaggagauagagacacacacaaaaaaaaaaacgcuucgaaaaaaucaaugaauccaggagccacuuuuuuggaaaaauccagguuuuugcaaaaaauuaaugagauagacuguuagcuagacuaauaaagaagaaaagagagaagauuuaaauaaacacaguuagaaauguuaagagggaugucaccacugaccccacagguauacaacugcauggaaaucaaacaaccuguuccugaaugacucuuggguaaauaaugaaauuaaggcagaaaucaagaaguucuuugaaacuacugcaaacagguagcuuuugaggaauuuagccuugucagagaaaguguccuuaaagaagugacauuugagcugagcucugaaggaguacgaguuaccuagguaaagcaagaaggagggaagggaauccaaaugcaaagggguuggcacgugcauacacccugcagacagcgucuguccuguagugaaacaugcagagaugaaaaagauaguuucucacacacuaaauauuuaucgagcagaugaaggaaugaugcaagucaucgaaaaugccauuuggaaagaaaaagagaaaaaaacauuauaagcaacacuucuaaaacgcuuucuggaauagacuccagcucuccauagacagugggaguacaggugucuugucucgucucuuccccuagcuccauuugcacuggcuuuaggauggcauuuuaccguaggacucaucuucaaauguauuauguaaauuaaugaaaaaguuggauuugacagauaagauaacaucauuaggagcaucuuuuuaggauuucaucuuuauaaaacgaggggugguugccuuucagaagcauuccugucacaaagauagagaauauaaaauaaauccugcuuuuuuuuaacuuugucaauauaugcaaaaauggaaauacuucuuauaaauucuccaauagagaaaaauaauuauacccuaguugaauuuuaaauaauccuugaugcuuugucuacuugcacuuaacauccauaggcaauuuuaugcuuuuaaaugcacuucauuugcauuauuuuggaauauacuaaaauaauuauuccgaugcauaguaccaagaaaaccuuauuuuuaagcucugaguuaaaaauaguugguuaacacuagaucgcagugucaauuuuauuucuaaagguguguauguguaucaaauacugauuugauaggcuguaaaaaauggaagcuacagugauuuuguaaaacuuuacaaaacuuguauaaagcucucaauuuguagcuucuuucuuuaguaucugacaaguuagguugacgaggugguuguaaauaucuuucauacaaaucacuuauuaacuucccuuuuccuugaaaagaaauccagcaaaguaaaugcuuagaguguugguuugauucacaccacuccuuacgaaccaugugaaucugugaaacucagugucuuccucuaaugcuacaggucagcaaauaacagccacaggccaaaucuacauuuuaaauauacuuuuaaauguaguuacauauuuuaauguuggggaaaaaguaauaaggauauuuuaucacaugugaacauuaugugaaauucaaguuucagugcccauaauaaaguuuuauuggcacacagccacguucauuuguuuacauauugucuagggcuguuuuuaugcuacaacagcagaguugaguagcugugaugggcuacaaggcccacaaagucuaacauguuuacucucuggcccuuuucagaaaaaauuugcaaagccaacagugggagggauacucacucaggaagcaguugagagguucaaagcagacaguaugauucaaaugcaaugugaaaagaacaacacaguggcauccggguguucuucugcaacuuugcaguuguuuuaagcuuucgauguaauagugauguuaaggcaguuauuauacucaaacagcaaaaggaggcuccugcacacuguuuuucaguguucccagacuacugcagcauggauucucaucuuaguacaguaaagaagggccuaagccuuccccuuucccagcuacaagggcagcaaaugcuaggacugaggauuggguucccuaggggccagugccagcucugccacuuaagggcagauaacuucagaagauagaacuguuguccccgaggcauucuucauuuuguuagguacaucgccucauucuagaaacucagucuuuuuuuuuuuuuuaaggugguuuugcuauguuguccagguuagcuucaaaauccugagcucaagugauccuccugccucagccuccugaguaguugggacuauaggcauaugacaugauacccagcuagaaacucagucuuuuaucuuuuacucauuuucccgaggccaguuguucauugccaacucaugcacacugaauucuacuccacccccuguuuuggucccugugaaagagcaugggcuuuggggucagucacaccuaaguuccagucccaauccugccauguauuuaucaugugaaugaauauaacuugccuuugugcuaguuuucuuuuuuauaaaauguggaugauguucucgugaggauuaaauuagguggguaugagaguuccugacacauagaagucuccuggugaaugauaauugaauuggaaccccauuugaccuaugcugcaguugcaggggguuggaggguguugguuauugaacaagacaaaacccaccucuguuuccugccagagagcugggaggagggagaaagaaagaaauggaggcaggagucagaucaacacaguggagacccacgugucauaucagcuuuaucauugguaaaaucuaggucagcaaacaaagcuuugguuugcaggcggguggccuuguugauacucugcucuugaauuagacacacucaggcauuagugccacugcgcagccgcagccccuggagcacagacagcagggacaggccccuuugcaacauaggagagagaggaacagagcggaaccucugcugucucuaaguagguaaaagagaggagagaaagguguggugacuauaugcacaccccaugcuuucugcgagggggccagagggaggaggcucugggaggaggcaaggugucauuuggggaaguugguucccacagaaacaugaggauuagggaauaagcauuccccccgguagcccagguucuguccagguggagaaagaccacccuuauugucucucaucaaguucucccucccaaaggugguagacugcuuaaagccuuucuuuuuuacucuucugcccucccagugcaaugugcuagccuuggccugcuccuaggaacauuuuauguggaguaugaucauggaauugaaagaauauguguagaaauacugccuucagaccuaugaggcuuuguuaguuugacauaauuaggaagcuguaauuuuuuccagaauguagagcucagacuuuauugacccauuuaauuuuuuuuuaauaaugacauuuuacuagagcagaacagcauguaaccuagauagccuguggcuagaucucugaaugauuuuaauuaaaaauaaugucuccacuucugguagauggacuuuuuccacaauauccuggcaacaaaacaaucugggagaaaaaacuuccuugguuucuguuguucuuacuaauagaauaaccauacugucaauuuucaauuuagaagguuaauguauauauauaauguuuccuaaaggaacauuaccuuuuaauuaaauaaucaguuuuaucaaauuaaccuuuagaccuuuucaauuucacugagcugaguuuccauuaaaucaaaauauagaguaggaggauguuaaucgaauguucuuggaacuagucauuucuaggucuguucugucugcaggguacauauucacugaguugguaccuuucugacucauuugucccugaccccguuagccucuauuuccgaugagaagguuccuaguagggaugaaccuaaggcuuuggccccucugcuugccacucuggcuccuccccagaggggagccauucaucugguguuggaggugggcugggguuggggagaggggaucgagcuugcuggcuuagcgccuuugucucacuguugggucuucccucggacagaguccauucucucaugguugccaucccaagccuaaguaacuaauagaacaagauccuaaggagcauuggaauaaggaacuaauuccaugucacucuucaaguuccacugagagaggaucaucuauucccuaggaggcuggaggcugugggauuucuuuuuccaacucuuccuuagaaaauauggaagugggguaggggccgugggauaggggugacuccaagggaggagaggaugcuuaucuggugauugggagugagaaggacuucgugcucaucuuaccccuuucuuuuuuagaagggccuguccucaggauggauguauucccuguuuguuugugccuuaaguuuccuagagaaggcuuugggagggggaugccuaccugucuugggguggggggaaaaaucgguuuaggaggaacuuacuagggagcacagucguagcuguguaucaagcauauucuccaacucaggcucauucauugguucaguucauucaaaaguauuuauuacugauuuauuaauugaucagccuauuaaaaaugcuaggcauugcucuugaugauggggauacagcagugaacaaacagaaguccuugccuuuguggaacuuacguuuuuagaggggagagacaggcaagaaaagaaauaauuacacaaaauauauggaauguuagagugggguaaguaucuuuacggggaaggaagaagggaagugggauagaaaaugucagggaggggacaguuuauaaagaaggauuagggaaggccucauuaagagggcaacauggaguaaacaccuaaaagaaguaagggaugcauugaugcagcuaucuggggaaagaacauuccagaaggaggagacaaccaacacauguaaagguccugaggugggagugugccuggaauguuuagggaacacccuccacccucugauucagucauuuuguagugugagacccuucaguagcugcgccauuguucucaaaagcagagccuacauucuuuauaagccuggcuuaugcuguagcccugacuccacgcuccuucucccucucccucuccccaucuggcuuacgucaguugggucuauuccggaggauuuucuaccacacacccuucauauguguucuacuaucuaucuagaugguucucucaccuuuucaccuggccuguuccuccucacccuucaagucucagcuuaaaugucaccugaucagggaggccuuuucuucucuucccaucccacucagacuauauuauguucucauuugcugcugcccuuuccuuugcugucuuuuuuuagccauaccaugucugaauaugggaggaugacagacacagaacgagaccagauagaccaggaugcccagauauucaugaggaccuguucagaagcaauucagcaacuacgaacagaagguaaagugcucugaaagaugcaaacaagcaaccaugaauauagcaaguaguuaaacaagaugcauauggugcggccaguuaaaauucccucuucuuauuucgauuuagguuuuaaaacguuaaaaucuuuucuuucuugaucaauguuuuaaccaaagcuguuaaaaguacugcaaaggcuguaucauucaaguuaaaccaaugagaggagggagauggaaaggaccucuccaaacagaaccaaaaauauaucuaggggccaggggcagugaagacaaauuugugugugugugugugugugugugugugcguguguguguguucuguguggcaaauuguauguguguggguguguauguguguaugcacaugugugccucuguucuguguggcauuuagugggaugggaguugacagcagccugggguacuuaagcucuacuuguaauauucaaguaaacuuuccuaucaaaccuucaagguuaggaggaaggcucuggagccagggcugcuuagguugcaccccaacuccacccguccgagccauauagcccucugcaaaucacuuaaucucccugggccuuguuuuuuugucuaugaaaugcagacaauuagggaauguaucucuaggguuguuaugagcauuaaguuaaauuccuacagcaugcuuagaacugugucuggcacaagagcgcuuauuaucucacuuucguugauguuuaauucucacugagacaaugagauggcuucccaagucacgccucuuucuugauucuuuuuuaauuugcuuaggcauuuacagaguacauuaaauaguaaguagaguucaaagcugccagaugcuguugugcucacaacacagacuuuuguuggggagguuuuuauuagaaugcugacggaccacuuggagacucugauggaagcaauaggcauucuugccagaaaaauguacauacacaaaauucuauaugcaauuucacagagcuccugagucccccacacaaaucuuggguuaagcagcccuauaguaaggcagaaaucaugcccucuacccuuaagggcauauacauucauugagagaccuaaaaaaugcacaggaauauuuaacaaaaccuacauuuacauaugaaaccaucuaaccuugggcuauuuauugccucugaaccuuaguuucuucacguguaaaaaucaggaaacucggaauugcuauuguaauuacuagcaguacauauguaaagugcuagcagaguaccugcacgcaguaggcacucagucucucagucaguggucacuaucuuaccaaaaccaguggcacagacuuuaggucugguaaggccuuuuagcacacuucugugugguaguucccaggagaaaggcaucuuuguggcuaggagucauagguuuccuggagacagaaaguuugacucauugucuaagggacccuuagaaugugaguggccaaggggagaggauggggcacuacaggcugaaaagcagcacagguucaagcagggaggagugugugauuucaguuguuuaaacauguucgcugaaggucagcuugagcauuggaugcuguuaacacagauggggucagcacucaagaaguggcugcgucaaauacuauccuuaaguguucugauaaaccauaaauuauuugacuauagauuuucuacagguuuaaucuuucacucuugcgaagccugauacaucuuacuguuuuaaaaauguagugucacuuggcacaagacuuguuuuauagcuguguuuuaaaaaauacucucaauaaagaaaguguugugaggaagcugaugaauugcucuuuaggauaauugagugcgaaggccugaacauugucuuuuucuguuacagcucacaaggagauacauucccagcaagugaaggagcacaggaccgcuguuuuggauuucauugaagauuacuugaaaaguauuucauuuucuuuuaaaggucaaauguaacauuucacaauagaugugaugcagaauuuagcuuugcuagcugaagacuguaguaucucauuauauuuaaugauggcuuugccugagaagcuguuuuaagcagucucucuucugguauuuucuucugcaacaggaguauguaaacuuuacucagaacagagagccauccgaguuaaaagagugguggauaagaaaagauuguaaguauugcuuucauugguguuucuuaauuaauaauaguacuacuaauaauagcaguuaaaguuuguagagcacuuacccuaugcaauguaccguguuugaacuucuucgcaaaaugccauagcuggcgcuaccgggcacucacugugugccaggcagcaugccagccacuuuauuggcccacaacaaacccccaugaggcagguacuguuuccucccucauuuuacaaaugaggaaguugaggcucaggaggcuuggccacucacccuagaucccacagucccacagguagcauagcugggguuugagccuaggcuguugguccaaaaucugugcucuugcccauuuugucucuuaacccgaugaggcuggcacaucuugagccauuuuaccucaaucucuuugacccccauaccccuucuugucgucccugaaaguguauuccugagagaagagcgagggcacaacaagcaggccaccacaaggcuguccucaggucaccugugacagacuugcucgaugccacaugcucugagugcacaccucccuccaaccccacuaccugucccaugcaggcacuauuaggagcccugucagcagguaaggacgcugacgcuccagcaggguaaaugacucauccaaggccacaggaagcaggagggccaggcuccuguauuuuccauggcgccugccugguuuccccucugggcucacaugagcaucuggaaugcaagagcuguguccucacagucguucccgcugcaacucagccagucuuggagauggaauacaucagugagcaaguauccaaaccuggaccauuucuagacuagcuuuagaaagguuuuaggauguucuuucagaagauaacaucacauaacuguuuggggacacauuuucuuuuuuguuuuuuuuuguuuuuuuuguuuuugagacagggucucacccugucucccaggauggagugcaguggcacgaccuccugggcucaaacaauccucccacuuuagccuuccgaguagcugggauuacaggcaugugcuaccaugucugccuauuuuuuaauuuuauuuuauaagggugggaugucacuauguugcccaggcugcugucaaacuccugggcucaggcaaucccccugccucccaaagugcuggacuacaggcgugagccaccaugucuggcccacauuuuuuaaauucuuacugugucagggguccccagcacuacucucugguucuaggauucacuaagaggucucaugggacucaacauacaguccugcuccuggcuaugauuugucacacugaaaggauacgaagcaaaacagcaaaggaaaaggcaugugggacaaaaguccagaggaaaccaggcaugagcuucuaagaguacucucccaguggagucacacagcaugugaccuaugacaacacgugaaguguugucuaccagggaagcucauuaguaacucauugcccaaggauucuguuaggggcuggucacauaggcaccucacaccuggcaucuaccgaaacucuagacucccaggaggaaagcaggugcucagcacugaacugcauucaaaccgcauguuuugcaaaacaguucaggcacggcgagcuguuuuuaucaauuaggauggcaugaacucugccaaaguccaacuucucagaugccaggcaaggguuaaccuugcaagcaggccuuucuaaggauagcagccucaggccuacuacaugaacccuuuucugcacauuugugaaacagaugugaaauuguuaaugccaacaaauagaagcauuuguggaagauaguaagcagaucagucaaguuaucugucagcaacagcuacuauuauauaaugcacugagaggguagcuugagagaagccauagauuaagucuuugugcuuagagagcuuagaagcaggcuggguugcuauuaaacaugaaaaauuagucagcuuaaucaggauaugucauaauuagugaaaucgguaguaagcucagagggggaaaugguacgaucaaguggcauaguauaaugccuaagagccagacucugcaaccagacagccuguguuugaauccuggcucugccacuuucaaacugugugacuuugagcagguugcuuaacuuuucugggcuuuuguuuccuuaccuauaaaaugggaaaacucauaguaccuaacuuguagugcuguugugagaacaaaaugaagauacagauaaaacacuuacagugaguuaauaaauguuaauuuguacuauuaucuaccacuaagcauuuaccaugugccaggcaguauauuauuuuauuucauuaauccucaaaaagccaccauaucuuuaaauauuaguauuucauuuucuaaauuaggauauuggggcucagcaaauuuggguuagcuguccagcaucacagcugaaucaagauuugaaucucaggguaauuggagcagauuucucaagcaaugggguuuguguuggcugucaaaagaaaaauaucugggugugugaauuagagagauagaaagcaguccagacuuggggaagaguuugaacugaagaucugggacacgaugagaccaguuagcuccaagacauuacggagaaggagguaggccucugaugaugcgugauuugucaucaagauggugugguggucacugggucucacacucaccagggagaggaaugcggauuucuccuucacuaucccaaguggacuucacagguacccaaguaaaguaagaagagauuuuugcugcuaccuuaguucuuguuucucagcagaggccuugacuaaaauacaaauuaauaucagucagaugggaauuguucucauuuagacagcgaaguauagccuugucuccugccacauaguuagcugcccugugccaauuacuuugcacaaaagaccuugagggaaauaaugaugugacccuucacaauguaguucagcacccuccuucuuguccuuuccucaucuuuaggcagaaggcaucugccuaaaacguacaugugauuuuaucacucccuugcuuccaugucuuacaaaggcuagacagcauggcaugugccuggacaacagccacaguaacucaccacaguagugugacaacuccugagcuugucuauacucuguccagcgaaaugagaccacugauuaaauggcagugucauuuaugcuauguuucuagaugcuuacucuucauuuuuguacuuaucuuguagcagaccaguaacaaacaguccauggucugguucuguuccauggaccacacuuggaguagcacuggguuagaaagucaccuaguauguaguguaugcccaguaaauaucuguucagugagugaguaguggugaagguggcuucauugagguagugugaagcaucuccugcuuuggggguccacgguaccugugccugaguggacacauuugucugaaagcuaguuuuaaaauuauaguacuaugauauuauauaucaaaaauaucuucuuucuacccagagccuuugcuggaggcauaaaagaaggacaggcguaccucggagauaucacaggugugguuccagacagcaacaaagugaauaucacaauaaagcaagucacaaagacauuuugguuucccagugcauauaaaagcuauguuuauacuauaaagugugcaauaacauuaugucuaaaaaaaaucaugugcauaccuuaaucagaacauacuuuauugcugaaagugcuaauguuugucugagccuuaggugaguuguaaucuuuuuguugguagagggccuugccucaguguugauggcuacugacugauugaggguggggguugcugaagguuggggugguuguggcaguuuuuaaaauaagacaacaaugaaguuugcugcaucaacugagucuuccuuucacaaaagguuucucuauugugugcagugcuguuugauagcauuuuacccauagcagaacuucuuucaaaauuugagucaguccucucaaacccuguugcugcuuugucaaccaaguuuaugcaauauucuaagcccuuccuuguuauuucaacaauguucacagucucuucaccaagagcagauuccaucucaagaaaccgcuuucuugguucauccauaauaagcagcuucuauccauucaagugugaucgugagauugcagcagcucagccgcaucuucagucuccacuuccaaucuuaguucucuggcuguuuccaccacaucuccagugacuuccuccacugaagucuugaaccccucaaaguuauucaggaagguuggaauccacuucuuccaaacuccuguuaaaguugauauuuugaccuccucccaugaaucacgaauguucuuaauggcgucuaagauggugaaaccuuuucagaagguuuucaauuuacuuuacccagaucugccagaggaaucacuaucuauagcagcuauagccuaugaaaugugagguuuuuugguuuguuuugaguuggggucucacucugccacccgggcuggagugcaguggcagucauggcuuacugcagccuugaacuccugggcucaagcaguccucccaccuuagccucucgaguagcugggacuacaggcaugugccaccaugcccaagauuuuuggaaugguaaaugagcaucggcuucagcuuaaaaucaucugcugcauuagcccuuaacaagaaagucacccuauccuuugaagcauugaagucagccauugacuucuccucuguagcuauggaaguccuaaauggcaucuaccuccaauuccaauagaaggcuguuuuauguaaauugaaaaucuguuguuuaguauagccacuuugaucaauuaucugaguuagaucuucuggauaacuuauugcggcuucugugucagcacuugcuaauucaccuuguacuuuuacauuauggaaucgacuucuuuuuuuaaaugucaugaaccaaccucugcugccuuccaacuuuucuuuugcagcuuccucaccuuucuuagccuucacagaaucgaagagaguuagggccuugcgcugaauuaggcuuuggcuuaagggaauguugugacugauuugaucucuccagaccacucacacuuucucccaucggcaauaaggcuguuuugcuuucuuaucauuuggauauucacuggaguagcacuuuaauuuccuuuaguaacuuuuccuuugcauucacaacuuggcuaacucuucggcacaagaggucuaacuuuuagccugucucagcuuuugaccugccuucuaacuaagauucauaauuucuagcuuuugacuucaagugagugauacgcaacucuucuuucacuugaacacuuagaggccgcugcuggguuauucauuggccuguguuaugucucuaggaauaggacggcccgaggagagggagagagaggagaaaaugggaacaacugggccggggagcagucagagcacacacaacacuuaugaaguacgcugucuuaugugaacgugcuuuguggcacuccaaaacaguuacaaaagucacaucagagauuacugaucacagaucagaaauauaauaauaaugaaaaaguuugaaguauuuugagaauuaccaaaaugugacagagacacaaagugagaacaugcuguuggaaacauggcaucaauagauuuacuccaugcaguguugccacauacccuccauuuguaaaaacaaacaaaaaaugcaauaucugcagagugcaauaaagcaaggcauacugaaacaagguacggcuguauaagagccacgcugaaaucugaaacaauuacuuuugucuaauaauuauagcaggcuguauuuaagguuugcaaaaacuucccacauauuuucuuguuucaaaacugaaaaaaucugucucucuucugucucuuuauguucucuuuaaauuuuaaauaaaauccugaggguuuucaagcaagggaccuggaagcagaugcuggccagguagaaacuguugauugcauuucugaaauguucagccuucagucagagaaaucaguuuaaauaaaucauggggcauaaacugaucuuucugauggcuuuuuaaaaauugcuuucuuucccccaaauuggcuucaacuaguuaauuuguaauuucccuggggacuuuaguagacauucuguauauaguuagaaucuguuuuuaucacuuaagaaaagaaaggcacucaacuuugucuaagucugcugcacuguagucuuuaauuccuuuuaaauuggaaacuuguacauuagcauccucuggacacaaaggaugacagacauuaaaggaguccuuuauuuuaaaagucagugaagcccuuugacuuccugaagaagucaguccugaagccaugcagugaggcagggguaaggugggcgucugcagucguggggagcagcaguuuuccagggcagggaggagaggguggcuuagcaugggcagucauagccuaagccaggagagggacugauccgugcuggagagggauggagaggggugguagaggcgggugguuacauuuaggagaauagaucaaauaauaaauacagaaggaggcuggauguaguggcucacgccuguaauccuagcacuuuaggaggccaagguggguggauugcuugaggccgggaguucgggaccagccugggcaauauggcaaaaccccgucucuacuaaaacaaaaauuagcaugaccuauaguccuagccaugugggaggcugaggcaccagaaucacuugacucgggaggugcagguugcagugagcugauauugagccacugcacuccagccugagcaacagagcgagacacugucucuaaauaaauaaaggaggauauugaaagcuagguuucucacuauaggagaagugaaaggggaaaagcccugucuguggucuuggguggaaaugaaagauuggcacgaauucacgguuuucaauuuccaaagaucaauacagaaguaacuaugguuguaaauguguacguauguacacauuuauacgcguguaugaaaaugcaugcauauauuuucuugcucuggccacugaggaggccuggaaacagugacacuguaauagcaauaagcguaguuagcacucagaucuugucuucuaaauaccaacuucaccuucagggagccaggccucuuagggaaauggcugauucuuaaacuggagcagggaacauauaaaccuggaacaaggaagggcucagaauguuaggacgugucuaaaggacacagccaucaauuugaagcggugucuacuggccaaauuagagauaacuuaagcauaaaaauaaauggcaguagcacauuauaacacauucaaugagauaggacauuaugaauccaucuaaauaggaauaaauaaaugaauaaauugaaagauugaaauugauacauagugucaaagcacugcucccccugguacuuacuaauuacaaaggggaagagaauaacuugacaguggggaagccuagcagucaccaccuucaucaagugggcaaagggaaaucacacacaaccuaauaggaugcagcaagaagaaagcaucacuuuugugauuucugccaaagaagcaugacuugaauccaaccgcgaggaaacaucaaacucaaauucagagaucucuuacagaauaagugacacauuauuguguguugaggccgugaaacucaaggagagacugaagagcuguuccaaacaaggagacugaagagaaguacuaguuaggagcagugugugaugcuguuguuauaaaggauauuacugagauaacuggucaaaauagaguggggugggggggugccgugcacaguggcucacaccuauaaucccagcacuuugggaggccgaggugggagggaggauugcuugaggccaggaguuuaagaccaacccgggcaauauagugagaucccaucucuacaaaaaauuuaaaaauuagcuggguguggugacaugcaccuguagucccagcuucucaggaggcagaggugggaggaucgcuuaagcccaggaguucaaggcugcagugagcuaugaucacaacacuacacucuagccuggacaacagagugagaccuuaucucaaaaaaaaaaaaaaaaaaaaaagaaugggguccaagggagaaauggaaguaauguaauaauauuuuucauaacuuuuuuuuuggucuacugcuuuuuuaguguuugcaacaacucuaguaguagauauuguuggaaggauauuggaagccagguuucucacucagaaaaaugaaagggauaaagccagaaugaacccugugguguuggguuggaaugaaagauacugaaagccauuuuacaguuaagaaaaccaaggccuagagguuaggugguaaaccaggggagcaccuacugugugccaggcuucaugccaggcacuuucucaugggugaucucauuuaaucuuugaaagaacucuuugagaaagauaguauuuucuccauguugcagaugaagaaaacuuagacaaagaggauaaaauuggcugggcgcgguggcucaugccuguaaucccagcacuuugggaggccgaggcagguggaucacuugagaucaggaguuugagaccagccuggucaacauggcaaaaccccaccuccacuaaaaauacaaaaauuagcuggguguaguggugcacuccuguaauuccagcuacucgggaggcugaggcacaagaaucguuugagccuggaagguagagguuguggugaguugagaucgugccacugcacuccaaccugggugauggagugagacucugucaaaaaaaaaaagcauaaaauaaaacccauccaaggccacacuaaaaauaaguggcauucuagaauuuaagcccuuuguuggcuccaaaucccauuguaaaugugucuuuuucaaggcagucaguaaaccagugguuuaaggagucucaucuccagacugccaugggauuuacagaauugcuggaguaaccugacagccaagacagcgugggagggcaucaggucagucuggugugcaguguggccaaggagaaagcccccuaccacucgaguagccuuuggccaccacccuaggccacugcccugcuacucugucaaggcuccuucaguccuucccccuucacagugacauucagaagaucagcagcuaguugggccagcacugaagacccugcuaagucccuuguacagauuguacaaguauacucuuuucucugaauuauuugcauuauuuauggguugguucagcaguuuucuucuguuccuccaucggucugcaucuugucagaggaaaaaaauguauauugcuuuaagacuucacaaaaaaaauugucuuauuaaccauucugccuuuuguuauuucacaguaauaauagcagcagcagcaguaguguaaucguuguaguaauagcuaauuuuuugagcucuuacuaugugauguagacugugcugaguuagcacuuacauauaaagcaguaacucuaacaagaaagauagucagagccccauuuuuuuuuuuuuuuuuuuuuuuuuuuuuuuuuuuuuuuuuugugagacggagucucgcucugucgcccaggcuggagugcaguggcgcgaucucggcucacugcaagcuccgccucccggguucacgccauucuccugccucagccucccgaguagcugggacuacaggcgcccgcuaccacgcccggcuaauuuuuuguauuuuuuuaguagagacgggguuucaccguguuagccaggauggucucgaucuccugaccucgugauccgcccgccucggccucgcaaagugcugggauuacaggcgugagccaccgcgcccggcccagagccccauuuuauaggugggaaaacaggcuaagaaauuuugcuauuugucauuuaguaacuggaaaaaaaaaucugaaaauucuggcagaugaguaucuugucaagcuaguuugaaaauuugcuaaugugucagguugcucaauuccuacaucccaaaacuaauauuugagguaaaauauuaagucauagaugcuaaauuuaauaaucauauguguauaccuagugucaaacauggagcagauccucaguuuaucuuuaaauagguuucucuuuuagguuuuuaacuggcuuuuccuuugcuuaacacauuuauuuuugagacuuacccuugcuauguucuucuucauugcugaaugguauugcauugcaugaaaguaaccccacuggcuuauccauccuguugguggacauuuagguguucccauuuuuuuggcuaugauggauaaggcugcuguaaacauucuuuuauaggccuuuguguggaucuaucuuuucauuucuuuuggguaaacaacuaaaaguggguugucauaguagagauguuucuuagacuuaguaagaaacugucuuaaguuuuccagagugauaacaccauuugacacacuguccagcaauguaugaaaguuacaguuccuccacauggcaggauuuggcauuggccauuuuuucuagccauucuacuggauguggagugguauuucauuguggguuuaguuugcauuuccucacugacuaauauuguuaaucaccuuuucauguguugauugacuauucauuuucuuccugugaaguaucuguucaagucuuuuacucauuucuguauuagaggauuguuuggcuguugauuuguauaggaguucuuuguauauucugcauacauauccuuauauacaugcugcaaauauuuuuuccuauucugugguuuauuuauuuucuuaauggugucucuuggugagcagaaaugcuuaauuuugaggaaguugaauuuuauuaauuuuuacuuugucuaccccaaggucacuaagauauuauuuuauguuuucuucuagaagcuuuaugauucugggugguauguuuaggucuaucaucugucucagaccaacuuuuugauaggaugaaaugggguugagguuuauuuuauucuauauaauaacugggguugagguuuauuuuauuguauauaaauaucuauuuauuauaucaauguuuguuuaaaacacuuucuuuuucucauugaauugaccuggcaucgucaucaaaagucaguugacccaaacauguauaugucuguuucuggacucuauucaguaucauuggucugauuguccuuaugcuacugccacacugucuugauuacugugguuuuaucauaagucuuggaaucagcuaguuguaaauccuucaaauuucuaaauuuucaguauuguuuuugcuauuuuagauuuuuuguauauuuccauaucaauuuuagaaucagcuuuucgguuucuucagaaaaucugcuagaauguuuauagggauuauguugaauuuauagaucaauuuggggagaauggacaucuuaacaucuauccacaaacauaguauaucuuugcauuuauuucugucuuccacuuuauuuuuaaauuucuuuuucucagcaauauuuuguuauuuucaguguagacaucuugcucaucuuuuguuagauuuauuccuggauuuuuuuuuuauucuauuguaaacgauaccauuuuguuaauguuauuuuccaguuucucguugcuaguauauagaaauacaauuaauuuuuguauauugaccugucuacaacuuugauuaauucacauguaguucuaguagcuuuuuuuguaaauucuuuucuuuuuuuuuguuuuuuguuuuuguuguuguuguugagacguaguuucguucuuguugcccaggcuagagugcagucgcucgaucuuggcucacugcaaccuccaccucccgaguucaagcaauucuccugccucagccuccugaguagcugggauuacaggcgcccaccaccaugcccggcugauuuuuguauuuuaguagagauaagguuucaccucguuggccaggcuguucuugaacuccugaccucaccucaggugauccaccugccucggccuccuaaagugcugggauuacaggcaugagccacugcacgugaccuuuuuauuguaaauucuaucaauuuucuacauacauaaucauaccauaugugaauaacaguaguuuugcuuuuuaaucuuuaugccuuuuauuucuuguuccuuucuuguuuuauugcacuggcuagggccuggaccucugguaccauguugaauagaagugguuaggauggacaucuuuuccuugcucuugauuaagggacaaggauuuaauacuucaccauuaaguaugaaguguugggauuauaggcaugagccacugcacccagcgcacccauguuuguuuauuuguuuguuaguuuguuuucauauuugugguucauuuuuuuauguguauaucacagaaguagguauuauguagcuguucuuuaucagguuaaggaaauuuccuuucuuauugagggauuugcuagaagaacucauggaacucagaaacacuauuauacucauaguuacaguauauuauagugaaagaauacagauuaaaaucaccaaagcuaaaaggcacauagggcaaacuccaggagagaucagguacaagcuucuagcuguccucucccaguggaauaguguagacagcacuuaauucuuccaauaugugucucccaauaccugugucaccauguauugucaaucagggaagcucaccugagccuugguguucaggguuuucauugggggucagugauguagaugugaagugcuagcauagcaggccguaguuaacucagucuccagccccuccagaggucaaacugauggucaugccagaccccuguuaacuucaguagggauggcacuugguucaaagaggcugaagaagagaccccgagccaacaaacaaaacagaguuuauuugggggaacuuauuuauagagcaguccaguggcagugggcuggacaggagaaccacuacugcuuguaaaaagaauguaguuuguauacaccuucacuuagccacccucccgccaaacaaccuccacauggcagcccucauuacuuaaauugccaucaagugugucugccaugcacugauacaguggcccaaggcccccagucauaaaucacucuguuagcauaaacuaucuggaaugcccccagguauacaaagauacucucaucagacaagacguacuaggagcuuagagguuaucucccaggagccaagcaagggccaguuuuuuccuuggaaugugcagaauuugaacaccacaaaccugcugagucaucccuuuacugcauaccuuauuuuccuaguuugcugaaaguuuuuaucaucagaggaucuugacuuuuucaaaugcuuuuucuacaucuaaugcaaugaucauauaggcuuuuuucuuuuuuuguuaaggggguguauuacauugaucgauuuucaaauguuaaaccaacuuuguauuccuggguuaaaccucauuuggucaugauacauuauugucuuuacauauugcuaaaaucaguuuguuuguauuaaggaugcuuuuauguucaugaagauaugugucuaauuuucucuucuuguaauaccuucauagguuucugaaucuggguaauacuggccucauaaaaugauuuuguaauuguuuucucuuccucuguuguucagaucuacuggguccuuacguuguuccucauccuagggaaaacacuuaggcuuucaucauaaaguaugaugcuaacuguagauuuuguacguguuuaucagauuaaggaauaucccuucuauacaugcuuuuccccaucuuguuugauugcucuagagcaguguauaaagguauacauucuauuuuacagcuccauaguacugcagagugucuuccaccaguuccauguugauggacauguggauuuuuuccuaggccuuugccauauuaaaauugaauuacgaaauugcuauaauuaauaacuuuuucauauuauuguuauaucuuugggauagagucccauaagugggauugcuggauuagagauuaaauacauguuaauuugcaggauauuaccaagguccccuccauaggagucacacuguuugguacucucaccaucaauauacggaagugccuacuucacagccugaccuacccaguaugucuucacauuuggguauuuucaccagucccaguaggcaagaaauaaugacgcaguguaguuguuaauaugcaucaucuucuuaugaggaagauugagcauuuuucauguguuuaaaagccauuugcauuugugugaacuuucuugccuaguuuacuguagggcuguuggucuuuuucucugucugcuuuaccuaugguggggcuuuuuuuuuuuuuuuuuuaauaaacuuguuauuuuaagagcaguuuuacguucauagcaaaauugagcagaaaguaccaagaguucccauauaccucuuucacuguccuccccacccgccaauacacuaauagccuucaccaccaauagccaucaacaugccccaccacucauggugcuuuguuucguuuguuuuguuuuguuuugauacggacucucguucuuucgcccaggcuggagugcagugggugaucucggcucacugcaaaccuccaccucccaggcguaagcaauucucccaccucagccuccugaguagcugggacuacaggugcgugccaccacgcccggcuaauuuuuguauuuuuaguagagacaggcuuucaccauguuggccaggcugggcuuagaccucaagugauucgcccuccucggccucccaaagugcugggauuacaggagugagccaccgcacccaguucacccauguuuuuuuuuucauaugugugguucauuuuuuuauguguauaucucugaugcauuuggaauuuaccuugguguacaguguagggagagggaaaacauuuauucuuucauauaacuaccgauuaucccagugcaacuuauuaaaccauaucauauauuaaauacauauaugcaguugagucugguuuugaauuuuauauccuauucauuggucugucaaucuuuucaugcucuaauaccacacuugguuuuuuaggguuaucuuggcuauuauugccuccccuuccuaaucuccaugauauuuucacuauaaaccuuuucaaacauauggcagaauugaauuuuacagugaacacccauauaccuauacccuagauucgagcauuuacauuuuaccauacuugcuucuuuuaccugccuaucauuccauaugcauuuagucucuuuuuaaaauagauuucagaguaaacugcaaacagugcccuuccccuucaauacuuuaguaugcauaucauuaacuagaguucaauauuuauuuacaguuuuucugaccauucuugcuuauuuccagaugaauuucauaguugauuuuuccggcuucaggaugggaccuggugauguuuuuuuauugggaucacauuacauuuauaaauuaacuuagggagaaccaacaucuuuauauuucuuuuucuauccaagaaugauguguccuuuccuuugugucuuucaggaaucuuuuuugguuuuuuacguaugggcuuugggcuuaaguuuauucuaaaguuuuuguugauauuguuaguuuuuuaucuuuuguuuuguuuuggcuauugcaaguagaaucuucucuuucauuauaucuuccaacuguaaaugagguacauuaucaugaacauuuaagucauuuuguuguuguuauaagcaguuuuguggugaauauccuuauaacuuuaccuuugugcauauuugugauacuuagaauagcagauuauauuuuccaaagaaagcugcccccaaauagaucccauaccacaugcucuucuuaaaaagugauguuacugcuccauugagaaagcaaauuggagucuguguuucuuccccuugaacuccaguggaccaucgugaauguguugggcaguagaauauggccagaauuaugauuucugacuucuaaggcuaggucaugaaaggcacugaagcuuccaccaaagucuuuaagacugccagcccugcaggcagccagcugccaugcaccaguaacacacucaugcagcuccaugaagaagaaaugaggcucccagcaagcaccaacuugcuagccauguguguggccuccuuggaagugaacccuccagcccuggucagcccuucagaugacugcagcccuaguugccuucuaacugcacccuccugagacacacagagccagaaccacccagccaagguguucccaaauuccugaccccagaagcagugaucaguaauaaaucucacuguuucaaggcacuaaguuuuaugacucagcuguaguaaccagaacaauuaaaaagauugauaacagugacuuuugaaaaaauuuuuuguuaaauuuuguagaggaccauuuccuaaauagucuuuuugagaaaacugcucucaaaaaacucugugaagagagugucugcaaucagguuauuugcaaauaccauccuuuuuggaaauucaaaauguauuugagcauauuaaaggcucugaaaacuuauauagugaaacaccuuucuagcuuugacucagcuuucucagacugauucgaccacagaaguccuuucccacagcccaggauggguagaauauaccccacauggagcaguuguuacgagcaugggcuucagagcuagguucccugaggucaugucccagcccagccauuugcugacugugaccugggcaaguuuccuaacuucucuacaccucaguuuccuccuuuguuaaaagguuguuaauacuaguaccuaccugauggggauauucgaaauuaaauaaauuuauccauacaaauugcuuagaaaaaauguccacuauaugagccauuaacaaauguuagcuggcauuaguaauaucacccuaauaugcauuuacauuguuccuuuaauuacagucucucugccuaacaauauggaauuuauccuagauagcacucugccuauaauuuuauagcauuuauguagauucuaguaaagcuauuacaaagccuguuauugcauaaccuaaacguuuucuuauuaaccaguuacuuguauuuauaaugcacucauucauucaacauauauuuaugcaauggaauaccaggcacuaauccagaaucugggaucuaggagcaaggcugacaaccaacagauaaauaaacagggggauuauagacugugauaacugcuauggagaaaacagaugcagaggagugggaggcggccuuuccuucacagaagagucagagguggccucucugaguaggugaaauugagcugagcccuguagaugggaaggaagacgaugcccugggaagagcccguggggaagaaacaggggaaugccaagugcagaggacucaguccugaaacaagucugugccuucaaguggguauuuaaggacuugugcuuucagagcuaacuuauauuaagaugugacuuagaacauauacguguguggguauagguauauauauguguguguaugaguauauauguugggggguauguguguggggguguguguguguauauauauggguaggggguauauauguguguguuucuguguguguaugugggaguauauguguauguauauguggggguauauaugaguguguguguguauguauauauguguauguagauauaugugugugggggaggguauaugugggggguauauauacauaucugcacauauaugguguguguguguauguaggggguauauaugugagugggggguauauauauguaguauauguauguggguguguauauaugguauguguauauguguggguauguguguguauauauguguguguguuuaugugggugaguauaugugaauauauguaugugguguguguguauaugugggggauauacaugcauguauguauauauaugggguauguguguauguaggggguuauauaugugugggggguauauauaugugguauauauauuguguguauacauguggggguauguguguggggguauauguguggugguauauauguguguggguauauaugugggaggguauguauauaugugugcauggguauauauaugugguauauaugugugugugugguguguguauauguguggguauacauguguuggggguauauauguguguggggguauauauauauauaugaauauauguauaauauguauuauauauuauuauuaauaacauacucagcaaucuuuuugcauuagugucaacuacuggguaagcaucaauccagcuuccuggguuuguugagugcggugugucagucuauggagcguauucagcacauaccaacugcagccucccccugcaugcuggucacugugccguggcugcaaaugcagagggcaugcacaaucucuacccugcaggcaauaaugccaguguuaagugccccaguggagguguguccggauggccacugggcccagaggcagugacugcuccccaguacagggacacagagcaaaagcgcagggucacaugugacuccuucuguuuucaaaaaggaauccuguuauggaaauaaaauaccugccugcuaauuauuuauuuuuagaucuaagcuggaaccagaaccaaauacaaagacaagagaauccacaucuucugagaaaguuucacagaguccuucaaaagacucugaagaaaacccugccacugaagaacguccagguacgaauugagaugaaaaucucaccuugcauuucuuccuugugacauguuggcaagaguacagcacaggaacgaaguagcacagucucagacauguuuugguguuuguauuugcauaaagcaaaggaagcaggaggcggcagccuuugugucugucacaguugaucuucgugagugccacagaggcagggggugcauucacccagucaccugggagcuggcgggguccgggagaaagggccugcuggaggggugaggccgggagcugucugccucaggagcccugugugccggccucaggagaggcagcauugccucccuggcagccaugcccugcaugucagcucugagcugccaggccugcauccggguagaguguauaaccucagcagccuugcacagccagucaaaccaacaggacaaaaugcaaaucugaauugacgugcugccuaucaccacagauacuagagggcccauggcuuagaauaguuccugaugcacaggagaugcagaagaaauacagggucuccaugaaguccgaaaauguagggggacauacacaguguggucauggaugucugcgaucugugugucuggcugguaccccugcguagggaugccugcauaguuugccauaucucaaaggcagaguggagcaggguucuuugugugaaucacagggugauggcgugcuggagccaggagagaccugggaguccccuuuagcauccuucuccguagucucauggcaguucuuauuaacucuugucuuccagaugcuaggcaugguccuggacaugucacagaaauuacagguugaguaucucuuaucugaaaugcuugggaccagaaguguuuuggauuuaggguuuuuucaaauuuuugcauauuugcauuguccuuaccaguugagcaucucuaaucugaaaacuaaaaucuggaaagcuccaaugaguauuuccuuugggugucacauuggagcucaauaaguuucagggaugugauuccugcccucagggagcucacaguugaugggaaagauaaggcucuagccccugggagaaaguaaguaguaccucaagagagagcagagggccagggagacuucaagaggagguggcacuaagaagugagucugggccaggcgcagugguucacaccuguaaucccagcacuuugggaggccaaggcggguuggaucaccugaggucaggacaucaagaccagccuaacauggaaaaaccccaucucuacuaaaaauacaaaauuagccaggugugguggcacacgccuguaaucccagcuacuggggaggcugaggcaggagaaucacuugaaccugggaggcggaaguugcagugagccaagaucgugccauugcacuccagccugggcaacaagagcgaaauuccgucucaaaaaaaaaaaaaaaaaaaaaaaaaagugagucuggaccugaaaaaauaaaaaaugaaagcuuagaaaguucuagacagaggcagcagcaugagcaaaugcucagaggccagaaagccuggagauugggugggauauagucaguaaagaagacccguggggaucagugaagcccaucagugggaggagaggugggaguaagcuuggaaggguggguagggccuugaaugccagaguagggagucuggacuugccucuguggcaccagggugcacggguggccugggcagaggacuggcauggugggugcugugcuucaggcugauccuuagggcagccuaucaagaaggcuucugauggccacaaaugagcauguuguagagugugaguucugcuaagaaaacuuucccauucuagcucagaguuaauuuaugcuugguucagauaugaacaagguuucuguuucuaauuuugauguuuuuuuccuuaaaaaagaaaucaacaacaguaaaagcuugaaauggauaccauaaugaggacaaguaggagacagcucauaaggugggggugggggguagaugaaaguacaaauguuccuacccaaagaaugucaucucaggaaaauaucagaucauuucuaaagauacuuuuagccaaccuuuuacaaacacauguuuuucuauaaugacacuucugguaaaaacagccauuuuucuaaaagccugcaugcacuaaguuguggaugacaugcaguuuuuuuuguaaagauauauuucuaauaaauaaccauaacuuucaggcauggccugccuagugagcuuucucuacauuguugcuaucauuacguucucuuccccuauuuaaagaucuggacuuguugccaucucauggggcugagacugacuacaggaaauuuacugagauugaggaaaaaaggaaaaagaagcaguauuugccuuugaguacuuggaagcucacugauaagcccugagacacagacacaaagugacuucauuacagucucccccgaggauccaucccugccaucccucuccccuccgcucccaacccuaccccggugaugaacugcacagaccucuuaccgucauccugggcggcagcaguccuuucuaggggccugugguauugacaugcuucaauggaggaugcaucaccuuuccuugaucauaaugaaaaaguucuccagauuaaaauguuccuacgcucccuuucagcaguugcaugcccagguaucuguccuagagagucacuccagcaugugcacauagcacagaccgggacacaguaccaugacaccagugaacagucugaaaccacugaggucugucagcguaguuauggcuaaagaccaguguauccucacgauggaauaucaugcagcaauuuaaaagaacaagguagaucuacuuggaccaucuccaagauguaucaauaaaucauacaaagcaaguuuuagaacagcauguuacuauugauaucugugugaaaagcaagccgccauacacacaaaacuguguauuacuugaauuucauggguagacagggacucauauaucuuuguaugugaauaucuuuagauaaaaucuaugaagcuacaucaaagcaguaacaucugggagaggaauaggauuggagaacaguauaucacuuccuguauauauauauauauguauguauauaugcauauguauuuuuuacaauaaaaauaugucuuacagucuuuaaaaguagacagggguguaugugucuugaaguaaaacauacuuuaagacucauucugaagaauucugaagacauucugaauaauguccauuuaguuugcagccauugcugacaucagugcgauacugaaaccgugcauaggucccccuccccaucacacacacacaugcacgugccugcacaaagacaauuuaaagccuaaauguugugaaagaaucaugucugcagugccugaauauuagcccaaagaucaugaaauauauagacaaagcuguaagauucuguuuaaucucuuguuuguguuaugacuacauccuaagccagccuauucuaaaacacauauuuggucuucuauuuucaauuuuuuuuuuaacagaaaaaauuuuggcugaaacacaaccugaauugggaacguggggagauggcaaaggcgaagaugaguuauccccagaagaaauacaaaugguaaugcuauucucugccuaauuauuuauuuuuaacugguuuucauaagacuguuucacuaaggagaaacucauccucaaugcccuugcccuuauuuuuauacugaguuuuaaaaauuauaaauguguauuuuauauacacuuucccauuugauuuccuaauucuuacggugcuuuucauaugcuuuaaauuugcaguagcauaauuaaagaagacauuuugccuuggaagaauuuuacuaauaauagaugucuuuucaacaacaguaaaauagucuucuagacuaaaugggucuuuuauaaaugccacuaugaugcuuuuuaauuguuugaauugcuagugcuaugguaaugugaaaaaaguaagauaaugacugaaaagugaaaagaguaacaccuuaacuacugauagcaccuccuuuuaguuaccugccuucugguuuccagcugcuauagcuuaccaucuauggguggguuucaaaaggaacugauaggucugccaagccccugccagcucacguccagcaaugucugugugcagcucaucuggacacuggugugacagaagccagauggaauaugcuaucugugugugggaauagaugucaccuagagcugcuaggaugugacacuguccucuaagacguggggaaugugacuaccacacggcacgccuccagugacugugccuggcaagugauagcauuuuaagugugcagcaguuugcaguagacaaaacuuuuugauucucauuuuauccaugauacuuuuaauaauugcacaaagaggugguggaacauuagcaucucauuuuaacauuggcaaaaggcagcaaagggucuugcccagaguccccuaguuaaucagggaagagcuggauuuccagcccucaagaagauaaggaguggagcaugaagacagcucuguugaggaagaaugggauccagucuuuccccagccuugagcuucucagacugaggcguuuguguugcugcuuaagccaccugaaauuucaagcucucucuauccacuccuggcaugucuuacaggucucagguauuuuuuccucagacagacccggcaaccccaccuacagcagcucccagauacugugucccaugacccuacuugauuucccgcauagagcacaagcucugugagagcagaaucuugucuuguuuuccucacccagagcccagaacaguguuugggaauucuuuuuuuuuuuuuuuuuuuaauuuauuuuuuuuauugaucauucuuggguguuucucgcagagggguauuuggcagggucauaggacaauaguggagggaaggucagcagauaaacaagugaacagaggucucugguuuuccuaggcagaggacccugcggccuuccgcaggggaauucuuuguugaaugcaugagugacuuugaugaguauaacauaaaagcuauagguuguuuucaaugguaaaaugggaucaucaguaauaacuauuagaauguucuaguguucaguuauuacuaguauuauggauacuuaugaaugccuucucuaucccaagccuuuuacauauguuguccuguugaaucuucaugacaauccagucaaguaggaauuaucacuauuacacaguugaagaaaaugacgcacaaaaacuaaagcccuacccaacgucacagaaccaguagagcagcagagccaaccuuuggcuccaaccugugcuuuuuuuccaguugguucugguggucuaggcaaguguugcugcacaggagcagcguggcacacugacacaggccagccaggcagagaagucagaacagccgcgccggcccaccgaagugucauuguaagcauaguugugcaggcuggggaccuccagggauggccagguccacaugucugcucucgugagcauuggccgccaagggcagaggacuggcucagcauccucuugcucuuuggacuuccuguuucuucuccaugccugaaauaaaagacggaaaccaaaucucuuuccuaaaaauggcauggacaagugaagacaaaaaagccaaaagguagcacagccuagugggaacaguguacugucugacuggaguccacacgcagccucaucauugcagcccugggcccucucacugcucuggaccucuguucccucaucugugagaugggcaaaaaauggccaccccacagguggggcuaaaguuugagugagcuggcccaugaggugcaugcaacaaagagccagacacauggggugcuugaaaaauucuguuuccccuuccuuuacccuugagaguggcagguuguacaaagaggcagaagagccucucccugcacaggauggaagagauugggcauagcugcccgugugccaugagcagggaaggacuguggcaugcaugccaucauggcagggucagggcaugcaggauggcagcuggagcucagaccauuuucauaugccuuucauauacaauucaguuucacacagauuuauccacccagaugagugguuuccccuuuaaaaucaucgccuugaaagcuugaaacugauuccagugaugguaccauuagcccugacuuuccugagacuugcuuuggggguucuccuucagagccugugauauuuucuuuggaauacuaagcagagcugucuuuguccuuuacagacaaaaauaauucugaacuaagaaaaugacucaaacaccuuaaagugcccugcaagguccuugccuuccuuuccagcuucuuucauguuccagaauucaccuuaugacuugaaauaagugcucaccaaauccagcaaaugugggaccuaggcccucgaggugcacauuguauagucggugguuagaggaagacagccgcagggauuccaagcagucauugcugucagucagguugagagaugaggagggccuugagccgggaguggcagugaagguaguguugagagcugugguguaggaaauggccugcacugaagugugagaugaggaaggaaccuugagcuuucugacgugggucaucaggaggagggagggugcacagaaggugggcaggcuggggcugagcaggagaugaugaauuucauguagacaggugugaguuugaggcgccugugggacauucaugagaggugucuaugggcuccagggcucgggcuagagaaacgcaugugggagacaucuuacagcugauguuugaaggaugggcuugcgugaggcucucuagaaacaugaugaacagcgagaaaggagaaggggucauggacaccacccugggguacacuccacuggagggaggcuggggcggagaagccaacaaaggaauguaaagagggauuggaucauauucccguccuacagccaaauaauggcagaaguuucuuaaaaaucucuuagguuuucaccgguuuauaugaaauccuuguauuaguggaaaugagucguuuccccaaauauuauaccauugccccauuucuuugcuagacaaaaaauguguacagcucugucucuucauuaagaaagaauacguuuguauuuaagaagaguuuaccuucuguguugggcuuuuuuuuucuuucuuucuuuuuuaaugcacuccaccacucuucauaaaggaaauagcuagaauaacaauaguguggguuguuugucugaggauuuuugccuuucucuggcaggcaauggugagcuaagcauguuaaccuuuacagcugcgugacuuagcagccuguaggugugagaguuggaccagaggaaggcuagcagugaggauauucguaaucaccugaugcucucauccuguggagggaugaugaaagaacauaggcuuugggacuagacagaguuggcuaugaauuuauaccacuuacuaucuuuguaagcugaggcaagaaaucacugccaucagugaucucuucagaaucaauaccccacagaauugucucaagcgcuggaugcaguagcaccuguaagagcacccagcagagggcagggcagagcaaauggugacucccucccaccagaaggauacugccaugucugugcauuguggcaugcccugcacguguuuuagcaacugauaugucagaguacggcuccucuccccacauugagguugaugcagcaugcuucuguuucauuccacugucccgagucauugucuaaagacaccagcggccacucccaguaacacugguagcucuagcaugguaguaucaaugacuaaagcaaucagaaucagcaggacuuccuaauuuuuauuguguuacugcaagaggaucgggcagaaggcuguaauguucaguacuuuuaugacaggcuauuuaauguccaguuaacuucuuucuuaauugggaauaauagcuaaguaccauaucuuauagucugacuaacucaaaucuuauuuaaaaggcuuaacuuugaaaauaaagagaaagaaauacaacacuguugguuuuaaauuggaaaauauuguagcaaaucguggucauaauucauaaucacuguuucggaauuuuuccucaggguaaaauaaugaauuaagcccaauaauagcaauauaauucauuguuucacccaaaggaacaguuauuacauauuucaaaaugguugcaggguauuauaugauuugcacaauaaauuucccuauauaacucaugauacagguauauuaaugccuuugaguuugcagguguuuguggucaggcugaguggaaccaaauuguuuuccaaaguuacaucaagaaaauuucucccuuucuaaacacacauucacuuuacuugccucagguaaaaccaccugcauuuauugauguacuccuugggauaauuuuuuuaaaacaugaauguggcuucuguuucuuaaauccacaugaaaggcgucuuccaaggcccuguccccugagguaggccuguagaaacucccaguggcuggcuggcagggcucgccaguuuucagcucaugcaucuagaacaaggauugguggaaucugaauaccacauagugagagcuggacagacccuggggagguuccagguuuacaggggcacagcaaaugcuggcuuccaccagaaggauacggcagaguccgucuacugucacauuauggggaucauaggggaucgaggugagggucacacagccagaagugugaagggguuugguacagagaaagcacgucuggaagaguccagaaagggcugggcaggggacuccugagcuaugagggccagagggcuuucugggauggucccccugugcuccucagcuuuucuuggcucuuugugacacaaauacuucucuuggcgucauuuuauacugaaaggccuuuguaggagugauuuucuuuugaaaauuauaguaaagaggauuagauuagaaaaggauuucuauaacaauauauucacaauguggauuuguauccuuuaaaccagauuagaaaccuuuuagcagggcuugauuggaaagucuaacugacuucuaaaugggauaaagcaguugaauaaugauauugucuaaugcgcaugugacacauaccaugugccaaguacugcucugagcccuucagcauauguucauuuaugcaacccauauggagagaguauugcuggccccguuuuacagagagcuuaagucaccagcccuaggucacauaggucccaaguccuaggcuguucaacaugaugcugugcugccaugguuggagggugggggagagugcuggucuagcugaaggaaagcauuguguuuugguaggagaccguaacagcguagagcagaugggccaaugcagggagcccagagcagcggcuggcaaccaccaugcauggagggcccaaccugcccaccguacccaccaucuaggccucucaccuuccuuugcaauuccauaggaaaauaagaauuuccuugauuguguucagguuugucuucacaaagcaucuagauacccaucugucgugcugaccuuggagaccaggucuuucauucagcaccgcaccuugcaaaguguggccacaaagagacagauacuagcuagugaggcucagcgagcucuggaagaagaugcuaugggugcauuucccagugccugggagagugaaauggcugagagccacagcaggccucuaggacuuugagacuagaggguagaaggggucccacagcaucugaccgcucauuuugcauauccagaaacugacacccaagagauuaaaucaugauagacagccuucaccgagagcuuacuauaugccaugcacuuugguagacaacucacauguauucacucauguauuccuucuaacaaccccacuacuuaaguacuguuacuauccccauuuuagugacaaagacagagacgcccagagauugugaccuccaaaacagcuuacugcuuagaaggugaggggcuggaaguccagccgugacuuugcauccucagggucaggcagaaaaggauaagaaucaccacaucuguccccaaagaaacugacaggcccaccagaagccagugacuggcccagcauugccccaggguuccuauaaggcccccagaacuggcucccauauccacgugguacauccaccacuaugccugccaccuggcaacagacgaagggaggcacacagguuugccauuuagacagcguuggaagccauacugaaaccugguacaagucaguguugucagcagccuugccaugaucuaauuguccugggcccugccagccuccuuaaguaauagugaccuuguaguugucugggaaauaggccuuuuguuuuuuaaacacagaggcggcucuccauuaaaacuccuggccguuggcaaaccucucuccucagcccuuagcaccuuugauccuugaggcaccugcuucucuuccucuagggacuagguauuuuucaggugggguggaaggaaauuagagccagcaucugaucccacuccugagugcaguggagggcggacauggagcuaucagaaguuaacaauuacgaagaggccuaagaggaggugccgcaccuaagugccuuauaccacaggcccucaaauuggggaggaaacaagaaaagcuuuguucccaaggaacaguccaggaaugaaucaccccaaaccacuaguuaauuuuguuuaggaacaguuucaaagcauaaaagggacuguggauuuaaaaggucagggccagggccauauuuugucauuagaaaaauucaagaaaaugccgccacccagggaaagcugaguaguaccugaauuagccaaagugaauuggcgccugcauguuuuaguaauuacauguuuuccuuaaauacuguccucuuaaguaacuguugaaguuaacagagcggauacuuucaaacucaaaagugaaaguuuuacucucuuaaauagccuuugucuugccuaauuaaaggggccauaagcaauucugugucagcagccagcacggcccccugcuguggaugaguugguccugcagggagcuuuccuggcacuuccgcccuucccagagcuuugccccuuccccguuuucuggcccggugggucuggagugcagcagaugccuccuuguguuuugaguagccggggccgagaacugguguucugucaugugugaggcccugggcugggcucaguguccaaaggaggacagcugccuuccacagagagaagacaagcccccugaacaagugugagaaauguccuugaagagccaaguacaggggaacuugguaacaagagugagaaaguaagagaaggugauucagucugcccugagguaucagaucgcuaggaagaugccugggguuuugagggaccacguggaguucugcagccaggcaggaaacuagccugucagagcagagcugagaugggagaugucacguggccagggcauggauaacagugugcccuagaccugaucuguagggucagcgggcaaggccaccaugaggcauucuggcaugaccagcacuugagaucacuuugaccaaggauuggauaacagguuggaggcaagugagaaacggugaggguggaauguggacgguaggggaagggcugaauacagcaagugcaugugcgggggcgaaacugguggacuuaggaaggggcgugugugugaagagcgccugcauagagcacagcugggguacuuggaggggagggguccugggugggaaggaggcugcuggggagacccugcaacucauuuccgcccuaggacaauggcaacaaggucaggcuguugaaugaagugccagcauagcccgugguggucagcugccucccauaaccauuguuucccuuguauuuuugguuuacuaagcaagugauaagccagaucuuccaucgauucggagccuccagaggcuugcuuguauguaucccucccacuccugcuuacagaaugccucagaaaauauuuguggauuugauggcagcuuuaaucuauaagaaagaaagaacaacuggaaugccuuugcaaaguuauguuccacccaguucccgcccucaggaagcucagggugacacgggaaguuugggaugggcacaguuuauuacaaggcagaaagggaccguugggcgcuacuauccuaagauauuuucagaaaaugguaggccaaggauaggaauaugagaaauaaguuugagcuuaggggccaggguagguguccuggagaaguggggccugcgggaugcaucggggaggaaaugcaggacgccccugacucccugcacauugcgggaguugaguggacacacgaggacagggcugugggggccugcagugagggcaaggagcuguuccuguccauucucugugcugaguuucaggagcuuccauccuuuucuuuggcccauaucaaacuggcaagaauggcugggagagcaacugucugugccaagcucacucagcuccaagaagcucccauguaucccuggugucagggcacccguccucacccagccugagcacugggaaacacgcuccucuggcucugggccucugucccuguugagcaguggaguggccaggcucugaagucagaggggcccagaggcagcucggccaagcugcccaccuccccuuccucuccagacccuccccacaccagauccuucuccauauuaaaaaauauguauaguccuucaguauaguucaugagagaaaacaacaacaaaagaauuuucuuaauaaugguacuagagucaggaagcaggccgugggaucccaggggagagcggguagguagauacagcuacagccauagcagucagcuuguaccccuggagugcagugguugagauggagaagucaauuaccaggcagcacagcuguuuuuuaaaacuuucuccugaaagcagggacguuguucacacuaaugcuaacggucguccagcaccggcugccacguugccgcagcuggaaaugggggcuucggcagugauuccuggagcguagguccgcuuucuugcuagacucuugccuaaguucaguaugaugucauccugagugugucuguuuccucacaguuugaacaggaaaaucagcgacuaauuggugaaaugaacagcuuguuugaugaagugagguauguuuguagcuccucugugagcugauagccugcuuuacaacuuuuccaggaacuaggaacuuuauuuaccuuggugcccaggcauccccauggggcccuugggcuggugcagccccccucagccauuuugacugggcuggggugggcauguggccugaauccacaacucccucagcuugugggccuguggguuaccuccugccugcugccacugcugcggggggcccaggugcuucccaccccgagagauacaggagugacuacagauuaccugcguauaauuuccaccaccauucgggcuguuuccacgcagcgacucugaaaugaaauggggcccuuaugaagggcagcuaaccaagggaagcccucuucugcaaaugguuccacuggggucugccugcuccuguacccaccagggagucaggaaugcagaaggcaaggccuuggucacucacacaugcacccguuagccucuaguuucugugggaaggcuuggagcaugcugaaaguaaggcccaggacuuugcagagccuguuguauuguggacaugucccccaaauaaaaucaauccugaugcugcacucacacagccugaggacuuucucaguguaggugucagccuccaaggggcucuucgccuucugcccucagagauggaccuccuaguccuccucugacagccuagcuuucacugucugccccacuaccgcccccaccccgcuacucccccaugcccagauacucacuggcuuuucuucccacaucuccuccccugcccccugccacugugauacuguugggauucaucacugcuuccaccuggccaggagcucagcucccaccacuuuuugccuccugucacuuccugucgcugcuuugugcuggaacagcaguugacuucagcuugggccagcuucuguuucuaaauagaugugcccccacccgccccccaggguagcccaugcugccccugacaccaggaagauggcuagcccaaguguuucagauccgacagaacacuccguugccaaaccaagacauggcauuuucuaaaugaaucagaggagcuuuuuucuuggaacagggaguugguuugaagguaaauacacuuuuuucuuuaaccugcugagcauuaacaaagcuggaucaucagcauauucugaccuucugaauccccaccauguguuaccauggugaugaggcuaggcagagaacuuacuggagacugcuuucuguaacuggggcacaaccaggcccuccccauuccccgagcagugacacagaaugcaaagggcacugcacacacccaccucuugggacugagggucaguuggcaugguagaguggacuuccaaaaagaccagugugcuaggcuaugccagaagacagggaaggugacccaguaaggagaguucgccuuccucucccaucuccucuucccccagccgacacagugugcccccugucucucccaccuucacguagaagauaggauuucuuuagaaguguguaacaguccuguuagauuaccaagugcuaauaguuaauauguaaucuguucuuuuuaugaaggcaaaucgaagggagagugguugagauuuccagacuccaagagauauucacggaaaagguuuugcaacagguaaaaaaacaaaaacaaaggagcuguauguuuucacucaaaggggaauguacuugagagcacgagacauuuuucccaaaggcugcugcucuacacagccaggagcagagccauguguugcuagcaggugugugugcgcagagcuccucagggaaaagcucucacuacccagagcugccucugcacacgugugauggaggaggagcuccccacaggggacccacugaccaccccaugugguagcacaugcgguggcacgugggaggagaguccaggccuggcagucaggguucuggaugugcuggguaagcuagguagcccccacaagcuacaguuucccaucuauaggagggagggacuccugcaggguuauucucuguuugagagauaacugcagaagcauccagcacgaugcugacgggcaguugcuuuucagucaguagguuacaggagcucagacccaggccucucacaacgcgcgguccaugccaccucagggauggugucugcgugggaaauaggauuguucuuuucaagugaauuuucugaaauucuuccagccaauaacuggcaaaacuuuucaagaccugauaaauuugcccuuuuauuuuuagcauccaaagacuaugggaacguuugaaagacaaaauuuucuccaguauuuuaaacuggacuacuugacuuaagauacuucacucacaaaaugacuuuccauaaaccacacagccagagugaaaucauuguaaaugagguacauuaagucuaacagugguuugcaaguucggguucauaggagucgcccuuuuuaauaacacuacccugcuucaaaccucccagcggcuccagggggccugggaggggcgugcagagcauaggcagagccuugccuuggcucaccgggaguuucuuuuucuuuucuuuuuuuuucuuuuucuuuuuuuuuuuuuuggagacagagucuugcugugucgcccaggcuggagugcaauguugcuaucuuggcucacugcaaccucauccucccagguucaagcgauucuccugccucagucagccucuugaguagcugggauuacaggcaugccaccacgccuggcuaauuuugguauuuuuaguaaagacgggguuucaccaucuuggccaggcuggucccgaacuccugacuucaggugauccaccugccuuggccucccaaagugcugggauuacagacgagagccacugcgcccggcccacugggaguuccuaaguccugaggaacaaugugucuuucuuguuuuuuccaucaguguugcauuguaguucauauugauucucucauuggaaccuuggcaguggucacuuaguucacacuuugagacucucuaaaaaggggugaugaugaggcaaagccaucccaguaauauucauugcugggaaucagaggccacaugcugccuuccucccuacaaugugucagucagguuucucuaaaaacccacgcuagcauucauucugcccugacccuguuaggaagcagcuucaccaccaccgaaaggaggagagaagcaggcacuccugcuuguaaggacgucuagcaccgucucugcuccuguggggccagacgcccccuguguuaucccacgcuucucaagcuuuucaaggcuucguuuggaguaaacguuuucuguaagcauccugcauccuauuuugauuuuuaaauuuuagccuguuuuuuaagagauaugaugauaguaaaacacaaagcacuauuuuugaagcuagcauauguauuucgaagcacauacauuuuaaagcuuacuucuguggacuucagaaagaaaugagagacuagaagggaagccccuggcauaugguggcugcuccacaaacaauagcucuuagguuuuuguccgucaccggcgaguggcgcaggagggaugguaaguguggcggaaggagcacugcaacaagauggggucucagcccugcgcgguggcucaugccuguaaucccagcacucugggaggccgaggcgggagcauggugugagcucaagaguucaagaccagccugggcaacauagggagaccccccaucucuacaaaaaauuuuaaaaauuuagccaggcgugguggcacaugccuauacucccagcuacuugggaggcugaagugggaggaucguuuaagcccugucucaaaaaaaaaaaaagucucaguccugccacuugguugcugugugaugugacuuugggcaaguuaguaaacuucucugagccgugaguuuccguuucauaaaauagagguaauaccuacuucuuggggugcugugaggauuuguggcuaugcaaguaaagccguuagcccuuggugacggcuacuguucuugucaugauauacgcuucagggaggaggaaguggcuguauaugucaagcaucccuaaacuucaaaaugugaaguccuaagugcuccaaaaucugaaacuuucugagcgcugacaugacacucaaaggaaaugcucguuggagcauuuuggguuucagguuuuuggauaaaggauacucaacuuguauuuaucuuuucuuccacaggaagcugagauugacagcauucaccaguuaguugugggggcaacugaaaauaucaaggaaggcaacgaagacauaagagagguaggcacuguuuagguuccccaggugcgacguggcgcagcacugagucccagcagcggguguuagucucgccggcacagcugcccaggagccuugcugggcagagcucacggggcugaucacaaaauugugugaccgcggagcugcguguguucaugagacccaccaccugucgcccaccuccagcugcuuucgagaggcaguggcucaccagccuccaaaggagcaauccaggguggguggggguacuccuggcagggucaggccagcucuucauguccagggauguacauggguagcucguuggcccccaccgaggggucagagccuggccccugcuuacagaggacacuacagccauccuguugaggggacuguuucccaagcucaguccucaggguugggucaccacggacaucauguuacugggaaacacaaagcuugcggucacacucugcucggggcccuuaacccugggacagaagggagugauuccgagaguuguguugagggagaauugugcaggacccaaaugauggccaaacagagggaaauauaacccauuugucuucugguggaucucaaaagccaucuauucaagguaagcacagauggaacgacacccauaguuacagccaggaucaggagagcacgugggaagaggggggcauuucagggcugcucaaaccaaaauccugugugauaaaaacaccugugcucccgucccugcccaggccauuaaaaacaacgcuggcuuccgcguguggauccucuucuuccucgugaugugcuccuucuccuugcucuuccucgacugguacgacagcuagccagggccacgggggcccagcacgagaguccucaugggcacucacagacugcgugcuuucauguacuuccagugcuggagcaugguaugaccagauuuuaucacagugccauuugaagggaaaggaguucagacagacagacguauuccccaaaaagggauaccccaggccgaugguguucagccauuuagcagcugaaaaaggaaacagugcacaccaaugggaggcagccugcguagcccucaucaggcaagacagacugaaugcaggagugggugauuagcugcuccuugaacuugaggcugccuuggcagcaggggcacagcaggccucaagagccccuaauugucucaggguucaaaggaagacacugaccuuucccaucccgguagcuucagggaagaucauaguuaauaacgucucucaacaaaugauuacuucuuuguuuccuuguggcuucuugucugucugagucaacgaauacacagacuuacuggauuauagaagagaaaauucacaucugccuuguuaaucuaauaaauauaauuacagccccuuaauguguugucaaugagucuaaguugacaaauucaguggcagcccagccaccuccuaucaaucaaucagggaagaaaugcaggggagacuggggcccucagugaggggcugccuggcauuacuccuccaaagacugcugcccccagaacaggcagggggugugggagggccaguuucccgccacuggguccaaggagccuuuguucaaaggaagaagugggccacggaagaacgggccugcuucucucgugccugugcuucugaccuccaggaacuguaaacaggaacaccuauguguaacugaaggcaugagacaucuguacaggaagcaucccagcgcccacaugggcaugagacagucugcacugcgccuggugaaaugcguguguguacagacaguccacugggcagcacagguauccucauguucuuuauuugcacagagugaaaugucagaaguuacauguaaaugaauucacagucaauaaaguccacgucuaccuggaaauacaggcucggccucugcacugugcgcacacgggcuucacuugugucuauucagaugcgcagggaagcuuuggcacugauuuauugcucuugagucauuuuccacagcuuaacaccacccuucucagcacacgccucugaugcacaccgcugcgccaaggucacggucugugucuccagacacccuugaugagaaaauacauuuucugucuuagaagcacauuucaggaaacaagaguggcgcugaccacggucaccaugccuguucacaacacaucucacacuauuugucguuuauuucugaucuaaaaaacugaaacuuuugacacguacaccagaaacaacacauucaauaacauagaagaaaugucugcgaaugucuuuucuauuuguuuuacacacuuaguucaucuaacuggcaguuuuguaaacauaaacuuuaauaucaagauucaaacuggaacaauuuucuuacaaagauugugaguugaaauuugucauuuuguuugcacggugccacaccagucccccacccccaccccacagccuuuccugccuguuucccacaucaagggauaucaguuucauagaauaaaaauuaaaguagcucaagcuuaccagaaauuacauuuccacuuuucccacccagcucauuucuuuaaaaacuaauggggcuauuggugcaaauuuauucauaauagaagugaaccagagggccagugggggcucuuuccuaucagcacaucacagagcagacagacuaccugcagggagaguucugcaccucacgggcccagggccgucucuucccagcccucucccucacaugcucugccagucuacacacacuggagcaaaccccagcugucuccacccagauggguggugccccucccuccuuaccaagaugccagagucagaggggagggaguagucaauccacaccgagccugccacauugcagggccgucccaccccgacucaggagucagcacagggaggggugggggggucuuuuuccucguucucuaugccacuuacuuacuacagugcaccuuggcagcagucagcacuguuacccgcugauggccgaggaagaaaugcgaaguaggcuugcucuuagcacagcgagagaucacucuagauauggcuauggaggaagguuugcagacagcagggucgguucagaaaaucaauuccacaaaaugcauuuaucugagauccaaacccuucgcauauccaguguaaauuuauuuuuuuacagcauccaauaaaucccaguaaaggagcuaaaugaagaucuuaacaugaaaaguggugucagagcucuuuaggcaaugcugaaaugcacuugauuuuaugcccguggguggucggcagcaaguuuuauuugcaaagcagcauuagcaaacagaagcaauugcaccguaaaugaguaaccucuaaaguaucaguaauuauauuuaaugaaaugucccucaaagucccuuuguuauuugcaagugacacauuguaaggaacuugcccaucccgcuaagcugacuucucagccgcuucagucuccugcucggacagcuucucuucugacagaacugacauccagggcgauacggagcgcgugaugcucugcuuggccagguuguagugguuuaugacuguguaaaauuucucccg

SEQ ID NO: 14325 - RNA, 12926 nt, Homo sapiens
cuuccguaggucggaauaaacuugggaacucuuccaccggcaaagcucaguguuuuaaaauucaaaucacacuugccgacaugagagcggaaccuuugaggccgacuccacccuagcugcucgcuaacuaaacagcgaagagaacacagucuccaauccaaacgccaggagguccagacccggagcggacgccggaagcgcugugucugacgucacuuccgucgcauuucggggcgguaccaagauggacuccucgcgggcccggcagcagcuccggcggcgauuccuccuccugccggacgccgaggcccagcuggaccgcgagggugacgccgggccgggugaggcgcgcaccaagccgccccgagguucucagaggcgaggcgucggaaaacggccggccuccggcagcccuggcccagucuggaaggacugaguuucggcuuugcaagucgaauauuuaaugucagggaagauccuuagaaucgcggagugcugugcaucgucauuucagcugcgcuucagaauucucuggagagcugauuugacaccuauuuggaaauagcgauuaaaauuaaaaauacccaccaguuuuaagucuuaaggauuuaccagaaacaugcguguaccgcaguguacaaugaugugcgcaguguuucacuucaggauugcuuguaauagcgaauuacuggaaauaucugccuugcccgucagcagaaagcuguuuaaguaaauuuggguauauguauaccugacacaucaggucgacucguauguaccaauggggaugauuuucaaagggaaguguggaacacuaugguaugccgccauuuggguacaaaacagguaacuugugauguauguucaccugugaaugcauagaauauggaagaauucaguagaaauuguaaguggugguugcuucuggggauuagaucugagguuaaggaugggagacagauacuucauuuuggauauuuuuuaucucauauguuuuaaaaccacguccauuuauuaccuuuuaaaauuaaaaacacgaauaaccucaugcccaggcaugaugauguauacauuuugaggauaucccagaauauuacgaacaugcuucccaggguuuccgauggucaucuaaaggcccaaaaccucagauguggaccauugauucucacgugaaccuagagggcaugucagaauccccggaaaacuuaauagaaaucauccaucugacccaacccccauccacccauucuuucagauugcguuccagacaggaaaaaugucuuguccaucaccugucuagacagugcugugcuggaacuagagcucuggugugccguuuccacuuuugagcuguguuuaaaguaacuaaaauauuuaguuauaggcugggcaggguagcucacgccuguaaucccagcacuuugagaggcugaggcgggcugaucacgaggucaggaguucgagaccaaccuggccaaauagagcagccuggccaagauggugaaaccccgucucuacuaaaaauacaaaaauuagcccggcgugguggcaggcgccuguaaucccagguacucgggaggcugaggcaggagaauugcuugaacccgggaggcggugguugcagugagccgagaucaaaccauuccacuccaacccgggcgacagaggaagacuccgacucaaaaaaaaaaaauuuaguuauaaaaguguucuuggaagaccacaaguccaguucaugcgcuaauguuugccuuuggcauuuuuccuaauuaacaagacuaauuacuuuccuagaagaaaugugaaacauaauauuaaaauucuuacauuuccaggugacauuguuauuuccgaaagacgaugaaaguguaaauuugauuucacaauguauuuagaggaaauaaauugacuguauugaccauauuuuauagugggcucuuauuuuuuguaaauauaaaccuaucucaaggguuuuacagaaggauuuguuaucaugggagagacuguuucuuagcucuaggaaaugauuuuauuuggcuuaaguguaauuuuuccucgcaaaauugugguaacuuaauaaguugaaaucucccuuauuugcagaaaccuccacagcuguugagaaaaaggagaaaccucuuccaagacuuaauauccauucuggauucuggauuuuggcauccauuguugugaccuauuauguugacuucuuuaaaacccuuaaagaaaacuuccacacuagcagguaagaaaauuuuauugcuuuguaaauuaaacccaagucugauuuuucguguuauauuuuguuaguugaauucuucaaacaguaagcaccuacuacucucugccaggcccuguguuggagguguggugauacgaagaugaauaugagaugggggucaaaggguacauauuuuuaguuauaagaugaauaaggucuggagaucuaauguacauacaguauagugacuauaguuaauaaggcuguauuguauacuugaaauuuucuaagaguaggucuuguguccucccccuguuaccccaccagugguaacuaugugaggugaugagugugauaauuaacuugauugugguaauaauuucacaauguguguguguguauauguauacacguauauauauauucauauauauguauauauguauauauucauguguguguguauauauauaucaagucaucacacuguauaccuugaauauauaaaauuuuaauuugucaauuguacuucaauaaagcuggaaaaaauaaaaccaaugagagggugugugcucugggcacauacaguagaguggaauagaacuggaaauuauuugugugcaaauaaauguguuguaggaugaggaagguaguaaauuuaagaagaaccuaauccauuuggggaaaagagggagaaagacugacugaaggucuucaaagaccaaguacaagaguacugggaggaagagccgagaacuguggccagugggaauugggucucaggguugguuucagagggugguuacagcugacaagguaacuacaggguguaacuguguuagaguggaggugaagguccacagugggaggagugacagcuuuguggccagaccagauguccaguaguuccucauucacagggacugagauccuuucaguauagucuccagaguugacauggaggagaggguuggaaucauauccuaggguccuuacugcacauuggagagugauguggagacccuuggauaagaaauggaagggagagguauguuggugagcaucauggcauugggagggcuggugugcuuagggucaagaguaauaauuuggaaguaccaguggggguaggaagaugcagacaggacugugguccccucguaucauggcaggacacaugauuucuccucaagggccuucaggaggagcagugacuucuggcggaggagacugucgagccacaaggaaaaagcccacaggggaaaguaggcagaggggaguuuauuuaaacuguccucuacuuucuaggggagaaacuuucccuaaacacucccaucuucugccccuccaugucacucacuccuuugugggagguggcgugacugauugagugugugaugaagaacuggacaaagguagcucagcaccuucuucugcugcaagucggcugcccauaggaagcgcagagucuggucugccuucccauggugucauuccacaggggcaguccccacaggaaaaggucucuagguuuucauuuugaccuggaacccaguggguaaggcuguuucugggugucagagacccaguauuaggaagugcuuugucaucacucaccaaagccauauucuucccacggcugcaucaguauaacagacauuuaaucuucaucagcuugacucagucaucucucuuagaacuugggcugggaaaagagggauggauacuuuauuuuuauuuuuauuuugagacagggucucgcugcacucugucacccaggcuggaguguaguggugcgaucauggcuugcugccuugacuucccaggcucaagugauccucccaccucagccucccaaguagcuaggacuauaggcgcacaccaccaugccuggcuaauuugguuuauuuuuuguagagacgaggucucuucauguugcccaggcuggucucaaacuugugggcuccagugauccucccaccuugacuuccuaaaguacugcgauuacaggugugagccacugcaccuggcuggaggggauggguacuuuaaccaccaccaauagcagcugcucuuuccuucaucagauacuuuauggaggcugagauguguuuggcugucagugccaaacacguggaaggugcauuucuagcucuccaacagcucauucuaggcugcagcagacaaguuaccaggccgcaugguaugugcuuuguaaguguaggcgcaggguaucaugggagcaucuaggagggauaucuaguccaggucagccucaggacugagaccuuuuugagguuuuaggagaugugagagaacuucuguauuuguguccuuauauuggguauuuuuaguaguuuagagaaauggcagaguaagaaaugaucacacauaagauauuugggggcaacugcagugaaguggagugcccaggaccacauaacugcuguguggcaaagccgggacgcagacacugggaccagggcuguggggguuggaaagaaaguagaagucauagaucuguccucaacaaggugucaucuuagagagaaaaaggcagaaaugcauucucaaaggcugaggauuuugagucgcauuguuuucuugggaaggacucauuaaggggaguugggggguauugaacagccaugaaaugagagggcugcacaaaagacagugccggcugaguucugcuuuuggaaaauggcuaaaauggcucguucuucugacgccugaggugauuucuuuuuccucuggcucuagccuaaguuuagaagcuugaggccuuaagguucuuuauauuguucaaagaugggagagcagguccauauuaaaaacaaaacaggccaggcgcgguggcucacgccuguaaucccagcgcuuugggaggccgaggcgggcggaucacgaggucaggagaucgagaccauccuggcuaacgcggugaaaccccgucucuacuaaaaauacaaaaaacaauuagcugggcaugguggcgggcgccuguagucccagcuacuugggaggcugaggcagaagaauggcgugaacccagcagguggagauugcagugagccgagaucgcgccacugcacuccagccugggcgacagagcgagacuccgucuuaaaaaaauuaaauaaguaaauaaauaauaacaaaacaacacugugaugcuuuagaaaucacaguuuaaaauacucggcuugugugcaucaaaaucaacaguggaguuaaagacagaaaguaaaauuaaaauccuagaugcucaggcccagaauuuuggaaacuggggacuagguaguuucucuuagaaaggugcaaggugacugugauauaaagccagggccgaggaccacugacugauaguauuauauuuuguucaggcaguuuaaaaaauuuucuuaggccgggcaugguggcucaugccuguaauccgagcacuuugggaggccaagguggauggaucaccugaggucaggaguucaagaccauccuggccaacauggugagaccccaucucuacuaaaaauacaaaaauuagcugggugugguguugggcaccuguaauaucagcugcucaggaggcugaggcaggaggauagcuugaaccugggaaguggagguugcagugagccgagaucgugccauugcacuccagccugggcaacaacagcgagacuccgucucaaaaaaaaaaaauuuuuuuuuucucauauccacauguuggcaaaggaaaaaaaugucuaaaaagacuccuuagggguaaugauaaaaggccuuuuuagacauuuuuuuccuaaucauuccuguggaauguggaauuagauaaacuauaucauuuauauacugcaugcauaucuaugcuuuauacauacaauuagagccauauuuuuuucuucacuuugggggcgauacuccccccagugagauugcaugcucuagcagaagagaggucuuugaagacuccuaaagaugaacauggacauuuuuuccucauagauauaacuugagugauggcugggcaugguggcugaccccuauaaucccagcacuuuggaaggcugagacagguggaucacuugaggucaggaauucgagaccagccuggccaauauggacauggugaaaccccaucucuacuaaaaauacaaaaauuagcugggcgugguggccagugccuguaauuccagcuacuugggaggcugaggcaggagaauuggugaaccugggaggcggagguugcagugagcugagauugcagcacugcacuccagccugggcaacagagcaagacuccggcucagaaauaaaugaaugaaaauaaaaauaacuugaguggaauaauaaugauuaugauugagagucagcugugaggagcacuuugcugaccacuugauuuaauucucacagcuauucugaguuaaguacugucaauauuucugaaacacacggagguuagguaauuugccuagagucacaaaacuagucuugcucaaguuaagauucaaacccauacagacagauuucagaggcugugcucuuaaccccuucccucuacagccucucaugacuccgaaucucagaauugcaucaucguaaaaagccuucauggaauccggaaccuugccauuauuggaaguucacuuugugccuuuguaacuuaucuguuguagccaucuguucucccucucucuuccacauggauugucaggcuuuucccauagagaagcagaugaugaugggauauuggauugaguugggagaaugggaaaggcauuucaguccccaaguccagcugggguggagggaagggguuguccagguugccucacucuugcugaaucaggucacagguggaauuggaagggaguaaaaaggcauuggcauugagggugagguggugaguagaagauauuuugaaaaugggaggauuucauuuagaaaucuuuuaugagagaaaauuugaauuauugaucuuccuaauugucuuucaguauuccaagaaaguccacuuaacuuggaggaaugaaguuucccacugauaaacuucuuuaauccugucacacucaaaacuucagaaacaaccagaaagccacuaucuuccuuguauuuuuguuuuuauuuauuuuauuuuuugagacagaguuucacucuuguugcccaggcacuccaggcuggagugcaauggcgccaucucagcucauugcaaucucugccuccuggguucaggcgauucuccugccucauccucccaagaagauuggauuacaggcuugcgccaccacgccuggcuaauuuuguauuuuuaguagagacaggauuucuccguguuggucaggcuggucucgaacuccugaccucaggugauccaccugccucggccuuccaaaguguugggauuauaggcaugagccacugcgcccggccucuuccuuguauuuuuaaagaaaaugcauugucaugaccagaauuuucccuugguugguuggcugaugagaguguauauauaaaugcauguauuucaagucuuacuuuucauucuuuccugaguuguguaucucuuuuucucacccccaucucccauagauugagacuuucugaaagcauggauuguuuaaguauggcucccucugcaacacuugauauucuuagaagcagauuuuuaagcuauuaguaaaaacuuuuaagauaugugacgauucauuaagugcugucagaccucuuacuguuuuuaucuccacagcugguuucucuguggcagugccuuguugcuugucaguuuaucaauugcauuuuacugcauagucuaccuggaaugguauuguggaauuggagaauaugaugucaaguauccagccuugauacccauuaccacugccuccuuuauugcagcaggaauuugguaaguuaacuuugaaaugacuaacaggaaugaacaacaaauuuuuuuuuugaucagauagugauaugcuugguccaaacuucgaaagaaaaaaaguuaaaacagaaaaauagucuccuggucauucaugcucucugguucccuuuugauuaguaucucuuucuccuucuauuuauggaucuaguuauuuaaagcacagauggugacauucuguacauauucugcauuuugcuuuuuaaaucuauuuuauuaugacauacaguacauauagaaaagugaaaaaaacugagaugaaugaauuagugaaugaauucucaugaagugagcauugguguaaacugagccagcacacugggaacccccuucauucucccucccaguuacuacaccuucccuccugccacagguaaauacugcccugaccuucaugguaacuacuugcuuugcuuccauuagauauucuauuuuuguuucagcuacgcuuuugaacuuuauagaaauggauuuguacaggguguauuccuucacauugagcuggcugugugcagcauugugugcaguucuuucauauugucgccgggaacagugacucaucuucauugcucuuuagcauuccauuguuuaauugaaucccaguuuucuuuucccuuguugauuguguuuagauuuuuuucaguuugggguuacuaugaaggaugcuauaaagagcauucuuguacauggcucuuguagcacagugaacacauuucuguuggguguagagauguauguauauauguauauauauguaccccaagggguaaaauuguuggauguacguaccuuugacuucaguaaaucaugccaaacugcuuuccaaagugguuguuuguccuuuucuccuuuuguuuuucaguggauccuuauaguuugggauucuuccauaaugguacauauagaugugucucauuuuuuuaaacaguugcauaguuuucacagcauggacauaacaugauuuauuuaaccugucuucuguuguuggacuucguuauauuuauacccaaacaaugccacaaugaauaaccuucuucauaaguuaauuaaauacucaaugaaaaauacaggguuuuuuggguuuauaaaaguaauacuugcucacugaggaaaaaaaaucuguaaauuacaugaaaacacaaaggaaauauauccuaugauucaaccagaaagaaaacuacuuuuccuauguugugugcagcucucuaguuuuuucuuucuuuauaucaauuggauuuuuuuuucuuuuuggagauagggucucacugugucacccaggccggagugcaguggcaugaucacagcucacugcagccucgacuucccaggcuuaagugauccuccugccucacucagccucccgaguaguugggaccacaggcaugugucaccacaucuggcuauuuuuuguauuuuuuguagagaugggguuucgcugugcugcucaggcaggucucaaacuccuggccucaagccaucugcuuguguuggccucccaaagugcuggauuacaggcgugcgccaccacccccggccuaauugaauuuuuauuuuggaagaaccauauaccuuuauacauauucuuucuaugacuuauuuucuguaguugaaguucaagguuguuugacagugugaugugguuauuguuaaccuguaugugggggcaugcagauacguuguuuuacuuuuucccaugaggguaagaucauguccagaaauguuaauuuuuuagacagugugauuugugauuauaguuauuuaauacucauacuuaucaaacuauuauauauuaaaaccaauaaccaucugaacuuauuugaauauaguuuucccuauucuguucuuagaaauuucagucauuaaaaaucuuuauacuuaguguuuuaauuuuacuuugaugacaggaauaguguuuuucucaaugaaagauauaauagcagcuuauaagugauaacuguuuucauucuguuuuuaagagacaauauuuuggucuuuuuuaccaugauaguuuagugugugaugucauaaaaaugggcuguagccauuuaaauuauuguugaagucagaaacuaagagacuucaguuucuauuaagccaugucaaccccuauuaggagaccuuuagugguuccaguuccagggccuucuugaagaaauugugauacuuguuuaaguauaucuagaguuuuccuuuccagcauuggcuaagucacauacuugagaaauaugauacauagagaaaguugcugacuggaugaacuuuucuacauugaauacuuuaaaucuggauucuagaauaaaauauauugaugcauauuggaguugucaacuguuuaugucuuguucuuuucagcuucaacauugcuuuauggcauguguggucguuuuucacuccauuguuguuguuuacccaguuuauggggguugucauguuuaucacacuccuuggaugauuuccgaagguaagauaucuggagugguuuuucuaaaaaugaacucguuugaaaaaugucuuuuaugacaauuuucaguggauggagcuguaacagacuauuugugaauuauuuucagucauguuuacaccagaguuguccacacuagaauuauccauucauugaacucugagauagacuccuuuuuguuuugagacagcuucucacucuguuguccaggcuggaguacgguggcaugaucacagcucacugcagccuugaccacuugggggcucaagcaauccucccaccucaguuucccaaguagcugguauuauaagcaugugcuaccaugcuuggcuaauuuuuaaaaauuuuuuuguagaaacagagucuccuuauguugcccaggcuggcggggguugggggcugagacucuuucuuuuguaaaaguugguucuaagugacuacuuuuuagagaagguacccugccuuucaaagaccucauaaagacaggauuuguaccuuccaauauaguugaauucacacauuagaccauuuuauguugaaauuauauuaauuugugucagcuuauauucagugacuguuggcuggaucauucuuaagaaaugggaauacaggaagaaugaacaauuuuaccuaauugggaaaaaaaauucugccaucuucuaauuauucugacuuccucauaaaaauguguuggaugacacaaucagcuuucguuugguguuauuuauagaauuucugccucccuacagaucaccccauccugagaucugcugccuuacacaguggaggcuguuuucugagugucggauaacucuguuauuaaauaaguguauauugagaauacucacuccagaugcuuaggggcauggugagaaggacaaagauagugccuccugucaggucacuuacaucagaacuugcaggaaaccugcuuuauacagcaguugacagguguggaaacugaagcucauggaaauaaaaguuaauacgcuaaauuuucaaggaguuaaugaaaacugacauuucugcuaaaaacagcauguucucccugugggauuuuaaaggaaggucagugguaacuguguaaagaagaaauggacauacucucauuguuagcagucugaaaauaguugcuagcaccuccaugcccacgccaaugucuccagccuccuucaggcaccuugcugugucuugggaccacugggaacccucacaggaggcccuucauuccuguacaccuguggugccacaagcggcuuugggcccggaggaauccuacacaucucagaacacuuccucaccugacccugucacccaucuccccuucucguguucucagccccuucuuugacucuugaauuuugaguuuuuacagauguuugggagcucuuacucugacaugaaguuauaauugguaauggagacucagacaauguuguagauuacagagugaacuaugcuuuuuaguguuaaaugcaauagcuugagauacaauguuuuacuugguacauaaaugcugguuuucuuucagauuuaaggacauacacuuuuuuuuuuuuuuuuuuuuaagagacagggucuucuauguugcccaggcugucuuugaacuccugggaucaagugauccuccugccucagccuucgaaguaguugggacuacaggcccacgccaccgugccuggcuggacauguaaauuugaagugaaugguuaaacauccagcuagcugaaagcauggcagacccuaacagaaaagcuacaguguguuuuugcagcuaugaagugaaugguuuccuggggaaaauugugacuuuguauaacuguuguugaaaccagaauaaauuauauuucacuugcauaugcauaaauuauuaaaauuuucagaagucagugauacagaaguacuauuuugcaauguuaaucuguuugagucuuuggagaaagugguuucauuguagguacauagugcacuguuaauauuuuaaacaaguaguucacucuuccauuuaagggauagcaguuccuuguauaaaaugacuggauguguauaaaggaauuauguugucaugugccuuuaaccagcuuuaguaauuacuauaaucucauauuuaugauaguuuuguuaggugacaggaccaaaugaaaauauuuuauguuuucucaucacuuuagauuuuaucauuauguacauuacuggguuuuuagcauuuccuaaugugaaguuuuaaucacuuuuaaguauacauuuuuuucuguaucauuuaaauaaaauauuuuuauaacuuucuugugaguuuuguucaugcg

SEQ ID NO: 14326 - RNA, 1494 nt, Homo sapiens
uccgggaauuuuccagaaugcuccgugagaggcaggaggcagagaagugguagcugcccaagcugcacacaucuccgggcuccuuccugcucccucacacacuggccucagccugcucaccggcagaagaugguggauggugaaagaaaccacuuacuaugauguuuugggggucaaacccaaucaaugcuacucaggaagaauugaaaaaggcuuauaggaaacuggccuugagguaccauccugauaagaauccaaaugaaggggagaaguuaaacagauuucucaagcauaugaaguucucucugaugcaaagaaaagggaauuaauuauaugacaaaggaggagaacagacaauuaaagaggauggagcagguggcgguuuuggcucccccauggacaucuuugauauguuuuuuuggaggaggaggaaggaugcacagagaaaggagagguaaaaauguuguacaucagcucucaguaacccuagaagacuuauauaauagugcaacaagaaaacuggcucugcaaaagaaugcaauuugugacaaaugugaagauagaggagguaagaaaggaggaguagaguacugucccaauugccgagguacuggaaugcaaauaagaauucaucagauaggaccuggaaagguucagcaaauucagucugugugcguggagugccagggccauggggagcagaucaguccuaaagauagaugugaaagcugcaauggaaggaagauacuucgagagaagaagauucuagaauuucauauugacaaaggcaugaaauauggccagaagauaacauuccauggugaaggauaccaagaaccaggacuggagggagaagauauuaucauuguguuagaucagaaggacgaugcuguuuuuacucgacaaggagaagaccuuuucauguguauggacauacagcugguugaagcauuccagaagccaauaucuacucuugacaacugaaccauagucaucaccucucauccaggucagauugucaagcauggagauaucaaguguguaauaaaugaaggaaugccaauuuauccuaggccauaugaaaagggucgccuaaucauugaauucaagguaaacuugccugagaaugacuuucucucuccugauaaacugucuuugcuggaaaaacuccuacccaagaggaaggaaguggaagaaacugaugagauggaucaaguagaacugguggacuuugauccaaaucaggaaagauggcaccauuacaauggagaagcauaugaggaugaugaacaucaucccagaggugguguucggugucagaccucuuaaugggccagugaauaacacccacugguggcauuuuaugugcaguaguaaaugagugaaggacugugaucauaacaugcucacuacuugcucuuguuuuuguuuaauauucaacuauaguaguguuuuaaaaaguuaaaugaagaauaaaugcaaauguaaaagcuc

SEQ ID NO: 14327 - RNA, 1058 nt, Homo sapiens
aagcaaccaguccaagggauuugaauggaguacuugccugaguuuggagcccaagaauaucacuguuacaauuuuuuuuuucucuggcagcaaagucuaggcucuuuccacuacaaagcuucugagcugggcuuuaaaaggugggugggauuccuaauggcagaaacaugaagggaaagaaagugggaaaugaccaagucauuugcuaugccgugcauuugguauuugcaccauucccuucagccagagauccaguaugcuuuguaaauguuaaaccaagaaaaaaagcauucuaggaguuuccuuugagacucacaaacauucugcuaaagggaaagcaauccaaggcaacauuuguuuaaauuaaaaauaacaauaaaaagaaaaacuugacaucuauuccuggccaaagguugagcauuaaauaacauucaaauuuggcuuugauaaaaaauguauguugcuuuggauagcuauauuuaagcaauuuuugcaagccucagagggaacuaaaaauuccuuaauugcuuccucauuuuuacauacuccauuacauugaaccucaaacagcaucugucacuaaauuaccagcauuacaaaaacaguguguauuccauacauggaagaaccucaaauaccugaaaauaacuccaaauauuuaagggaccuauugagcauuuuuuaacauuaauuuuagucuuuaaaauuucuuguuaugccuaguuaucuggaacauacccuaaggccuuuguuuuuuuuucauuuauaauaaaaaaaaauuucauugaaauucucccuaaucagccuauuuaugagaagaauaguuaugcaucuucaagaaagcaaagauaauuaugcauuugacauuuuaagauacugaaccuuauaucagagauuuuaagaacaaagagugugugaaauggaaaucaauauuuugggagcuucuucuaugugccagauaggugacuaggccuuuuccauuccaacaucucugcgauccaaacaucagcauuuggagagcugucaucugccccagugauacugcccuucagaggcca

SEQ ID NO: 14328 - RNA, 845 nt, Homo sapiens
uuuuuuuuuccggcuggaaccauggaggguguagaagagaagaagaaggagguuccugcugugccagaaacccuuaagaaaaagcgaaggaauuucgcagagcugaagaugaagcgccugagaaagaaguuugcccaaaagaugcuucgaaaggcaaggaggaagcuuaucuaugaaaaagcaaagcacuaucacaaggaauauaggcagauguacaggacugaaauucgaauggcgaggauggcaagaaaagcuggcaacuucuauguaccugcagaacccaaauuggcguuugucaucagaaucagagguaucaauggagugagcccaaagguucgaaagguguugcagcuucuucgccuucgucaaaucuucaauggaaccuuugugaagcucaacaaggcuucgauuaacaugcugaggauuguagagccauauauugcauggggguaccccaaucugaagucaguaaaugaacuaaucuacaagcgugguuauggcaaaaucaauaagaagcgaauugcuuugacagauaacgcuuugauugcucgaucucuugguaaauacggcaucaucugcguggaggauuugauucaugagaucuauacuguuggaaaacgcuucaaagaggcaaauaacuuccuguggcccuucaaauugucuucuccacgagguggaaugaagaaaaagaccacccauuuuguagaagguggagaugcuggcaacagggaggaccagaucaacaggcuuauuagaagaaugaacuaaggugucuaccaugauuauuuuucuaagcugguugguuaauaaacaguaccugcucucaaauuggaaaaaaaaaaaaa

SEQ ID NO: 14329 - RNA, 59883 nt, Homo sapiens
caguucccuuucacuuccgggguugcucuggauccgcugguuccguaacaacaucccguuggcuucccucaggcggcgggaccagugcagccgccgccucccaggaucguccgccggucagggcccuugcccuccccggcacaggccaccauggccaccaacccacagccgcagccgccuccuccggcgccgccgccucccccgccgcagccgcagccgcagccaccgccgccgccgccgggccccggggcuggccccggcgcgggcggggcgggcggcgcgggugcgggcgccggggacccgcagcucguggccaugaucgugaaccaccucaagagccaggggcucuucgaccaguuccgcagagacugccuggccgacguggacaccaagguuaggagcgcgccggguuugggggucugcgagggaaggggaggacccaagggcgcgcuucuuuugcaguggcuuccucuuggagcugcagcugugugccacggacugugcaaagcacagaguguucauuccuuagcguguccuuugguucguuuuaccgacuaguguuuaaguaccuacuacgugccagucaugguuucggcacagugauuaccccggucugaugagcaagacuaaggcauuguucuuacaggaacugguuuggaaacaguggcgcuaacaguagccaguuuuguauucauucucauaucugaugauuuuacuuuguaucgaaguuauguuugccuucuuucuugaagguuucugggcgguaagggccuuuauccuuuggagaaaugacuaaaugguaauugaaucaaguuauguguaauaugcuuugcuggacaucgugggggugggagcgcaaagauaaggaggcaaaccugagacaggacuuuaguauuguuucuagcagugauugccugauuuagguaacuuaggccaugucaccauucuaagguaagaagggacaggaaggugggguagagagaaccgagucauucaguggagaaaagaugcaggagaggugacagcagauacugaaguggagaaaggacaggaaagagagcagauucaggagaguaauguagagaagggaaaggacagcaacaagguucccuguccagaaagagaggcuggaaaggggaagggauuuuguaccaaaugucagagugaaagggacauuagcaggaacaaguaaacuuagcuggauuggcaaagaauuagccaaagacaccaggaaagagcagucagugagauggauggaaaaccacaguacagucuagaauucuggaagcagaaagcauguuggaaaauuaacugguuuguagggguuguuuuugucugcuuguuaaaucugguuggguccauuggauuggaguuuugaugaaaugaggguuuccuuuuuuuuuuuuuuuuuuuuuuuugagacagagucucgcccugucgccaggcuggaaugcaauggcgugaucucggcucacugcaaccuccgccucccggguucaagcgacucuccugucucagccucccaaguagcugggauuacaagcgcgugccaccacgcccugcuaauuuuuguauuuuuaguagacacaagguuucaccguguuggccaggauggucucgaucuccugaccucgugauucgcccaguaggcaugagccaccgcgcccggucgaggguuuucucauaguauguuuaguuguucugaggagcuuuguaucuuugagaaaugcauguuuacaacauccacaguuucuucuaaagcuuucaggugaacugcacacaguuccacuaugucuucuggggaaacucuugaauauccugguacaucuuccuuuauaaggacucauacugggcccacuauguaaaacgugguuuuucgggauauuggagguuuugcaccacagagaauucaauucacuugggaguguucaucuauuuaggaaguauaguuuuuuuuacuuuugucuucaggaauaugcacugcuaccuuuuagaaauaauuucuauugccuuuauuauuuuuguuguuauuuaaugggaaaagguuagacauggccagguaaauguuaucaaauaaaguuaguuauucguauucaacaaguggaauuuuuacuuugcuguucucagaaacccaugaaucuguguguucucagaaacccaugaaucauuauguauacaaauuaaaaauuguaauguacugcugcaaugucugaggcucaacuuuuuuauuauccuauucccacaaaauguuauugguaugugucuauaauaucccugccagacccuucaaaguaaaggauuaaaaccuuuuuuggagggaaggagggaagcacaguaucucugaucaucuaaugaaaguuaggaccuucucucaagaaaaaugcgcaaguaacacauuaaaacgcuguuuuucuacuucagaauggucaacuauaggcaauuucaugagaaucaaucuaauaacauauacaguuucagugaguucaggaaccauggaauaagaaccuauuuuaauguucuuagccucuuuuuugaggucaagaauugaaugauauuguuacaacaaaacucuuccauuccgaggcacaguacuuguuuauaugaacaagguuucucagggcgcaugacuauaaaaauuagaaauaggaauagaauugaugaucaacccuucuucuaguaauaagacauauucagccacagaugcaggaacuuuaaaaagcaacaguauggccaggcccgguggcucaugccuggccaccgugggccaaaguagaagauucccuguucaugcaaagaaccaucacuuuaauggaauccuugaguuucaucugccacuugaaccucaaagacugaccugcuuucugucaaaaagucuuaacuuguagcauauagaguuauaguggauuaugucugucacgugcauauuuaagaaugaagacauuugauaccugccaggugcuaagagcaaaacugucauccaguuuaguguguuuaaaccaggaugagaaguaccaaagucugcugcuacaccagaagaccacagaacccuggucuucugggaggccgagguggguggaucauuagaggucaggaguucgaggccaaccugaccaaaauggugaaaccccaucucuaguaaaaauacaaaaaaaguagccauguaugguggcacaugccuguagucccagcuacucgggaggcugaggcaggagaauugcuugaagccaggagacagagguugcaguuagccgagauugugccagugcacuccagccugggagacagaacaagacuuggucuaaaaaacaaaaauuuuuaaaaagcaacaauacacauuuuucaauacaguugcauauacuauuuaauaauuaugaaaauuucuaauauuucuguugcuuugagaaauuagaacugaaaugacacccucccagacaaaaaagaacacucagcuaugguugaaguucuggugcucagacgcuagcuuaaacucucccacaaaaucucucucucucucccccucccugccacuaaccucuguaccugcuccugguuauguuacagguuauguucugguacuuccuuuaccccaugacucucuccuucucuucuacucccuuaguuagcaauuagguagauuuuaauuugauuuaaaagauuuguucucauugaauaccauuuuauacuucauuuucuuauuugaaaaaaaaaaaaauauauuccccccugcuucccaaaaagccaaaguuuucuucaucagaacauaacauucauaucaauaugaugagugggccaaaguagaagauucccuguucaugcaaagaaccaucacuuuaauggaauccuugaguuucaucugccacuugaaccucaaagacugaccugcuuucugucaaaaagucuuaacuuguagcauauagaguuauaguggauuaugucugucacaugcauauuuaagaaugaagacauuugauaccugccaggugcuaagagcaaaacugucauccaguuuaguguguuuaaaccaggaugagaaguaccaaagucugcugcuacaccagaagaccauagaaccccccuccaaacuguccagggucauugauaguccuuaaccaggagagagaucugacuguaacagaccaaaucagcccuucccacccaaagaaauggaaccaugggcaacccuaagcuccaacuacugcaaagacuccuccguuauagacuaccaguuuccagaucucuggagcaagcuuagugguuacaaagccauucugucuccuuugcacugauuagcaucuggagcgugugaggagggaugaucaagaggcccuucagggagcucgccagccagguaaauaugguaccucucuugucaaguaagaaagucugauuuuuuggacacuuucuuaguuauaaauggccccuggucaauuuauucacccaacaaacauucauugagcaacucuuauguaccagucauuuuuuuaggugccagggauacagcagugaaccaaacaucccacuguuauggagcuuacauccuaguagaaaaaaaaaauagacaacaaguaauguaugguagguccuauggaaaaaagcaagaugagggauggaugggcuuacuguuuuauuucgaauaagcuguucaggguagguuucaaugugaugauacuugagccaucugugaaggaauugaaggggcaaugcagcugucuggggcuugagcauuccaagaagagagcauagcaaguauagaagagcugagacagacccacuaaggggaaagugacaagaggugagguagguaugccuucacagaucuggcaggucuugggagccaucagaagaccuuggcuuuuacucgagcucagaagccauuggcagguuuugagcaaaagaaggacaugaucugacuuccauuucagauggguugaccacguguaauagcuuccccuuucuugcuaaguugugauuugaaugggucaauaaauuacaugguuaccugauuuuuagaagacaacuuuguuguagguaaggauagaauucugcaugaggccaguuguuauaauucagacagaugagaaugccuuggaacagauugaggucaguaaagguagugggaaguggucagauucuggguguauuuucaugcuacuguugagagaauuugcuaauaguaugcaugugaaguagaagacaaagggaggacucaaggauaacucuaaggcuuuucaccaaagcacuggaaaaggaagaaaggguggaaguauguguaauauauguguguguguauauauguguacauguggguacauacauguuccuaggagaauacuucucaaugaauacuuaauauuucucuaguugcucaacuuuuuacugaaaggagagcuugaaaacaaggaaaauuaccuguugaguaguucagauuugaacuuguucugggaagacuagacuagaaugccaaaugcauugugauguuagagccuaaugaauguguguuagauuugggaauaccggaaagaagaauuaggcuuuagaaucauuggggagaaagaauuaagaauuaguuuuagggcuggguaugguggcugacaccuguaaucccagcacuuugggaggccgagaaagguggaucacuugagguuaggaguucaagaccaacauggccaauauagcaagaccuugucuccacuaaaaauacaaaaauuagccaggugugguggcgcaugccuguagucccagcuacucaggagccugaggcacuagaaucacuggaacccggcagguggagguuccagugagccgagaucacaccacuguacucuagcaugggcaaucgagcaagacucugccaaaaaaaaaaaaaaaaaagaauuaauuuuaguucauaucgauuuuggauaaauggacaggcacauaggaaaugaucauguaggacaggaaauaaguaucagcaaaggccugaaaauuggaacugaugaaagggcaucagagggauaaaauguuugucauucuguguuagagauaguuacccauucagcuaacaaguauauuuuaauugcucauuugccaagcagugugauaggcuauaugaaaacaaauuguaagagagauagaggaggaggcuuacacaucaauggaggauaaauaugccuugcuuccgaaaauacaauguagugcaagaauugcucgaaugguagcauguauagaaaacaguaggagcguggaugaagagcccauaagccuaccuucggugucaagaugauuucacagauuagggugagcucugaaggugagaaguuugucagauggacaaccagagggaaugguaguugcaggaugguaggugcagauaugagaauuucucacuggaguguaaacuuugaagcuaaaaggaggcaaauggcagaaggugaggcuauacagugcuugcuuaauaucagucagggacacucaaacucauccacauuaaaagcuguauagaagaaagguagaaagaacaucaguguugggagacagccucuagaaauggagugcagugcugagugcuuggucacauauuccuuccaggcaaugccccuucagguagagaugauguaauauguguuccccuccauguuccccucagggagcacaucaaggguucucagacucagcacugucgacauuuggggcuggauaguucuuugcugucgggggauuguccuaugcauuguaggaucuucaguagcauccuugcccuugacccacuagaugccaauagcacucucaucaguuguaacaaccuaaaaugucuccagacauugccaagcgucccuugggggaugagagugaaauccuucuugguagagaaccauugccuuaccucagauuuaaugccuaguucaaguaguugucccucaauaauuucucuugggucuaugccauuagcugguuucugccaccccaguaaagaccuuccucacuguaguuuauugcaugcuuuccuaaaguauuuugugucucuuuacucuugcacuguaggaugauuaaccaucagaaagcuuagcuguucuaucacucugcccauaugugcagugggcucccauucucuacccuguaauuccaaacuuguacaaguaaccaaagcuuuuuagcaccuggccccaaccucucugucuuaaccucauuucucugcuuuuuguauucucuucuauagccaaauuggaccaccaauuuggaggcucacuaaaugcuccuggccuccaguuugcucauccacuugcucuuuguuuacauugacuguaugagcaaagccagccauucucauucccagcuuccuugugcaauugauuuuuccagcucaaauggcacauuuucagugaaggcaugcuuccucagcucuucucccuuuuuuacuccaaaucaucuaauaauaacacuuguucgugucuuauuuuccaguccuuugucuauaaauaagagguguaucuuucuucuuuauauuccucauaucuccaaacaccuugucuuacacaaaauaaguaguauuugaaugaguguaaguuaucuugaagcagaauugucagaaacugugaaacuuuguugucccaugguaaaaauacuuuucugagaggugaauauugauacuguauaaccuugaagacuuaccuucguuuuuuucucucuagccugcguaucagaaucugagacagcguguugacaacuuuguugcaaaucacuuggcaacucacacauggaguccgcaucucaauaagaaccagcuaagaaacaacauuagacaacaaguccucaaguaagucucagagauagaguucugggcagguuuuaaauguccuaaccuacuuugccugaaagcggaggcauuacauacauauuuguucaccuaaugauguugacaauuuuacuggauuugguguggcuauuucgugugauguagcauaauuuuggauuugggucuaaucacuucacauguucuuauacauuuuaacagucugauuguuccuauagaccuuuggaaauauuugaaggaaggaaauaacaguaugacuuucuaaaaaaucuagauauaauauuaauagaugauauauacaguugccuucacaacuauuuucuugacccuaagagagcaagcaggcuuuauuauucuuauuuuacaaauaaagacauuaaagauuacugaaauuaaaauauucucucuugauuugaggccacgucuucuuuuaauacagugcccccgucuuuugcauuuuacuaugacuuuuaacugcuguuuaugaaugauauagcuccccaccuccccucaaaguguuuggacuugucagagccauuuugagugaacauaagguaaugacaauuauaagaacucgaauauuuggagcauccuuaggaaacuagauuuacggucuucuacuuuuuuuuuuuuuuuuuuuaaagagucucauucuguuccccaggcaggagugcaguggcauaaucauagccugcugcagccucaaucuccugggcucaagcagaccucccaacgucauccuccugagcaccugccaccaugcccagcuuaucguuguauuuuuuuguagagacagggucucauuauguugcccagacuggucuccaaauccuaggcucaagggaucuucccuccuuggcuucugaaagugcugggauuauaggcaugggccaccucaccuggccacuacuuguucuugaauguaaauauuugcaaagacaagaaagccuucuacccuugcuauaccccucaaaaaaagggugacuaaguuauuuagagaucauccagucucccugacuugacaaguauuuauguucaaguacaucuuugagaaugaaguguagcuuuuuuuuuuuuuaacaguuaaacaaaucuguuuuauaccugccaccucuuaauuuccuuuugucccauaggaaccucucgaaagccuaucuagucugauaguuucaaccaacaggaagccccacaaaucaaaauucacacccugacuaaaagacaaaccuauuuagccacagguaauacuagaaaccagaagccugggggcucagacagugucuccuugugcauaagagaagagggaaauucacaauagcuuuguugucuacauuuuaaaggaugucugaggaaccuguaaaagaguccaggugagaucaaaagaugccauuagaaggcugcauaauaauaccuggugggaaaaggucaaagcuguuucuagaaaaaguagaaacaaaaaagaucuguugggugacaggcccgcugccuguaguuuccacaaaggcuuucaaagagaacaaugaccaaaauagcuuaggacuaggggauaagggaguggagguaggguagagcaccccuucacacacauuuauacagagcccuacugauuacuuucauucagugauuugcauagccaccucccuguucacaaaugauugcauugcuuuaaaagcauguuuuuuugggagucuggcauuuuuuuucuucauauauugacacucagauugaaggcaaacuucuuagaauugcauuuacuuuuauagcguauaaaaucuauaagguaagggagcagucauucuuuuauuuaagggaacuaagucuuacacaugugaaaauuaagcacuuaaaauuauugcuguaccaguaagauauugugaucacaaaaucauguuuggugcgaggucagggguucuuguggcugugucagugauuaaaugcuggagcaauuugccuaugaguaaugaggaaucucuuuuucuggagacauuuugaaagagggaagacagcugccuucucuuggaugauacugauaauaacauuuuaaagcuuccuuaaagagauuauuuaguuauguucaaucugaagguauagggguggacuagccccuguaaauaaauauaauuucaaacaguuuuuuguacguaugcuuugagacauacucacuugacuccauuagguugagcuaucugcacuugccauuuuuguaagacaaaaauggucuaauaccaguaauuucagaugguucaacuuaauagcugaucugcugacucaguaggagggaaaauuuuauucuacuuaagcuuuuauuuguacaacagaaucugaaaauccuagguaacugaauaacgaacuuagcuaaacauaauuugaaaggaagacaaggaaguaacuuuaaccagaaaaacgccagcuguuggcauuuuggcuuugccguugaccuagggcuguagcuucuccccacuugggugaggcaguuauggccgcuaagugcaguaugaucauugguacuggacuccauuuuucuguaagauuagagcugaccucugugugagaaaggacuaaagcagaaguguuuuguuuguuugcaaaacaagaggcuggaacauaggcaaacagagaaagagacugaagcaaaaauuugggaguggauaguuuaauuuuuuuuugguacuuuuuuuucuauuuucuauuuuuuuuuuuuuuuuugagacggaguucgcucugucgccaggguggagugcaguggugccaucucagcucacugcaaucucugccuccuggauuccagcaauucuccugccucagccucccaaguagcugggauuacaggcacgugccaccacacccagcuaauuuuuguauuuuuaggagagaugagguuucaccauguuggccaggauggucucgaucuccugaccuugugaucugcccgccuuggccucccagagugcugggauuacaggcgugagccaccaugcccgguccuuuuuguaccuuuuuacuuguacccuaaaaccuuuuuuaagauugcuuuuucuuauuucuuuucuaccuacuacauuuuaaauacaccucuaagauguaacaguguuugcaagauuugcauuuuuuuuuaaucuuuaaaaagcagguaaccuacuuugugcugaguuggcucauuuuucucuauggcccacauaaguagaauuauaguuucacaaggcgacaaggugcuuccagaaaugaaaaacuaauccauccugcacuccagauggaagugcacucaaaaauagcauuuguaaaguguaaggaaagauggcuccucauccauuccauagagagcaguugaggcuuagaagcuaaaaaugacgagcacuuugaucuuccagcacuauccugacuaccuugacuccuccacuucuuuuuuaggaagaaacaagauuuaaguguguuucuuaaaauaaauucacguucucuuauuuuacucagaugccuuugugcagaagcacauuucacagauuguuguccucaucgcucuuuugucucuuguauaugauauuuccuuaacuccaugugucuuucuuccccuucucuucuguagaaaugaagacuuggcucaaaugucuucuccuuuaugaagcacuccuaaauuaucuucgacauaucuaauaauuucuuauuccucuaauaagcaaauaauuucuuacuccucucuuuuccuauaguacauguuguguacuagugccugucaucucaugucuugauuguuugugucuacauccccauccagaacagggaccaggucaauuuguagcugucaguggccagcauagugccuguuauauagaagacacuuauaacguaauuguugaaugaauaaaucauccaguuuuuacagcgggaagauaauagaaagccagaagucuuguuucuccaaauuuuuuucucuaaaguuuuccuucuuugauuuugcaauuugaugaaaucauauuuuguauguguuguuuuuuuucuggggacucuaaugcuuauaaaaagcuuacauuuuuucuguuaaaaaaaguuguagagaccauagguuuauuuuauacccagaacucagcuuuuuaaugagcauauuccuauaugccaugagcagaguaggggugagauaagcaucaccucuauacuggacccuaggcaguguacugugucuaguucuaaggguguuuuguuuugucuguuucaguauuuccacuagugacacagugguagaaaaguuuacagacuuguauaguaugguauaucuaaaugcuacuguagcaugaaacuuaguuuccauugucuauauccaaguaaauggauugggacaauuuaagguuggauggauggauagauagaugacagauuguagaguguuauuuuaaaguaauuaaugcaaauaauauauuauuuuuucaccuuuccauaaauuaucuuguguuucagaucaggaauguuggagucugguauugaccgaauuauuucucagguuguggacccaaagaucaaccacacauucagaccucagguagagaaagcugugcaugaguuuuuggccacgcuaaaucacaaagaggaaggaaguggcaacacagcucccgaugaugagaaaccagacacuucccuuauuacacaaggugcuuugcuuuuacucuuggucaguuccauuguuuuucuucuugaacugaauaucaaguuagggauacuuggcucuuuaacacauuuuuuaauuuggcuauuccaaugaaauuguacuuuaaauaucaccuaaauuccucaauugccauaacauuucguuuucuagauuaauaaaaauaauaagcauuguaguaaugugaugugagugugaguaugauaauagaaggaauaacuaaaauaauuagagaauauagucuuuuucuaggaaguagacaacuccucagauuugcauggugcccucgcuaagauaauauauuagagagguagauaauucagaauaugguauauacuaguacugguaccugaaagucuaaaagaauauacagauggucugcacagcauaugcaucauauaaagaugacaauggcaugugguauugauuuagcagagguauuuuccuucugauuaaauguauucuaaaacuucuguuuuucuuuaagguguuccuacuccugggcccagugcuaauguagccaaugaugccaugucgauauuggaaaccauaacuucucuuaaccaagaagccagugcugcuagggcuucaacagaaacaucaaaugccaagaccagugagagagcgucaaaaaaacuuccaucucagccaaccacugauacuaguacugacaaagaaagaacuucagaggacauggcugauaaagaaaaaucuacagcugacucuggaggugaaggacuggaaacagccccaaagucugaagaguucagcgaccuccccuguccagucgaagaaauuaaaaauuacacaaaagagcauaauaauuuaauucugcuaaauaaggauguucaacaggaaagcagugagcaaaaaaauaaaucaacagacaaaggugaaaagaagccagacagcaaugagaaaggagaaagaaagaaagaaaagaaggaaaagacugaaaagaaauuugaucacucaaaaaagagugaagauacacagaaaguuaaagaugaaaaacaagcaaaggaaaaagaaguagagaguuuaaaacuuccuucagaaaagaacaguaauaaagcuaaaacuguugaagggacaaaagaagguauauaaaaacuugcaaacaucuacaaaguuuaaagaacagaguguuuugggaucagggaaguaucaaauuugccuucauauuuuaauaaguuuauuuaauacuuuuggaaacuuauauccccuuugcuuaagaaaaaaagcaauaaauauuuguauuuuuguguacucauauaucuguucacagaguaaauuaacagaaguuauuaauuuauaauuugucuuauaauuuauucacauacauuauuuuaagcaacuuaguucauaguuggauauccuaauuuuuauuagguaguaaauacuucaguuacuuaaaauucauuuuauuauuauaucauacauuauaaauuaauaguuuaguuauuuuuacagaagucuacuuugccuuuguauuuucuggaaaccacucugccuuguuugauaguuugacacguauuuaaagcagaaaauuuuaaguguaauuuaguaauugagcucugaguauguucuuauaauaagaugauuuuuuuuucuguguuuuauuuuccgcuugaagauuucucuuugauagauucugauguggauggacuuacagacaucacaguuagcucuguucauaccagugaccuuucaucuuuugaagaagauacugaggaggaaguuguaacgucugauagcauggaagaaggagagauuacgucagaugguaaagcauuuuacauaauaaugccucugaagcauccugucaagcauuauuuguauauucugauggcuauauccugagaaacagugugguauaguagcaagagcaugggauuuuguaguuggaagauuuguuucugagucccagcuccaaaguugucugucugagcaagcuugguaaguuacuaaaucucaacaacccuugguucuucauuccuuaacucuauccccuaguauuauuauuaauuuaaaauuuagaggagauaaauauaugaagaugcuuuuuauuugugugugucacauuuggggacagcguaguccacaacacugcccucaauuaauggcaccaguugcaaguuccggguucccuaagaccaccguuagauuugauaauuugcuaaaagggcucauagaacuuaccgaaaggugguauacucacagcuaugguuguuuacaguuaaggugcucagauuaaaaucagccaagggaagaggcacacagggcagaguccaggaaaguuucagacaguuacuuccaauuguucccccuugaauuacuuccucugcauugaugucugacaacauaugcagaauauugccaaccagggaaguucaccagagccuugggauccaaaguucuuaaccgaggcucuagcauguagucagaguuggcugcccauauggcugaucucagucucuacccccucuagaggucaaacucuuacuccaugacccaacacuccgacccuaaaucacaucguuagacuguuuagcuugacucaagagccuucgcacucugaaacacuccagucaggcauagcauuccagaggcuuagagauuaccucccagaagcuaaugguaaaggccagaccucucugggcaaggcugaauucuuuauaauacaguuuguuuuucagaaaaccccuccugagcacuuccugucuuccaggcacugugcuaaggacauucauguaauaacuccuauaguccucagaaccaccccaggaaguagguacaggcaaggagacaaagucacagagagaccaugucuuguccagucauguagcuagugagcaccagugcagauuucaaacccgagucugugcuucuuaccaauaucuuauguugcucuuaccacaugauuaaauucuguuuaggacuauuaguuuaggaguaauaaaaauauugaguuuuauuugcaacugccuguagagagcaucuuauaaauuuguugccagcuuucggauaggcuaccuagagagaaaaucauagaggagaaaaaguauaagcuuuuaacaccauagagguauuucucaaugccucccauuuuuuuuucuucaauuucacaaacuaaaaaaagcagcagcaguaauuccuaauugucauaucuguccucaugaggucagcucugcauuaccuguguaggaagagugcucccuauucugugaacacuccacuuucucugcccuaacuaaaauuaauucuuguugccuuuuugggucuucuuaaguuuuuuccugguaagacuagauuuuauauguaugggauuuaaaaagugagaagaagauggcuauuuuaagaguacaugguaggaagugaaaaccuuguuuacuuuuuuuuucuucuugcugugucaaagcaaagcaaauuaccuuccaguuauuaauucccaccucuucccuaaaugagaaauucagagguggucauuaaaaucucaaguuuauuuuaaacuacaacuuccaguggauuuguugaacuuaacaaugguaaagcauaaauaucaaguccagugacaaauaagaauuguuugucaagagaacucugaggcgcagauggaggcuguuaggcugagagauagcuccagugccuuggguuccuacaaaggcaaacugaagcccagucuaaauaguaaaacagaauuuaaacuuagcucaucagaaaccuccaauuaaccucuaacuagggacuuuccaccagaucauauucaaauaaggcaaacaucuggcugcagccaguccagucaugugucuccucugcuuuuguguucagccugugaaagcacacugcugguguugcgaagcagagcucucagaaccucuccugguuccaacgccugagucaugaaucauucuuugcuccagaaaacucuguuacauuuaauuugucugaaauuuuccuuuuaauagcauaaguaacuauaaugucuaauuuuucuuugucuuauuuaugugugagaagcugauaagaaauaaaaauaugaauuauagcuuuuaaaagucaauuucugaaaucuucacauccugauauuuccccuuuuggaccuccaauucaucuugccuuuacugcuuguacagcauaauguugauuuuaugcuaauucacagacauacuccucuuucuauuaacuuucuuacagaugaagagaagaacaaacagaauaaaacaaaaacucaaacuagugauucuagugaaggaaaaacaaaaaguguacggcaugcguauguccacaaaccauaucuuuacucaaaauacuauagugauucugaugaugagcuuacuguagaacaacgacgacaguccauuguaaguccaguuuguucuguuauuuuaaccuacuacaucagguuaacaaacuuaaauagucuaucugcaagguacugaugugcauaugaagcagagacauacaggauuugccuucaggaaacuugucauuuaacuagguagaguagauguaaacaugugacagagauguuugugucaucauuacuaauacaagugaauaucccuuauccgaaaugggugggaccagagguguuucaaauuuuggaauuuuucacaauuuggaauauucgcauauacauagugacaaaucuuagggauggaaugcaagucuaaacaugaaauuccuuuguguuucuuauauguauaugcacauagccugaagaguauucgauacaauguuuuucauaauuuggugcaugaaacaaaguuuugacugcauuuugacugccaccugucacaugaagucagguguggaacuuuccacuugugacagcaugucagugcucaaagaguuaagauuuucagaugagggaugcucaaccuguaguagugaaacugguaacaaccugagugcuucacaguauggaaauguuuaaaucaaguguagauccaguccugcaaaaauacaguaugcagcuauuaacauacuauugauauggaaaugcuauuuaccuauuucuuggauucaaaaauauuuccaauuauaaaauguaccacugaauuaauaacagcuuuuuaaagaaaauuacuaccuuauuguuacauauguauauugguuuuaagauagcuuacaauuucagaaacauuaaaauaugaaaaguuguaaaauaugaaaaguucagaaucaggaaauauugucacauaggaaaaugauuugaagaaacuaccccaaaaugcuaguagugauuagccuucccuucaggcuuaucuuuugaaaacauuacuugguuagaaguuaugcaccugcuuaggauuuuuggcacucugagccagaaagagauaguaggaauagcacaaugacugugaauucuuucugcuguaaaagaccugcaaguccugagucccuugggucccaagcauauaaccagcaagucauauauguuguagaacuagccuaucacuugaauuuuuauuucaacuguuuucuauaagaacaguugaaaaguuauaaacaccuaccuauauauacuugauguucauagauauuuucacagcuaucauuuuaauugaaacaaccagcuuauuuaaucacuuuuccccaaaauuauaccuuucccuuucuuuaauggcauucuuaaagaguaauggcaaauuuucacaucuguuucuucuauucugguagcuucuagauugaaacauacacauacauauguauguauacacacagagauaaauguguguauauauauguaguguaugugcauuuuuucagagcccguuaauuuguaagaacaucugaaggguaaacuaaaacuuuaaaaaaaauacaauuuuucaguguguuuuugccuuugccuaauaaucuguuaggguauuuugugguuuuaggccaaagaaaaagaagagaggcuuuuaagaaggcaaaucaauagagaaaaacuugaagaaaaacgaaaacagaaagcagaaaagacaaagucuucaaaaaccaagggucaagguauagaugucaacuuuuaauauuuuaaacuaucucauauauuucauuauuuucuggguacucuuauauuacuuaugagacaugaauauaaaauaaaaugaucuagucucaaauguggaagauuuccuuacguuuuaaucucauguguuucaucauuuuucuuuuuuauuaaauugcuaaaucuaaauuaaacauuuuaccagaaaccagcuuaugcaacucauuuguuagcaguauauuuuucuguaaugauugaaucacuggaaaguagauuguuaacacaugaguuaucaacccuugcuggugauuaaugaaauuaaucuaugcuuauguuaacuaaaaugucaaacauuucccuguaauauuguguugaacaaaauuguauucccucugggcacuaauccuauguaauauaugaaaucacacauacacacacuuaugugaucauuugaaauaagagagauaagacuucuucauccaaaauauuauaucuauuccagcacaacuuaagaauauuaaagccauuuuggcuuuaacaaugauuagaaaaaucuuaaugaaaaauuaauauuacauuguuuguaaaacuuuucugaaauacguuuuauugauugcuucuuuucuaggcaggaguaguguggacuuagaagaaucaucaacaaagaguuuggaaccuaaagccgccagaauuaaagaaguccuuaaagaacggaaaguuuuagaaaaaaaaguagccuuaagcaaaaagagaaaaaaagauucaagguacauauuuuaucuggucauguuucccuuauaacacuccccugggugcuuucagaagagaggaauugaagugacaguaaagaguuguacuuugguuguguauguuacugcauguuuaugaaggaccuuaggguuucauauuuaguaucaaaauguuaauaucuauaacauuucuaaguaguguauccuaaucuuuuugggcgucccagaucuuuuugauaauuuggugagagcuuuagacccucuccccugaaaaauguacaugcauaagcuaacaauuaucccuagacuuuaagaguuuaugaauccucuagaaguucccuggagguauuccucuuguugguguucaguaaccacuuauuuucaauuauuauuuccagucuuuccaugccguuauuuuuaccaguauuccaugauucucccccaacccagaaucugggccagauuccuuauuaacccugcauuaucaucguuaacuuuuuaagaauuagaaagcuaaagagacucuugaggguagcuaugaagucaugugagccaugggcugcaauuuugcuauuccaucaaguugcauuuauguaaauuuaucacagacuucaggauaacugauuugauaauuugcagaacuugguaagaguaguaagcucucaaauuucuuacuauuauuaccucucauccuuauugaucugaauaaauaagacugcccucuuuacucaaaagauaguaauuuugaaguguaauuauagcccauaaagcauucaucuuuaagcaacaaauuaggaauuuuuguuucagcuguacuuuccuuuagcaccaagaacaguuaaugcuauguuugggauugugcucuccuuuguugaccaauaauugauaggauuuaaauugaaauguaacaagucugcauuugucgaucaaguguauaaauuauaguaaacagcugggcgcgguggcucacgccuuuaaucccagcacuucgggaggcagaggcggguggaacacaugaggucaggaguuugagaccagccugaccaacauggugaaacccugucucuacuaaaaauacaaaauuagccaggcauuguggcguaugccuguaaucccagcuacuugggaggcugaggcaggagaauuacuugaacucaggagcggagauugcaguaagccaagauugcgugauugcacuccagccugggcaacaagagcaagacuccaccucaaaaaauaauaauaauaaaauaagauaaauaaaaauuauaguaaaggaaagauuuuuauuguuuucaaccuuccugaaaaauuuucguauuugauucaugcuuuauauuugacucuuucccccuuaggaauguugaagagaacuccaaaaagaaacagcaauaugaagaagauuccaaagaaacccuuaaaacaagugagguaugccuuaauaaaaccucauuucaaaugcuguuuuguuagauauaggcuguuuauuccuuuggaguaaaacuuagaauguaauuugacuuuuuucaagucaaauaaaaagucaacuuacauucagcauuuuugaaaccccauuuuguuaugucccaaauugcccauuuuguugaguugauuuauauauuugucguuuaucuagguaauagcuacucuucuucucuuuucccauuucuuauaauugcaauaacaaaaaugccaguaaugacaaaaaaagaaaaagggaggcuaaaauuaaaaucuaaaaucccuccacuauaacaaauuauccuuuuuauucccucucauuccuuauccacggguccacauaauuuuuuagaguacaaguaaucuggcaaacuguuuuuaacauuuuacucauuucauguuaccuucuaggcauccuaauuauuuaaugauugucuaguguuacauauaauguacauaccauaauuuauuuaagcauguccuuauauuuuagcgcuuagguuguuuccaagauuugaucauuuuaaacaguaaaaguaacguacaauguuuucuucccccuuucaggauuauuuucgugggacaaacuuuugcuuucacuguuuuaaaauucuuuuuuacaaaaaccacauuaucuguaguucuguagcuaaacuaucuuaauauuuccagagggaaaaagcaauguuagugauuauuuguucaucaucagcaaacauaaauuuaauuuauuuacucagaaauuaaaggcguauuuagaaguauauagugauggcuuaaugacauauuuuuaaauauuuaacuuucuuuuaugauaauucucuauaagaaauuaucucauaaaauaguauucacauugcuuagaauuaguuuuuuauugugaaguugaugcaaacuccuguuaguucuuugaggaauuuuauuuuaagcuauuuaauaaggucuuguuauguccuggacccuguuauuaguagaaguacauuaaucuuuguguugacauuuaaggagaugaaguguuaaacugaccuagaggcacaaagguccgucugaacuuuggcccauuauuugcauaagaauaauuauagcuaguagucagugaguauuauugaaguggauuuagucaaccuccacucauuaauauuaaucgccuacuuagugccaaaccacagggccagaaggaagguuuagaugcucuugucucuccguaucuuuuuuugaauacauaaacauauacauauguuauauaugauaugguuacugugcguuauuguguacauuugaagcuucauguguagaauauuguacaaguagccuaaauucaugagguuuccauacauaauucagcuuuuuaaauuaaaauauaggaaaucuauauuucaguauauuucaauuuuaaauugccuucauguauuauguuuuugacugaaaaggacauuugacugucauuuauucagcucauauuuauuauugaguacugggcauuagugaguucuagugauucagaauugaagaauucauagacaaaucagugccugugauauacuggaaggaguacuagacucggaaugaaauaaucuaaacucauuccuaacacaccuacuuguggucugagugucaaguuauagaaucaugcugagcuacaauuuccugauguuuuaauggcauauuuuuaaguauuuaacuuuauuuugugauaaaucucuaugagaaauaaucucauaaaauuguucauauuguuuagaauuaguuuuuuuauuguaaaauaugguuguugcaaacuccuguuaguucuuugaagaauuuagcuucuuaaaaucaaguuaauaauacuuauuuuuuaaaaucaggugaguuuuugacaccuacacaggcuguuuguaagaauuaagugagauguuacauaugugacagcacucaacauauuaaauccacccaaauguuauguuuuaaucuaaaaauugauuuugguauuucucauauuuuaaccuuuguuuucuuucagcauugugaaaaggaaaaaauuucuucuucaaaggagcugaagcauguucaugcaaaaagugaaccaaguaaaccugcccggagacuuucagagucuuugcauguaguugacgaaaacaaaaaugaauccaaauuagaaagagaacauaaaagacggacaucuaccccuguuaucauggaggggguacaggaagagacugacacaagagauguaaaaaggcaaguagaacgcucagaaauuugcaccgaagagccccagaaacagaaaagcacacuuaaaaacgaaaagcaucuaaagaaagaugauucugaaacaccacauuugaaaagccuacuuaagaaagaggugaaauccuccaaggagaagccugaaagagagaaaacuccaucggaagacaaauugucugugaaacauaaauauaaaggugauuguaugcauaaaacaggugaugagacugagcuucacucuucugagaaagguuuaaaaguagaggaaaauauucaaaagcaaagucaacaaacaaagcuuucuucagaugauaaaaccgaacgaaaaaguaaacauaggaaugaaaggaaauuaucaguauuaggcaaagauggaaagccaguuucugaauauauuauaaaaacagaugagaauguucguaaagaaaacaacaaaaaagagagacgcuugucagcugaaaaaacuaaggcagagcacaaaucaagaaggucaagugauucuaaaauucagaaagauucucuggguuccaagcaacaugguaucacauuacagagaagaagugaaaguuauucggaagauaagugugauauggacuccacuaacauggauaguaauuugaaaccagaagagguuguucacaaggagaaacgacgaacaaagagcuuguuagaagagaaacuuguguugaagucuaaaucaaaaacucaaggcaaacagguaaaaguuguagaaacagaauuacaagaaggugccacaaaacaggcaaccacuccaaaaccagacaaggagaagaacacagaagaaaaugacucagaaaaacagcguaagucuaaaguugaagacaaaccuuuugaagaaacugguguugaaccuguauuagagacugcuucuucuucagcacauaguacacagaaggauucuagucauagagccaaguuaccauuagcaaaggagaaauauaagagugauaaagacuccacuuccaccaggcuugagagaaaguugucagauggccacaaaagcagaagcuuaaagcauaguaguaaagacauaaaaaagaaggacgaaaauaaaucagaugacaaggaugguaaagaaguugacaguagucaugaaaaggccagagguaauaguucacucauggaaaagaaauuaaguagaagguugugcgaaaaucggagaggaagcuugucacaagaaauggccaaaggagaagaaaaauuagcagcaaacacuuugagcacucccagcgguuccucccuucagagaccaaaaaagaguggugauaugacauugaucccugaacaagagccaauggaaauugauucugagccagguguugaaaauguguuugaaguaucuaaaacccaagacaaccgcaauaauaauucucagcaagacauugacucugaaaauaugaaacaaaaaacuucugccacuguucaaaaggaugaauugagaacuugcacagcagauucaaaagcaacagcuccagcuuauaagccaggccguggaacaggaguuaauaguaauucugaaaagcaugccgaucauagaagcaccuugaccaagaaaaugcauauacaaagugcuguguccaaaaugaacccuggggagaaagaacccauucauagaggaacuacugaagugaauauagauucugaaacuguucauagaauguuacugagugccccaucagaaaaugauaggguacagaagaauuugaaaaacacagcugcugaagaacauguugcucaaggagaugccacucuugaacauuccacaaauuuagacuccucaccauccuuaaguucagugacuguugugccucugagggaaucguaugauccagauguaauuccucuguuugacaaaagaacuguuuuggaagguagcacagccagcaccuccccugcggaucacucugcucucccuaaccaaagucugacuguuagggaaucagaaguccuuaagacaagugacagcaaagaagguggugaagguuucacaguagauacaccagcaaaagcaagcaucacuagcaaaagacacauuccagaagcucaccaggcuacuuuauuggaugguaaacaaggaaagguaaucaugccucuuggaaguaaguuaacgggcgugauuguggaaaaugagaauauuaccaaagaagguggcuuaguggacauggccaagaaagaaaaugacuuaaaugcagagcccaauuuaaagcagacaauuaaagcaacaguagagaauggcaagaaggauggcauugcuguugaucauguuguaggccugaauacagaaaaauaugcugaaacugucaaacuuaagcauaaaagaagcccagguaaaguaaaagacauaucaauugauguugaaagaaggaaugaaaacagugagguagacaccagugcuggaaguggcucugcacccucuguuuuacaccaaaggaacggacaaacugaggauguggcaacugggccuaggagagcagaaaagacuucuguugccacuaguacugaagggaaggacaaagaugucaccuuaaguccagugaaggcugggccugccacaaccacuucuucagaaacaagacaaagugagguggcuuugccuugcaccagcauugaggcagaugaaggccucauaauaggaacacauuccagaaauaauccucuucauguuggugcagaagccagugaaugcacuguuuuugcugcagcugaagaagguggggcuguugucacagagggauuugcugaaagugaaaccuuccucacaagcacuaaggaaggggaaaguggggagugugcuguggcugaaucugaggacagagcagcagaccuacuggcugugcaugcaguuaaaaucgaagccaauguaaauagcguugugacagaggaaaaggaugaugcuguaaccagugcaggcucugaagaaaaaugugaugguucuuuaaguagagacucagaaauaguugaaggaacuauuacuuuuauuagugaaguugaaagugauggagcaguuacaagugcuggaacagagauaagagcaggaucuauaagcagugaagagguggauggcucccagggaaauaugaugagaaugggucccaaaaaagaaacagagggcacugugacauguacaggagcagaaggcagaagugauaacuuugugaucugcucaguaacuggagcagggccccgggaggaacgcaugguuacaggugcagguguuguccugggagauaaugaugcaccaccaggaacaagugccagccaagaaggagaugguucugugaaugaugguacagaaggugagagugcagucaccagcacggggauaacagaagauggagaggggccagcaaguugcacagguucagaagauagcagcgaaggcuuugcuauaaguucugaaucggaagaaaauggagagagugcaauggacagcacaguggccaaagaaggcacuaauguaccauuaguugcugcugguccuugugaugaugaaggcauugugacuagcacaggcgcaaaagaggaagacgaggaaggggaggauguugugacuaguacuggaagaggaaaugaaauugggcaugcuucaacuuguacaggguuaggagaagaaagugaaggggucuugauuugugaaagugcagaaggggacagucagauugguacugugguagagcauguggaagcugaggcuggagcugccaucaugaaugcaaaugaaaauaauguugacagcaugaguggcacagagaaaggaaguaaagacacagauaucugcuccagugcaaaagggauuguagaaagcagugugaccagugcagucucaggaaaggaugaagugacaccaguuccaggagguugugaggguccuaugacuagugcugcaucugaucaaagugacagucagcucgaaaaaguugaagauaccacuauuuccacuggccuggucggggguaguuacgauguucuuguaucuggugaagucccagaaugugaaguugcucacacaucaccaagugaaaaagaagaugaggacaucaucaccucuguagaaaaugaagagugugauggucucauggcaacuacagccaguggugauauuaccaaccagaauagcuuagcaggggguaaaaaucaaggcaaaguuuugauuauuuccaccaguaccacaaaugauuacaccccucagguaagcgcaauuacagauguggaaggaggucucucagaugcucugagaacugaagaaaauauggaagguaccagaguaaccacagaagaauuugaggcccccaugcccagugcagucucaggagaugacagccaacucacugccagcagaagugaagagaaagaugagugugccaugauuuccacaagcauaggggaagaauucgaauugccuaucuccagugcaacaaccaucaagugugcugaaagucuucagccgguugcugcagcaguggaagaaagggcuacagguccagucuugauaagcaccgccgacuuugaggggccuaugcccagugcgcccccagaagcugaaaguccucuugccucaaccagcaaggaggagaaggaugaaugugcucucauuuccacuagcauagcagaagaaugugaggcuucuguuuccgguguaguuguugaaagugaaaaugagcgagcuggcacagucauggaagaaaaagacgggaguggcaucaucucuacgagcucgguggaagacugugagggcccaguguccagugcugucccucaagaggaaggcgaccccucagucacaccagcggaagagaugggugacaccgccaugauuuccacaagcaccucugaagggugugaagcagucaugauuggugcuguccuccaggaugaagaucggcucaccaucacaagaguagaagacuugagcgaugcugccaucaucuccaccagcacagcagaauguaugccaauuuccgccagcauugacagacaugaagagaaucagcugacugcagacaacccagaagggaacggugaccugucagccacagaagugagcaagcacaagguccccaugcccagccuaauugcugagaauaacugucgguguccugggccagucaggggaggcaaagaaccgggucccguguuggcagugagcaccgaggaggggcacaacgggccaucaguccacaagcccucugcagggcaaggccauccaagugcuguuugugcggaaaaagaagagaagcauggcaaggagugccccgaaauaggaccauuugcaggaagaggacagaaagagagcacuuuacaccucauaaaugcagaagagaagaauguauuguugaacucccuucagaaagaagauaagagcccagagacagggacagcagggggcaguagcacagcaaguuauucagcaggaaggggcuuagaggggaaugcuaacucaccugcccaccugagaggaccagaacagacgucugggcagacggcuaaggaucccucugucagcauucgcuauuuggcagcaguaaacaccggugcuauaaaagcugaugacaugccaccuguucaagggaccguggcugagcauuccuuucuuccugcugagcagcaggggucugaagacaacuugaaaaccaguaccaccaaauguauuacuggccaagaaucaaaaauugcuccuucccacacaaugaucccuccagcuacuuacaguguagcucuguuggcuccuaaaugugagcaggacuugacuauaaagaaugauuauaguggcaaauggacugaucaagcaucugcugagaaaacaggagaugauaacagcacaaggaaaucauucccugaggaaggagacauaaugguuacugugucuucugaagaaaaugugugugacauaggugagaaucuguaccuaauugcaaauuuuaauauuuacaaggaugauuguacaacagagugcauuuaggacagucuuccaaaagaugguuuugguuccagaaagauaaaauaucuauaaauuuuuuucucauaucauaauguugcaaaauaacucucaucaaacuugaaggucaaacuucucuaaaagcuacuuguguuuaaaaguuuaaagccuuuggcccauuucucauguguggggagagaaaaagcaggaggcugaggcaugggaaguccacauguuauuuacaugacugcugcaacuuacuaaaccuuuuugaccuacagguuuuuugucaaucaaaaagaagaauacccuaccacaacccaaugaaagcaauacauuuuuuuuuuaccacccucauuuuacaaacgaggaaauagggucagaaaauuuaaauagcauucaugguccucgggugacuuuuagaggaaaaaucaguuucugagccuccauuucuuguuguauaaaauggggauaauaagacgggaugauaauacaaaggcaaacacgauuccaacccucaucugaucauagguuugcaguauuuguuuguucagucuguuaguuccuuugaaucaaaggagcauguuauuuuuaacugagcuuauuuuucaggugaaaugaguuucuaguuuagaauauauuugaaagugaaaagaaacauuuuucccugcugacagauuuuggacagugcuggucuuuuagaaauaguuaauaacuuucaaagauauuaucucagucaugccuuauaccguccaacuucagauacuuuauaccaguccagauuggagaaaaguggacagugacacuuuaaagcaugacaauugcauagacugggauuaagcacaggaugcuguaggaacaaaaggguccucaugggcuggacuugaagggacagaggaauucuuuuccacucuggcuauauaaauuguagcauccuggacuuuuaacugaaauagaccuuagccaucaucuaacccagucucaggaagcugaggcuaauagauuuagucuuguucauuauagagacuuaggagacuuuaagaaaugcuccaaggguugaaacaaguaacuuuacaaguuucuguugaauuuagccuggaguaaauugaaugcuccagaaguuuuuaugacucaaucauugcuacaauuacucauuccuccuuuuuuccugaagaagugaaaauagaaggguuuccacagaagcuucuacacaaucuaaagaaggauauaagaggcaagaccagaguagaacugaaucucugcaccugagaaaauuuuuucuuuuugucuaccucacaguuuaacuuuguguucaauuuuucuguguucagugugaagcaaguaaagugaaucuguuaauaaaucaccuuuacugagaauagaccuuagugacucagaauauuuuuaaggacaaacuugauggagaucacugcagaaaaauacuuggaaaugaagaugucuccacagauaauacuuuugucauucuuucugggcaguuaucuuacugugcaaauaagaauuucacucacccaaaaugagcaaauaaucccugccuuucauccagauucuuuuauacaacauauuccuuuugaucauuuucuacugacagcaaaauaaaccagaaaaggaaggugcaacagcaugucagauaaccacauuccauuacuuuuugaccccagauguauuuugcaagcaaauucuuaaacuguacuaaauggcuugaauuuuauuaggcaaugaagagucuccauugaauguuuugggaggauugaaacugaaagccaacuugaaaauggagguauggcuuauaauucagcugugcugaacuguaagugauuaaauacuguuucaucacauauacacauauauauacuuaugugguauauagguccuguucucauuguacuuaugauauuuaguguuguuauugccauauccuguggggggaaagcuaagaaccucaguaaucuuaguaaauagugcuaucaucaguucauuuacucaagccagaaacacaagagucacccucaguuucuccgucaucccacauuuaaucuaucgccauuucuuacagguuccauuuccaaaauauaacaugaguccaucuauuucuguuucuacagucaucacccuaggcuaagccacuacuucaguagccucuccauuaggcuuaguucacuccagcccuccuccagugugauucacacaguccugcagguagucauuagaaacauaacuuaggcccugucauugcucugcuuaaaauuugugguggcuucccaucaugcuuagaauaaaaucugcuuuuuuuuuuuuaagcauggcuuuggugcuuuacacaauuuagucuccauauccucuuucuagccugaucugaaggcaccauccaaguauaugugacaaaacagcagugaacauggggguuaugaacacuacagaggaaacacaacuugcccaauaguagcaauaggcagguagacaggagggcuugcaaggaggacacuggaauagaauuuugaaaguagaguggaaauuucccagaaaagaaagaaaagagccuuccaagcaaagagaauguuguguucuagacucagagacaggagggcacguggugugucucaggcgcugcagugguucacggugagcugugaugagacuugagccuggaagggagugggagcccaucaggaagagucuuguguggugugcugaguugggguuuuuaccuuuaaagcaauagaauacccauugauggaugaaauacgagauuaaauugauuuuuuacuuggcuuuguuuuuaaagguugauguauuuauuuuuaaguuuuguguacucuugaaaauaggcuuuuauauuguuucaggaugcuggguuuuuuuuuguuuaauucacuugagguuagucuucuuguaaaaacccugguuaacuuauuuuuauggugcuuuggauuuuuuaggcuuaugugccuucagaggaagagaaaaauggugaaauucuggcaccaccagaaagucugugugggggaaagccaaguggaauaggugagcucuuuagaaugguuguucacauuguuuuuguuuuugccuugcaugugguuuuaccuuucuaaaaaucaauagcugaugcauaguaacauacaggcucuauuaacuugccucucacuuuuuaaaauagauuagggagaauucuuuacuauuuuauuuuuaacauacacuuuuccucaugaaaugucaaucaacauuauguaggguaauuguuuaaaucugauuacccccaaauaauaaugcaaaacgaaaguuguuuuggagcaaacucuugcucuaucccagaaauguuucuccauaccccugccuguccccagaugcuauugcagcuuacuuccaaaaggcuagucugaggauaagggcccacuuuacaccauuugcucuugucucuugcucaggcuuuuccccaguggcugcacagauacugcucucagcuuguauaaccucaucucagucucucugugcaacauucuucacuguggacuacagauuuuaagggagauccucaauaucagaaaggauaaaggcaggagcucuuaaacguuuuggucucaaggaccaaaaauuacugaaaaauuaccgaagaccccaaagagauuuuguuauauggcuuauaccuguugacauuugccaaauaagaaauuaaaauugagaaaaguaaauauuaagucacuauuaauucaauauaauuaacucacuauaaguuaacaacucuuuuuucaugaaaaauggcuagauuuuccaaaaaacccaauuaagugauaaaagugacauuguuuugcauuuuugcaaaucccuuuaagucuggcuuaauaaaaaacagcuauuucucguaucuguuuucacauucaguccuguugcuguuuauuguuuugauuaaaguaaaugaagaaaauccaacauuacagauagacgguuggguuuuuguuuuuuguuuuguuuuauuuuguuuuguuuuguuugagauggagucucacucuguuugccagguuggaguacaguggcgugaucucggcucacugcaaccucugacucccugguucaagcuauccuccugccucagcuuccugaguagcugggauuacaggcacacaccaccaugcccagcuaauuuuuguauuuuuaguagagaugggguuucaccauauuggccaggauggucucgaucuccugaccucgugauccgcccgccuuggccucccaaagugcugagguuacaugcaugagccacugaaagccacugcgcucggccaaugguuggguuuuaguagccuuuucagauaauuauggguacaucuuagccucuggaaaauuccauugagcacucaugagucuguaagacaaauaauguuaguuuggcccuuguggauuccuugauggaaagccucaggaauuccccagagaggcuggaccauacuggcuuaaggaaauggaaaugagaagaacugugacagugaggaauuauuucuaauuuguauuacaaacaugauuguguauuuucuucuguuucccacaauauuuuuuucuaaguacuaggaacuauagaguaugugaccaaauuuaagccaguccucaauuuuuuuccacaauguuaaaauguccaugcaagucagguggaguaaacagucagggugauuuuuguuguaaauacuuauaacaaaaaacucuauaggcauuugcuuaaagggacuuuauuagcucacaaaacugaaaaauucagguaaagcauaauccaagaggaugcagauagcuccaaagacacaucuaguagaaacuccauuuuaugucuucuuccucauccccugaauaagggucauugcuuucucauucauagccucuacuuuuagcuuuggcuuaccauuccuggccaaaaaccugagacuuauucugauuuagcauaaguacauguguccacccuaaacgaauuacugugaccagaggaauguagcuuacuaguugacuuaagucaggugcuguguuccuggauccacaugguauuccagaccacagucugggcucuugggaaaggugccaggagggcaacuguaaugucuacuguaguuggauuggcucuuuaaauuauuucccugacaaacaucaagucugcuaccugugaguacuagggaaaucaacauggaaaugacugauggaaguaagucauucacugaaaucaacgugcaaauaaguaagguacuauaauaaagauacguacuugacugugggagucagcuucccugagguagggccucagggaagacuuguguuggcucaaucaaucucuucccccaccccaucuucuuuaauuauagaaaguaaaauauacagaaaugcauaaaaaguuucccacucccuaugaguaaccaccuucaguacaauaaaauuauauuuauauuguuauagaauuuuuuuucacucgaucauguauugcaggcacccaucauuacuuuauuagcauauacagauccacuuucuuuguuuuaauagcuaaauaaucaucccuaauaccaauuuuaggucuuuuaauggccucgggguuucuacuguuacagggcugcaacgaacuuucauaaugcauaucacuacauguguuuuaccaaguauuuucauaaaauuggauugggggagggagggucaaagaauauacagguuaaguaucccuaauccaaaaggcuuggggucagaaguauuucgaauuucagauuucuuaggguuugggaauaugugcauuauaccucauugagcaucccguaucuaaaaauucaaagucaaacuuccagugagccuuuccuuugagagucauguugguacucagagaauuucagauuuuggagcauuucagauuucucauuuuugaauuugggaugcucaaccuguauacguuuugaauuuuuauaaguacuuguuacucauuugaggcuaaauauugaauaaugaguagguaugcauuaaguguacaaggcaaagagaagggcaguagauguggaaugauucagauuaagugaauagugcauauaaauccucacccaugacuaucuggggagguuuggggagugggagcaguugaggaccuucuuacacaaaaccaucugaaagggucucagaagacucguaagaagugucagccaguccuggaagaccacaccaagacuugguaagucauuuauacugacauguuaaaacccugaagaugacuaaucuauucaaaacuuggaaagauacauuaauuaaaaugugcauggguguuuuauacuacaaauaauuaacgucucauuuguuaauugucaagaagcuaacauuuuuggauucugaaguccguuguucccacaguuauauuucagauaacuuuacuguguuuagguacaguucaguaagagaucuacuuacguaaaaggaaguuguuuaaaagaaaaauguguguucugucauuguugaguagaaacaguagacuuuguacuucauguuuccaaagcauauaaacagaccauugcuguuggaggggauaggaucuaacuuuucauuugacgcuauuauuuuaaaugaaccaguguuauacugcagcuuaacagcuacauuaaggucuuuuacuuuuuuucuaagcuucagaucaccaacauaguuaaaucaccauagugauguaauauaccacugccguuauuauaaaaaaugcaggcaacauuaauuuauguugucuuuuucugguaguauauucugguaguacaacauggauugauugugggaaauaacuggucagauuuuuauaauuuaugaaagcagcuaagccacuuggugacauaggauagguucccuauccuaaaaaucuucaaauuuguuucucugcauuucagaaacaauauucaguuucuuuacaucucauuuuuauuuuugaacagcugaacuccagagggagccuuuguuggugaaugaaucacuaaauguaagucacuguaaugguuuugauuuuugugguuauuggguuuuuuaauuuuauuuuuuuggagagcuauugaggaggagccaucugaagggguugccuguguauuucuguaguagccaggaggcauuugguaguguacucuucauuugaguucagcauccugacagcagcuuucacuagcucuuuuccauguucaccuauacccacugauaaagaacuuugaacuuucuauuguuuauuauuauaacgggauugaaaauuagauuuugaugucuuaaaucauccuggugcuauagacaaaauagauuuuaguuugagaauuaaauuucacuuuauguuuuuagaaagcuuuucucaagauacuaaccuguaacugcuauguguacauauuuuuucccagauguggcucucauaaucccguucauucuugaaagagucuuguuuuuggucuuucugucuuaauguauuuauaaggaaccuuguauuguaccaggagugaacauuuuauaaaauguuuccaaaugugcagacaacugcauucuuuccaaugcuccuagaggaauugggguacuaucagugaaccgcgggaucagaguacuuccucaucaagcacucuguuuuguagcuagaaacucauacaccauaugcugaauaagaagaaagagaaaagcaccacuuggugugguucaaguuugccauccaagaguuaaaaagauuauggcugggcacaguggcauggccuauagucccagcuacugaggaaguugaggugggaggaucauuugagcccaggaguuuggguccagccugggcaacauagcauaauuuuuuauuuaaaaaaaaaauuuuuuuuuuaauaaaauacacuuuaaaauuuaaaaagacuuuaaaugggguuggagcuuaccgagccagcuggcauguucuccauccuaccucagucccuugaguccaccagcagcugucuuuuccccagucgagcauaaauguccuuuccaaauuugugcaaaagucuguagcuaggacuuaggauauuauaggauauucugagccuuuccccucaguuuaaaaaaagaaaaacaguagaauugauaagauuugccaaauaggaaaucuuauuacagaauccuauagaguuuuuaaauaaagaaaaaagaaaaucaugcaggauuuggaugggaagggaaauuuauggaauucagaaaauuuuucucuuauuuauucuuacucuuuugccauuggcugcuuuaaggacaggcagaauaagcacaauaauuuguuaaacugaaauuuuuucaaaaagaagaugcugcaugcuuuugagcuucugggugaaauuaaaaagaauauguaccccaauuccuuuuggcauuuguacaaauagccagguuauguaaauuaccuucucucuucuuucuuuuugccuuuaaauuuuugugagacuauccauaaauaucuuuuauauuguauauuuagguugaaaauucaggcuucagaacaaaugaagaaauucauagcgaaucuuauaacaaaggagguaaguuaaugaauuucauaguuauaguuuuaauauuauaguuaacauuuauugaguguggucuguauaccaggccuuguguuaauuauuuuacauacuuucucucauuuaauucauaaaaauucaguaaagugauaguuaacagcaucaggaguauaguugaggagaacgagucuuaggccaggugacuuauuccaagccauacagcuuaaaagugaugucuugcuuuaaauagcuacuagaacuuugccauuaaucucccaguugacucaauccaacauaaauacaaaacgaauagcccccuguggauugcaaguacccaacugugaaauguguuaacuucugacaggcaguuuaggaugguagcauaucaaggaugucacauuuaugugggucuucucccaggggugaggucugguggccacacaacccgugcaggcugccaacucugaacagaaaauucccuucucaaacagaacauagaauuuucuugaugccuacuaauuuuguuaauuuccuauuauaggaguggggagagaggcuuauuuacuuagacaguuauuuuuauaauguauaccauauuucaaacaaaaguaaagcaguaauaaacaccuaugugcccccaaccuaguuuugcccuaucuuacaauuuaguauauuugcuucacauaccuuuuaaaaaauguuaacaguuaugguggaauccccauuuaccccuucccaaucccaaucucuuuccuuuuaaucccacuccaaaaggaaccacuauucugcauuaauuauauauagguccauaaacaauauguaaccuauguugccugcuuuagguaaauauguggucucacguuacauaaacccuccccaccuuauuugcucauucagcagcguucuaagauuuuguucuguugauuuauauuaacucuaauuauuuuaauugcuuuugaauauaccacaguuaguauuuuuugcuucauuuguacauuauuuugcacauguagguauuuugaaacuuuucccaauuacaaagaaugcuacuguguauguucucauaccuuucccagugcuuauguaguguacuuguaauucuggguauggaauugcucaguuauaggcaccucuucaacuuuacugcaugugcuaaauugaccccaagugguguaccaguugucacuccacaccaucugccauauuugguauuguuuggugacuguuuguuagccugaugauuaugaugcaaugauucauuauuuucagugaugcuucuuaauacuguguugcuacacaaacuggggggaagggccuugaagucuucuguguaaaguccaguguuguuaccccagacauguuacugaccuucuugaaccccauucccucacaucuacaaguggaaaaaagagaauuuaacugacagaguuguguggaggaucccaucaaaaaucauuugugacuaucuaccacaaugcccuguauauaacugguacucaauaaaguuacuaacucaguuuucucccagcccccuaacacauaccuaaguaaguauuggaauauaaaaauauuuaagauuuuuuuuucuuuuuuguauuuauuacucagagauauccagugguagaaaagacaacgcagaagccauaagcggucacaguguugaagcagauccuaaagaggugcauuuuaauaaacucaaguguuugauauuuuauacauaauauuuucacuguacacaaagaagggcuuuagaaaggcuuuauuucuuuguauaaauuaaauauuaaauggguauacugagaguuccacaugucacuuuuaccuguauaugcccuuucaauguuuaggcaauuuggcaguucccaggacuguuuggaagugcccacguuguacagucagaaugguuuuucaugcaccuuucaucaaccauaagaaguccauuuuuaauaagccacuaagacaguagaaaaauacuaauugugaugugccaucaguuguaagauauauauagcuugacuucagaaauggugaaaugauaaauaauuuuuuuaaaugcguuuuagaauuauugaaauauaguauguagcuagaaacagcauguguuguaugaauuugcauucaaacccagaaaagagacugaaguuuacaaaauuagucuaauccaaaucuaaauaucaaguguucuagauuuuuuuuucuuuuuuuuuuuuuuuuugaaacagucucccccuguugcacgggcuggagugcaguggugugaacgcuucucacugcaagcuccgccuccgggguucacgccauucuccugccucagccucacaagcagcugggacuacaggcacccgccaccacgcccagcuaauuuuuuucuguauuuuuaguagagacgggguuucaccguguuagccagguuggucuugaucuccugaccucgugauccgcccaccugggccucccaaagugcugggauuacaggugugagccacugcacccggccaaguguucuagauuuuuaaaaaauuuauauaucaacuuauuccaaagguuagaaucuaguacagugugcuccucuuucaguuuauuugaaucaagauucuauggccuuugauauagucauucuuaauuccagguugaagaggaagaaaggcauaugccuaaaagaaaaagaaagcagcauuaucucucuucagaagaugaaccagguauuuauauuuauguuucuguuuuagacaucuuugaaaaucauuauuuuuauauccaaaagagugagccaaaaacauagagaauuuuugaggauaguaacucucuacuuuacaagucuugaggcuaauuuguuucuagacuggcuugauaccuccggaguccuuucuggaccccaaucuagaaacuagauugcuuccugcagaagacccaaccgcuggaucucagacaaagacaggcucucucuggaaccacacccuggagcccagccaggugccacuacagucuguauuuuauaucauaagcagauacccuacagagcuagugaagcacuuuaguccaaaagugccucuaacacccauucugugcuucauacuguugauuuucucauggucuguaacggugcccucuaguagaacuacagugauagaagucuuguacauuuauuuugucuaauacagaagcuacuagccacaugucacuauugagcacuugaaaguggucaguggaaaugaaagacugaauuuuuaauuguuuuuuaauuauuuuauauuucaguagccagaugugguuagugacuaucauguugaacagugcagugaccuuuaauacuugacacaaaggagaaguucaauacuuauugaaugacuacaugagaaagaaugagugaagaaugaaauauuuauauuuuauauuauuugguagcaauuuaaugaguuccugauguauucagguacuauccaugguacauuauacacauucccauuuaaucuuuacaauaaaccuguaaguuaggugguguugucaucuuauagauaaagagauuaagguucugaaaaauuacgacuuuaucuucaccacauaaaucugauuccaaagcccauggucucaauuacuaagcuauaccucuuaggugguaacucauuuagaaaguuaaaguaucucuggaaacuauacgcuaagcccuucccauagaacccacuacuucauuggugucaugugaacauauggggauuuuuguauuuuguuuuauuuuuacuuugccagggcgaaaggcaaguguucagugcucaaaucacaugauauuauaaauauagaguaacuuuuggcuucucuguaucacaggccuaagaaagaaggcucaaacagucuuaaaauagaacuaugcauuucauuuuucauuuagcuuuuguuccuuugugauucugucuaaacugauuuacagaugauaauccagauguccuggauuccagaauagaaacagcacaaaggcaguguccugaaacggagccacaugacacaaagguauuuuuuccacauauuaguuuuaaguuuuggguggggguagggaggccuaauuacagcauuguaaauacuuaguauaauauuuuuuucauuuuacuaucccucuuuaaaugucucuaauaauaaucacuuuauuauaaaaggugucuauuuuuuagucuccucccaaaaaucaaauguugcacuuuauaauucuuaaacugcaagaucguguuaauuauuacaauuuagauauaacauugcuuagguuuuuguucaguaguaguauugauuucuugagguuucuaaaugcuuucuuccaaaaguauaaugugcuuuaucacagauauacuugcaccaaaauauugaaauacaguuauuauuaguacucugcucucuagcuuaccuccuguauuagucuguucucaugcugcuaauaaagacauaccugagacuggguaauuuauaaaggaaagagguuuaauugacucacgguuccgcauggcuggggaggccucacaaucaugguagaaggcaaaggaggagcaaagucacgucuuaacaugacaacaggcaagagggcaugugcaggggaacuccucuuuauaaaagcauuagaucucaggagacuuauucacugucaggagaacagcacaggacaaaccugccccccgauucaauuaccucccacugcauccuucccacuacaaguggggauuaugggaccuauaauucaaaaugagauuugaguggggucacagccaaaucauaucaccuccugccucuaaaaucuggguacucuaaggauuggccucacccauugccuuuuuuccuaugguuuuauuuucaucuuaugacucacagaaccuccucacaaauuuguauuuguguucugccgucucuuguuguaggcccagauuuuuucauucccuacuagauaccucuucuuggguguucuuccauuucugagacucaguacucuaaaauuucucauuaucugucuaaacuaguuccaucuuuuccucucucuuucucuaauuuauauuuuuauaaauuauuagacgccuuauuccaaaaguguuuaaguccaguuaugaaaauauuugagcugacuuccaguucucuaaaaccagacuuuggucucuuuuuuuccccaguaaccgaagaacuaaauaaaaaguaggaaaagguuuaauaaccuaagagggaaaguggcauauugucaugaauuuuaguugguucugaccaaaggaagaaacaggcucuuaaacuaucccucacccugcccuguccaaaaucaaaaauccugagacaauacuucuaaauuugaagaaaagcagauugaagggguaucauuucauuuucucuuaaauuucgugauuuuuuaauguuaaauuuaaauaaaaucaauuuauuuucauuaagcaguuuuauagacacaguauuuucaguuacuacagaagaauguuacauggaaagcugucugcaauagcauuuauuuaauaucaucuuaauauuaguaauuuuuggacaguaaauugggagugauuucaucauuucuguuaaaguuuucuguguaguaaauaugugccauuuuauaaaaucaauaaagucauuauucuaaaauguguauaguaagaccaaaagaccaaaauugaauacgugaaaaaauuccaggcacuggaaaaauaaaagcaggaaauaaaaagugaguugcgugcgugucaucaggaucugauuaagugcuuacaggaccaaguguuggcucugaaagagccaguucaaaaacagaaaugcaguucguccaaugguuugaagacuuuugugcaggacaucuucagcccacuauaugaaacagauaaaaguguagauguucuggcugaaaugagggagaagaccccaaaaacuucugccugcuccuaaacucgcuccaacacacacacacacacacacacacacacacacacacacacacucucucucucuuucucuccccgccacacacgcacacaugcugacucucuccaucucacacacucugucucucucucucacacacacacacacacagagcacuugaagagguccugagcugaaaauggcagugcagcaugagugucucagugaagccucaguguugaugugcugauaacagagcaaauagguuucuccuuggcuuucccaaacgaguugaccuuccauccucuaaaucaacacccucccaaauuggauguacgacaagccaucagaaugugagaagaaaugguagaaccacgauuuauauaugccuuuuaucuaaaaaucuuaaaaaguaaucucuacuaauauuuacuguauagauuguuggcccuggugccaucacugaaagugagcucuccucugacaucaccuguuagucuugcacauuauugcaugucuuggaccuaguuauguaguacugucaaaguaccuuaaggguagcugggagucccacaacacagaggacuugagaaugagccccucacuuguuuguucacuuucagcauuauaugacuuaauaguuuacagaugcucaacuaaaugaauuugcagaguuuguuuaccuuguuuuaauugaauugacccucccaauaccgacacugguuugagguuucggcaaaaauaaccacaacaaaaaaccccauaagacaaagauaauauuuguaaugcagauacaaacaaauaauaagagaaauggcugagcugacacuucuuuuacuaggaaguagcagaagcucugugucauccucauuguuagguaaaaaagaaugaagaucuaaucauaucugacaugaagugggccagaaauuccacuguuucaguagacugugugaaauguggaauugcuuuuauauccauccccuuccagucccugaaaggcuauaucaaaacccaaugacauugaaugcauccaaguagggaaaucgggggugagggcauuucauuauagaccccuuuaaauuuugaaccacaagaauauauuucuauuaaaaaauaaguaaaauuaacauuaauagaaaugaggauuuacaauuuuuuauaaugggccauuaaaguaaaauuaaagcuuuaguuuccuauuucaucuugaucuuauucuacuuuauguauuuuuguuuauauacuauauuaguauuauaguugaaacauuuuggcauuucaugcugagaacuuucuugccacuauggggggauaauuuaauugcugaaagaucacugcuccaagucagcccaucuggauacccagaaauucccuuuggcaccucccaaauuauugcuuccccacaucucuccccuccaucacuccacaaagauaaauaucuguugccaguaucuguccauucuuccuuuggaguuugucuuaaaaagacaaaauccaaguagagggaggagaagaacaauuucuauuuugcaggaaagaaaauggccuugauauguuguacuugaaccuuaucucaugcuuuucuguucucagaauguuuauuuuuuuuauggucucacuagcagcaauaauaguuacacuucaaaaacauuuuccaaaaacuauccuuaaaaagagcuaggaaguuuuuuugaaauagaaaggcaaacuuguguggggaggaugaauggacgaaggcuucaguuugaagaagguucuagucuuuuucaacuucucuauaggaagagaacuccagagauuuggaagaauuaccuaaaaccaguucugagacaaauagcacuaccucaagggucauggaagaaaaaggugaguaaaauaucugcuuggguaaauugacugagccuucaaagcagccagcgugucucucaaccgaaacgucuauuuugcucauuuacuuuuccuguguaauaaagugccucaugcuuaagauuaauagggcuagggaaucauuuuuaauuuggauccugcuauacucaaagugugcuguuuacuagucacccaaacucaggcuuguuaauuuugaugguagaaacaugaaaauggagugugugguuauguguggcugcagcuguguaggucaccuggguaaagguggggaaggcugaccauggucacuagcauugaacaaaguucuuccuuuucuacagaugaauauagcagcagugaaacuacuggugaaaagccagagcagaacgaugaugacaccauaaaaucucaggaggugagaugugcuuuucguauuuguuuguucacaauuauuuaagcacuaaccaaauuaaauucauuaaauacuguuaucuugaguuuuucuuaaguacuuugaagaagcugcgguuuuuuuagugcaauggaacaccauuucauacagugcauuuuaucagugucauuuugauuaauuuuuuucucuucaucuuuguuucuucaaaacauuuguaugagacccacuuaugucauagccagauaggaucagcuuagugcucuacgucagcggcaaugucagguuccuggccuggcaaugcugagcugccaggccaggcacauggcagcaaacaggaggcugucugagccauggaguccagcuaggaugaaauaggaacagcagcagggugugcagaaggcaugcagggaauacucgaggggaccuaguucaugaggcaaggucauggauuccuggaggcugcaugcacagacagagcaucccagcccugccugcuguaagcccauagauuuucagggagccuguggagcagagaauugcaguggcuugagacugagcaccauaaaucaagagacacagccugugcacuagccgggucuagauaaccauugccagguuugcccauuguuaaaucauuuguuauuguucugucuguaugauauauucaguggaccccuuuauuuuuuauaaggguaucauuuggucacaacuaacuugggccaaaucccaaauuaaauggacauacauacuuauuacagaaguaaaagguuacacuuugauuacuucauugucucaaaauccucauggcuccauuaauuuaugacaguuagugauauuuaucagguugaagaagcaauggugagaucaguaaauaaaacacuaagcccuacaucacauauuuuuaaagugacaaagcuaggauuugaggucucuuagacaggaacucuaaaucugauuuuugagaaaacuuuauauaauaaaggauaaaauuuuuuuucuuauugcuguuguuguuuuuuauuucccccuuaggaagaucagccaauaauuauuaaaaggaaaagaggaagaccucgcaaauacccuguagaaacaacguuaaaaaugaguagguacuugguguguuuucaguucacacacaagaaauuuucgaaccgauuuucuaagugaauuuuuuuuuuuuagaagacgacuccaaaacagauacuggcauugucacuguaaguaauugcaaaacaugacaauuucaaauacuugcucuuaaccugaaaaacgguauaaugcaauaucuaguauuuugaacuuuauuuuuuuuacuugaaaagcuuuaaaagacugaguaaccauucauauauuuugauuacuaguaucuuuguguaaacagaguuacauuaguuguucuucauucugauuccauucuaauucaggaguuugauuauuuaaaaauuaucuagggauuuaacuucuuguggccacccuugguuaaaauauacaaauuagcuauuuuauaagauuuugagauaguggcuucuuuauagagacuugugaguugucuuaccaucuuacuacuuucuuuggaauucuuuuugaccuaaaauauucacugaguucagugcaggaaacuccuuagugauauuuuauguuugaacguucuuuaucuuugacccugacguauacccaccaaaaucauuguaucaggauuccaucgcaugcauuucaauggauuauuauaaggaggacauuacaagaagagcauuguaaggaggacagacguguguucacugaccuaacaaaacaacaugggauucaagccucagcuuugucacuuaucccgagaccugugacuuagggccaaucaugggacccucuggugacucaguuuccuugaaugugaagugguaugaugccugcaguacuuaucucauagaauuauuauaagacaaaaccagagaagcacaugugaaugcauuuagcaacauguaaaaugguuugccuugggaaacauuaaccacaguggccaugcugcauugccucacuucucauccuguagcaucacaaaagggaaguuacuuauuggaaagucuguauuuagaagcucaggcauccauguuugcuagguauacuuaaucaauuacagaaaauaggucucaaauacgccuauguaaauaaagauccuauaccaccuuuacaucauugauugcauuucuaugugaugauuauaaacugcugauuuaaaauuuuuuuuuguuuguuuauuuaaacauagguagaacaaucuccaucuagcagcaaacugaaaguaaugcaaacagguauguaccuaccgcauuccucuguguguuaucugagggaggggcaggagaggcuggcuguuggagaagguuuggaacuuccauucugccucucauugaaguggguggcccccuugguaaaaauaauuguccuuguaucugggagagacuguaucuauuggcuuacagagcccaggacucaagaauugaaauuguuuugacuauuuuucuccucauuccaaggagaagaauauauuccaaaauguugauaaugauuagcucuggaggguggaauaaugggagcauuccauauuauuugucaauauugcuugcauuuuccagauauuuuuugcaauguauauguaugcauuuuguggucuaaaauuuuuuacauaaaacaagaggugccauuagugagcuuugaaguguugauaucaacaacaaagauuaaugugacagcuauuuuguaucaaauaaauaguauggucagacugagaaaguacauauucucaucagcaaauaaagcaaauagguaauauauaguuguuuccacauuuaacuaugugugaucguacuucauuuuuucuugugucuugguaaauuaagguucauuuauuuuuugaaagaggaaggagauuaugcacguuuggucuuaaccaguuuuuauuaauaauuuuguaguauuuugaauccauacaagaaaucuuuauaacuucaguccccuuuaaggacuccaauuaaagcuguguuauucagaauguuuucugaauguggguaaaaugaugaccauuuuaagacaguccucuuuguugacauuucuauuggguuaacuuuuucaucuucauugguauuuuaaacuugcaaaaaaggacaacuacuaccgucacuaaaaagaaguaccuuugaguuuuugagugccugaugaacauccccauaauuucagcuucaacuagugcauugaacuaaucuuuacuuuucuuaccaugauacagucucagaaaauuguaacaucugcagaaagcaaaugcauaaagaauguauguaugcacccuacaaacaggucauaaaauguacuuuuuuagcuaccaugauguauuuggagucaaaagaauucuaccugucacucuacuuguuaguuaugugacucuaaacagauuacucaagccugguuuguucagacuauaggcugggaucauaauacuugcagagcuacacugaaauugaaaaguccauauuagccaggugugguggcucacaccuguaaucucagcacuuucagaggccuccacaggagaaucacuggagcccaggaguuggaggcugcaguaagcuauaauugcaccacugcacucuagccuggccaacagagcaagacccugucucauaaaaauaaaacaaaaguaccaguuauauauccuuauucaaaaugccuaggacaccagaaguguuucagauuuugaauuuauucagauuuuggaauauuugcauuucccaguugagcauuccuaaucaaaauucaaaaugcugcaauggcauuuccuuugagggucauguuggugcucaaaaaguuuuggauucuagaacauuuuaaauuuuggaucaucagauuagggaugcuccgccuguauaucauuccaacuugcaguuacugguacauauugugggcuccuuauaugcccccuuuuuucuucuuuuuuggggucagaacauuuaagcugaaagggaauaagaguagucuaacccagccgggcgugguggcucacaccuguaaucccagcacuuugggaagccaaggcaggcagaucaccugaggucaggaguucaagaguagccuggccaacauggugaaaccccgucucuacuaaaaauacaaaaaauuagcuggacaugguggugggcaccuguaaucucagcuacucaaggaggcugaggcaggagaauugcuugaacccaggaggcggagguugcauugagccaagaucacgccacugcacuccagccugaaugacugagugaaacucugucuuagaaaaaaaaaaaaaguagucuaauccaacuucuuauuuugcagcugaaaaaacugagggucagcaaauuuaaauaaaaucugaaaugaaaacuuauguuucgugacucacaauccaaugugaucucugcuagguauucugauucuaucuuugcuugacugauacaagauaaugaugaaauguauaacaauguauuaauacugauacauugacagacaagccaggcugauuguugaaauuuaaauuuacaguaauaaaauauuaaugcagagauuucccuuuucuuaaagaugaauccaauaaagaaacagcuaaccuacaagaaagaaguauaagcaauguaaguguuaaauuucuuaucaagauauguuguuuagaaaucaacuuaaaugcucagcugaccacccuuuugacuuuaauuuuauugcuucuaggaugauggugaagaaaaaauaguaacaagugugcgucggagaggaagaaaacccaaacguucucucacuguaucagaugaugcugguauguuucuagcaaauucuuaauaagucuuauuguuucaaaaccaccuuuuuaaagaguuuuucuuugaaugaggaaaaauccaauggguacagcuaauauuaauauuauauaaauaugugugaaauaggucuaaucccgugucagaaaugguacaucccagaugcuuuucugaguacaugucaauuuuuuaugaacgcuggcugugaacugcauauguaaacuauccaaaauguguuugagauuaaguuaaacaguugugaauugcaagugcugaaacaaaaaggaaguggaaaaccauuucucugccuccaagucccuaauauccuaaguucuaaacuccaugacucucucucuuggaaguaucuuugggaauuguaaaauccagguguuacccuucuauuugaacagaauccucagagccagaaagaaaacgccagaaaucaguuucugauccaguggaggacaagaaagagcaggagucugaugaggaagaggaagaagaggaagaggacgagccuucaggagccaccacaagauccaccaccagaucagaggcucagagguaaugggggcagcacagagcugccagagaccuucaccagcuucuccaucugaaaauugcucuggguuuucugggauucucuuugaacugaaucauucaugcugcaguggaaguucuucccuuucauuuuuauuguuagcagugggcacauaguucuuggagaacacauuuucuguccuaaaccauuuugggggauugccucaaagucuuuaccagguuuuaaaugccuauuugguggaacccauucaauuccuuacaaauauauuuuuugagcaucugccauccuucagaugucguauugagcaccauucaugaauauggacauacauaaaacaucaucccugcucucagcauacuuaauucaacccagaaagcaggaggaaccaggcccacgcaccgucaucacaugcaucucaccagugcuaugcaauagguugaucauaggaaagugcccaaauuugaccauuuuugagguaauuucauauauuucccaaaauguguucucucaaacccuauuguagccagaaaccucugagaaaaagaguaccacggucagaugaguuugggaaugucauugaauucucucuccuuccucaguuacauguucauuaaaauauuaaggguuuggcaaacuccagggcugggcgcggugacucacgccuguaaucccagcacuuugggaggccaaggcaggcgaaucacgagguccggagaucgagaccauccuggucaacauggugaaaccccgucucuacuaaaauacaaaaaucagccaggcaugguggugagugccuguaaucccagcuacucgggaggcugaggcaggggaauugcuuaaccgugggaggcggagguugcagugagcugagauggcuccacugcacuccagccugguguuagagcaagacuccaucucaaaaaaaaaaaaaaaaaaaaaaaaaaggguuuggcaaacuccuaaaggaaagaagccuguugaacuuuguuuaaacaagcauuauuugcugauaccacuuuucuguuguuggccuauaucauuauaccuguucacaucauccaguguuccuuuccccauggcacauuugagaaaugguacauaacuguauugucucauccuaaccguuaaucacuuucccaaacaugaauauuuuccaggcugagcacgguagcucaugcuuguaaucccaacacuuugggagaccaagaugggaggaucacuugagcccaggaguuuaugagaccagccugggcaacacagggagaccccaucucuacaaaaaaauuagaaaauuagcugggcaugguggcaugcaccuguagucccggcuacuugggaggcugagaugggaggaucgcuugagcccaggagcuugaggcugcagugagcugugaucgcaccacugcacucuagccugggugacagugagacucugucucugaaaaaauauauauuuuuuuaauuuuuaauuaaugugauuuacaagcuauuaaucuugguaucaucuuguuuaauuucauuauucaagauugaucaaaaaguucaggaagauuuauuucaaaaauaacacuaacagcauaauauaauaguaucuuguguuuacauaaagaacuaaaaucggggcugggcacaguggcucacaccuguaaucccagcacuuugggaggcugaggccggcggaucacgaggucaggaguucgagaccagccuggccaauauggugaaaccccaucucuacuaaaaauauaaaaaauuagcugggugugguggcacgugccaguaaucccagcuacuugggaagcugaggcaggagaaucgcuugaacucgggagguggagguugcagugagccgagaucacgccauugcacuccagccugggugacagagugagacuccccgucucaaaaaaaaaaaacaaaaaaaaacaaaaacuuaaaaucaaucuguuucuaauuccuccagacuuaacacaguauuagccauuugugccaugguuugauuucucaaagaaucagauuuuagagccaaaggacucuagaagcucacacggcuaaaguuauaagguggucucauauuuguuuuuuuagguggagcagcucacauaaauagaaaagaagucacagaauccaaauugcugcugcuaggagagggugagggugcuggagcccaacacccaugcauuuggguauagcauccaucccaccagaauuacugcuucccuuuaaaacaguuguggaaaguagggcucaacucagagaaaguuccauaggccuucuagccaucuucgagugagugucuagaaauugcucucagauuugccuuuuauaaauucuuuaaaaauaaaucuuauuugauuuauaugguucuguaaucaccuggauuaucaaagcucuuccuucaugcacuuuauaauauaaacuuuugauuuacaaaugaguuguuuucucucuaguuuagauuccuuggcauugguugaucagucccagggcucuggugucuucauaauuuuacaaauugucugaguugggugggcucucaguggucauguaguaccaauagccagucagugccugagucacugcaccugcagcuccucugaaagggucuuccugcuuuugcauggaccucaguggcagggaaagccacauccuccuuagcauucucugacuuguguucaguagaagccggccucccuguggcuucuacucuugauucuaguucgacuuucagaaccuucugucuaauuuugccuuacauauuugagggcagcuuccaggucuucucugcuugcuuauugagccccuucaucaucccuguuugugcucaucaguuaccuuuauccucuuuuagaagcaaaugugcagcugggcgcaguggcucaugccuguaaucccagcuacucaggaggcugaggcaggaagauugcuugaggcugggaguucgagaccagccuaagcaacauagcaagacccucuuaaaagaaaaaauuaaauuaaauuaauaaaauauaaaagaggccacgcacaguggcucacgccuguaaucccagcacuuugggaguccaaggcugguggcucacuuaaggccggguguucaagaccagccuugccaauauggugaaaccucaucucuacuaaaaguacaaaaaguagccgagcauuguggcagacuccuguaauccuagcuacuugggcagcugaggcaggagaauugcuugaacccgggaaguggagguugcagugagaagagauuguaccacugcacuccagccugggugacagagcgaggcucuuucucaaaagaaagaaagaaagaaagauagauagauagaggcucuuucucaaaagaaagaaagaaagaaagaaagauagauagauagauagauagauagauagacagacagacagacagacagacagauagauagaagcaaacucuguauaccaaguguggucuaaugaauccagaagaggacuguucuaccuuauuuucuggauauuguucuucagugugcauccucauuacugagccucaaauugaaaaauacaccagcuaaacaaguuccuuuuucagaguuuuuacuggaaucagaauuccuuaucugauucuugugcaguugacuacuugggccuuaacacuuagccuugugaauuguacuuucguuaaucuuggcccuuuauucuacccugaugagcucuuuuguaaucuuuauuuugucggccaguauauuuucuauuuuucgcagauacaucuuuuuucuaaaucacaauaaaauaucaugcacaguaagaacaaagauagugucacacaagcagagguaguuguagaugacauuaagaucgacuuaucagcaguggucaggaaaaccaaccauuuuucugauuuuaguuccuauuguucugacuugcccacaaggagccucauacuuccuacagaguuccagggacuggaguauucagugcuaccauugcccaguguuucuauaaucuguuucagaaagcaacauagcaagccaucugcacgugcaacauccaaacuuggcagcccagacacaguuucuccuagaaaucgccaaaaauuagcaaaagagaaguuaccuaccagcgaaaaaguuaguaacucucccccauuaggaagguaagucccugcuuacacuucaagccauuuuuaacccccuaagacuauuuuugguacaauaaugcuuucuuccuaauuuccuuuaagauuuugucucaccaaauaacuguuuuuggggaucauugguuuccaagaagaacaggaagggcugcagaaggugucuguguggccucaccagucuggccuugccgcaguggacugccacacaggcuuguccuugacaccugugagccuuaucugccuucucccauccaccaagaccaaaggcaaggcagugugguaaagcauuuaacagcccagaaucauuucuguuuuagcuagagcauuggagaggugaugaggugauaaagcuuccucuuucaggcacggccccugccagcuuacaccuuucacugcagccuuacuggucuuacugcuucccagaggugguccugagccuuccuuucuugccuuugcuugagccagugaggaguguccucaccaccagcaccccuaguaagucagauccuuuccgucccgcuucagcccauuuucaucucuucuugcugcacuucuggucaguacugggcacuugagaugccacauagcauugguuugguauauuccuuuuauuuaccccucugagcucuagguuucuuucuugagauaggaauuugucauacuuucuauacauuaucauauucaaaaauaaaagacucuucacuguacacaaaaacuguuuugaccucuuaccacauuuucaucuucacagcauacuuguauguaugugcuguuuuccgcacauucuagaaacgaaagcaaacuauagugccaggcaguuucacauacaugcucucauuuaacccucagugagugaauuguaauaguuacucuuauuuuauaugugagggaaagaaucucaggaagguuuccaugcauacuacucaaaauugaacaugcagucaaaucacuugaggcuguugguaaaaugcagauccugggucuguaagucuaggcuggggccugagaguuggcauuuccaacaagcuccucagugaccaaugccccuccucacagaccacauucuggguggacuagaagggccuggauaaacuacgaagcucacauggcuggggagaagcagccugacucagagcuucuguuggcugccacuuggcccccagcacaauacugcgcacggcaccuuuacugaagagguguucauugaguggcugguggcuuuccauggaaacaguuugaaauggauuaucaacaaacacauuuucagucauugucaacacaugucaaaaccacaucaucugcaacaauuuuugacucaguuuauuuacuuuugcugucaaacaagaaacggaagacgugucuucauaucacuaagagucccauuucuccaucuccugcaauuuugguuuuccaacucuuugauucauugacaggacauuuacugcccgcuugccauguguugggcauugcacuaggcacuggaguuagaaaaaugaauaaaucucagcagcugcccuagagaaucaucgugucuaaugggggagauauauguguauaagacuuucaaacuuuuuuggcaacaacccacuauaagaauauuuugcaauacagcuggugcucacauuccugcugcuguaacugaaacaaaauuucaugagucaaauuuaauagaugugauaugagugguauuuucuguuguguccuauuaacauguuguuuuaaaauauugauuguaacuugcaguuugaaaaaacacagcagaugaaucacaaugguaaaugcugugguaaagaccuaaagucuucauaucaauaaagucacauuucucugugggggauuccaaagauggggcaucuugcuuugugauguggaaggugcaggacuacaggcccagauggugcacaaguagaaggcagaacuauaaaaggcucuggaugauuuucuccugaaagcaucagagacccaagaggaacuucauacaucucuaggacaguaacaugauuaauuggaguuuccaacaaauaauuuuaaucacagacuauaucaacaggguaugcuggugauagggagauugguuagaauguucuucugaaauucccgugccuuuucuaacacagguauuuucuguaauacugugcuacgaaacaugauuuugcacuugguccaaccuagauugcaguccugcuguguucuugcuaguuguuugaacuugggacagucuguauauuggugggacccgcuguugaugucuuuguuuucuagaugaaagaacuagggcccagagaaggaaguggauuugagcaccaucagcaccuagagugugguagagcuggaaccagagcacaggcuucaaacuucucuuccaguguccuguguuugugugugagguugacagcaaauaaccaguuaguucaagcucuucgcgagguagcuccuuuucauguauaaauguuacuggguuuuucucuucuuagcugucaaguucaaaacucuucuguuuuuuaaggaacucccaaguuauuugaagcagcugcuuuuaaaccucaccauugccuugacuuugcuuaaugcagaucaaagacacagcucuccccuucuaucaagcgcaagagagaagucagcccuccuggggcccgaacaagaggccagcaaaggguggaggaagccccugugaaaaaagcgaagcgauaauccugaccacugcugcccuaggcuuauggaggaacacgguggagaggaaagagacaugccuugguggccauaggcuucucuuuaaccaggaaaaagauaugcaugugcuguaagucccuaggugcaagcuuuuucuuguuauguuuuaaacagcuuuauaaacuauuguucauagaagauauuauguacauuuauuucagauaaaggacaauaaguuuacuuuguaucugaacucaaaacaaaguaguuguauauuuuaacauucaaaauugggauuucccaaugugacacaucaugaaugcaaaccccuccagcccaucagacgccaggcugccuacugguaaucuguguauaguauauaaacauguaaaaauagguuguauuuuacucuauguaugaugcuaaucaaugaacacuuuauuuauuuuacagagaaaacuuaucugugaacuuuacuauauaucuguuuauuuuacuuuauuuuuuuuuuaaauaaaaaggguuuuaaaugcuaugcagucauuaguagaaaauuuuuuaggacucugccugcucuguaacuaucuuaauaugaucuggcagaaacucgcauguauccaaguaaaguaguuuagcuaaagaaagguucuucauugcuuuucuguucacaguuguggcucuguuuuuuaagaauguaacuuguuuuuagauuauacuugcaucugugacuuuacuaccagccacguugacacaaaacagguucugguucagguaaaguugcgucagucaccugcagcagaaaucccucuucauuccucuucucuguguucauuccucuucugugcuguucugaagcuucuaccaauacucuuuccauauugucuuuuucagugaagagaaaugcauucaagauuaggucccuccugucuauccaguuucaggauuuuauguuguuuuauacacaguuauuucaguauagaaacuggcuuuauugccaaguguuuuuuuaaacauguuuuaacucucauaugagcaaacuguccaacuucaguuuuucauaagauuaaacuucuuacgaucaaauuugucucuugcaaugaugugaugaguugccaaauaauugagauuauuuuaaaauguuuuguucauauucuuguuuuauaauuaaaauuuacauucaguguguauggguuuuuuuuuuuauuuugacucuuaauguaagguggauauuucugucauuuuacaugguuucuuacugagauuuuauauauaaauuauaaaauguuuaccaaaauuugagugguaagaauuuuauuuguguguuuuaaaaugugucugcaugaaaaccauuucuucucucuaaauaauuggucuuagcuguaucauuccaugcucacauucaaauuugagucagugauggccuuucucaguagaacugaacucgguagaacugaacuuggaagaacugaacuuuagauccagaaaggccauuagagaugaggaacaugagaguuucucauuuuuauguauauggaugauuuuuaaccaaaacucaaaaaucuaaagugauuugucuuaaaaguaagaaaugcaaaucaaagccacagugauguaccaucucacaccaguuagaauggcuuuuauuaaaaagucaaaaaauaacagauguuggcgagaaaagggaaugcuuauacacuguugguaggacuguaaauuaguucagcucuugugaaaagcaguuuggagauuucucaaaaaauuaaaauuaauuaccguuugacccagcaaucccauuaccagguauaugcccaaaggaaaguaaauuguucuaccaaaaagacaucugcacuuacauguuuaucacagcacuacucacaauagcaaagacaaggaaucaaccuaggugcccaucaacaguggauuggauaaaggaaauguggaacauacacaccauggaauucucuguagccauaaaaaggaacaaaaucacguccuuuacagcaacacugaugcagcugcaggccauuauucuaagugaauuuacucaggaacagaaaaccaaaucuaaaauacaaaauauaaguaaaaaauguaaaaaguaaaaggguagaagcugaacuaguuuccaagguuccugauuccuuuggucacagucuuugcacugucaguuuuagauu

SEQ ID NO: 14330 - RNA, 447 nt, Homo sapiens
gauggcagccaccacaggcucaguaguaaaagucccuugcaauuuccaacuguuggaagaacucgaagaaagccagaaaggaguaggagaugacacaguuagcuggggucuagaagauuacgaagacaugacacuuacaagauggacagggaugauaauugggccuccaggaacaauuuaugaaaaccgaauauacagccuuaaaauagaauauggaccuaaauacucagaagcaccccccuuuguaauauuuguaacaaaaaauuaauaugaauggaguuaauaguucuaauggagugguggacccaagagccauaccagugcuagcaaaauggcagaauucauauagcaucaaaguuguccugcaagaguuucggcgccuaaugaugucuaaagaaaauaugaaacucccucagccaccugaaggacaguguuagagcaauuaac

SEQ ID NO: 14331 - RNA, 9095 nt, Homo sapiens
uguucugacugacaauaauguggaugcuuugauaucagugcguuggguauuaucuucauuuuacaaaagagaaaaacagacacucagacuaaccaagugaccuggccaaggucccacugucacucuugacuaugaagucaaaauccuuuacaggguuuaucagucagugcccuagcaggacacagacagcguacugaaauuaggauaaugucaggagggacuacuuaaaaugguguggagaguguagacgaaccacaagguaaaauuccuguccuucuuaagacuggugagaguggagcaguugccaccaauaggcugaugaaauaagggcagaaaugauuacucugcgggcuccuaaccuuuugucacucugaugaacuccaaagacccuaucucaagggaaugucuuuaaaugaauuuaauaaaauacuaauuacagggggaggagccaagauggccgaauaggaacagcuccggucuacagcucccagcgugagcgaugcagaagacgggugauuucugcauuuccaucugagguaccagguucaucucacuagggagugccagacagugggcgcaggucagugggugcgggcaccgugugugagcggaagcagggugaggcauugccucacucgggaagcgcaaggggucagggaguucccuuuccuagucaaagaaaggggugacggacgcaccuggaaaauugggucacucccacccaaauacugcacuuuucugaccggcuuaaaaaacggcacaccacgagauuauauccggcaccuggcuuggaggguccuacacccacggagucucgcugauugcuagcacagcagucugagaucaaacugcaaggcggcagcgaggcugggggaggggcgcccgccauugcccaggcuugcuuagguaaacaaagcagccgggaagcuccaacuggguggagcccaccacagcucaaggaggccugccugccucuguaggcuccaccucugggggcagggcacagacaaacaaaaagacagcaguaaccucugcagacuuaaaugucccugucugacagcuuugaagagagcagugguucucccagcaugcagcuggagaucugagaacgggcagacugccuccucaagugggucccugaccccugacacccgagcagccuaauugggaggcaccccccagcuggggcacacugacaccucacacggcaggguauuccagcagaccugcagcugaggguccugucuguuagaaggaaaacuaacaaacagaaaggacacccacaccaaaaauccaucuguacaucaccaucaucaaagaccaaaaguagauaaaaccacaaagauggggaaaaaacagaacagaaaaacuggaaacucuaaaaagcagagcgccucuccuccuccaaaggaacgcaguuccucaccagcaacggaacaaagcuggauggagaaugacuuugacgaucugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucaagaacuaugugaagaaugcagaagccucaggagccgaugcgaucaacuggaagaaaggguaucagcgauggaagaugaaaugaaugaaaugaagcgagaagggaaguuuagagaaaaaagaauaaaaagaaaucagcaaagccuccaagaaauaugggacuaugugaaaaggccaaaucuacaucugauugguguaccugaaagugauggggagaauggaaccaagcuggaaaacacucugcaggauauuauccaggagaacuuccccaaucuagcaaggcaggccaacguucagauucaggaaauacagagaacaccacaaagauacuccucgagaagagcaacuccaagacacauaauuggcagauucaccaaaguugaaaggaaggaaaaaauguuaagggcagccagagagaaaggucggguuacccucaaagggaagcccaucagacuaacagcggaucucuaggcagaaacccuacaagccagaagagagugggggccaauauacaacauucuuaaagagaagaguuuucaacccagaauuucauaucaagccaaacuaagcuucauacgugaaggagaaauaaaauacuuuacagacaagcaaaugcugagagauuuugucaccaccaguccugcccuaaaagagcuccugaaggaagcgcuaaacauggaaaggaacaaccgguaccagccgcugcaaaaucaugccaaaauguaaagaccauugagacuaggaagaaacugcaucaacuaacaagcaaaauaaccagcuaccaucauaaucacaggaucaaauucacacauaacaauauuaacuuuaaauguaaauggacucaaugcuccaauuaaaagacacagacuggcaaauuggauaaagagucaagacccaucagugugcuguauucaggaaacccaucucacgugcagagacacacauaggcucaaaauaaaaggauggaggaagaucuaccaagccaauggaaaacaaaaaaaggcaggggcugcaauccuagucucugauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccugagugaccuacacagagacuuagacucccacacauuaauaauggcagacuuuaauaccccacugucaacauuagacagaucaacgagacagaaagucaacaaggauacccaggaauugaacucagcucugcaccaagcggaccuaauagacaucuacagaacucuccaccccaaaucaacagaauauacauuguuuucagcaccacaccacaccuguuccaaaauugaccacauacuuggaaguaaagcucuccucagcaaauguaaaacaacagagauuuuaacaaacuaucucucagaccacagugcaaucaaacuagaacucaggauuaagaaucucacucaaaaccucucaaauacauggaaacugaacaaccugcuccugaaugacuacuggguacauaacgaaaugaaggcagaaauaaagauguucuuugaaaccaacgauaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaauuaaugaaucuaggagcugguuuuuugaaaggaucaacaaaauugguagacugcuagcaagacuaauaaagaaaaaaaagagagaagaaucaaauagaugcaauaaaaaaugauaaaggggauaucaccaccgaucccacagaaauacaaacuaccaucagagaauacuacaaacaccucuacgcaaauaaacuagaaaaucuagaagaaauggauaaauuccuggacacguacacucucccaagacuaaaccaggaagaaguugaaucucugaauagaccaauaacaggaucugaaauuguggcaauaaucaauagcuuaccaaccaaaaagaguccaggaccagauggauucacagccgaauucuaccagagguacaaggaggagcugguaccauuccuucugaaacuauuccaaucaauagaaaaagagggaauccucccuaacucauuuuaugaggccagcaucauucugauaccaaagccgggcagaggcacaaccaaaaaagagaauuuuagaccaauauccuugaugaauauugaugcaaaaauccucaauaaaauacuggcaaaacgaauccagcagcacaucaaaaagcuuauccaccaugaucaagugggcuucaucucugggaugcaaggcugguucaauauacgcaaaucaauaaauguaauccagcauauaaacagagccaaagacaaaaaccacaggauuaucucaauagaugcagaaaaagccuuugacaaaauucagcaacccuucaugcuaaaaacucucaauaaauuagguauugaugggauguauuucaaaauaauaagagcuaucuaugacaaacccacagccaauaucauacugaaugggcaaaaacuggaagcauucccuuugaaaacuggcacaagacacggaugcccucucucaccacuccuauucaacauaguguuggaaguucuggccagggcaauuaggcaggagaaggaaauaaaggguauucaauuaggaaaagaggaagucacauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaacuacugcucaaggauauaaaagaggauacaaacaaauggaagaacauuccaugcucauggguaggaagaaucaauaugguaaaucuguaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucauacuaccugacuugaaacuauacuacaaggcuacaguaaccaaaacagcaugguacugguaccaaaacagagauauagaucaauggaacagaacagagcccucagaaauaacgccgcauaucuacaacuaucugaucuuugacaaaccugagaaaagcaagcaauggggaaaggauucccuauuuaauaaauggugcugggaaaacuggcuagccauauguagaaagcugaaacuggaucccuuccuuacaccuuauacaaaaauaaauucaagacggauuaaagacuuaaacguuagaccuaaaaccauaaaaacccuagaagaaaaccuaggcauuaccauucaggacauaggcaugggcaaggacuucauggcuaaaacaccaaaagcaauggcaacaaaagccacaauugacaaaugggaucuaauuaaacuaaagagcuucugcacagcaaaagaaacuaccaucagagugaacaggcaaccuacaaaaugggagaaaauuuuugcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggaaaaauaggaacacuuuuacacuguuggugggacuguaaacuaguucaaccauuguggaagucagugugggcauuccucagggaucuagaacuagaaauaccauuugacccagccaucccauuacuggguauauacccaaaggacuauaaaucaugcugauauaaagacacauguacacauauguuuaugguggcauuauucacaauagcaaagacuuggaaccaacccaaauguccaacaaugauagacuggauuaagaaaauguggcacauauacaccauggaauacuaugcagcuauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaucacauggacacaggaaggggaacaucacacucuagggacuguugugggguggggggagaggggagggauagcauugggagauauaccuaaugcuagaugacgaguuagugggugcagcgcaccagcauggcacauguauacauauguaacuaaccugcacaaugugcacauguacccucaaacuuaaaguauaauaauaauaaaaaaauaaaauaaauuguaaaaaaauaaaauaauaaaauaaaauaaaauacuaauuacaaaagaauacaaugauauuaaaauccaaugaauaaaauaugcuaauaaguguguaauauauuaacauaaggguuucuuuuuuaacacacuaucuaacaaggccugauggugggucuaauaaugacugcaacuucaaaguaggggugagcauaaaagacacuuugacaugccugcacccucugugauguuacacgaaaauacucaugacagcagucacagguauugcuaauaccauuaggauguguugccuagcuuggugauugaaggaaauggucaauuuugguuggagauuagugauuguaaagauauauuuuuaguuuccccauugaaguucacaaaccuccuaaacuuuacagaucucagauuaacaacuucuuggcuauuggaaaacagaagaaaagagucauguaaagagguuacuuggagggacagagccagcacaaagaccacaccacagggaggaacaaauaccccaacaaccuucuccucuuuccaccccaucucaugccagcuuucccuauugguguaauucaugcagauuggcuucucaggccagagaacagggugaggaaggcuggagagugaaucuggaggcaagcuaaagacauccaccucucaacaaucugccaaucugccuauaucuauaccucauccaccugcuucccaccucuuugcucuacguagucaagaaugauuuauuugagugagaguaagucagaaacuagaaaguacucaacccccuuccagcaucaagggauauuucuaccccauggaaaauuuugccucaccccacugauucuacauucuccaguaauaauuaaaucuacuugaugacagauuuuucaauuaaaauaaagguaucauuuauaugaguauuuguuuaauguuuuguaucaauggccauuguguuuggcugcagguaacagaaacccacaaccaaaaaccagugguuuaaguauaucagaaguuuuguuuuuauuaugcaacaagaaguccagagguaggcagggcagagauaauuaauauaguggcuuauagcugucaucagagauccugggucuuuccuuuucuguaccacaaccuuagcaugcuuccaugcuugcaguggccuuaugguuacgggauggcugcuggaaccccagagguauacauuaaggcacgaagaagggguaagacaagaggaaaaguuuauuucagcuggagcagcccagagcuuuggagcuuuuacaggagcuauaugagaaagggucaacugcaagauguuuguuaaggaguauuggaauugacacuguggaaggaggggaguggaagcaggagcaggcagagaaacacuuggagcuuccagaaagggccagcaacagcucuggcugaugccucuagaagcuccugagagacagcagcucuucagagccaucacuguugagcuaagaugccuggucuucauaugcccucauugaccacuggguaugggcuacuccagaaagaacaugaccuugggcaaggcagcucuccacagcugagaccauccaucaaggagaugacaacuccuuucgcauacaaacuucaggggacacaauucagcuccuaacagagaggaugugaugaagauaaagagggucgucccauuucaucagagaucuuuaucccugugaguuuaguuccaggcuuuuugauguuccuucauuggcuucaagaaaguuguaccccacccucaguagccucgcagucaccaaccugaccauggugacccaagcaggaaguguuggaaacuuggagccuggagcccagacaggaaacagcuuuccucagaacuauguuccauuacaguguccuucuucauacuaaugauauggauuguauuaaggaaucauuguacaauauaucucucuuugagggaacuguaauuaaauuguucuugauauucauguaucuuguauaugucaggguuacgagcugggucucaaauuaaacacauauagcuucaaaucucaacuuuuauacuucuaaguggacagcugucaaauucucucaguuuccucauuuucacuauaguuaaaauuauauauaaauauauacgaauauaugauacauauuucauaaauauuuuauaaaaauauauuuuauaaguuugcuaguauagcagguuauauacaaauauaguuauaguuucuacauuguggguuauugcagauacuaaauaagguuaugcauuuagaagcuacauaaaugacaacuguuauuuggaaaacguguugaacauguccgcgugcucuacaacagagauauagaaauaaaggugcauuuccuauccuaaggaaauucauuauauacaagggaaguagccagagcauugugaagaguagaauaagagagcuaaaaacaagccuccaggagaacacaaauggugcacauucucacugacuaggauggcucccugaaacagaggaccuuuuugcugaaaaagcaggagacacagaagauacugaagaacuuuauaagcacaggggucagcauaggcaacuccacagaggcagagggaucuggccuuugcagggaaucaaaauaggccauuaugcuagagagauaaaguaug

SEQ ID NO: 14332 - RNA, 2893 nt, Homo sapiens
uuccuaaaucagccugcugcagcaguuguugauugacuauuuugauggacaguaaggaucaacucugguacugagugaggacuaugauuccaacugggucaaaacguaaacauucuuucauugcuuguuuucacaacuaauccccuauuagggaaagugcugugucacauacucaaacggagugaaaugccuuagaauugacccucccuggccaauaacccuuuccaggguucucaaaauuaggcuuggaaacuacuauagaagaggccuauugauaacagaauaaguuauauuuuuagguugccagagagagaaugagaguagguaagagaaacgaccaauucuaccaguuauucuacaauguggguuuucacugcucuguucacaugccuuauucagacuucuugugguggucaauugcuagauggucuguuggaauuaucugcugucauacauccaaaaaggucucacagagagguaaagugacaaccuuggucuuaauaacccucccaaaucugcuguaguugcaguaaccuaugguaaugauacuacacugaucaaugaccucuuuagagcuaaaguucaguaaagucagucauuuauuuuggauauaucaggugauuaauugcuacauaauucagcauauggagcuaauguuaauagcuuuccaugggaaaaauuacucacagggauuauuuuuaaaaucacuuucuuucauuuugucaucuaaaacaaauuccuugaaauggccaguguccaaaguggcuguuacuacuuuucagcugauuauagagcuucaaaucuggguuacagugaaacuguguggauggacuuuuuuuguuguuguugccaaauaccuuuuuaaugugucugguucuacagauggauacacuagugaacagcacagacacaaacaguugauuggacaagacaacauagcauauuaaacauuaguaaaaaugaggaaauuacacagugcuaugaacuacccucauucuuuuuuccaacauauuuacugaauacucacuuuaugacagacaucauucuaagugcugaggauaaaacaaagugcauguucucauggagcucauuucucuauauaacugguucaccugaggucugauucugcauuccaagauagcuggagugaaagauuaguaugagguaaagaaauagaggguaaauaagaaaaugcucucuggagguuauuaaaaaauauagaggcaaaguccuggcaaaagaacgagaaacggggugaaagggagaaggaggaagagagaaauuaaucuuuaucaaauauuuuauuauuauucuauuucuuaagccuuauuccugcuucuuaagacagacugugaauaagccaucucuguaucccaacuaaugcaaugacucuggggguacugucagauccagauuuauaugacagauuuuugacuuacuaauuugugggacccuaggcaacuacuagaaugucuugaagacuuaauuuccugcagcacuaccucauagaguugcuuuaaaaaaguauuacuagcuuacagacgguacuguuauaagugcuucaaauauauaaauccucauaaagauucugagguagguauuauuagcuucauuucaugucagagcaaacugaggcauaaagaagucauauagcuuguuaacgguuguauagcuagugucuggcaaaaccaggaaucuuaacuuccagagucugugguuuaaccacuguucacacugucuauaauagcauauaguaauauaagauuagaacuaaauagggugcauuccacugcaaaguucuuucucaccuucuucuacuccauuauuuguugacuauuuacugauccccauguugucuugcaacugugauagauaauagagaacaagggugaacacagcauaucugguucuugcccuccuggagguucuggccauuaagcaaauaacaauuccucccaagguucucaggcuucccuguuuucuccuauuucucuaucuguccagcaguacuccagccaaccaaucuaagacugaccggcgugagcagagaacagagucuccaggaggucuguggccagggccaggcgauuuaugggaaagaggcagacauuuuccuggguuagugaccuuguuuucucuccgaaccuccgcuuaaaauggcgggauuuguaccaagguucuuucccgcaccaaccuuccauuauucacccuucuccccacccccaaggcccgucgggccuaucccugacccgcguuccugcacuugaggugcauuuccgcaccuggauccccagauacuguuuuucccccacguugagucucccgaauuucacgagaacucucucucgcggucucugccccgccccucgcacccaggccccgcgcccgcugugggcugccgcccgggaccgaagcucucagagcccgcagcucugguucaccaaccgcugggugggagccaggcccggccuuugaguggcggccgggguggucugcgcucggccccaggaaaaaucuggcacgggccaaucgcagggaggcgaagggcagcuccggagguccuggccagaagcauuggucacccaggccaagcaggcgucggggcgugggcacaagcagagcucgcggcccugaccgcggccauugugcuuggcugccucuccucaaggccguggugggcagggcagcaacgggagaagcgccgagagcgccacugcaacgacuuuccccuacccucagcuacugugcuuucauguagugaaagaaacagggaaaagguuuggguuccuucugcggcuuaugaagacgacaaaaaacgaaaagagugggggcgggaggcagaagccgcgagccucugcgcgcgcccggucacgugggccgcagggaucgcaug

SEQ ID NO: 14333 - RNA, 1327 nt, Homo sapiens
guuaaugaucaagaaaucugcuuuguuacaaucauuagaggacagaaauauacauacauauuuaaaucuauuuaaugaaaugcaguuuuauguuaaaaaucaaugaucugcuaaccuaaagagucgcacaggaauacuaugauuauuaaacacaaugcgauucucuaaauaaguaaacacgugcaaugauaucaaaguucaaaauucucuaauucuuccacaaagacuaugaaaaucaccuuggaguguaugaaccagcguccuggccccgccaggucggggcuggggcgggcgcgggccgggagcgcuuaccccgcggcaggagcgauucagcgccacuaccugcuucgccugguugugguguggcugcugcgccaaccgaaaggccuccuuaauccgcagcagucucuuuucgcucccauggcucugggacucuguccggacuagcccuguccgcgcucggcuacauccggcccgcccaccagcucagaggcagaguucuccgcggugucuccuaggguuucuugucagagggccccaggcgccuagggagucguuaccgcccuggcauucaaauaacucccgcgagaggcggaaaucccgcgagacugccgacagagcguagggaaguggaaaaguggagccugcaccgcccgcucccggcacccccggacaccgccccggucucacgcaugcgcagagggccgauccaguucuuuucggcuggaauggggaauuugugagguaggccggaagugguguugcggagggaaguguggggagagcagaggcgcagcucugcuggagagaccugaggcuugcagcgcugggcccggccgggucgcugcggcugggcuggaggugaggcgaaagaagggcauccucugaugggaguggaccggaguccgcuaaagcgaagcauuccaggguucguugcgggaaauacagucugguuuugccccccguaugaauugagggaaggugagagcagaagcaauccgggccugaagggcgauuauucuagggucggccgagggguucaggccaaaguucauugaaauccuagcugggucccuggaggacgagaaaaccggucaggagucuccugggaagagggucauguuuuaaucuagcuaaagcugguaccuggcaguuuccacucuuaaggccuaguguacuaacuaaugugugcgcaaugucaaaacaggaaacaaagggaaaugcaagagguggaagguaauuuuaaguuaguggcaguaugacagauuuccagugccuucaggaagguauccagccuuaaagaugcuuuuuuuaaauagacgauuuu

SEQ ID NO: 14334 - RNA, 747 nt, Homo sapiens
cgacuuccguuuccgggucagagccauggugguggcaacuucaagcccugcuaaccccaugguguucuuugaugucagcaauggcagucaggaaguuggccgcacaaagaucgagcucucugcagacguugugccuaagacgaccgagaacuuuggguaguucugcacuagagaauucagaaaagaugggguuccaauaggauacaaaggaagcacuuuccacagggucauaaaggauuucaugauuuaggguggagauuuuguuaauggagaugguacuggagucgccaguauuuaccaggagacauucgcagacgaaaauuuuaaacuuagacacucagcuccaggccugcuuuccacggcaaacagcggucccaguacaaauggcugucaguucuuuaucaccugcucuaagugugauuggcuggaugggaagcauguaauguuuggaaaaaucacugauggacuucuagugaugagaaagauucagaauguucccacaggccccaacaauaagcccaaacuacuguggugaucucaaagugcggggagauguaguccagaccaagacugaauuaggccuucccuucuuggugguguucuugaguaagauaaucuggacuggccccuguguuugcuucccugccugcugcugccccauuugaucaagagacccuggaaguacuggagauucagaauccaagacuguguaaauaaaguuuuuuuguauguggaaaaaaaaaaaaa

SEQ ID NO: 14335 - RNA, 2779 nt, Homo sapiens
guauuucugaaaaacacccagaguuuuauuaccauuaauucagcagaaaguucguugcacugaaauuaucacucuggcucauucagcucaaagacucuucgcugcucaaacacauagcugugugggccauggaaauacaugcugcaggaaacagccucugaacaucgcauccaagaaaaauaaggcaaauuccaaaacacaaaagcaaaaaauacaaaacuuguuuaaauauuucguugcacucacuaagcacaaaaguucauauuuuggggggacuguagagagcuuuaaaguauacagagggacuuacgacaugacaucucuuaagggaacccguucucuuuugaccucauuagcaugacguguccugcacuaugcugaggaagaaugugcagagagagcuccaagucucuccacagaacuccagggcagucuuccucugguuugccauaucuggguccuccacacacucgggagcuuugguggccauggucugggucacugcuaggcuagaggggguggucucuuugccuuugaugugcucccugggggacaucucuguuuucuccuuccugggcuuuguguucccaaauagaguggagcugacuagcuuaagacuggauucuggaaaauccuuucugcacacucugguuuucacagcugucuuggaauaucuacagaugucuuucugugagcgcagauuccgggcaacuuguuuccaauagacucucucauccuugagcuuuaggcaugagguuggauugccagcaaagacacaggaaaauucaugguccaauugagugcacucaaccuugagagagaugcccuccuccugcucaguagcagcccaucugcaguuggcuuggucuuuggugacaaacuugccuuuguucccgggccugcuuuucugcuuaaucuggguguugcccagaguguccuuuuguucugagaccacuuugcugugaaguccauucuucacuuuuuuuuuccccuccaccaggagcaccugagcagccaguaggaggaaggagagcagggugaggcuacagaucuucauggcugcagcugggcguucaccuguuugacaaaaggcaagugagucaguggcaggcagcaguucagcugugcaggacuacacgcuggccucccccuacccugacaggugccuacaugauuucagaguagaccaagaacgcuucuggcuccuggagucacuagacaaacagccugucuacucacauuuccacuugacuugagucuugagugucacaaaaguaccacucuuuggagccucacgaacucucauuuaucauuuauucacucauuaacuccugcaucugcucacuccucacucuuucauucacucauucaacaagcauuuacugagcaccuacuauaugccccccaccagacuagguguugaagaaaucaccaugauugagaaagccucagauuugaaagagcuuagagaccacucuuugggagaauuuaaauagcauugaucagggaaucuaucccgucaucucuguuucugauaugaaacaaguuacugcuccaaacuuucagcuccaaagggcuggauuucuaucucaugacuccauauggacacagaugcccaaaaugagaaaagacaugacagaugcccaaaaugagaaaggaugugguaagcaucaugaaaggugauguugacccagaguugaacaugccugggguuuggguggggugggugggguugugggggugggggagcuuuuuguggggaaguaagaguuuaaggaaaggugugagguggggugguugucugauuugccugggcaaagugaaucaggguggagagaggugaauuucaaccagauaguucacacuacaagaucgaagacaaggaucaugagaaaucauugaaucaauaggaugaacaccaacgucacacugaacugcaugaaucugaucauguguacaauaaaaacccaugcuuaacagaagaagagaagucaguuucuauaugacaccuccugugugcuaaguacuggucuaggguuugauucccaccuugugaaauccacacaagagcucuuccagguagcuauuaauaugucaucccaggugacagcucugacucuuaaggcucagacagguaaguaaauugcucaggaucucauagugggcaaguucaaagcugguauggguagccagaucaaucuccuuauuccuuucugucaccccugguugaucacuuuuugcuuuucacauuuacucugcccuuuaaaaacauugccaaagaauaagaaaaacaacuaugaacaaugacaauuuaguuucauauaacacauaaugauaagaugauuuguauuauuugugcuccauuuaaaacaaaacacagaauuuuuuauaaaaagaggcagacccaggaaaugguccugaucugauuucuacccuagaaguuggccaucuucuaggguuaagaaggagaaagacaaucacaaaagggcagagaacagcaauaaauggugaagaggagacuggauaugccagaaaaacacccagucauuucucacggcccuggggcucagcccccaccugcccaugauggaaugcaggcccaaggaacuccaggcccuugguggagugagaaguggcagcagguaauaaagcuguuaaaggagcgaggcucuuaccuuguucugagcacacggauccagugcaaucccaggcagugcgagugaauugcaggcugcagcugugucagguagagugcaagggggguagacuauucaacagg

SEQ ID NO: 14336 - RNA, 1989 nt, Homo sapiens
uguuuuuuguuuuguuuuguuuuguuuuguuuuguuuuaaauugcauugggauuaggcaacagaagggucuaaugcggccgggaugagacaggagaguuuuuaggaggguagcugcauucuaaguaagggacucugcggggggaaaagaggcgcaagcguugcaagaagggagugcaggggguugagcaggcaccucuacaggaaauggaugcuguccaggugcuggugggcgccccagggcuacguggcgaagcagcucagccgguccaaucagagugcguccagggcucggguuucgcgaucuuuaagugacugaggcagauccccacgcggcaccuggccaugcucucagcucucccgccgcggugaguauguuuaaggaauccuuuccauuacggcggccccauaccuagguccccguccgggacagaggaagccgcaacggguccccccgggcacccgggccuuucuccugccucccgccacguccgaggguccggccgcagcgccgccugagccccuccgcggccggcagugggaggcgggcucuccgaaagccgucgcgguggucccagaagccgggucauaaauaauucacgagccagggucuggcgagcuaagggaagggcggcggcagcggugacuagggcgggagcaggagcgggagccgggugcacggugaguagcuggguccucaucccggagcgagagaggcaucugcugaccaggcgcggggcugagcgcacuccuuccacuguacuggggguguacagugaggaguggacggguucgcucugcgccccccuuacccuagccaucugcgccgccucccuggccccucagcagguggugcgggcccggacagcggcugggggccagaggaacugcggggagagcgugguggugccggugcccguccaacccaaacuuuuuagucugagugguggcccgcgacgccccgcuugggucuucuuuccauccacuggggaugggggcggggguggggguagccggcggccgugguuccggagcgggagucggaggugagugugcgaacuggaccggggccccagagacuucggacucgcucucggggagaacggugaccgaggugagacucgccagggucuugggaacgagucugcgguaaaggaaacucuagggauggccccggggacgugaggcgcugagcuucccuggcugagugcggaaaugggccaacacugugcagccgaccacagcgggaguagggauauggggguacaaagcgaggccaucuccccgcguccgugggagaaagcaugcaccccuggcuugaagcaccuucccagccucucgcuccacggcccuucugcuugcaugcgcggggacccgcggcuaucgcuagauggagaacuggggugcucaaggcgcacccugccagaacacgccgaccggacaacaaagaggagcguggacagaccaggagcuucacggcuguagaaagucagaggcucgggaucaguuuccccgaaagcccgugucuggaggggcagggagucggaucggagggaggaacuagcuccagaaccccuucucucuggcaagaucgcccccgaucggugcccaacaggggccgcggcggggaacuggcgccgacgcgcucagagcagccaaguuacuccggcaacccccuccccugcgcggcugcgaauuccuggagucucuuggcuucccgcgcccgccccgccgcucauucuuuugugucccgcagcucgcgagaggcuuccgcccagaagggagcuaggccuggagggggcuuggccuggaggugguuuggagguaaagggcggggaagccggcgccccaggcuucauucugcaacagguugcuccuggagcccgcuaaggcgacugaccuuucuggagaaagguuugcuggaguuccugagggcggcagcuguucuuuguuaagaaagcaagugcacgaucguaguucuugagugcccc

SEQ ID NO: 14337 - RNA, 6095 nt, Homo sapiens
ccucaucacuucguucucagaacucccguucugacuuauauuuagccuggcaauaggcugacgcaugucucagaugcgaguacuuacaccuuuuaacauaguuagaauugggaaucccacucaucauuccuguuuuuauuugcucucucagaauggucauuguguauuuccuuguugcauaugugguuacuggccuugaacucuggauguagugguuaucaagaacugcagauugaucucuucuguauuuucuuccuguccuugaaaauacuaccaacuucuguuguuccuuuugacauaaaaccaaauaaucaauguuauguuuuugugcuuguuccccacuugauucaucugcagaaguccuagguaggagaguuucuguauagccauauuuuuauuuaggaaucuaaguacagcaaaucaacuuuggacuaagcauuaggaaaucuguguuuuuggcuugguuggguuguugaauugcuuuguaaacucugugcuugcuuagacugcuugccuaaucaguuugguucuguuucauaaugccacuacuagauaguucaguaucugaagcaucuagguugcuucuagucaccauggagacuuaacagaaggcuugguguaaauaaggguagcaccugugaggguagcacaggugaaacaguaccuguguaaugcagguguuggagaugcauggggauagguauugcuuguaaaacaagaaagccugaagucggguauaggugaacauauuguuucuacugguaacagugccauggacccauuucuuucuucuuuaacagugacucuggacuucuaaaacuucaacuuauuauccaucucuuuugccucucuccucucccuuuaaccaugguuagaccucuucuugcuucaccucuguuagagauugagcagaggcaggaagaaugaaacccagaaaagucaacugaauuuuuagcaauacccuuaaaagauuucgagugggacgaagguuuuaacuauucauauuaccuaugucuuauucuuuguguaacugaaaauuugucaguuucuucuuacaaauacauuuuuauuaaaauauguuuucauuuaaccagucuucaccuauaucacauaguuaucccaguggccccaaacuuaaccaaauggaugauuaaagggugacugauucuaaaauuaugaucuagagccaauuaauuuguucacaaagaaaaauaaaaauaauaaaaccgggaaauuacuuggaguaaccacaaaccagauacaaaguaaaauuagcuacuucugacaaacuauugcuuugcuuuuaaaauucucacuugcuuuacuuaauuaguauauauagaccaaacgaacaaugaaaaguuacuuauuuugguuuuugaucaguucagugucuuggcuuuugacaguuuuuaacuuuaacuuaguuuacgcucugaaauucaauccuagcagcucauuugugcuccaauuuggggacuacuugcauaaaagaagucucuggaaagccuauauagcauugacugucaaauuaaugauauucuauucucauuuguaauccuuugcuuuauaaccuuaugaccuuggaaaaagucacuccuuuguuuauaccuguuuuccaucuauacauguguaaauauucuacucuuuacuccucuaaaugagacuauaaacauuuuuucaaacaucuuaaaaacuugaauauacugugugaaaugguucuuuacuuaauguuugacuuaggaaggcagaauugcuguuguaugauugagucccagaaaagcugauuacuaauuggccugguacaagagugugucucuguucaauaagcuuauuuaauauuuuaguguaaccuuaauaaaguuuacuaaaguuuuauguuauuuaagacuauggagauaugcauguuucauauuuuccuaacaguuaaccaguauuacuuuccaaauuuuuaaaugcucaaugcuauuuuaagaaagauauauuuagacauauuacugaacauauaaauauauuuaugauuacucauuacuuuuaauuaauacuuuuuaaucuuugguucuuauuucuaaaauaagcuuucuuagaagauaauuaaacauuguguuuuuucuuuuaggggugaagaaaaagcaauuuauacuaugcuuuuucugaauuuaaguucuggaucacagagcaauucugugguaggagaugauaucauguaaaaauaugcuggaggggcugggcgcgguggcucacuccuguaaucccagcacuuugggaggcugaggcggguggauugccugagcucaguaguucgagaccaguaugggcaacacggugaaacccugucucuacuaaaauacaaaaaauuagcugggcguggaggugugcgccuguaaucccagcuacuuggaggcugagccaggggaauugcuggaacccaggagguggagguggagguugcagugagacgagaucgugccacugcacucacgccugggcaacaggugacagagcaagacugugucuccaaaaaaaaaguauauauauauguacguaugugcuggaggaauugauuuggauuuaugauugguauuauuuuccucauauuacauauucacaguugacggcugggcacgguagcucacaccuauaaucguagcacuuggagaggccaaggcggguggauugcuugagccuaggaguucaagaccagccuaggcaacauagugaaacccugucucuauaaaaaauacagugagccaagauugugccacugggcugcagccugggcaacagagugagacccugucucaaaaaaaaaagaaaauucacaguugucaaaacauaguucuucuaauguuaagcacuuguuuaugcuauaauaguaaaauguuucuuuuuuuuuuuuuuugagauagagucucgcucugucaccaggcuggaguacaguggugcgaucuuggcucacugcaaccuccgccuccuggguucaagcaauucuccuacuucagccucccaaguagcugggacugcaggcgugcaccaccaugcccagcaaauuuugguauuuuuaguagagacgggguuucaccauguuggccaggauggucuccaucucuugacauugggauccacccgccuuggccucccaaagugucuauuuuuaaaaaacuuuuacugaaugauauuucuuccugguaagauugggauaaaugaacuaagauuaauugacaucuuaaaaacugaaaucaguguucagaaaguaaauauuuggauuauuggaaaaauacuuauuuuuaaaacguagagguagauguuuggcauaacaaaugagagugacuguuuugcuuagaaggaaugaaauacugcaaaagucugacagaaguuaagauguacuuagcugucagaguucuuggugauacccauagguaaagaacaguggcuuugcuaaauaauuaaccagucaacuguagccaaaauuauaggacagauaaguucagauaggucuauagaauucuagagagcaauguuuaacaaaauaaaaacaagcgaaacacugaaacgcagguauaccucggcacuggagauugaguggcgcucugggaaaugcagccuucuccaggaaaaggugggaaugguccuggcagagcagaagcagcgaggcuaacucgauggcucuggcagugaggcacuguacccuccuaccuccuucaccaugaaucacagccaaauuauaauugucagagagaugguugaucauuuugauguaggggagagagcacgcuggacuagguacuauucccaauuugucacuuagcuuuucaaugacuuuggacaagucucucaacuucugugaaccucaguuuuuucauaauaugaaaauggacaaaauauggacaccauuaauugcucuguuuaacucucaugauuguugcaagaauuguaugaaguaaugugugcaagaccuuuguaaacugccuuauacuauaaaguagaaggauccuaaucccuaaaauaaagccacuuacgcaggaguaggugagaaggagguaagacaaagcuuucaagauauuuaccuuaugaaacuuuguuguugugguuaguauuucuuuaguguaucauuuaaaaccauuccccagccuauuagcaucgcgcuaauuguacgcaaaguuuacccuuacauucagaacucaccggcagggcuggacuucgagaauauagggauacauggggccugcucuuagaaaguucauggucuuguaagggagcaacuaguaaagaguguagcuucacagaagucagcccaagcugcagugggagcacagguaaaggggagggacagagggcuccuaauuuuccagaaguaacacaguggccuguuuacaaaggcacuugaggcaauaauaggcaaagcuaucuaauggugaaaagcacacucucuagccauagacugcuugacuuugaauucuggcuuuucugcuugcuuccugugugaccuuggagaucuccuuagccucucugggccuugguuucuucaucugcaaaaugggcauaacaguagaaccuguuucauaguugugagagcuguacacucaaaauagguuauguuuuuauuugacuuuuuauauucuccauuguagaaucuaaacuaguguuuauaauuaaaauucuuggauaucuagagguagaauccagacauuguauuguuuuguacuuguaauuaaaacacucaguauuuauguuguaugauaacauguuuacagaaaauuacuuagaugauauauguuguuaaauauacuuauuugucauauuaccuuuuaaugauagagcuaggauugcagaaauaaacauuagauaaccaccaaaccagaacugauuaauacuacaguacuugugaaguuaauaugaaguaguugaagacacugcgucaugcuuugcaguuuuuauauacuuucauacaaauacugucuuaguccuuugaugauucuguggauaaggcaaacagcugacagguauuaaaaaacugcucuaagcuuccauuuucuuuucggugaaauugacaucugugacuggagcagggucacaggacuaauguuuaagacagcugguaccaggacagccuuccucugguugcuaaucccaugcucuucuguggaucauaacacaacucucauuauggucaaagcugucaucuccagucaccagagaagacaccauuguggagaauaauuuuccaaauaaaccucuuuuucuugagauggaguuucacucuugucacccaggcuggaguacaguacacgaucucggcucacugcagccucugccucuggguuucaagugauucuccugccucagccucccaaguagcugggauuacaggcaccugccaccacaccuggcuaauuuuuuguauuuuuaguagagacgggguuucgccauuuuggacaggcuggucucaaacuccugaccucaggugauccucccaccuuggccucccaaaauugaugggauuacgggcgugagccacuaugcccggccccaaauaaaccuuuuuauuuaauuugcuuuuuaaaauugaaaaugauugugcaguaauguguuucuguaucucuuuaacccagauggcauucuugugggcugcguaauuucuuuccuugcacuuaguguggacaaugaggaucuccuuauucccaaacccagggcacucacuggcugugacugcaucaugguacccuguucccucaggggguuugagguucagguacccguuggguuaccuuuacagucacuuagcuacacauacagaguagaggcuccugaaucagcagcagcugcuaccuugagugaagcuuuucacuccuucccugcuaacuccccaagucucagaacaauucugucacaaucacaaguucuuuucucaaguaucuggaaugcucuucuuuugucaugucugauuuuuguuuuauauugguacguuguuauuuauuaagcaauuccauuacuauugaacauuuugauuaauuccaguuuuguuuucauauagaucaucuuucaauagagaaauucagcgguaaagaaaaaugagaaaauaccagaaauuauca

SEQ ID NO: 14338 - RNA, 837 nt, Homo sapiens
ugguuuaguucucaguuaaacauuugcuuucaagaguauuuacuuucuucauuggcaggaucucaguaagacaaaauagcaaaucucucaacugucuguuuacuuacuuagacuugaauauuaaaagcacucuguuguaaauagagauagauguagccaggcuucacuauacuuucuuuaaaacauuucucaguugcaggaaagccaccauuuuaaaagccuuuuuuuguuguuugcguggagaggaaaugaaguuguuugaagccuauugaugagcacagaucuugagcuugcaguaucacuuaacacuucuucccuggcuuuuucugggacuggauaccuggacuuccauggacuucauuauaccacguauccauucuucaccaacaugguucaccauguuuaaggcuggauuuuuuuuaacccauaguugcaggaagucauuaucagggagaugccuccagguuuagcuguugggguaguccuuguucuuuccccaguuccauugauuuugugugaggagaugucaguggccacuccugcuuuaccaagucacacuagccuuggcgaucaggauuuaggugagaauuccaaauuccaggaguauuucagcuggagccacuggccaguguucucucugagccuccacauaagccccuccuucuuuuccccuggugucccugcucugcuagucacauagcuccugccacugcuagcacccagucuguagcuccgauaaccauauuuguuagagguuuccccacuagaaacaauuauuuuaguccuucuucaaugcccaggcugcuaagucuagcgcugcccucuuccccugcucug

SEQ ID NO: 14339 - RNA, 1040 nt, Homo sapiens
gagucauuuugucuuaucacuaggucauauuacagaggggcagcaggagcuguauuauguauauuacauauguaauaguguaugauauuacaaugagagauacaaucaaucaucugacaacuugguuauaagaugucugccaguacuccaauucuaccauuaugcuuauuggaaauaacaguaauuuagaaucuagaagagaaguagacagagaagguaaaacuuuugcguaagaacauggacuuaacuucauuaaaacuucugcuaagauugcuugcaauguagaagaggcauuucuuaacgaaagaaauuuauaaacaaaauccaagaaggagucucucacauugauaauggggcaaauagcauuaaaauuggcccucagcaugcugcugcuaugcaacacauacagguuaucagagagagcagcaggucaggaaaugcugccauuaacucuguuuuuacagucuagcugcccgaaugggguccacucacuuauucuuucauccuuugccuccugcucaguugauacaugaaacuauuuaaaacggcuuuacgucucagaagaauuuaauccuucaaaguaauauaauuuugaauaaacgguuaauguucauuuuaagauggauuuuagaguuuguagucauauguauuuacaguuaauuucuaagucaauuuauaauuauuuuuguuaaauguugucuuguggcauuagcuaugaccugaauuguauuaaauguuacaaagucauccugcauauuuuaaauugguuugugcaguuagguuucccaaauccugugguuaguuaaugcuuagaauuauagaacugcccucaaaaagucugucaauuuucaaggauauaaagaaaaacaggauucuuuuaauucuagauugaucauuuacuuucuguauguaaaguuuaauaaccugcuugguguaauuuacuaaugaauuuuuuaauguauuugcaugaauuccauacuguuuagagcuuaaagcuacagaaacauuguuagaaauuacuuggacacugaauuuuaaau

SEQ ID NO: 14340 - RNA, 30316 nt, Homo sapiens
cccgaaagccccgccccaaggcgcgcccgcccaccgcucuccacgugcucgcuggagggcggugcgaggggccgagccgacaagauguucuugcugccucuuccggcugcggggcgaguagucguccgacgucuggccgugagacguuucgggagccggagucucuccaccgcagacaugacgaaggugagaggcggcggcucgcucaugguccgccgcuggggcccugcccgugggcuacuggggcugcggggcuggucgaagccgcgguguccugggcgcccaagccaaguugcaaaaaucaguuuaaaagaaaaauucucuccuugcggggaucggccuaggccgcugaggaccccagcggucguauugagggcgcgauuccccugcucggggcuagggggugaugguuguagccgcccuuuacccggcuccacucggccgcgcacuugcuccagucgucacccgcgguccuggcaguaacccggggaaagacgcggcgguggggcucccauccgagcuuggaggaagcccgaguuugccaaggugaaaggguuucugaggucccagagucacagggcuccuucccccgcggaagugaaaggucagggaguuaaguagcuuggaaggguuucuagaggaaaagcaugccucucuagagaaaagggcuuuggggagagacccacguuucccagaauuaagagcaucuuccagaagaaaagugaacuccaaaaaauuacgaaggucgcucuucagaugugaaggaucugcaaagggaauggcucucggaaccagcacaagcuugggagucaugccuaagcaccagaaagagaugacugucccugcagaagaacguucuagggggagcuugagcuccagucuccugcagguaucucagugguggagggaccagucgccugaccagugcuaucuccaguacugugccacagccuacccagauaacaguugcucaguuggcuccauugauucccggggagugaacaaucuuagggaaguuagaaccuggcagaguuaccaaugccaaggaaggccguuuucuuugguggaaaagaccgagagggcacuauucuaagugucugugugguuuuguggaaagaucaacugcugggcgggaagacaucuggauucucacucaguccuaccacaccacacaggagcuccugucucaaacuagguuucaguuuccuuaucggucaagggggauaaggcuacuuguucuuuccaccucacagaguugccaugaggcagacaaaacauuuuuaaagucauaaauugccgugcaaaaguaaauacuaaguauuacuagguuugcuuccucauuucugguauuugagaccugagacuugugaaggagaugaagggagugagccgcuaagugcuuagcagagugcuucuacccucccuaggaaguugguacuucucuuacagccucuguguugaccacaguccuuacguggcaacaguccuuacgaugggaggcacagccauuggcuugacuggaacggcauccuagaauaucugggauuugcacuugaggauuguaggggaggaaaaucuucccucuauccuccuagguucuguggcugggccuaagaaaacugacauaagauguauuaacaagagaaaaggauacagauuuuauuuacuauuuuuacguguacacaggagucugcaagaggaaaaugaagaccugaagaagcguugggcccaaaagcuuguauaccuuuuuaaacaaagaacaaugcauugugggggugugacaagacaaaggggcuuggguuaguaaauuguggaauaaugacuaggaaaucauauggggguaacuaacagaagauaagggugaguucaguagguuuauuuguacagguccauuuugguguugacuuccaguuucuggugauaagaauguucuccuuuuccugguacagggagaucaccuuucucaugggaauuugugugaccugcuuuuagggagaaagggaggucagagaguaccucugcaccugcuguuucucaagcgccuuuggcugaaaauaacuaaugugccaaagcgguauauuuuggaguggcauguucugaauccuuucagggucuaucuuggugacaaauagauuuuucuuaaacaaaacaucuuucugcuuuauuugaaagugaagccgucuccuaggagugagcacagaaacccagggcaauguccaggacgggcagugaugggucuugcuuuggcaggaaucugaaacacuugggcaggugcacauguagcugaccccagcaccugcuucuuuuuuugcuuucuucuguccauggggaggacacgguuuggguggaauuauuuguuccuucuggaauuuggggacuccugagccucucuaagggaucuacucuaauucuauuauauuuacguuuuuugcuuauucccagggccuuguuuuaggaaucuauuccaaagaaaaagaagaugaugugccacaguucacaagugcaggagagaauuuugauaaauuguuagcuggaaagcugagagagacuuugaacauguaaguguugcuugugggcucuaguucuuaaagugcccccaaaucgaaacaguauuuuuucuuucuuuucuuuuuugaaacagagucuugcucuguugcccaggcuggagugcaguggcacgaucuugacucacuucaaccucugccuccuggguucaggugguucucgugccucagacacccaaguaucugggaucacaggcaugccucaccacucccggcuuucauauauauauauauauguauuuuuuuuuuuuuucaguagaguuggguuucacuguuguuggccaggcugguguugaaucccuggccucaagugaucugccugccuuggccucccaaagugcugggauuacaggugugagccacugugccaggccaagaauauuuuucuaugccuuuuugucagaagagacaaugccgggaagugcucuggccagaagcagaagugaaagccugugucuuuggaaugcacuuugguacuuucuguuucaguauggaugggucugcaguucugggaagucaggccauuuccagcccaaucagaaaucuauugugaaagacugauccagaauaaucuggaaaguaccagauuuccucagcccacccuccuggcucaaauucacuuuccccacccucuuccucccagcugccuucccaccagccucucuacuucuuuuaacuccccuuuucuugugagagcaggaucccuaggauaguuaauagcagccuaaggguuuugcucuuuuauugccugccugaaguuucaagggcuucucaaaauuuaaaauaucugugaaucaccugaggauauaguuaaaauacaaaaagucuccauggggcuggagauccugaugguagggaaacauuguaacugcaugcuguauuuggcagacauggaaguauccauguaaaccacugcaacuauguauuauucggauuauagauagccuauuggaaccuaauagaugcagucuaauaauuauaguaacuaauaaucgguuaagagaauuuguaucuccucucaauuuuuuaucaguucuuguaguacacagagcauucucaagugcauugauuaauucauuaauccaaaagcuaaccugugaguacagaacgccugccuugcuaauggauggcugucagcugcauuccagagcaucugugcuacgggccucuuauagucauggaucuguuuuguuuggaaauugcccaggauagucaguauccgguucggguauccagucuguggagaaaccacauagauauacaaccuccaagccaaccaccacuuagauuacugcaguguuuuuggugucuuguggcuuuuauugaaaaagguuugagauucauucgguucagcgucaauccgugcucagaugccuugugcagcuguagcauugcuuuccauuguuuuuaaauauguuuguguuagaucuaaucugaaaguuuguuaaauaguuuuugagcuagaauuagaaaggcuacaccuaagaaaucugggcugggcacgguagaucagcaguguaaucuguauuacaccuguaauccuagcaccucgggaggcugaggugggaggauugcuugagcauaggaguuugagaccagccuaggcaacagagugagacccugucucuauuuaaaaaaaaaaaaaagaaagaaaucuggcuugagagcauucuguauuuggauaaaaacauaagugaaaaagaccauggaagcaguuagcagaauagugugauaaugccgaguauguaagugugccuucccaagugaaccgagcaaaauacuuguuuuaaaacgacuauuuccucuuguuuuagaucuggaccaccucugaaggcagggaagacucgaaccuuuuauggucugcaucagguaugagaagaacgugaucauuugguaaacccucaaugagcaucuacuguacaccaaguauuggggcugucuagucauacuaaacauuauguguuggauuguaugauuuuauuccacuauuaagcagaacauuuaagauuaagaggcgauuugcugucaaaaacuacugccuaucuuauauuccucaaucugaaggcuuucuuuauccgguuguggcucuggcuuacacagaauuauuugcaagaguauccucacuuacucugccucucaaaccuauaaguuauacaauuuugccaggacacaaagguuuuaagaaaaaaaagccacaaccaaauuucaccgugcguuuagcccuguugcugcaguuaaaguaauugugugggagcucagugagucuccacauguagaauuccuugcuggaaaugaaugcuugaaagaaauaaagugguugauuugguguaucugugggacaggacuuccccagcguggugcuaguuggccucggcaaaaaggcagcuggaaucgacgaacaggaaaacuggcaugaaggcaaagaaaacaucagagcugcuguugcagguuauuucacuuuuuaaguuuaaagaauccugaggauccacucuuuuugaugaccucucuuuccccuuuuuguccuuuuaccaguugccaccccuuaccacguucacacagaaauaauucaucuuaacaaaaauucaguuccucuugcugaauaugguuggccuuaugauaaauacagaagguuagcuaauggaauuuuauuuuuaauauaucuauaucucauuuggguguuuuacuaccauuuguucgcucuugucauauuagagcuguguuuucccagaaccuguaguguauagauuuuuuguaaugccacccugaugccucccgacuuuuaaauaacacagagucaucagauuuuacaaauaaagagacuaaggaagcaaagcguggcgugcuuguuuaucacuagccaaaggugugugccugucccaguaugucccaggcaggggccauugagucacuuagcauuaagcagcaggacgggccuaauaccgucaagagccaugauuaaagaugcuuuguaaaacauuucugaaacagugauaauuggcuugauuacuauuuaggccuguguauauuauaaaugcucauuaacuuuacuucaaauaucauugaagugguuauuuaauaacuuuugagaguuuuugcugaccugaucuuaauaaaaugcuguguuaauaauggacuuugcucaguucuuuggauauaauuucagcgucaucauuucccugucauuuuuaaucagagaagcucuuggcaauugggaagcuucaucaggaaaucauaguguuucagaaauaauccuaggaauaauugccacuuccugagagccuguacggcucugggaggagcuauucauucucuccaucagccuguccucaccaccaccugggagugagguacuugcuguaaaaugcacucacgucuucauuuuacagaagaggaaaugaggcucagaacauucggguaucagggcugggauuugaaccccagggcuguuuucucagcacaucacaucaugccucugcugucugcucuuugaguugucuuggacugacuccaguuuucugauuccucugucuuuucaagcggggugcaggcagauucaagaccuggagcucucgucuguggagguggaucccuguggagacgcucaggcugcugcggagggagcggugcuuggucucuaugaauacgaugaccuaaagcaaaaaaagaagauggcugugucggcaaagcucuauggaaggugauggaagcaaauuaggaggaggguggugcucccuggcguucugacagccuggcuuuugggauaugagcugccugcuuuucagcgccacccacagcugcguggcuuggcugugaccuccccauugccucagccauuuuaauaauguggucaaaauuaagcccaagcucugcuccuggcucucggcauaugucugauucccccaugacucccugaccccucccugcucugauuacaaggaagccauaaccagguagcucuuaccugagagggaggaaugacaugacagacauaucccacagguuucaacccagauaauguucauucauuuaccuggcaccugcuggccuugugcuaaaugcaagcaccacacagaugaagagauccucuggaugcuugguccuugcccuugugggcuaguggggucccugccaucaggaauaaauaagaugagaccuucagcagauggugccaagcacagugggggcccuggcacuggccaaggguuggcagcuguggggagugggggagagugcgggcucugcagccagucagcaugggcuuaaguccuggcuucaccacuuacucguugggggaccuugcugguuacguggcugaaaucucugugcuucauuuucugcauuuguuuacuagaguuguaauaccgauuucaugggguuuguaucaucauccaaaagagcacaucaaguagggggcauguggcaggccuucuaggccaucuacuguuacucacccaccucugugcugccauaggaagagccaggguugugaaacacgugccuguauccuuucucuucuaaagcugguccugcuuacgaauggguuggaauuuggagccccgacuuagguaaaagaaagcaaaaaggucuucaguugccacguuagagccauugccauacgcuugcuuugcaguuagcacuuggggcugcagcauuccugauacagugaaggagaacaaaacgggcuuuucuguggaagccucuucucuucauuuaugugguagauuuagagcuucaaagaccccacagcacaggcccuuuuucauguagaugaggauucugaagggaagugccugaccggauacccucugguucugcuuuguguggccauguuuucuagcuuucugcaccauaccaucugcugcccugggucagaucacaaaaaaugaauccagguccugugugccaauuguuuuugauuuguagucuuccucuuuuguuuucuguaagguaagagugucucuuaguuggcaggcagucagcguucuugagagguuguuugacagucacuuuaucuuucuucugccaguggggaucaggaggccuggcagaaaggaguccuguuugcuucugggcagaacuuggcacgccaauugauggagacgccagccaaugagaugacgccaaccagauuugcugaaauuauugagaagaaucucaaaagugcuaguaguaaaaccgagguccauaucagguaauucaggauugugucacagacucgagauguuacagccagaaggagcccuugagauccuaaaauccagcucccucacuuuuuagaggaauaacuugagaccagagauuugagaugacccacuuggguccacauggggagcuggaauagagcugaguuugagguucuuucuaucuuuccuugccuuugagagagagagugccaugauauacuauguauguguauauuucauaacuguguuauucagacacaauuaacaugccauagaauucaccaaugcaaagugugcaauucagugauuuuuuuuuuuuuuuuuuugagacaagguuuugcucuguugcccaggcuggagggcagaggcaugaacaugggcucaauuuccugggcucaggccucccacccuagccuccucaauagcugggauuacaggugugugccaccaugcccagcuaauuucuuaauuuuuuguagagaugggucucccgcuguguugcccaggcuggucuuacacuccugggcugaagcaaucucaccuuuuccuccuaaagugcugagauuacagccaugaccccgccaugcggccugguauuuagaauauucacagaguugugcuaccaugaccacaaucaauuuuagaacauuuucauaacccccaaaggaaacccuauacccauuagcaguuacucccuguuucccauucccuaaagccagcaggggauggacacuuugguuguuuuuaccuuuuauuucuuuuugguauaugccuaggaguugaauugcugaaucaaaucguaguucuguuuaacuuuuugaggaacuucacauggcuuauuuuggugaauuauuccuaucaucacuuuuggacacaaaugaagaacacagcaugccuaacuagacaugggaugagaauuucugccucauagauucccuuagccuagacuccagcauuggugcucccaggugucccugaaugcugugucagugggaggcuguuggagcugaaagccugcucguccaguuccgucgcucucuugggaucuccagcccuuuaagcaaaccaacucugagcauuugggaauuuauaauuaaaacaaaugaacagguauuuguuugaccuaaagaauucuuuauugucaaaguuguuucccaaggguacuuccauuuaaaagaauucuuuaguacuuaauugugauuagaguucguguuuuucaggaaagcaucuaugguuuagacagagugaagaaaaauuaauagucuguagaaagcacaguacuuagagcuugauaaaauuucuggaaugguuaguauauguuuaaucuauagcaauguuuagguucuauaaaaguaucuuuuuggucaccaaauagugguuaugacagccccucuggugugccuggaauuuaucauacaaagaugcaugaagugguccuuguccuugcagaaagugaggauguuguaagaaggaauagggagguaaauggcauuugcagaggguacugcaggaucagagggaugagggggacugccaaagaauaugaagcugcuggugcgauugugcacaccucuauuugcagcuacucaagaggcaggcaggagggucugucaaguccagaaguucaaggccagccuagggaacauagcaagacccaucucuaaaauaaaaauuuuaauaagaauauggagucuaggccaggcaugguggcucaugacuguaaucccagcacuuugggaggcugaggcagguggaucacuugaggucaggaauucaagaccagccuggccaacauggcgaaacaccaucucuacuaaaaguacaaaacuuagcugggagugguggugcgugccugugaucccagcuacucgggaagcugaggcacaagaauugcuugaaucugggagauggagguugcagugagcugagaucgcaccgcugcacuccagccugggcgacagagagacacugugucucaaaaaaagacuggagccuaaggagaguccugcagguugcuuagaaguuacaguacaagagaguggggcaggacaguucaggugaggaagcugcaaaacuuguagccgagcaaagggaaaagaguucagcagagaccaggcaggacgcaugggugggguaugacucguuaaacugagacauagccgcgcuaagcacucuccauuguaggucaguguauaucagagaaacacaggcaguucuuccacaagggcaggacuuuaaucagacaucaaguacugaguuaaugauuuaaaaugcccacauugcacagccuuguuguuguuguuuuuuuuuuuuuuuugaagugauuuuuaaaacuguuucaucuuccgauuuaaaauuuuuuucccuuugaagugugcuggucaucccaccaugaugcaguccuaguuuaaucauuuuaacaaguggauggcaaaugccggaggagcauuccuuggcugugguuguugcuggucugcaggaggauagaauuucuuucuuggccuaguuaccguggccagaaaucaauacaaagcccuuuugugcuccuagccuagaaagaagagcaauauggcaucaguuuucuaguuugaacuaaggacuguuuccauucuguuaccccaccgaucccauguuuauuaaguaagaacuaacuaguuuucucacuuaaagaugccucaagcaacaguugaaacugugagaaacagugugugacaacauuaaaaagauagaauucaacaguucuuaaaaagcaaauaaauaggauauuuuuuuuccagucauugggauauagcuuugguuugcugucuguugguugauuuuuuuuuuuuuucauuuuuagaaauaaagcaauggaccccuuaccuaucuuuaagcacucuuuguggucucagagccuauugcuaauuuuauuuuuuuaagagacaggguguugcuauguugcccagguugggugcuguggcgagaucguggcucacugcagccuugaccucuagggcucaagcgagccucuugucuuagccucugcaguagcuaggacaauaggcaggcaccaacaugccuggcuaauuuuuucuuuuuuuuuuuucuguagagaccaagucucaacuuguugccuaggcuggucucaaauuucuauccucaagugauccuccuucauuggccucuaauuucaucuuuauuauaucuuaccuuauuuguuuuagagacaguuucacuuuuuugcccaggcugguuucaaacuccugagcugaagcaauucucucaccucagccuuccaaagugcugggauuacaggcaugagccaccgcacccggccuucuaacuucaucuuuaaauuaaaauuguagaaauaucugaguagauuggagagaggaaauuaauuauauagacuguagacuauuaguugacauuguauuagguaccacacaugacuucucuuaguaauucaauaaucuuuugauggaagaauuacagaccucauuuuauagaugaggaaauaggcuuagaaucaagugacuugcccaagaauauacagaaagcaaauaaugggaccugauaauugaaaccuuaaugugcguauacuuuaagaguuuguauauuauacuuuuucacacacugugaugagcuuuuucuguuauuuugaaauaaagguaacaguauauuuacuuuuucccucuuucuacccuauagacccaagucuuggauugaggaacaggcaaugggaucauuccucaguguggccaaaggaucugacgagcccccagucuucuuggaaauucacuacaaaggcagccccaaugcaaacgaaccaccccugguguuuguugggaaaggaauuaccuuugacagguauuuuuuaugguguccgugcuuuguauuuuggugaauuauuugugugcaguuuaauuacuugguuauaggguuuuuugguuugauuuuuuuuuuuuuuugaggcagagucucacccugucacccaggcuagagugcaguggcgugaucucggcucacugcagccucugccucccaggcucaagcaauccuugugccucagccucccaaguagcugggauuacaggcgugcaccaccacacccagcuaauuuuugcauuuuuaguggagaugggguuuugccguguuggccaggcugguuuugaacucuuggccucaagugauccgcccaccucagccucccaaaaugcugggauuacagacaugagccacugugccuggccgguuuauaguuugauacaaaagcaugguguuugguugaagguauacauuacuuuaaauuuauuaugcuaccaccucuaaaaugcuuagaauaugucagagacuaucagguauuuugcauguguuagcccuaaccauaccccugugggcuagguauuguagacauucuccagguaaagaaaccaugacucagaguuuaaauaauuuguucaaaguccuauaacuaguaaguggaguccgaagucaaacucaggugugucguguccuuuuuuuaaaaaaaauauagagaugaguuuucacuguguugcccaaacuggucuuaaacugcugucucaagcaauccucccaccucagccucccaaagugcugggguuauaggugugagccauugugcucugccuaaagugucuucagauuuuucugccaugcacuuugcuuguccucuguggcuguuaaagauucuccacgagguuaguggugaugccccuguuuguauuaugcugucuucccuuugcuugcuucagaugauuacuucuuuuagcugaccagucuagcucccauuaaucuuauucaaccauaaguauuucuuagaguuggaaacuguaucugguuauuucagccaaggagaggcugaacugagaaagauaguggaguuugguauuucccaugggaagcauuugccaccaaacacaaguuucagggaugccagcgaguaugagacguaaaaagggcuacuuagcaaaaaaacuagguuagagaaacccaugagggguuucauuuuuguuuuauuugcuuaacuacaggacuucucaggguacagaauauagcauuuucuguauuuccuuuugaaggaacccugauuccugggaaucauguuaccuggaaacuacuuuggaaaaugcugcuagagaaccauacgauguugauguccccuuguacauuuuugugcccuuucuggaaugcuucuagacguaggaagccccugucauuggcauagcuugcugucaguguggucuccuuguguuagcaggucaaagugccuccuugugucucccacccacuaguucacauuuucuccuuuaaagcauugaucuccaaaugguuuuccugguauagcccaucaguaaaagaucuugagugcaucccuuugaaaauaugcaugcuuuuuuauaaguuauaugcauuauacuauuguacuaaagugucuauuauuuuauuuauuuauuuuuuugagacagagucuagcucuguugcccaggcuggagugcaguggcguaaucucggcucacugcaagcuccgccucccggguucacaccauucuccugccucagccucccgaguagcugggacuacaggcccccgccaccaugcccggcuaauuuuuuguaguuuuaguagagaugggguuucagcuuguuagccagguggucucgaucuccugaccucgucaucugcccgccucggucuccugaacugcugggauuacaggcgugagccacugcgccuggccacuaaaguguguauuauaaaaacaauacagcaaacacaauuuagaaaguuaaacuuuuuuuuuuuuuuuuuuuuuuuuuaguagagacguggucuugcuauguugcccaggcugguuuugaacuucugagcucaagcaaucugccugccuuggccucccaaagugcuaggauuacaggugugagccaccacacccagccuaaacuuuuguuuuguuuuguuuuuugagacggaaucuugcucuguugcccaggcuggagugcauuggcgcagucuuggcucauugcaaccucugccuccuugguucaagugauucuccugccugagccucccgaguagcugggauuacaggugccugcuaccacuccuggcuaauuuuuuuuguauuuuuagucccgaguagcugggauuacaggugucugccaccacgccuggcuaauuuuuuucuauuuuugguagggaugggguuucaccauguuggccaggcucgucucaaacuccugaucucgugauccccccaccuuggccucccaaagugcugggauuaccggugugagccaccacaccuggcccuagacuaaaugucuugccaauugugacacaaauauuuuuaugcuaagggugaaguuuauuguuaauuuaaguccacauuuguaauuuuugcugagaauaaaaacaaagaggccuaaacccaaagccuucuuuggguuuagagaagguuuccuugcaggagugucaguuuuagcugaagaugugaagaaucaggaggaauuagcucaggagagacuagggacaggcauucuagugcagggaaacauggugaaggcuguaaggugggaaggagcaggguaaauuccugguauggcaagaguaccagugugccugcacacaagagcgugauggagagaaggggcaagauacggcuagagagguacacagaagcuuggucgcugcgggccugcuuagauuuuugcacucugcucugagaacaguuggccguaacugaaggguuuccaccaaacagaaugacgugagauuuauacauacagugaaauucacccucuaaguggccagcucaaugaguuuuaacaaaugugugcaccuugggggggugcaguggcauacaccuguaaucucagcuacuugggaagcugagguaggaggauuacaugagcccaggaguucaagagcagccugugcaacauaguaaaacaccaucuuuaaauaaauaaauagauagauuagauagguagauagauugauuuuaaaaaccaaagaacaaauguauacaccuaugcaccguucaccacugucaggaaaauacaacauuuuuaucaucccccagaaguucccuucugccuuuuuguagucauuccccaccugcccuugcuccagacagccgaucaucuuccuauuacugcagauuaguuuugccuauuccggaaagucauauaaaugcagucuuugaugucuggcuucuuucagcguaguaucugggguuuaucuauguuguuggucaugucagccauucuucuuuucuauuguugaguaguguucaauuguauggaaaugccaaauuuuguuuacccauucaucuauugguggaaauuuguguuguuuccaguuuuaggcuauuaggaauaaaguuaagagcaucuguaagccuuuguguggacguguuuuccuuacucuugcguaaauaccuaggaaaacagccacuguguuguauaauaacugaguguuuaacuuuuaagaaacuaccaaacuuuuccaaagcggguacauuuucacuucuaccaucaauguacaaagauucuaauuguucuacaccuuccucaguauuugauauugucagucuuuauaauucuagcuguaccagugaguauacagugaucucucuuugugguuuaauuugcauuucucuagugacuaaugaagucggucauuuuuuauuuuuugagacggagucucgcucugucacccaggcuggagugcaccucggcucacugcaccuccgccuucuggguucaagcaauucuccugccucagccucccgaguagccgggacuauaggcacacaccaccaugccuggcuaauuuuugcaucuuuaguagagacggguuuucaccauguuggccaggcuggucucaaacuccugaucucaagugaucugccugccccagccucccagagugcugggauacaggcaugagccaucacacccagccaaagcugggcauuuuuuaaugugcuuauuggacauugguauaucuucuguaguaagguauucaaaucuuuugccccuuuuuauaggaguguuggcuuuacagaauuguaagguuuuuuaaaaauauauuucauuuuaagugaguuuuagauuuugacgcuaugcuucacuuugaaucuuuguguauggugugaaaagaccugguuuguuuuugucuuuuuuuuuuccuauguggcuguucauuuacuucugcacuguuuguugaaaagacuguccuuuccccacuagacuaccuuggcaccucggguggaaaucaguuguccauauaauuguaggucugccucugggcucuguauccuuucaccagugccugaagaccaaauaucuugauuacugcagcuuugaguaggcuugaaaucuagucacaugaguccuccagcuuugcucuucuuuuucagaaugacuuuggcuacauccuuugcaucuucauauacauuuuagaaucugcuuggguuuuuuuuuuuuuuuuuuuugagacagugucucacucuguugcccaggcuggagugcaguggugcaaucuuggcccacugcagccucgaccucccugggcucaggugauccucucaccucaaccucccgaguagcugggacuacagaugcgaaccacuaugcccagcuaauuuuuguauuuuuuauagagaugggguuuugccguguugcccaagcuggucucgaacuccugggcucaagugauuugccugccucagccucccuaagugcugggauuacaggcgugagccaccacacucggugaaucugcuuguuuuuucacacaacaaaaccuacugagauuuugauugagauagauuuuguguguguguaaaaaugugcuguuuuuaugguuaaugaaaugacaguggugagacugauacagaaagacccguuaaggagaccugacaaacauccaaaugacagaggguaguagcaucaaugagggcggcugaguagaaaauaaguggguggauuugagagagauugaaaaagugagccaaagcugauugcugaucuuuaacugguggcuaccuuagaaccauagucauaggaauuagagagcagaacuuccagaagaggccugcagauaaauguggcagguggacagaagaaaaacuucaaauacaacagcguguucccuuuguccaugggguuuacccauguuauuuuucuucuuugagccaggggaucaucuuuaauucuuggugaacaugccaaccaucuaaguaacaagugcuucugagguaagugagaauuaggauuuaauuuugaaggaaagcagacuucagagcagcaggcagaccucucuccagugagccaccagggcacaugagcagcagaucucaauuagaacuuagagucgaagccccuggcucugugcuuggccugugaagcauguugcuucuggacuccuacggacuggaagcagaaaaaccacuagcuaguuagaagccucugggggucagguaguuugguuucuugcuaauugcagccuuauucaguucucauguugaaguacugucucucagccauugggccugugccucauuuagguuguauuuugccaucagcaggauauagcacaccuugugcaguguuggaaggaaauguuagcccucuguccugucgguuucagagaaaugccuccagucaucucugugagcucaucagcuuuucuuaacagcucaugaccuucacguuccauaaguugaucaauucauaaaauuugcugaauagacuaugugggugucaggaguuaaucagacaauacagagauggaauuugcacagucuugauuuuaugauauaguaauguuuccaguggcacuguuuaaauuucauucaaguagaaauaaaaugagcuaaaggcugggcgcgauggcuaaugccuguaaucccagcacuuugggaggccgaggcuggcggaucacgaggucaggagaucgagaccauccuggcuaacaaggugaaaccccaucucuacuaaaaucacaaaaaaauuagccaggcaugguggcagcugggacuacaggcgcccaccaccacacccggcuaauuuuuuuguauuuauaguagagauggguugcaccguguuagccaggauggucucgaucuccugaccucgugauccgcccaccucggccucccaaagugcugggauuacaggcgugagccaccgugcccaucuguacuuuuuaaauaaagugauuuuggccaucuucuuugcucuuaauauugcacguuguccauuuccccauaguggugguaucuccaucaaggcuucugcaaauauggaccucaugagggcugacaugggaggagcugcaacuauaugcucagccaucgugucugcugcaaagcuuaauuugcccauuaauauuauagguaagugggguaacggauuacaucucauaacgcuucuggauucuagccaggugggagaagagagacaacagauaugauuuccccuaaucugaaaagauaagaaaugauuuuuaaauagucaucaagcaguagcuauuuagcccagauaaguguuuuacugucugagcugauugagcuaaauguaucuugcaaccagugggcuguaacuggaauugauuuguuucacuucugcaaaaaguggcuagcagucaggggcacauaaugucaaguuuguaguugacauuaugaaacuugcuggguacuugggguggcaggacguugcuggcucauugacugauugcuucguaggauuguggccggugaaauggcacaacacacagaaagugccuagaacagaaaaagugcucauuauguggcaguucuuaguaauggaagauacaaacucccaggcacaguacugggaguuuguauaauagcauugcucauacucauuucagaggagacggggaaggaggagagagucuuagguuaaauaauaaugcccugacucuuguccauugcacaaggaagguagaauuggaauccaggucucagacaugccccccuccuucacuaucauaguccuuuuuuuuccugaacuauuuaaaagucaguugcagacaucacgacacguccucuaagaaaaaggacauucuauguaaugacaaaaccauuaucuuuuccgaggauuaauucaguaaccuaauucaaguuuccaguuguguaaaaaauguccauuuuauuuauuuauauuuagguuuuuuugguuuuuugguuuuuuuugagauggaguuucgcucuuguugcccaggcuggagugcaauggcgcgaucuuggcucaccacaaccuccaccucccggguucaagugauucuucugccucagccucuugaguagcugggauuacaggcaugcgccaccaugccugguuaauuuuguauuuuuaguagagacgggguuucuccauguugaucaggcuggucuugaacuccugaccucaggugaucugcccgccuuggccucucaaaaugcugggauuacaggcaugagccaccgcgccuggccuauauuuagcuuuuaaauccagaaacuaaucaaggaccacacauugcuguuggugccccuuuagauuucuugauucuagacccuauuccuguuuucuuccacggcauuagcaguuuugaagggucuaggcuuguuucaugauauucugcaauuuguauuuauuugaauugcuucuucuugauuagaaucaaguuagacuucuuugggaagaaugcuacaugggugauguguacuucuuguugcugacacaucaugucaguugugucauuggugauguuaaauuugaucaguucguuaagguggccuuugugucuugcuucucauggcucacagguggccucuugucccauagguggcauguuuggacccaguauauacugugugccuucauauauuauuuccaauaggucuggccccucuuugugaaaauaugcccagcggcaaggccaacaagccgggggauguuguuagagccaaaaacgggaagaccauccagguuuguaaaugugagacacagcacuccccauccagcguuccucaggaaucccgugguggccacauaaccacagcuaggaugcgugcagagccccagaaccauauuaggggagggugcugucuuuagugcuggguagccuuucuuuuccuucccuuuccugaaauggggucucgcugcaucacccaggcuguagugcaguggcgugaucaugucucacugcagccuugaccuccccaggcucaggugguccucacaccuuagcgaccugaguagcugggaccacaggugcgugccaccaugccuggcuagcuuuuuguagacacaggguuuugccauguuucccaggcuggucccaaacuccuagacucaagugaucugcccaccuuguucucccaaagugcuaggauuacaggcgcgagccaccauucccggccccugaguagcuuuucuugcaaaggcagaaguaucuuuuuugggggauuuugaagaauguuuuuccagacuuauuguuccucccauuuccuguaugcuauacauguguauacacacguuuccaugaauuugcugccagcccugcagagggcggcaaagcaguaaaauugugggcuaucuucuggauauaccugugcuaugagugacuuuuuuccauuguagguguugagguagaacauacuguccuacaucaugggcccugcacugaaggggauguggcagcagguccucuggguggcacgugcaugcagguguguacaagccacucagaaaacgacuggaccucuauuuaaaagaaaggaauauaguuaggaaguguuacugaaguugcaagaguuuucauuucuaggauugagacugccauguagcuguagcuuucuuaaagcucuuuaaccucauuuuuggaaaucuuuacauuuuuccccuucuuguuacaaaguuacggguaaaauggacuagacauuuuucuauuuauuuuggcuuccaaagucaucaacauuaggucaucagcucugguacagugauuauuauauuauuauuuuuuuauuuuuaauuagaaaugggguuucaccaucuugccuaggcuggugucgagcuccugggcucaagcugucugcccaccucuaccucccaaggugcugggggauuauuaaaucauauuugcucuccagauuagauauguuccuauucucauugaaguaugaaugguuugauaaugacacacgucacaguagcuuuuuccaacuuuuccgucgaacacuguugcaagugucuaguuuucauauucuuuacuugcgcugucacccuuucuguuuuugacccucugcagguugauaacacugaugcugaggggaggcucauacuggcugaugcgcucuguuacgcacacacguuuaacccgaaggucauccucaaugccgccaccuuaacaggucagaccgcgcacuugccuugauuuuguuugaaggaagucuuguucguugcauggauuucacacacuauacuuguggcauuauuuugcuaaaauuuggcuugguccauuggcauucaaagaucuuucaccagaggaauuguucugcaguuguaaaauguuuugaauauuagguuugucguuuuaaaacauuccaagcuguacuuuuuuuuugagacggagugucacucugucauccaggcuggagugcaguggcgugaucuuggccuccugaguucaagugauucuccugccucagccucccaaguagcugggguuacagguacgcaccaccaguccuggcgaauuuuuguauuuuuaguagagacgggguuuuugccauguuagccaggcugguuucgaacuccugaacucaggugauccacccgccucagccucccaaagugcugggguuacaggcaugagucacugugccuggccuaauuuuuauauuuuaguagagaugggguuuaaccauguuggccgggcuggucucaaacuccugaccaaggugauucaccugucucagccucccaaagugcugggauuacaagauuacagaagugagccacugugcccagccugggcuguaccuuuaagcagaaauaacaagugcgccagaucagcucaucuagagugacaucuaaaaaugauguuaagagccaggagcgguggcucacaccuguaaucccagcacuuugggaguccgaggcagauggauuaugaggucaggagaucgagaccauccuggccaacauggugaaaccuugucucuacuaaaaauacaaaaauuaguuggguguguggcacgugccuguaauuccagcuacucgggaggcugaggcaggagaauugcuuaaaccccagagguggagguuguagugagccgagaucaugccacugcacuccagcuuggugacagagcgagacucccucuuaaaaaauaaaauaaaauaaaauaaaugauguuaagagauuguuucuguuacaauuaccauuugauacagaucugaaaagauuagugauaaauccccaagucaauagcuuucuuuuacuuuuuuaaacuaauuguaauguaucuaauacccucugagcuuucagagcuuuacuuuuuuuuuuuuuuucuucuggaacuuuuuauacuugaugucauaaggaaauaaaaacauuuuaccagaguagcaggauucucauuuaacaagugacacagugugaagccagcgcuuuaaggccaggcucagguggaacucccagcugugccacuuacuagucaguuagccgugggcaaguuucuuggcccuuuugagcauugguacuuggggacaauuccauuugcuuggaagagcuguaaaggcuggagggaguuucuugaaagccucuuuaauacaggcugugacaccaccagcccuggagggcugggaauagauuccuaaagggaugacaaacaaguguugucuuauugccaaaucccaauguucauaaucuugcauccaaauguucucuuccuaguaauucauccugacucuaccccuuuuuaaaaaaaauuaauuucugaaucuuaaagucagacucuaccucuuuuaagaugaaaauuuagaucauuuuuuauccuuugguuuuauucuugcccuggucauguugagccuuuacuuuggcagaaaucauguucccuuuuguauguaggucuaaaaauaguccacaggucuauugcuaagaguuuuuuuucaaagcuggcauuauaguguuuucaugguuuuuggucuaucuauucaguuuagcaaacacuuuaccugaaaagcagagcuucuagggugggggguugggggaggcacuggcagugaagcgaguacccccuuacuguaaaugaggaaucacagaggauagauacaucagauacgucaaguucuacaauuuaaacauaacguucauaauuaccacuuggggaauacuuuuccuagaugcuuaauagcagcauucuaccccacuuuuuucucagucugagggguugagaaggugggaaaguuggcccuacguaagcaagggugaccuucugggugagcuuucagaccacaccaggugaugguuccccaaauacuacugagccccuucugaguuccagaagcuaggguuccaagaggagaauaagaaccaguuucuaaacucaggcucuugauaggaggaaguacacagucuucagaaauagaagaccugauuuuaaaacuuguccuaacuuuuaauagcacguuaaaaguuggacuaggcuuuaguugucucauccauaaaagggguauaauagcaccucguucacaggaaggaugccgugaagauuaaaugagacaauacagguugauguccauggcccaguacaucauagacacugaaacagauguuacuguccuuugccuuugaaaggcaggccguaccccagauuguaggaacagugacauauucggggauggccauauccaaucacaguguuucuuuucauuuucuuaaugcuugggcauaauuuaggauugaaugaguguggugcuauccucacuuuccuuggggcuuugauguuucuuccagacuaugagcaauucugguaacauugaucagugagcaucacaacacagggcuccaaacgugccuuguaaauaaaaaugggaaguaugccucugcuacuaguaguucugaaaugggcuguggaaauaauucuggaauuauagagaauaaacuauuuagcuauauaauaaaaucaucuuuagagccguggucccaacuggaccaccuuaaauacuuaugucugccauuuuuuauuacuuuaagggaagauagcauggucuuguuugaggggauuguucaucuuuucuaugacaaauuuuaaaacugauagaugacucuuaggggguugacugaaauauuuugaggacaagugaauaauuauauaaaaaaccacuaacuuguaaaguauuaauagguauguauauauugucccucaguaugcgugggggauagguucuaggauccccccucagauaccaaacccacgaugcucacaucccuuauguaaaauggcauaguauuuauauauaaccuauguacauccuccaguacacuuaagucaucucuagauuaguuauacugccuaauacaauguaaaugcuauguaaauauucguuacacuguauuguuuagggaauaaugacaagaaaaaaaguccguguauguucaguacugaugcagccaucucccccgcuucaaaauauuuucuguugacuccauagucaacagaacauagucauauuucuguugacuccaaaauauuugguugacuccauagaugcagaacacacggauacggagggcugacuaguuaguacuaucuucaaguuucaguuuuccuugggagagaugcuaaugagcaguuucauguaaagacaugguuaagaauuuaaggagcaacuuggacauacuuugcauugcagggagcaaaugccaccuugugaagacuauagauugcccccaguuucagugcugccuccucugacauuccauauguguguccugguacugauggugguggguucagugcuuguccugauacugaaggauaguaagguuugcuuuuccuuucaauaaauacuuagcuccuuuaugccaggcagugugcuuucugggcccuaaggauaugccuaggaagcagacguguuccuugacucagcgcuuacagaugggccaggcaaauaacaaaugagauuacuaggagcucauaccacaacuaaaggaggcagcacuaaguggcuguaccugauugucucuucucaagaggaccugcaaaucuggauuuuuaaguugauuuuuuaaaaauaugcuaauuaauguaaaaauagaagucagccaaugggacacaacuuuguuggagaaaaaacuaaagaugaaacaaguaaauauuaugcaguaauaacagccaucaaagucuuauagcaguacuuagaugugauuaaaauugcugaaaaauuagauuccuuaaauuaugauaucuccauccaguggacuauuuuuacaucauuaaaaauauuuuccaacauuuguuuauaaaagaggaauaauuuuuucucuuuuuuuugagacggagucucacucuguugcccaggcugcaguggcacgaucucagcucacugcagccucugccuccuggguucaagccauucuccugccucagccaccugaguagcugggauuacaggcaugcgccaccacacucggauuuuuguauuuuuaguagagacgggguuucacaguguuggucaggcuggucucgaacuccugaccucaagugauccacccgucucagccucccaaaaugcugggauuacaggugugagccaccgcgcccagccaaagaggaauaggauaaauuuuuaaagcauaaaaggaagaacacagccaggcgcgauggcucacaccuguaaucccagcacuuugggaggccgagguggguggaucacgaggucaggagaucaagaccauccuggcuaacacggugaaacccccucuccacuaaaaauacaaaaaaaauuaaccaggugugguggcaugugccuguagucccagcuacucaggaugcugcgggagagaauggcaugaacccgggagguggagguugcagugagcugagaucgcaccacugcacuccagccugggcaacagagcaagacucugucucaaaaaaggaggaacacaugcuugagcacauacaggauggccuuguuuuuuaugaaaauuuagaaguugggcugggcaugauagcucaugcuuguaauccuggugccuugggaggcugacaugggaagauugcuugagcccaggaguucaagaccagccugagcaacauaaugagaccccaucucuacagcaagaaaucuuuuuuuuuuuuuuuugagacagaguuucgcucuuguugcucaggcuggagugcaauggugcaaucucggcucucaccacagccucugccucccagguucaagcgguucaagcgauucuccugccucagccuccugaguagcugggauuacaggcaugcaccccacgcccgacuaauuuuguauuuuuaguagagacaggguuucuccauguuggucaggcucgucucaaacucccaaccucaggugauccacccgccucagccucccaaagugcugggauuacaggcgugaggcauugcgccuggccuuuuuuuuuuuucuuucuuucuuuuuuuuuugagacagaaucucgcucuaucacccaggcuggagugcaauggcaugaucucagcucacugcaaccuccgccuccuggguucaagcaauucucccuaucucagccuccugaguagcugggauuacaggcaccacgcucagcuaauuuuuguauuuuuaguagagacgggguuucuacauguuggccaggcuggucucgaacuccugaccucaggugaucccacccgugaugggauuacaggcgugagccagcaugcccggcccaaaaagaaauuuuuaauuagcuggguguggcagcauguaccuguaauuccagcuacucaggaggcugaggcggaaggaucacuugagcccaggaguuugaggcugcauacagugagcucugaucauaccacuacacugcagccugggugagugagaccuuucucaaaaaaaaaaaaaaaaaaaaaagguuuagaugucuggaaggaaauuucaaaaauagguuaacaguuaucccuaaaaugaaauuauuggucaaauucaguagguuccuuuuuugcauuuccuaauaauuuaagugaauucuggccugaaaaacauaaaaauauguuaaguauguacaggaaagauuuccuaagcuuaucuauuuuugaaaaugaggaagccauuaaauaggguacaugcuaagguuuccaucuggguggcggaggagcccauuuugccuggagagacugcacgugaccugagggcuugugucuuacaggugccauggauguagcuuugggaucaggugccacuggggucuuuaccaauucauccuggcucuggaacaaacucuucgagguaggaauaauauuuguauaucuaaauuguagagauggugaauaaauuauucuagccuuagaaggauagacuucuucaacccuguguuaaagugauuuuuaugccgcagguuugccuuugaauugaaaaugaaccacagcaauagauugaguucaguggcauuggguuuuccacaaaugcuccuaaaggaggggaugaugcccccugcuccccuccgguagccucagcguccugugaaaauaucucacgaacacuguggucauaguuuuagaaucccugagguagaaaugguuuugaagauggcuuuguggagcagcguuugugacugcgugucgugagucauauaagggaguucacccugcaucgaugaggaugucuucagaccgcugugcucugugccucccuccaugcccuucacagccagccucuucccagcagucacccucacuuccacacacacacacacacacacacacacacacccucacuuacugccauugguuuucgaauguccacaccacuguuagccuaacucagccugucuugaggcagcaggugacucuguggccuccugacaccugguucagcuucugugauaauccuuucuugggcugccuccugugauucuccugcuccugucuccugacguguuuguucccuuuggccgcccuuuggcugguguucaauucaaggccauaggcucuuccuacucuacacauuccucacauggaagcuccagccaacacauguugccugauggcucccaucucucucccgagucccagccucuguguacccauguggcugcuagacagcuccagcuggcugcuuacucauucauucaacuaguaauuaaugggagcuuacucugugccagugggaggggagacaaacauaaaauguccccaaauauaauccugagggugguuuaaggucuaaacuuauuuucacucuaaacugcuucuccuucauauaugucaucauucacgaagcccaauuuucccaguucugcaauacucagccccaucaucuucuuccaggccgggccaggaaccucuccucuggccucccacauaaccguuaucccucucuuucauggcacccacaauauuguuguuuugacuuuuaaaaaacauuuaagcuuuaaaaaaaaaaucucaguuauaugugcauaaaucaacaaucagcagcccacagucuguuuuccagaaggcagccacuuucaacccuuggcugauucaucugguauuuacuuaugucuuaaaauaacagcuuauauugcugcuucuugauuuuucacuuuuaggucuuugauuuuuuaccagugaguuaaauaaucuguuuauguaucuguuucuccuacuagccuguaggcccuuggguggcucagaugguaguauuucagcacaccugguggugcucaguaguucaguaaacgaugaaugagugaguggguaagugaugaaugaaugaauguggucauccugucucaggauuucagugauacagguccagucguguguuucugucacauagaagugacccgccacauaagaacucuuucacccucaucaacccacaaagccuguaauuguaguuugaugauuuuagcaaaaugcccuacagauuugugaaauugcuucacagcauucccgguuucuuuuuauuuuuuauuuauuuauuuauuuuugagacggagccucgcucugucgccaggcuggagugccguggcacuccguuggcucccugcaaccuccccguccuggguucaagcaauucuccugccucagccuccggaguagcugggacuacaggcgcgcaccaccacgcccagcuaauuuuuugcauuuuuaguagagacagcguuucaccauguuggccaggauggucucgauuucuugaccucgugauccacccgccucggccucccaaagugcugggauuauaggcgugagccacuguccccagccuccugguuucuuuuauaguucuaaaauaaaucuuuuaaugaguggacacaauucugaaaccuauuuucuaguuucauguuuuagaguaacagguuagaacaacucuuccuucaugcauugagcauguuaaugccaugaauuucccacaaccugccucauccacucuuccaccugucauaccuguucucuaggccagcauugaaacaggggaccgugucuggaggaugccucucuucgaacauuauacaagacagguuguagauugccagcuugcugauguuaacaacauuggaaaauacagguauguaagcuaagcuaaauguacauuuauacaaucauccuugauugccaaaauagcuauuuucaauuuuauccccuuauauaaaagguuuaacuauuuaauuuccuuuugguguagugcuuguaagauuuuuaaugucuugaauuuucaaguauuucuucaaccagauuucaaaauuugcauauuucuaaucuaaugguaauuuucaauaaaugguaagggaaagagauggaaaauaugggaauucauuaccauagcaaaaaggaauauagaauuuauccuuuacugcuuaaagcaauaucugaaaauaaauauucugaaacugauauguggguuagcaucuuaauaggucuuacaagcuugacucuuguucuuugguuauagaauguacuuagcaaaaaugugggaucucagugcacauuuacaugggguuguaaagugcuuuuugucuuucucuucagaucugcaggagcauguacagcugcagcauuccugaaagaauucguaacucauccuaagugggcacauuuagacauagcaggcgugaugaccaacaaagaugaaguucccuaucuacggaaaggcaugacugggaggcccacaaggacucucauugaguucuuacuucguuucagucaagacaaugcuuaguucagauacucaaaaaugucuucacucugucuuaaauuggacaguugaacuuaaaagguuuuugaauaaauggaugaaaaucuuuuaacggagacaaaggaugguauu

SEQ ID NO: 14341 - RNA, 3014 nt, Homo sapiens
gccaaaauuuguuuuagcuaucauauauaaaucauaagcauauuauuugguugguugguguuaguucauuccuucaaucggaugauuuaaaauaaauguuuuucaaguauccucugugauguaucccaaagguuagcuuagaaagaaaaguacuuggugaaccauuccuggugcggagagcccuguuucugcuggacuucuuuggcuugggccguuucaccaucugggguccuaaaagcaaaaaaagguuuuuuuauaugguuuugaaaacuaugcaagaagcagcuuaauacccaccaucuuuucagggaaagauaacugcuuguuuacucuucaaaaacacccaaaugggacuggccaacauuaguagugggaaacaaauuguaaaggauggggcuggggagggaguaccuaauccucauuuggaaaacagaagguucaccauuguuugguucuccauuguuccuuugagacuuagugguuguagcucuaauaaugcaggauuaaccaaaccuacagaucaagagacuuuguuuuuauuuuuugugacagagucucccucugucacccaggcuggagugcaguggcaugaucucggcucacugcaaccuccagccuccugcguucaagcgaucauugugccucagccucccggggagcuggaauuacaggcgcauaccaccacaccuggcuaauuuuuguauuuuuuguagagauggguuucaccauguugcccaggcuggucucgaacuccugaccuuaggugauccacccaccuccaucucccaaagugcugggauuacaggcgugagccaccaagcccggcccgauuaagagacuuuagaauuccaaggugauagaguaaaucuugaggaauaauguuaguaauaauacugaaacuauauugaagauuuuugugccaaguccugugcuaagcacauccuauggauuaauuccuuuagucucacgucagucugaugagauaggugcuguauuaucuuaauuuuaaaggcaagguauauggagaccuggagaggucaagugaccuguccaaggccacagagcuaagaaugaggaagacuguaauuugaauucagaccuccaggccagauggaguccaccuuuuguauaacccaugcugaaguuuucagguaagugauucagugucccuugucuaaucauccaugaaaaaaggccuucuggaauuugguaccaggugcuagaaagaauccuacuuccccucuuaucuacagggaaauagaauaagggccccuguccccaacaucccccaaaccuuguggcaguuuuugcaucuguagacugguuggguuuguagguccggccacagcuggggcuuggguccaagcugggugauguaguuauuggaggggcauuaauccuggaacucagaucgccacucagaaaguucuuugcauaggaggcgagguucggcacgcugaccacgcggcugggcacguccuccaccuucuuuuucuguuuguauuaauggacagguuagugcaaugcaaugcaaaaaacaaaauaaagcauuauuguaaaagcaaauaaugcucacccaaucaaaauuguaucggagaagaagcaacaauuucauuuauacacuuacaugcuauuuuuuaaagcacuuuucccuccaaucuucauuuuguauuauaaauaaauauguauguucacaaccucuuaaccaaaacuucuggagauggauguguuuugcaacucaauuuuguuuaagauuuuagaaggucauguaacacccccagcaggggaugggcccacccuagccucaaaugcauuuauuuaaauuucuggagugaaacuuguauuuugucacaaugagggauacauaaaaacuacacgagaugacauuaguuaagucacaaguguauuguccugugaacuauuuuuaaaaauacuauuuuuguuuuuaagauguagccuugcucugucacccaagcuggaguacgguggugcgaucucagcucacugcaaccuccgccuccuggguucaagugauucuccuaccucggccuccugaguagcugggauuacaggcaucugccaccaagcccagcuaauuuuuguauuuuuaauagaguuggaguuucaccacguuggccaggcuggucuugaaauccugaccucaagugauccacccaccucggccucccaaagugcugggauuacaggugugagccauugcacccagccaaaaauacuauuuuuuaagagccuuuaggauuuugugauaguagauaauugaaugugaauaugcucauugugaaaaauuccaaaaauauguacagaaauaguuaagaaguggaagauucuuacucuucucccucccaucaccuagauagagcuauucuuaauacugacacacauuuauucuagaaaauuuggaaaauacaaaaucccauaaaaaauaaaaaucacacauaauccgcccagccauagauauaaacaaguggguuuuuuuuuuccaaugaauauuuuucugagcguacaccagcccuuaaauaaccugugguuaccuuuaagaaaaacgaaaccaauggaauuguauaaugcauuaaaaccauuagaaccaauuuaccuucauggaaggggucaaauaucccgggugaggauugaaagagaaagaccgauuccggugggacauggcacuggggaaugcugcguagugaaaucuucucucuuccuagaaaaccaauacaacugagucuaaaugagccuaaccacacagcacuggguuugacuugaaggaagauggcugugagggcagaauagagaaggaaaguccaggggaggaaggggaagucagugggaauaaagcugccaggcacugaagcuuuugaggaagcaccuuugcuuuuuuuauguccccagccccucuuguaaagaaaagggcaagcugaugccuuaggaaauugaaaauucaacuguucuuagcaugugaagguaaccuaaugcagaaaguuaguaauuaaggcaaa

SEQ ID NO: 14342 - RNA, 42801 nt, Homo sapiens
cccuggggcugucauagaagacuacucggagagcgcugccucuggguuggcgggcuggcaggcuguagccgagcgcgggcaggacucgucccggcaggguuccagagccaugggagcggaaaggaggcugcugucgauuaaggaggccuuucggcuggcgcagcagccgcaccagaaccaggcgaagcuggugguggcgcugagccgcaccuaccgcacgguaagcgcucccggccccggccgccgccucucgcccgccccggcccacccucccucaggggcccuccguggcccucgggcucggcgcaccgugacuccagccuuguucaccuucgcgacucacuucauagggaucugagguucggagaagucagggacuuacccgaggucgccugggcccaggccagaaagccuccgaagccugggcgucguucacacgggccccgccuuggcuuuucugagccgacacccccagcuucugggcggcguggaccguuauuccuuaguccgaucgugaacguggagagaaacauuuacgaccaccgaggcgaucagacaucaaauauugaaccgcagaguggauccugaaugcggggguucaguggucguugccccuggggucaucgcuccccgccgaacaucaaaugauucuacccuuguccuacgguuacguugaauccaaucaccaaauaccaaauuauuuuuagggccuggccauucuuauuuauguacauacuauuuguuuguuuugaguggaaccuugagaagaauagaacaauuaauuuggggaagaugaauuaucuugagguccaagaaaaauugugaguaaacaucacagggcuuugaggauaugagauaggaugugcaaguuaucucauaaagaaacugcuggugauaggaaggccugaauaugagaaauauaaaagccaguauugauuuuggguuguugaagaagcguauuuguaacguacugguacuaaaggcuuauugagaaucaaagauauugaaaaaaauauaucaaaggaaucuuuucacugucaaaagucaagcuuguguacucccauuauagccuggagagaaauucaugcaaauugauugcccuuuggcugguuuggauaauuaagaguuuacuaaauaaauauuuuaauuugucugcauuauuauggcuagugcuuucaucagucuuagggugauguugggaauaaaggauuuuuaucggugcaguuuaugaaggguuucuuuugucuuucagauggaugauaagacaguuuuucaugaggaguucauucauuaccuuaaauauguuaugguggucuauaaacgugaaccagcuguggagaggguaauagaauuugcagcaaaguuuguuaccucauuucaccaaucagauauggaagaugaugaggaagaggaagaugguggccuuuuaaauuauuuguuuacuuuucucuuaaagguacuaugaaaaugauagcuuuggggagggauuuuagaaaauuuugccacuuuaaaagagucgugggaguuuguauguuuuugacaaugaaauaucuagugauugaaaaaaccugaaugagucuaccuuucauaggaaauauuagaauuaucauuaugauuaaaaaguggacuuuaacuccagcauuaaauuuuuaaugaccucuuuaaaccaguucuccuuuguuuauuuuaaaugaguucuguauuuuagaagccucuacaaagaggacuauguaacuuagcaaagacuucuuucagacuguucauuuugagacuguauaaaauauauauauuugcuauacauauggaccaagguagcauuauagguucucuucaggaaaugaauuguuguuguaacuucuugcauuccgaauguauagaguucagauaauauugauuauuugggagugguaugugacuaugaauaaauuuugauuuguuucuguuuuagucucaugaagcaaacagcaaugcagugagauuuagagugugccugcucauaaacaagcuuuugggaaguaugccagaaaaugcucagauugaugaugauguguuugauaaaauuaauaaagccaugcuuauuagauugaaagauaagauuccaaaugugagaauacaggcaguucuggcgcuuucacgacuucaggaucccaaggaugaugaaugcccagugguuaaugguguguguaguuuccuaaaucuuuuuucagauuuguugauuuuguuaaauucucaguauuugaaauuuuuuauuauggucuauacauuugaagaguauagguaauuaauauaugauuccgauuaaacaaaaaaaaccuaaguagcaaccacccagcuuaaaaaaaaaagucaguacuugcauccuaucccaguugcaucccugucccucagaaguaacuauuaaauccucaguuugggguuaauuagucucuugcuuaaauuaaaaaaaauuuuuuugcauaaaucacauaugucuaucuuaauguuuuccugucauuuuguguaaaucaugcuguauguauauauuuagcagccaauuauauuucuauauaauaccuguuacuguguuuugcccauuuuuucauuggguuuuuaauuuaaaauacuauuuuaaaaaauucauuugcauucuuuauauauuuugaaaagaaauccuuggguuauaugaauuguagaucucuuccuguuuuagguggcucauugggguaucauuguuucacucccuuugggguaucuuuuuuuugaacagaaauucuuaugucaaaaauauaaaucucugccauuaugauucguauuuuuuaaucucuuuuuuaaggaacuuuuucuuaccuauggggucauaaagguaguuguauuucauuuuuccauauaugccuagguauguuuuaggcacucuucuguccuuuuugucccuauuaccaguuuuauaaucacugguauauuuaucacuauaguaguugguauuuuuuuugguguuaaaagauacccauaauaauauuguguaaaacauagguauuugauagucaaccuguacuuaauaauugagguaggaaagaugugagaaguacagauaaauauauuuaaauauaagaaauggguuuguuucaaugaauaaaaccaaaaaauauuuccuuuuaggucucauuaaaaaccaaaauaaugggcccuuauaaagccauaucaguuuaaaauaaacugucugcuauaguaagcuuucucuuaaauauugaggaguagcacagacauaaucuuaaugaugaauuuucugugacuuuuagggcuauuuguuuucacuuuuggccuaagagccaguccguugacuaauucccccuugugucuuuagaagggaaguugguggccugcgcagcagugacucaggccuguaaucucagcacuuuggcuccaaccugggcaacauagugagaccuugucuccaaaaaaaagaaaaagaaggaaguuggugggaaaaaaacuucaacuaaaauaugugagacuaaaaaaaugacauuacuuucuauuacagauggguucucacucgggcuggauugcagagguguggccucaaacuccugggcuuaagugauccuuccaccucagccuccuaaguaacuggaagcgccacuaccaugccuagcuaauuuuuuauuuuaaaauuauuuuguagagacaggggucuuucuauauugcucaggcuggucuugaacucuuggcuucaagcucuccaccuaccuuggccucccaaagugcugguuauaggcaguagccaucaugcccagccuaucuuuaucacauuaaaggcauuuuaaaauaucaaaauguguguuauuuuaugacuguaguuaaauaaauaauuucaucaguacuaaaauguauugcuuuauuuuuagcauaugcuacuuugauugaaaaugauucaaauccagaaguuagacgggcaguguuaucauguauugcaccaucagcaaagacuuugccaaaaauuguagggcgcaccaaggaugugaaagaggcugucagaaagcuggcuuaucagguaaauaaguucaaugucuuguguuggcauauucuuaaaggacaaggagccauuuucuuaaagugccuuugaaaaauacuuggcauguaauaauuucuucaguugagguuuuauggagaacacagguaauuuagguagaaucuuacuguauuaaguauguuaccagguauuaauuucuuuuggagauucuggguaauuuucuaagauggugauauucuuaugaaaucuauaaauuguguugagguuaaugaccaucuuuauaaauuauuuuuaagguuuuagcugaaaagguucauaugagagcuauguccauugcucagagaguaaugcuccuucaacaaggucuuaaugacagaucagguaagauaaacaacuuuauauauacaaaacuuuaguagauuuugaggucagacuuaacaagguuuaagaaacgagugucaaaucaggucaaguaagccugccagucccaugaaccuggugaaauuuaucuugauguauuauauagaaaacacagggcuaaagauuuugauauauauauauuuuugagacagagucucacucuaucacccagacuggagugcuguggugcaaucuuggcucacugcaaccucugccuucuaguuucaagcgauucuccugccucagccuccugagcagcugggauuacaggugaacaucaccaugucugguuaauuuuuauauuuuuauagagacgggguuucaccauguuggccagacuggucucgaacuccugaccucaagugaugcaccuacuucagccucccaaaguguugggauuacaggugugagccaccgcgucuggccaagaucuugguauuuugaaggagcagagcuuauuucuuucacccuuucuguauuuuacagauggagaaacaauacuuaagucuguagagcuaauucaugucagaaguaggaaaagaucuauuugcccucucucucugacuuaaaaaaaaaaugcuguuccuuauguguauacuuugguaugaauguguucuguguaucagaaacaacaaauaggaauggucagaccaguauaauuuucuuauuuuuuuuuuuuucuguuagaguagaguuccccaacauuuuugacaccaaggaucgauuucauggaagacaguuuuuccacagagggcgggcuggaugguuuccagaugaaacuguuccaccucagaucaucaggcauuacuuagauucucauaaggagcgugcaaccuggauaccucaugugcgcaguucacaauagaguuccugcgccugagagaaucuaaugcaucugcugaucugacaguaggaagagcucaggugguaaugcucguuagaccacggcuuaccuccuccugugcggcccgguuccuaacaggccacagacugguacuaguccguggcccagggguuggggagccugagagaaucugcuuauaggaaugauauuuuuugaaguuuuuaacucucaugagaaggccaagauggcucuauugcgcuguagugagaaaaccgacuugcguuugaaaacauugucagaggacuaauuaguaggaugaccuuaaaagcuaagacuaagguuuguucagugacgugugcuuguauaguucacuacugcaaauagcaaucguguaauagauaaaaucagauaacaagugagauaauagcuauuacauauucugggcuaacaccugaagcccauugaacccaggggagaaggaauguaaagauauuuuuguaggcugugguauuuggugcugaaccuuuuccauuuuuauuuguaagugaccauuacagugacuuuugcaguaucaugguacuucuuuuuuuuuaccuuuaauaugcuuaguuggcugggcgcuauggcucacaccuguaaucucagcacuuuuggaggccgaggcaggcggaucacgaggucaagagauugagaccauccuggccaacauggugaaacaaaaauuagcugggcgugguggcgcaugccuguagucccagcuacucgggaggcugaggcaggagaaucgcuugaaucugguagguggagguugcagugaaccaagaucgugccacugcacuccagccuggugacagagcgagacucugucucaaaaaauauauauauacaugcuuaguugugccucuuaaccucuacuauuucuauuguaaauacugacuuuguuaauuaaaacagacaaaauacaagagauggaagcuagagggagccuuuguucaccuauguuucaaaugacucaauagaugcugugaaacaagcuaugcagaagcaucuucuucaaggcugguuacgguucucugaaggaaauaucuuagaguugcuccaucgguuggauguagaaaauucuucugaaguggcagucucuguucucaaugccuuguuuucaauaacuccucucagugaacuggugggacucuguaaaaacaaugauggcagguacauaaaggauucauucuuugaaauguaguacugauuaacuugugcaauuaauuuguuuuuuuuccuccccauagcuuaagauuauauuaauaccuuuaaucuuaacucucuuuuguuuucuuuuagucugaugaauauccuuuuauccuuccuuuuuccccuccugguguaagaacucauaacuuuaucauagacuaucuacuuuagcuaugcuuuuccccccuucaguuucuuacuuugauuuuugaauuagccuaccaugagaaaauccagcaacaugcaccccuaguauauguuugcuuauuugguucuuuuuuguucuaaguuucuucauuccuuuuuguguggauacauuaaugacucuaauuaaaaggauaguguagugguuuuaaagcaaaucuuauuauucucauuuuuguacucuucaauucuuaaugauaaaaagaucaugcuuucucucacacucuuucuuuuaaaugaaggaaauugauuccaguggaaacauuaacuccugaaauugcuuuguauuggugugcccuuugugaauauuugaaaucaaaaggagaugaaggugaagaauuuuuagagcagauuuugccagagccuguaguauaugcagacuauuuauugagguaaauuuuuuuucuuuuaguuuggagagugauuguguugcugcaugugucaaucucccaguccccuuccucaaagucauguuugauugugaauauguuaaaaauccuuuuuuuguacauguagggauaguuauauacaucgagucuuuuugaauaucuugugcuggucuguauacugaaagagcaagucacuauguuuaggaucauuucuucaaaacuguuaagauaugauuaugaccauuucugcauaaaguugaugaugaugauauauuauuucugaaauugguuggcacauuuucuguuaagugucagauaauaaauaucuuaggguccugugggccauaccgucugucacaaugacucaacucugccaugguauuguaaaagcagccaaagacaauguaaguaacuguuuuucaauaaaacuuuuauugacuuuuauggccacuaaauaguugaacuuuaauauucauguguuaacaaaauaagaaauuuuaaaaaaugaucaguuaaaaauuuaaaauagucuuagcuugcaagcuauauaacagguaauaggcuggauuugaugcacggaacauuguuuuccaauucacagcguggaucuuuguggccaguuuuauuuauuaaaaacuuacuaucuagcuucauguuuuaaaguuuuuucaaaauaugccuuuuuaaaaaacaauuuggauuaccauaauuauaccucuuaagaaauuauuuggauuacuuuauuucacuuuaaaauuauacaagaaaaacaugaaugcauucuugucaaaauucaaauacagagguauaaggaauaaaaauguggaauucccucuuuuauuuccuacuuccucaaucccauugauuagcaacuaaguguauauucuagcaacccuuagaauuagcaacuaaacaauauaggguguauauucaaaccucuuucucugcauuuauauacauuuuuugaguacagguuucuuuaaaaauauaacacuguguauauacuuuuuuuuucaacugauaacugagaucauuauauauuggugcauauauaauguaauagauacuguuacagucuuaacagcauaucauuccguaguauggugguaacauuuaauuuauuccucuguugauggacauuuaggauguuuccauuuuucacugauaaaagcaaaaguauguuaaauuuccuuuacauuuuuggguaccuuugggauuuuuggggguuaauuccaagaaauaaguugcuacaccaaaggauaauauauguauauuuugauagauauugguauguagguuuuuaacuucaacuuuaugguuuauuuuuuuuuuuuugagacggagucuugcucugucgccaggcuggagugcaauagugcaaucucggcucacugcauccuccgccucccggguucaagcgauucucuugccucagccuccugaguagcugggacuacaggcacgcgccuccaugcccagcuaauuuuuguauuuuuaguagagaugggguuucaccauguuggccaggauggucucaaucucuugaccucgugaucugccugccuuggccucccaaagugcugggauuacaggcgugagccacagcgcccagccugauguauuuuuuuaaaaaagcuuccauauaauaugaauuauggaccugaauuaucuguaugaaguacaguucucugcuuuuguuuaaaaugaucucacauaaaaguuaggcagcaaagcugugcaugccucuaaauuuccccucaaaaauccuaaaucuaggauaaguaucucaaaugugagccaguagggaaacuauagcucaagcccauguuaacaucaugaagaaccugugugaaucuaaugagcauuuuaauguuaauuauuucagacuuugacauuuaaguagggaauucauuauaaugcuguuugggccauguugaaauguuuccaaaaggaaugaguuuguggcaaaguuuaauaauauauauaaauauaaaagauguuuauagaagguagugaaaauauaagaaaauaugaggaaauguuaaauauuuaaauggcauaaagggggaggaguuuuccucaaggacagcaucagaaggugacuuguaaaaagcuugauuccucccuucugaaaggucagggauuaacauuuccuuugucacucucuuaguuuugaaauaaguaacuuuaaccucuucgacuuauuuucuucaccuuuaaagaggaaaauuuucggcugggugcgguggcucaugccuguaaucccagcacuuuaggaggcugaggccgguggaucacgaggucaggagaucgagaccauccuagccaacauagugaaaccccgucucuacuaaaaauacaaaaaaauuagcugggcgugguggcaggcgccuguaguccuagcuacucgggaggcugagguaggagaauagcgugaaccugggagguggagcuugcaaugagccgagaucgcgccacugcacuccagccugggcaacagagcaagacuccgucucaaaaaaaacaaaaaaaagaaaacuuucagaaauuuauuuuagugauuguugaaagaauaccuaaaaaauagaaugagugucuuuuuggaggaacaugacuagaugggauuaguauacuugaguacagaaacaaaauuaaauugaaaaauuguuuccugauaaucucaggaauauguuuucaggcauacuguauauuuuaggcaguagauucaaugacuaagaacucugaugugaaacaauuuugguuaaccaaggugcucacuuaaagagcaaacgaggaaaugaggauuaucaaauuagaguaaguaaaagggacaacaauaaaauuuguugaaagccaucuuaaauauaaauucuuagacuuuaaaauacuuucuugaguggucucuucauuauaauaaaugucuuuauaaaugguuaggauuucaugguaacuaaaauuggugggucaguuuuaaguuguauuuaugcaguugaggauuuuuaaucuauuaauuaaacaacuguuugaauuuacuuaaaaaaaaaaacucagucaagaugcugugcauuuugcuaaagcugggcuggagaaguggggagagauacaaagaugaguauaaaugaagguuuucuuuuagccugucagaaaagaguaacucuacugauugguugauuuugauaguuaucgguaguguaguuuuccuuaguuuccuacuagaacccaaaggguggcugaugucuuaaaaguccuaaucuuguggccagaaauuuaugagcuuuuauuuacucuuggucaucacuuuguaauacaugagaguauacucauuauacauuauaccacaauuucuguaacuugguuuuugucacccccgccuuuuuuuuuuuuuuuuuuuuuuaagagacguagucuugcuuuguugcccaggcuggagugcaguagcgugaucuuggcuuacugcagccucugccucccagguucaagcaauucuccugccucagccuccugaguagcugggauuauaggugccugccaccacauuuggcugguuuuuauauuuuuaguagagaugggguuuuaccauguugguuaggcucuucuugaacuccugaugucaagugauccucccgccucaaccccccgaagugguugggauuacaggugugagccacugugcccggcgacauuuuugacauuuuuuaaaugacauuuuugaucaggauuguuuuucauguuacuuccaucuuaaaggcacuucgcugucuaagcuucaauucuuaguucugcuuuuaaguagcuuuuuuuauuccacacaaaaagcagaggcuacugaauauacagccuucuuggugaggauuauaaagggcuuuaguuuggguggugaugucuguaguaagaauaaaaaguuaaaauaaaagguagcugaugguggugguguauacagagauuaguaggguuucuaagaaagaauaauaaaaauuugugaaauuguuucuauuuuucugauuuuuuucaaaaaagauaauuguauucauggauuacuuguguaacuauuguuacaauuuuuaaaaauaaaagaaugauaauuaggcaugaugaagauuaaaucuuuuuuuuuuuuuuuuuuuuugagauggaguuuuucucugucacccaggcuagagugcaguggugcgaucucggcucacugcaaccccugccuccuggauucaagcaauucuucugccucagccuccugaguagcugggauuacaguagccaccaugccuggcuaauuuuuuuguacuuuuaguagagacagguuuucaccaucuuggccaggcuggucucgaacuccugaccuuguggugcaccugccucggccucccaaaguguugggauuacaggugugagccacugugcccggcugaagauuagaucuuuaugacuaauuggauuuuuggguaagggauucagaacuugauagaugcuucuugacuuaaaguggggcuaugucauaagucaaaugaguuuaauucucagauaaacucauccuaaaguugaaaaauuguaaguugggccaccuguaauuggggaccaucuguaauugggagaaugcuagugacauugaaauaauuaguuaucaguuagacauaaauauguaccuuuugaaaauuucccauagaaaauuugagucauuauugaaaauacauuuucaaauucuuuugauucaucaauaaguuuguuugcaaaaguuaaugacaguggcauagaauugaguuuguagaccaaauuacauggcauagauauguauuuagacgaauaugaccugaaaauggcccuuuucugaccuaauggugggaaucaacucuuguuugauguuucuuaaaagauucuacuuuauuaauucugcuuguuuuaguuacauccagagcauuccaguuguuaaugaagaacacagaggugauuuuuccuauauuggaaauuugaugacaaaagaauucauaggucaacaauugauucuaauuauuaagucuuuggauaccagugaagaaggaggaagguaugucuaaauguuaacacucauucuaauuugcccuucuaauuucuuauauugaaauauaguccuuuuacaauauaacuaaacauauuuacccuagcucucuaaagugguauaaaaaguuuucuuuucccuucuacauauuuccauauauacacauacauuuauauuucuaguucaauuuccucagaauaaaucaaugaaauugcaguuuuugguuaaaaguuucuguuuagauuuauuaaggcuaguagcauuuucuaaaagguuuaaucauuucugguauuuugucauuuuaucauguugauuuauuaaaaaucauaggguguuuuauaaaaauuuuuuuuuguguggaauaagaauauuugaccuaaagucuguacauacagauuuuuguaccuauuauagugauaaaccuaagugaaagaacugaggcaaauguaauuaaguuugcagaguaggugaauguuagagauaaaacauguuuugucauaauaauauuuaaauuaguucuuuuugacugcagaaaaaaacugcuggcuguuuuacaggagauucuuauuuuacccacaaucccaauaucccugguuucuuuucuuguugaaagacuacuccacaucauuauagaugauaauaagagaacacaaauuguaaguaauuuuccucauuguugauaaagagguuuuggucaaugacauugaauacugucuuauuuucuguuuagaacuuuuuguuuugucuguuuuguuuuagguucgucucuuuaaugaguuuuaaaauuucuuaaaaccauuaucuaucucuuacauacacagaauauuugaaaaaugucaccuucuuccucuuaguguaccuguuauuguugaaucaguuugaaauggagcagguuugguaggaaguuacaaguggggauaugguuuuguccaugaggcacugggugcuaguguuuuugagagcuuacucaaauuguacauacuaggguuuagaaucucaucugacacuuucuggcuuuguggcuuuggacaaguuauucugcuguuuuacuugucugcaaauaagaauagcaaugaaaucuaccuuucauuuuucaaugagguauuguucauaaagguauuguucuguauugcuugauaaauacagaaauaauuguuuacuauaauacuauuucaguguuauuuuuuucuggcauagccaaaaaagacagaucuguaucauuuauuucauaaaaaucacauaauuucaguugcagguuaauucacagaucaucucuuccauccucuccuuauauauacaccccuucuacaacaugcuuaguuguuauucagcaucugcuuaaauacuuucauuugggaggcagccuuuuccugaucagccaauuccaauauacaagugguucugaaaggaaaguccuuccuuaugcuauuauuauuuaugcauugucuacccaaaggaagaauaaaaggauauuccauuuuucuguguuuaacuccuacagagcugaacaagagaaggguugaggauuuuaggcagagaauuuaagugucucaucuuaagcaccauaauucauauuucuguuuuucaaacauuauaugagggauaauuuacuuucacugucugugugccuauuucccuuccauucaaauaauuucauuuuguagucagauauauuguuuuguuuuguuuuuuucuaaaauugucuagcaaacagaaugugugcuauuucuaccaguauguuuuugcuccauuauucaauauaugguggauacuacuuggaguuuuauauagaauuuugauacuauuugcugauauaucaaacauauauuaaagcauguacucugaacuuacagguuacagaaauuaucucagagauucgggcgcccauuguuacuguugguguuaauaacgauccagcugauguaagaaagaaagaacucaagguaagucucuuuuaaaugaaagaagugcuugaguguaauguagcugggcaagucuauucuuuccucuugcugugcaguucugaaauguuucucacauaaucaaauuauuguuuaauuguuaaacuauaagaauauuuaaaauguuaccacauaugucagucucagagauaugcagaucucugugucaggaaaacuacaaguuugcauaugccugacucauuaaauucugggcaguugagauauuaaauaauacuccugaguugcuacagauauucauauuaacaguuuuuguucaguguugaaacaauuuauaucuucccuuagauggcugaaauaaaaguuaagcuuaucgaagccaaagaagcuuuggaaaauugcauuaccuuacaggauuuuaaucgggcaucagaauuaaaagaagaaauaaaagcauuagaagaugccagaauaaaccuuuugaaagagacagagcaacuugaaauuaaagaaguccacauagagaagguacagguaacuuuuuucauacuaaaucucagguguuauuaaucaucucaacuaaaucuuauuuucucuaacuucuagaauugccaaaauauauuuacuuugagcacuuuguaauagugacaugaauuaaaaugaaaaaaguuuuucccuguuucuauuuuuggacuuugaaaggccuuaauuaacuuuaauuauuggagguaggacuuuauuugcuuccuugucaugcuaaucucuagaauccgaagucuuucuuaccagggaagcuagcuuuccagugguucacaucugaguuuucuguuuuuugucuugaaugguuuaaaaaaggaaaauacauccauuuuccucuuauuuguggaggaucaaugaccuuucuuuuuuauugcuagcaaaauaauuucuaugguaacgugcauuuuuuuaaagcuaaauuacuuuuguguuuuuagaaaaagcuacgcagcuuuguuauuuuuaaugaaauacugaaauaugucuaguaacauuuaaagcuugcuuuucaguaguucguuuuuuaaaaaauuaguuuguuaaaguacucucuuaaauggaguaugucuuuccuucugaaagaaauuuuuuguuaaugguaucgauaccauucugucuuacaacaaaugauaaauauguaaacauaagauagguaucaauuaauauuugauauuaacuuuaauuucuuuugggaucuugccuuuuguaaugaacaucauuuauuguuguacuuuugggaugugcugauuauucucauaaaaagaaugcuaaauaggagacucuuuuauauaggagaguuucaugaguuauguuucugaucucuuuagccauagacaucccaacuccaacacccaccuucccagaguguaugccugaauuuuauuuugauagcugguggcuucuuuuauuugacgaagucugugggccauuauaggcuauuaaauuuggaaagcaaauuuaaagcaaaaacugaaaauaucaucugaaaaaugacaaacuuuaggucaaaauuauaaaauuagcaaaaguagucuaucaugguuaauaucgucuguuuaacuugacuugcuuugaccauuuaugugucuauuuguccuguucgagggcuacaaaucuguuaaaaugcaacuacaacagagcauaauaaaugcuauggucagggaaguauagagguuuuauggagagguuucuagugcugguagaguauuguuggcuuccccagaggaagacauguuuuauccugagauuagaauaaaaauaacaauauaaucuaacagucagaggauacuuuuucugugguagucacagcauuaauuacuucacaaaugugaauucauucuuuucuuccuauaggccuaugagguugguacuauuauuaucuucauuuuacaaagggcaaguaacuugcccaaaaucacacagauaguaaaugguggaggcaggauuuaaacccaagaaguggcucuagacuugugcuuuuaacucacucugugcugucucuccucaaugaauuauggaaggaauguuguagacagauggagcaacaucugugaugguccagaaguuaaagaaugccuauuauguuuuaaaacuucagguccaugugacuagagaauugauggggagaagcaggagaaaaaucuggggaaaaauuaagggcuaggucauguaaggcuuugcguaagcaauauuaaaaauuuuguauucuaaggauuguggugaaccacuaguauuuuaagugguuagguaagucuuaugucucagaucacuguuguuuaggaaauggauuggagaguaguaaaagcuuagacaggcauaauaguugggagacuuacaguaggguugggagacuuacagaugaugguagucugaacaagauaaugacaguggauuuggaaaguagugaugaacuugagagguauuuagaaauuaguaacggagaaaagggagucaggaauguaucuuaagucuuuugguuuagacaacuggguagauggugaugacaguaugaagauagagaacaaggaagaggagagauuuguguaaugaugaguucccuuuuggacauguugaguuugaggaaacuguggaacaucaagaggaaaugucuuuuagcaguuauauauaugaaucugaaacuuagaaaauagcugggcuagcucauagaugauaaacgagguugucagguuuuuuuuuuuuugaggugauaauuaggcaagaugaagauuagacuuuuuuuuuuuuuuuuuugagacaacgucucccucuguugcccaggcuggagugcaguggcaugaucucagcucacugcaaccuccaccucccguguucaagccauucucgugccucggccucccaaguagcugggaccacaggugugcaccaccacacuaauuuuuguguuuuuaguagagaugaaguuuugccauguugaccaggcugguccuaaauuccugaccuuaagugauuuaccugccuuggccccccaaagugcuaggauuacaggcgugagucguugcgccuggcugaaguugccaauuuuaaaauccugccucuaccauuuacuaucugugugauagcuguaagaucaccuacagagucuauauagagugacaguaugcccuacacaaagcccugagaaagcaaacauuuaaaggauggggagaagauauuacuaaugcugaauauuuugucuucauuuuagaaugaugcugaaacauugcagaaaugucuuauuuuaugcuaugaacuguugaagcagauguccauuucaacaggcuuaagugcaaccaugaauggaaucaucgaaucuuugguauguugauggccucuugggcuuuauuuuaguccacuccuuucuuauuuuguaagugauauguucuuuagaaaucaaaauaaugaaaagauuacugucuuaaauaucugauaaguauaaaugauaaaauauauauauauagcagcuacuucauauugugaggauuaaauaagaugucuguaaaggaccugauauguaaauuacagucuuuuacauauuuuaaaaaaugauuuuauacuggaaagagauacagaauaucuucauuuuuugaauaguaagagaggagauacugaaacauaccaagaauauuuaaguacuggaauugugcuacguaaugagacugagacaaucacauuuuaugcccugggaaaggaauuuauuuauuauauuuaaagggcuuuuaaaauaacccuuuguagguaauucccauagggacacaaguacuguaagacucuagaacauuacuuucugauaaggaauauagugcaaaccauauguaacuuuacauuuuuuaguagccacauuaaaaaaaguggcuuuuuuuuaaagccacuguuuuaaaaaaaaaaaagaggauaauuuuaguauauugaauauauccaacuguauuauuuggauauguccaauauauccaaaauauuaaucauuucauuauuuacucacuauuaaaacuguugcaauguuuuacauucuguuuugcauacuaagucuuauagcgcaucuuaaacuggacuagucacauuucagguguucaguagccacaugaggcuaauggcuacaguauuagugcgcuguuuuguuguuguuguuguuuuugauaguacuacucauucaaagcaaauucuguauguagccagguucuuacagaagucucucaaaacuguauuuacuugguauuagugagaaauagccaaugaauguaaucugaagucuaauuccuuggguugucaugaguuccugaauguaguaaagaaaaccaauuuuaauaguuuagagcuucuggagaaauacuguuuuguacucaaccauuagaauuuagcuuuauuuuuggaaaagcaguuaucuuuagugaaaagugaugcuuaauuugugcuugggcauuuuaugucugguccuacaaaauugaaguaguaaauacgaagacuguauauaugugggaaaggauauacaguguuaugugaagaauaaacacaaaauugaaugaucauaaugauuuuaaauguauaaaaaucugguuaaagauugaaagagauuaguagaggaauauaaaagauguuuggauaaaaguuauauuuuuaugaaguuacuguguuuuaaauaaaagauuuaauuauucauugggaaaauacaaauuauucauugagcaaauauuuacugaacaucuauuacauacuaagugcugggaugguacaugguauacaaaauagauauagauugcccacguugaucuggucaagugagaggagcaucgauuaaguaaagaaauaagugaaacuuugugcuauuagugcuugcuaugaagaagagcuauauggccguaugugaacuuauaauagcaggauuugaacuauucauggaaggugacccuggucugauauuugaguagacauuacauguaugaaaaagugagagaagauuguuuaauaugguagcugucagccacacauggcuuuuaaaaacuagaccaaaaugagauaugcuguaaggauuaaaaacauguuggggguugggcgugguggcucacaccuguaauccuaguacauugggaggccaaggcgggauggcuugagcucaggaguuugagaccagccugggcaacauggugaaaccccaucucugcaaaaaaauagaaaaauuagccaaggguggugacucgggccugugcugucagcuacuugggaggcugagguaggaggaucacuuaagcuuaggaggcugagguugcagugagccgagauugcgccacugcacuccagccugggugacagcgugagacucugucucaaaaaaaaaagaaaagaaaaaagaaaaaaccauguuggguuucaaagacuaguacaaagaacagaagguaacuuaucuuguuaauaguauuuauauugauuaaauacuacagauacgauguuuugguuauauugaguuaaauauauuaagacuaguuucacuuuuuuuuuuuuuuuuacuucaaugugguggcuacuagaaaauuuaacaugacauaugugguacccauuugugacuucuauuauauuucuguuggauagcauugaauccaagccagacuaguugaacaaacugagcaagagguagcaugguauaagaagauugggaaagaaacuacacaauagggaauaguauauaucauguuaaggaguuuuaucuuguucugugagcauugggaaaccauugagucccuuuuagcagguggaggggagguaucauggucagacccuauuucaggaaggucacucuggcuauauuguucuguuuuagcaauuuaauacuuaccuuuucuuuaaaagugaaaaaugacaccuuugagguaauagacaauagggaaaugaaguagaucuaugaaaucauauggaaaauuucugauucauuuuagauucuuccuggaauaauaaguauucauccuguuguaagaaaccuggcuguuuuaugcuugggaugcuguggacuacagaaucaggauuuugcaaggaaacacuucguauuacuauugcagguaggauuuaucuugugauaaaucucaacuguauuuccugaaauacucuguggcgauaaugcuaauacucugaauuuaucuauucugauucuuauugaugaugauuauuauggauaaucuuuggagacacaauacuuuuaucuuuugauuucuuauuaaaaugucuuuguagaaaaagaugaaacgccaauuauguaagauauucuuuuaauuauucacauagcaaauacuuauugagugcguauuaugugccagcaacuguucuagacuuagaagaaauaaaguagguagguagugaauaaaacaagauaaaauguguugucuuaauggagcuuacauucuagaaggggaaacacacagugaaaaauaaguauacaauguaucagauagagaaaaauaaagcagagaaggggauuaagcagugggaaggaggagagggaacuguuugguugagaaagaccucacuaauaaguugacauuugagcaaauaccagaaggaaguacaagagcgaaccacgugguuauuuggguuuccaaggagaggcaagaauaagggaauaggcacugggguguaggacuuuggguguguucaaggaauaagagaacacauggcuaggaaagauugagcaaagggaagaauaauaggaaaaaggguuugcuggcagcaggauguccaugucuucuaggaccuuauagacuguaaagaugucaguuuucacuauaaaugagauggaaaggaauucgagggcuuugaguagaagauuguuaugaucugacugggcauaaagugguguagaccagggaggguuuggcaaaccuuuuguguacagggccagagaguaaauauuuuuagauuuuugugggccauaugaucugucugaacuccucagcuuugcuuuuguagugugaagacagcuguagauaauacauaaaugaauuaguauggcuguaguccaguaaaacuuuauggacacugaaauuugaauuucauguaauuuucacauguaauacauuuuuuuaaaccauuugaaaaugcaaaacuuccuaacuugcaggcuaugcaaaaacaggugguugaauggauuugagcuguuugcagaucccuaguauuaaguagggguacaaguauggaagcagggauacuaauaaggaggguauuugauaaucuaggaaagcgauggcgaugguuuggacgaggguugugguuacugagguugugagcaggaugguaaucuaaguuugaaaauaaagucuaagauuugcuaaugaaucugacaugguaugugagagaaagguggaggauaauuuaaagauuugcgccagaauaacuggauggaugaauuugcguuuuccuaugauggggaaagcagaggagcagguuuuguagcagauaggaugaaauaaggaguucaauauugggcaugauaaguuuacaguuuaagguacaaguggauauauugaauaggcauuuauauaugaguuuggaguauaggggagagguccaagauggugagauggaagucuuuauucuuuugguaguaucugauaguaugcaacgcuuagagauaggauguugccugaggaaugaguauagacugaaugaguguagggucaacuuuauaggacccuaagccucagauaaagguaggggagaugaagaggaaccaguaggggcuaaggugaauuggacaguaaaagaggaauggugugauuuccuggaaagcaagugaagauaauauuuuaaagaugauagaaugacccagcugucccguguugcuucauaauggaccauucuggauuuauaauggaccauuucuggcaaucaggaacugcucuugaaauuucuuuaaaaguuuugaaaaauugagccauuuuucucaauucauuauuuacaggugauauuuauuuguucuaaaagccaaguuauagagccaaguuauuuuaccaauuaccuaaauuuaauuacauuaaagaauauaguaaauuggcacacacccguaaucccagcacuuugggaggcugaggcagguugaucaugagaucaggaguuugagaccagguugaccaauguggugaaacccccaucucuacuaaaaauacaaaaauuagccaggcauggugguaugugccuguaaucccagcuacucaggaggcugaggcaggagaaacccccaucuacuaaaaauacaaaaauuaaccaggcguggugguaugugccuguaaucccagcugcucaggaggcugaggcaggagaaucgcuugaacccgggagguggagguugcagugagcugagauugcgcuauuaugcuccaggcugggcaacagagugacacuccaucucaaaaaaaaaaaauauauauauauauuuuuguuguuguuguuguuguuguuguuauauauaucuuauuuuuccuacuggauuuuaaauuuggauagacauuuuuauuuuacuuuuuuaauaucuuaauuaaauccuaacuuucacuaucauacuuaauuucucacuauauauauauauuuuuuguaauauaaauacugagcucuguauuuuuuucauggcuuugaaauuuggugggcauuuuuaaacuuaagauagacucauacaaagugcuguguuucgugauuuacgucuuuucauaaaggagucuaguugaaaacugaguuuacuguuaaggaauucuaaauucauugagcuaaugagagaaaaaugaaacuugauaaccuagaagaauacuguucuaaugaaugccuuucauugcuuagaauguaauguuuuucucuugacagaugggcuagaacacuuucaacauaauugaacaguuuuucuggaucuuaaaaaaauaaaaucauaguugaaggcauuguugauucuuuuuuaaauaaaaggaacaaauaauauaauucagccugacuccaacuccagaaauuuuuauugacugugaagauuaacuuugucuuaaaguauauagcucuauuauauguuaugguucaaauaaauaaaaauaacauuuuuuuaaauugaaauuuuaacuguauuuuugaaaagugauguuuucuuuagacuagacacugucauuaaaauuugacuaagaaaaaaacaagauacauauuaauuuuauguaaacagaaacaaaacaguuuacugaauuuacuuuuuuugguggggaauaucuugauuuagguuuugcaaauugaugaugucacaauaaaaauaagugcuuuaaaggcaaucuuugaccaacugaugacguucgggauugaaccauuuaaaacuaaaaaaaucaaaacacuucauugugaagguacagaaauaaacagugaugaugagcaagaaucaaaagaaguugaagagacugcuacagcuaagaauguucugaaacuccuuucugauuucuuagauagugagguaagaaauaauccaguccugugauuaugaaaugucauuuucagcauguauuuguuuauuauuauuauuuuuuaaauuuauuauaguuuaaguccugugauacaugugcagaacauacagguuuguuacauagguauacaugugccauggugguuugcugcacccaucaacccaucuacauuagguauuucuccuaacgcuaucccuccccuaccccccuauccccugauaggucccagugugugauguuccucuccccuaugcucuuuauaucuuauuuuuccuacuggauuuuaaauuuggauagacauuuuuuauuuuacuuuuuaaauaucuuaauuaaauccuaacuuucacuaucauaccuaauuucucacuaucaaauuguauaugcaaagaaaugaaguauaaacaaaaaugaagugauuaaaguggguuguuauuuuuuauuucuuuauguuguauuugugauauagagacucuaagauuuauccccaagacuuuuaagaaauaguuuagaauaauuuuauauuggguggguagaagauguaagauaggguaugggauuggaucucuuuuaaguacucuugaacuacuauuuuuguagcacacauguaaaccaacugauuaaaaauuuuuuauacugauuguaguuuuucauugaguuagaagugauauaacaaaacuuaauuuuauuuuuuugagauagggucuugcucugucaucaggcuggagugcaguggcgugaucauaguccacugaccccucaccugcuggguucaagcaauccuccugaauagcuggaaugacaggcaugugccaccaugcccgcugauuuuuaaauuuuuuguagagacagggucucgcucuguugcccaggcuggucuugaacuccuggccucaagugauccuccugccucagccucccagagugcugggauuacaagugugagcccucgugccuggcccaaacuaauacuguuaaugugaacaauucauuggcauuuaguacauucaaaaugaaaggcaacuaccaccuuuaucaucuaauuuaaaacauugucaucaucccaaaaggaaacuacucauuaagcaguugcuccucauucccccuucugccagcccugacagcaaccaauccgcagucuguuucuauggauuuaacuguucuggauauuuuguguaaguggaaucauacaguaugugaccucuguuuagcuuuuuaaauuuagcauaacauuuucgagauucauccacaugguaucuuguaucaguacuccguuccuuuuuguagccgaauacuccauuuuauguauauauggugauuuguuuaugcauucauccauugaaggacaguugggcuguuucuaccuuuuggcuauugugaauagugcugcuuacuaugaacauggcauguauauguauuuguuugaguagcuguuucaauucuuuuggguaucuguauaccuaggaauuguguugcucagucauuuaacuuuuugggaacuugacaaacuguuuuccacagugauugaaccauuuuaaauuuccaucuucaguguagaagguuuuccauuucuccacauccuuauugacacuuagguuccauuuuuuaaaacauuauagcuauccuaguauauaugaagugcuacuucauugugguuuugauuugcauuuccuuaaugacuagugauguugaguaucuuuucaucugcuucuuggccauuuguauauuuuguuuggauaaaugucuguucaaguccuuugcccauuuuuaaguuggguugguugucuuuauagaguucuuuauauaguuuggguaguagauccuuaucagguauaauuuguaacuuuuauuuuacagguugucuuuuuacuuucuuguuaauauacuuagauguauuaaacauuuuuaauuuuggagauacacucauuuuuuucuuuuguugcuucugcuuuugguguccuaucuaagaauccagugcuaagucuaagucaugaagauuuaucccuguuuucuucugagaguuuucuggcuuuagcuuuuauauuuaggcuguugaugcauuuucaguuaauauuuguauauggucuaagguccagcuucauuguuuugccuguguacauccaguugucuuuuccuuugucuucucuagacuuuuguuuacuuuuucuaggaaugccuucugcuucaacaccuucuguucacauucuauccauuauucagacaaauugcacuccuacauauggagcuuuugcuuauagauaggcaccuuccucuaauaccaggggccaggguuuucuaugucuuagaaacccuaagcauuuaaauauauguuuugcucuuuuuuuccaacaguuauaaaaggccuuuugguucuucuaaaaaguuuuaagauaauugaauuuuucauggcuagacuaagcauuugucuagucuccuagucuuuuagauuugucuaaaauuguuauucuagcuuugaagaaacagucuuuuuauuugccuuuaaagaauuuguaauaacucgaaugguuuuuggaugguucguguaaaaauacuguaggacaggcuacauugagaggcuuaaaaaggagauacaaauaaauuucuucuaaugaaugucaucuuuguuagguaucugaacuuaggacuggagcugcagaaggacuagccaagcugauguucucugggcuuuuggucagcagcaggauucuuucucgucuuauuuuguuaugguacaauccugugacugaagaggauguucaacuucgacauugccuaggcguguucuuccccguguuugcuuaugcaagcagguauugagucauacugauaaaucaaaaaucugacuugacaucaaauucaagucccccaugaauuauaucuauaaugauauuuuguuguugauacuuuuucugucuuuaguagauaaaugaugaaaugacaagaacgauacagauuuuaucuaucugaauuuuuggcucuuuccuagaugaaaaugcacuuaaugagugaauuuccuacauaguaguuuugaauuucauacuuuuucucucaucaaauaauguucugccaacauacuuugaauuuguuucucaauaggacuaaucaggaaugcuuugaagaagcuuuucuuccaacccugcaaacacuggccaaugccccugcaucuucuccuuuagcugaaauugauaucacaaauguugcugaguuacuuguagauuugacaagaccaaguggauuaaauccucaggccaagacuucccaagauuaucaggugagugacugugguaacugcaugcagaucacuguuuugguaaaauaaucucucucaaagaucccuugaaauacugaggaacugcauuuuggucuuuagacuucugucucaagcauauaccacaaagcacgaaagaaacaugaccuugggaaauguggagaaaucauaugaaaacagaaguaaucaaugcuaacauuuuugcuacugaaaagaaauuacuaaaaauccaccacccacaccaugcccaccuaguacugacuguuaaucugaaguaauaaccuauguuaucuaggacucacagagucuucaaauguuggcuuaccugcuaugcuucuggcacaagaaaggagaauucaaagacuagaacucaccucaagcuuuuuuggcuuuuaauucaaagaagauaaaucaauugcacacugacucacagacugaacuuaagcuggguuguuuuaauccuuuaauggcauuuggucaaacuuguuaccauuuuugaaauuuaauguauuagugauuucagaugcuaacagauuaaguugaaaguauuacucuauuuuauuugauauuuagugauaagcuacucuguucaauucauauguuguauauuauuggaaagauaagauuacaaaggauauuaggcaaaauuagguaagggucaguaauagagcuauuaagcacuucaugacuugagacaagggcaagagucaugugguaggaaugaugaguacagcauuaguuuuaaaacucauugaccaaaauucaguuaggccuuguugguauuuggggagugguuuggguagaggaaggauguuuuaguaaaggugauauauguagaugguuaugcaaauauuggggaacuguagaaagaugacuuuggcuaaggauccugaauaggacuguuagggcacaacacuggggguagauuauagauugcuuuaaaggccaauguagggaauuuggaguuggccuuaugugcaauggauaauuaugcagggcuuaugaugaaaggguuaaugucaugaaaaccacuuauuggaaagauuaauuugguggucaguggugguuauaugagaugaauuggugagcagaaagaaaagaauauuaauaaagaaagcagcugaaaaucuguauaauucgcuuguagaaaaaguacuagaaaguaauaguagaaagaauagaaauugaccuaauaaagaauuauggguacaagaaucuaaaagaaagagcuugagaggcaagggagauggaggaguccaggaaaacucuaaguauguguaacagcagacuucaaaggagcuguugacauaguuuaauuggggaguacucucaugaucagugucuuggaagaguaagggaaaaguagauuggggcauagcccuaaguucaacuacugcuaugcaaacaaaggccccagccaaucccauagggaguuccggaacugggauguuccuuugaguuguccagaauggagacaagcugaaacacuguacuugugcacgggccagucauuggauuuggacaaaucuuugggagaagagguaugaucuuggacaagguccaccaaaguccaccauugucagccuggaucaguacugcagcugggaacuuuuacccuccaaaacaugcagcaacugggggaugagugcaucuuuccuaaagggaguggaacugggcccuauaucacaacauccacaacaagaagucaagaaggggagcuuauuuuggggguagggaggauguuaaauuugguuuuagacauuuuauauuugggauuauggcaagaaaauuaguuggaaauauuuguuagauguguaagacuauauaauaaucauaaucaucuucaauuuacagagaauuuucucuuaauuuuuuaggccuuaacaguacaugacaauuuggcuaugaaaauuugcaaugagaucuuaacaaguccgugcucgccagaaauucgagucuauacaaaagccuugaguucuuuagaacucaguagccaucuugcaaaagaucuucugguucuauugaaugagauucuggagguaaaguaguuucucauuacucuaaauuaguuuguguuuauauuuauacauguagaauuuacaugguuguauuagauuauacauauguuagcauauugugacuuauuugaaguauuuucuucauaaauuucauauaauuuaguguuuuuaaacaacuugauauguauugguacuauuuucaaagauuagggaaugcgguguuuacaaaauguuaauaauguuuucuuuuauagcaaguaaaagauaggacaugucugagagcuuuggagaaaaucaagauucaguuagaaaaaggaaauaaagaauuuggugaccaagcugaagcagcacaggaugccaccuugacuacaacuacuuuccaaaaugaagaugguaaucacauacugaacagaauauuuauaagguucuguuuuuuuuuuuccaucuuuacugagacauauuuuuuucuacucuaacauguuugguuggacaucagaaaugaaugaaauuuuuuuucuaauuaauccucuugggaaagagcauuacugauaaauguuuauucugcuuuucaaguguuuuuuggcaugcauuucucaacauaugaccaucuuuuuaagaguuuugcuucuuuuuccaauauucaaauuuucgaaagggugauuuauaacuuuucacuagcugcuagaaggacuuugucauuucaguuuuauaaaaacuggucuuaaaaagacaauuuaaaauauuucaugagguuaucuuauuuauauuguuguauuauucccuuuaauagaaaagaauaaagaaguauauaugacuccacucagggguguaaaagcaacccaagcaucaaagucuacucagcuaaagacuaacagagguaguguguggauugaccaucuuuaugauaaaaguuuuaaauuuuaucuuccaaugaaaaauacuuguuuugcaaguuuucuuaucuuuguuuccuuagggauaaagauuuuuuuuaaaaugucuuugguauccuuucuuuuuaauucuuucuguggaugucaguuuuugccuugugucuaaagauuauaaaaucaguguugcucuuggugcuuuagauugaaagaaguaugaugcaaaagauauuacaaaagacaauuuggguuaaauuaagauuugguuaaaugaugguuuuauauuaguuauuuguguucuauccuuccuguaacuaagcauuuuuaaaaaaucccuguaguauuuuucugggcuuuguuuuccuucuauucccaucuuauuucauauuuucccaacuuauuucccaagggcuauccaacaauaggggaucuguuggcaaaguaaaugcugacuauuagggggucacuuggaaaaaaaucugaaauucaagaucuuuuuauuguuuuauuauuuccucauuacaaaagcaaugcaugcuuauuacagaagaaucagaaaguacauccagacaaacuacuauaaggaacacuaauaaucccacccaugagccaaccaugauuuugauuuuagaaaucuauuuuuuaaggcccuuuucgaugcagauuuaauuuuuucuaaaauggagucuggucauaauauuguuuuguaaccaguaaauuauuuaaauaccaauugcuggauauuguuccaaauuagucccauauuguuggauguuuucuuggggauaaaugcauuaguaaaagcagguaaggaguagaaaaaaguguaacaugaaugaaguagaguauauaauuuucagacugucacauugaacaguuugguuuugaucagauuuuuuuugugguauaucacaccaugagaacaccauccuuuuuaauagaccaaacuucauauauucauauuguuuuauuccuuauaaaugagaaacaucacaagccaaacuuugucuuacuccuuaaccuuguaaauuucuaguaaguagaaucuuauaauccccaguauauaaagguucuaguuuuuacauugaaauauauuuuagaacacauuugaauuggucauguauguuauuuuacaagaagccauuauuaccuuacuauguuuuaucaccuuccaagaaaaaaaaaaguuguuucuuuagcaccuguuuaugcaccuaaccuaccuuucuaacccuuaauuuucaugagucuccacagacuuugugcuauagcaauaauagagguacuucauuauaacacauuuuucauauacuguccucaaauacauugaacuaaaauuugccuucuuuuaacuugcuugaaauuuccuuauuuucccuuacucauuauuagugcuuacaaaauaaauuaaguuuuaaucuugcuuggguuccuuuuucuguggcagugauaacugguaccaagauggcuagaacaaguaggagauacauguguugaaaggauuguuguguugaagacaaaggauuuaguuagccuagaaacuagauuaaaaacaaaaagcaacugauaauaaauccugauaaugaauuauacuaucuucaaggacagagaaaagugacaguuucagcuaggacgaacaggaggugucagacugcugaagccgacucugaaagguaugucaugcaugucuagaauauauggaggccuaucuucacuuuuuauuucuacaaguagaaaaaaacuaauuuucuugcgaaugagagagaauauauaacaagauagugaaaacuauaaauagcugucuuagguauauagucuaaaauuccaucaucaagagcauuugacuucuuacggcguguuugcuuuugccuauuagcuggcauggucuuuaguacuaucuuuaauauguuguuucaauuuuuaauuacaugaugugacuccucuuugaucuucaguuagcaaacucuugauuuugauaauauuuggguucucuacacuuacauacugauagaauaauucugucuauaauuuggguauauugugugguagaguguuuuauuuuuggcuucugucagucaagccacuguuagagcugaaaguugguagcugucuuguauucauuugcaaaauuguauuguguguauuuucaguacauaguuuuacacuguugauuaaauuugucuuuuuuggggggaaacuuguuuuuuacuauguuuuuggaauuuauugcuuaaaucaagagagagaacuuaauuuuuuugucacuucuugaguuucaaagaaaucucuuuuggacaguuaugguccucguuuaauuacaagcuucauuacaaguuuguggcuuuuuuuccuguauaacaccagguucuguuauaguauauaaaaucauuagcuagauuuucccugauucacuuugcuagauagccaagucaguguuuuuuugacauugagauuuuaguuuuaagcuaagucaauggaaucaggcuaucaauuaaacacugauagaaugugagucagaaacaaaaaaguuuuauuuauaaauaaacugguuuuaaagcuuguaucuaaauucguguauuuucaacaucuauuuagugaucaugaaguuccagaaccagaaucagaaaugaagaugagacuaccaagacgagccaaaaccgcagcacuagaaaaaaguaaacuuaaccuugcccaauuucucaaugaagaucuaaguuaggaaagacgauggagguggaauccuuuaagauuauguccaguuauuugcuuuaauaaagaagaaguuacccuugucaaaaucagaacaaaccugaugucuuucugaagauuuucugcugugcgcuuccacguuacuuuggccuguauuaaagcaguagagcagcaucaguuauuauaguccagaaaaagugugcaucagucagucacacagauuuaucacaaucugaggugggccuaggaaucucauuuuuaaauagucucuccaagugauucuuaugaacucuuuauguuuaaaaucaugucauuauggaaaacuuacaaguguaacuagcuaguagcuugcauuugagaagcuuaugacuuagaugggcagaaucaacaaagaugaaaccgccugaggacacauuuaacaaguaacauuucuagggaaaaugaaggaaguaccacaaacuggcuagaaaggagcuuaucaaucaccagugaggaagaccaguauaacguucaacaacaguuauuuugacaaaaacuuauuuugugauuccuacagugaaaacauuuuuggugauaucugccugggaaaucucucuuccuaaaguauuuguauaugggaguccuuguuugugaauguuuccuggauuagggaggugucaacauaaauguauuauuaaccaugaagcugcucgcuauauuuuuggcauaacaaaauaauauuuauuuacuguggauaauaauucuagugggaauauaaugugacaggaacuucucuuuauauacgcuaccaauuuaugagcacuauucacugucaauuucauuucuugucuuuugaaauugacacuuggccugacuuacgaaacuuguacuauaugaaauugguccucuuuucugcaauacccaacgaaacaccuuuucucuuuauuauucagaaauguccuaacauggaucuguuuguuuuaauaauugugcuuuuuuuaggcuuaucaucuacuagaggccauuuacuuaaggugaaauuuuaagauggagcuaaaguaagaucacugguuuuuagaaccaaauugcuauacauaugugccucauagaacuuauaaaaggagucaaaguuucaaagcaagauaguuauuaagcaaaaggaaaaaugguaaugauagaaagucaguuaaaaauagaugauuguucuucauucuguuuguuggcucuguguucuccugugcuucagauuccuuauguguuguuguuuuaaagacaauuugcaggggguugggagaaggacugaaaagguacauuaagugugcuguaaggaaaagucuuagaaacauaauaagcuaaaaucccauucacacauggccaggcuauccaaaaagaaaggagccauguucucaugugguuuaccauaccaaagcuugcuuucucuggcaugggaaaaauaaauuuaagcaccaaaccuuuaguauucugaguauucaguuuuuagacauagucauguagccauugcugaaacugugcuuugcacuauuaaagguagggaauguccugcuuuuaaaagucaucccuuuaacuuuaaaauaaaaggcuaagguacaauaaaacagauguaaauccauuuaccauuuuucauucaaaacugguaacuuacagaaaccacauaguauuuuucucuaucaagaggcacagauuugcugaacaguaaacaugcaauugugccauugcucuuaaagcccacagacuuagauuuaaaauacagagaaagaacugauaagcucacauuuuccugugaaugggaaacaugcuacuugacaaaaagcuaugaucaacuuuuuuucuucuguacauauauaacguugaaggagauuuacuucuaagagauaccuuugccuuuucuuucaccaauuugcuucgagguaguugguauccaccuguuuuacaacugcucaugggucagguuaucaucacaaaucuuuacaauacuagcuuuauaaaucacaauguguuauauauuaaaacuuugugcacagaaauaaaacuagggacaauuacguauuuaaacuuagggcauaaaaaauucacauaauaccacuaaaagagaaacaucaaaauccguuuacaaaauuccacaaugaucugauguaaaacauguaaaaaaaacauauaaagaauauaaucaaaaugauuaaugcuaaugauuuaauauaaagacaaaucacaggacuagaaauacuucaagaucaauugauaaaugcuuauuguucagaaggaauacugacauacaaaauaaagauagugcaagaagaacugcaaucuauuucucuucgcuuuugagauuuugguuaugaacuguacagcucguuagagaugcuguugucaaauucagauuccauucaaugggacgauuaaggcacaucuuaauggggcucaaagggcaacuugcuguauucucaucagacacauucaguuucucaucaguuuucacuuguagcaugcuggaagaaaaaguguaaggcauuuuaguuuuacuuuaauuucaaaguaauuaucaaccuuguaaaagaacauuuaguuguaguaguguuuggaccucuaaauuuuagcauacauaaagcauuuauccugaaaauacaacaguuuucucucccgccuacuuacugaacuaaauacaaugaauaaugccauguaaccuguguaacuugagaaguuacauaugacugaaaaaguaacauugcauauauggauuacaucaguauacaucagaaauuauuuaaccuugugagccugguaggauucaacccuuuuaacuugcccuuuuguggaucagaaugagagccacuuugagaaaaaaaagggaucaacauuuguugaaugccuauuacguucuagccaccuucacauguauugucucaucugaauuuugcaaaagccaaguaagguugguaugcuuauccucauaguaaacaauaaaaucaagacucugagaguuaaguacaaauaugccugaggucauacagucaccugccuggaacuggaauacagcccuuucucuuuuccuuaugcuugucuacuaagcucucugaugaggcuggaaaaacaucaggaauuaaacuuauggccagcucaucagaggagcaugcggcauccacaggauacucugguuguuuuuucuguugaaaaaaauuuccaagaauuuuuuacauugaugggaaaguuggcuuauuuggcuuuacauuagguuggucagaucucuucaacauuauucuuuaauauacacccucuguucuggacuggugucuuauuccacaaguucaugagcacaguccugucuguuccuaaauguucccacauagggaaccuugcucaccacucugcuuaaccaaaccuuuacccaugccuaauccaaucucacaucucugaacuugcucucaguaaaacauugcauuggauugugaacuauuugggguucuccacuauuguuucaugucuaauagucugauaacccccucuagaucagaaggaaaggaugguaacauucuuuucucugugaagauaagcacagugcuaaauacacaguaauuacucaaaaauucaauaaacauuuauaaaaagccuguugugaaacaucuggagcagagugcuacucuucagaaucacagacacgugacagucaaaaggggagcuaguccacucuguguaaugaauacgccaucccuaguuuuaaauauuacuuauaguccacauauucagaugugaauccuuauguuuauaaacuauucaacagcucucuaauucacuugacauuuaacuaugguuaguucauuugaacuacaucauuccuaaacuuccuccaacuguagcucuacaagucuuccuauuagcaaugagguucagggucucauauuuaagugacuugguagaguugggaaaugggagcguccagacuccaguagaucuguccuugcaaccucaaccaaccaacucauaugccauucaauaagcuaaauccguuauauccuguuuuaccaccacuaacauaucuaacugcauucuccccaaacagucccagucccacagaauacaguuucaauuuguauaaauagauacuagacaaaaugacaaacuaccagguagcuuaguaugcaucaauaguaguaaaccacuuuuuugaaaagcuaaaacggaugugauuaaaaaauaauauaauuaaaguauaugugacaaagagauccaaaguacaguauuuucauacauauuagaaaugauaacugaauuuagaaaaaauuuacauuauuauuaaaauguccucagggaccucauuuuuguuuuucaaguuagcaaaacucagauaaagccauuuccuuccuccaaggacugcuagucuucauauuuguauugcuuguauuuucaaagcaaaaguuugauguacaccuuuuugagaaacucuaaggcaagcuauaaaaacacaauuauauuaaucaagauagcuugguaggcaaguauaguaaguauuaaacuccaaaaaauaaaaugaaggcauagaacaaauaaucauggucacaaauaaaaacaaauuuuguuuuguuugcuauuugacuaagguguuuucaccagagaagaauacuuuaauaaacuacaugauuuuccuuuucaaaaacauacggcgguuuucuuaaguaacuuuucuagaaugguauaguauaaauuuggguacacagaucccacaggugcacaaaacuauacuuauguaugggaagaaaaugucaguuuugaaaaaaaccuaaauuuacuaauauacagcuugacauuuaauucauauauacuuaaaaaacaguggauaugcaaaguuugggcaguacugcucuacagaauucuuagaauacagcuaucuuaggaagugcuggaaccaggggcauuagaacauuacagcuagaaaguaucuuucuagauguuugcuuuuugagacagcgucuugcucuguggcccagguuggagugcaguggcaccaucauggcucacugcagccuccaacuccugugcucaagcaauccuucugccucagccuucugaguagcugagacuacaagugugugccaccacacccaaauaauuuuuaaauuuuuuugaagagacagggcuggagccaagauggccaaauaggaacagcucaggucuacagcucccagcgugagcgacgcagaagacgagugauuucugcauuuccaucugagguaccagguucaucucacuagggagugccagacagugggcgcaggacagcgggugcagugcaccgugugcgagccgaagcagggcgaggcauugccucacucgggaagcgcaaggggucagggaguucccuuuccuagucaaagaaaggggugacagacggcaccuggaaaaucaggucacucccaccccaauacugugcuuuuccgacgggcuuaaaaaacggcacaccaggagauuauaucccacaccuggcucggaggguccuacgcccacagagucucgcugauugcuagcacagcagucugagaucaaacugcaaggcagcagcgaggcugggggaggggcgcccaccauugcccaggcuugcuuagguaaacaaagcagcugggaagcucgaacuggguggagcccaccacagcucaaggaggccugccugccucugcaggcuccaccucugggggcagggcacagacaaacaaaaagacagcagaaaccucugcagacuuaaaugucccugucugacagcuuugaagagagcagugguucucccagcaugcagcuggagaucugagaacgggcagacugccuccucaggugggucccugacccccgagcagccuaacugggaggcaccccccaguuggggcagacugacaccucacacggccggguacuccucugagacaaaacuuccagaggaacaaucagacagcagcauucgcgguucacgaaaaucugcuguucugcagccaccgcugcuguuacccaggcaaacagggucuggaguggaccucuagcaaacuccaacagaccugcagcugaggguccugucuguuagaaggaaaacuaacaaacagaaaggacauccacaccaaaaacccaucuguaaaucaccaucaucaaagaccaaaaguagauaaaaccacaaagauggggaaaaaacagcagaaaaacuggaaacucuaaaaagcagagcgccucuccuccuccaaaggaacgcagcuccucaccagcaauggaacaaagcuggacggaagaaucaauaucaugaaaauggccauacugcccaagguaauuuauagauuuaaugccauccccaucaagcuaccaaugacuuucuucacagaauuggaaaaaacuacuuuaaaguucauauggaaccaaaaaagagcccacaucgccaagucaauccuaagccaaaagaacaaagcuggaggcaucacgcuaccugacuucaaauuauacugcaaggcuacaguaaccaaaacagcaugguacugguaccaaaacagagauauagaucaauggaacagaacagagcccucagaaauaaugccacauaucuacaacuaucugaucuuugacaaaccugagaaaaacaagcaauggggaagggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuucacaaccuacucaucugacaaagggcuaauauccagaaucuacaaugaacucaaacaaauuuacaagaaaaaaacaaccccaucaaaaagugggcaaaggacaugaacagacacuucucaaaagaagagauuuaugcagccaacagacacaucaaaaaaugcucaccaucacuggccaucagagaaaugcaaaucaaaaccagaauaagauaccaucucacaccaguuagaauggcgaucauuaaaaagucaggaaacaacaggugcuggagaggauguggagaaauaggaacacuuugacacuguuggugggacuguaaacuaguucaaccauuguggaagucaguguggcgauuccucagggaucuagaacuagaaauaccauuugacccagccaucccauuacuggauauauacccaaaggauuauaaaucaugcugcuauaaagacacaugcacacguauguuuauugcggcacuauucacaauagcaaagacuuggaaccaacccaaauguccagcaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacagugagaacacauggacacaggaaggggaacaucacacucuggggacuguugugggguggggggaggggggagggauagcuuuaggagauauaccuaaugcuaaaugacgaguuaaugggugcagcacaccagcauggcacauguauacauauguaagaaaccugcauguugugcacauguacccuaaaacuuaaaguauaauaauaaaaaaaaaaucagugaaaaaugucauauaauggaaagaagucuaucggugcuccaagccccucuucuggggcaacuauuguuaccauuuuauugucuauucuucagauaguccccucacauugaaauauguagguaucuguguuucaacucucuccuuguacacaauucuaccauucuauauacuguucuguaucuugcuuuaaaauauguauuuuggauacuguuucauauuuguacaaugaauacucaauucuuuuaacagcuaaauagaauucuacuuuauggauaaaucuuaauugauuuuaucaguccucaauugacagaauuuuuggcuguuuuaaucuauugcauaaaauagcaaugaugcauugaauauucuugcauguguucaaguauaucuauagagcugacgaggaguagaauagcugggucaaagggugcuuuuacauuuuugauauuaucaaagugcccuucggagacuguaccauuuuacagucuaaccaacaaugugugaagaggucuuucauuccucuuacucuaaccaauaauguauaauaaaacuuacagaucuuugaaaaucugauguuaaaaaguggcauaccauuguuuuaauuugcauuucucuuaugaauaagguuaagcauauuuuaauguuuuagaagccauuuguguucccuuuuuauguguucuuugccaauuaguauaauguuuuucuuguguuaugaaaauccuuuguucuauagugauuugugaucccacucuccucccacccuauccaguuuauuaguuuauaucucuuauggugguuuucucaggaauacauucuaaaugcuaugucaucagauuuaucacucuuaugucauggcuucucuguuucauaaaaugauuagaaagcugaaagcagcagcaguuaagucaucugagaaagugacuuuauauaucuauauccuggauucuaaugaaagcucagcaauaguauguauacagugguacucuugagaguagaguuggggggaaaaauguaaagaccugggcucaauuucugacaauaaucacaauaauaaugacccuggacaaguaaccuuaaccucuugccucauuuucuucauaagaaaaaaaaaagguacuuucgcugcuuaucuuacagauuuguugugacaauuuaaugagagccaauuagcaugcuuuaaaaaccauauggagcucuauacaaauacaaagccuuaguuuugccgcauguuuuggugaaaagagaaagaagugggaggagaagugcuuaucauaaguaaggccucuucucuaucaaacuaggaaacuaaugcaggugaggguugaacaagggcaagaggaaucugaaaugguuacguaggcaucuaagccuauuuucaauacuuugguaaucccauggaccccaagauagaguccaucuccaccaucugaauggaaguuuacagaguaugugcauuugcaaagugugaaagauggaaaucuuuugggagucauagaaauccaaauaauuauuugugauuuaaauuaaugauuauugauaagucuaaucuucacaaaaguaaaauuguaucuagcucuaauaauuuaaacuugcauuacuggagauaugcaauguucauuucugucauagggacaauaaacuugaauguuaccuagccgacucuuacaggaaucaaauuuuggugcaaccaagacaggucugaaaauaucacuuacagaacaguagcuacguaccaggcagugugcuaaaagcuugauuuuuuuuuuuuuuuuuuuuuuuaacaauacaacauucaguccuaacaacuauucacugaagcucacagaaguaaaaugacuuacccaagccacauaacuaguaaauggaagucuccagggccuaugaucuaucaccuuguacugcauacuaacucuuggauuguucuaauucugucaugauucuccauguuaauacccauuuuucuauucuucagaaggcuuaacaugugagauuaguggacaaguguaugguuuauagguuucaaacagaaagauaugccuaaggcuauaguuguaaccccauccaggagaguuaaauauuuaaugcaugaaguuuccucauggcauuaacuaaauaaguagcagcuacucauauccuucaauuccugaaagaggagaauaauguucgggcauagacugacauguuuuugagagcuaacagaguauucuuuaggucaagaguuucagggaacaccaaguucaucuuuucaaagggagaagucagcuguaucacagauaaacugggcucugguacaggauuuggacuuggaauaguuaauguacuugacacugucaaaucugaacucaucuauuuaacuccaaauucuggaugacagcuuacuuucuucuggaauggugucuucuaaauauuacuagaguaaaaauuuacugacuagcuauuacagcucagcucuguccugcaaauugaugucuccaca

SEQ ID NO: 14343 - RNA, 5808 nt, Homo sapiens
uucaacuaccugagaugugaaggcagaauuaacaauggguugagcaauuguaggaaccuaauauuccuuccuguccuauggucuucuuagaccauuccauaccgucauagaagugggccccaaagacacuagaauguggugaauuggaggugucuaguuagaggcuacugccguuguucggauggaagagcaugaagguuuggaggguguuggauggugaccauggggacaagagaaggggccugguauaagagaacauggaggcuaggcaugggggcuuaugucuguaaucccagcaccuugggaggccgaggcaggcagaucaccugaggucaggaguucaaggccagccuggucaacauggugaaaccucaucucuccuaaaaauacaaaaauuagcccugugugguggugcacaccuguagucccagcuacccaggaggcugaggcaggagaaucacuugagcccaggcggcagagguugcagugagccaagagugugccccugcacuccagccugggcaacagagugagacuccaucaugaaaaaauaauaauaauaaaauaaaauaaaaagaaaacauggaaaggcagaaauaucagaauauggcaauuuauuugaaauagccagugauuccccccgauuuuuagcuaagguguagucuucuaauguuucuauaagaaacauguaauauuuauacaaaaaucacaaaacuuuuuuaaaauuguuaaaauaaaugacauauuccaaaaaaggaagguacuuguaauauucuaaggcuuuaaucuugagugccugggagagaaugcuggcgcaauucauacaaaguuagaaaauuaagacaaacauguuuuccuguguguggauaggaaaauggugaugaauuuacccagagaccuguuuaaucuaaaauauugcuagggugcaaagaaacaauggcauauaacaaguguucaauaaaugcuugucaauggaauaaauaaaugacauacacuaucugcucugagaauuaaggagcaccagauaaaagagcuaggcaagacucuuaccaagccugguacacaaaagaugaaaugguaaugauagcugcaggaaaaaagagauuccacaaugaguuugaaaagcccuggacaaaaccauccacacaaguuucuucacaucuugaaggauacagagaaacuagcagguggaugaggcagucagcgaggaaagacggagguagcugucaucagcaaaugcuagcaggaauacagggcuggcccaugauguggauacccugugcagacuaaugauuucucaccuuuucaaaaaggcauucaaauguugcuuaaacauuuauuuagaagaguggcugagaguuucagauaggaaggaugcagaaaggaacauuuuucaaucuuuucuagaauguucccagcaauucagcucuggcccagacuuccauagccuacucagcaaagcaguuaccagcaucccuccucuucaggaggugguuuaggaaacacccauuguugcucaaugugccucuugagaugaucagugcucaagcagcaaucauggagaagauaaccacauuuagucuuuuuccugaauagaguaauuuuauauugcuuuuuuucaucuccagugacauuuccaugucccuuugagauucaugccccaauguccuugauucugcuuugccugagaugcacauucauaaggucaauccucucccaguacaaucaccaaguacaagguggggaccacauaaacuucuucagauuaaaacaauuguagugcuauuugugugggacaagaaagaggggcuuauuuucucccuuaggauuccaaauuuucagcugcuucugaaguagugguggcagaaaggugaguacacaggauaacugguauccagccaaaccucuuggagauguuuuauggucccacaacccuuggcaaaagugccaggaaguccgcucugccuuucugcaaaugccagcacaccaacgggguggucacaccugggccagcagcgugcuuugaacucuuguuaucuggcaccaacugucccugaaucucucuccaaggcugagagcagcugucagaucaaugccugcaggcugggauugcuacauucccgggccgaaucuuacaaacagcaaccagguuaucuccuccgucauacugggcucuagcuugcccugaauucuucagugaaggagucauuuuucugucacugccugcgucacugccucaccccaugagagccaccaucaagauaaagccucaggggaggcguccugcucaguuaacaauugaucaaucaaagaguugucuccauuauucucuuaacucuuaccuaucuucacuaaacaccuacagccacuggcuggacuccagaggccccuccuccccuccuccaaacauggacgcuucugguacuagucauaaaugugaagauagggaugauguuuggauauuugaugaucagugugggguaccucagaccugguaccggaggccauacagacauaagccaacacaaaggccacuuccacauucugaacucacaccuccaccugcccauccguccuguugagaagccccauggagagaguucuuccugcugauaaugccuagucacagagucccaucaguaaagagaagugauuucucucuuuagacaaauuuuagacauaaaguuugaggauuucucuccuuaggaauaagucaauucauuuugaggacuaauauccauaaucuauaaggaacuuaaacaaaucagcaagaaaaaaagagccccauuaaaaaguggaacaaaggagaugagcaggcacuucucaaaagaagacauacgagcagccaacaaacaugaaaaaaaugcucaauauuacuaaccaucagggagaugcaaaucaaaaccucaaugagauaccaucucacaccagucagaauggcuauuaucaaaaagucagaaaauaacagauguuggcgagguugcagagaaaagggaaugcuuauacacuguuggugggaacacaaauuaguucagacacuguagaaagcaguuuguagauuucucaaagaaauaaaaauagaauugccauucggcccagcaaucccauuacugggacauggucaaaggaaaauaaauccuucuaccaaaaagacaccuacacucacauguuuauugcagcacuauucacaauagcaaagacaugaaaucaacccagguacccaucaacgguggauuggauaaagaaaaugugguacauauacacuauggaauaccacacagccauaaaaaugaaugaaaucauguccuuugcagcaacauggauauagcugggggccauuauccuaagcaaauuaaugcaggaacaaaaaaaugaaauaaugcacguucucacuuauaagugggagcuaaacacugggugcauaaggacagaaagaugagaacaauaaacacuaaagauuccaaaggggaaagggagggagacaaagguugaaaaacuaccuauuggauauuauguuuacuauuucagcuacuggaucauuagaaacccaaagcucagcauuacacaauauacccauuuaacaaaccuucacauguaccucuugaaucuaaaaaaagaaaaggaaaaguaauauguccauuuguuuuacaauuccuuugcacaacucuaggaacuacuaaaagaaauagcaaauccuacucacccacucaucccguaacaagaugguggggaaaaaaaaaugaggacaucuccaauacccacaaaagaaacuguaacauuauuuuuuuaaauuuuuacacaaaauaaaucguaauucauucuacuuuuuagaggaaacuuuuagaagacagggaauaacaaaauugaacagagaaugagacggggagucacagauuuggggaaagagaaacaagaaaaagauaaaauguuucccuccgaagaguucugaguuuggacauuccuuaaauuuuuacuauauuuuauuacauauauauuaguauuagccaauuuauugaacacuuaccaggugucaugugcuguguaugcauucuauaagcauuaacuuguucauuuuauuuaaucuuuauggcaaaccuaagacguacaaugguauuaucuucauuuuauaccugaggaaauuagacaacuugucaaaggucacagaaugagagauggcagaaccugguuuuuaucaaugucuuucugacuccaaaaucugugcucuuagucauucaacugaauuaacucccaaacaaaacuaaaauuucauauaaauaaaauguauuacuaaucuuuaccaccaaacauagaggaaauauuugcauaugcaucauaguacagaggaaauguauaaaaugguaaguuuuggcugacugcagugacucaggccuguaaucuuagcacuuugggaggccgaggcaggaggaucacuugaggccaggaguuaaagauugccgugagcuaugaucacaccacuguacuucagccugggugacagagcagacccucacucaaaaaauaaaguaaaauuuucaaaagcuugacaaugaauggaauuguuauacuuaaauuaacuagcuaaaaugauuugguuuguuccaauaacaguaagaccguucuucacucaaaguucaccauuccuucugguaggagaauaaaaauguucuagaaacaucccagauacugcagcauuuggaauguuaauuuuagcaagucccaguguuuggaacaucugccucacugagagauacccauugauaacacacuggggggaagguaaaggguacaagagaagcauguaauucagggaccaucuccaagggcaaaagauaucaucaugauguuugacucugggcuugagucaaaaagcagaggaggcuaaaaaaugugcuuucaguugucaagagaauaaaucucauccucccauccuagaggcagagugaagcucauuagcauagaguagaaaguccuccaggacucuucaucaaccuucuguccacacugcugugcauuacgcuugugagagacaguaccuugagguaguuaagaaaacagucucaaagccaggaugcaucucuugauaucccaacuuuuuaacccauuaaauacaucaacuucucugugccucaauuuccucauccaucaaugggaauaauaauaauacuuaucucauagaguuagugugagaauuugaugagcuaacguauacaaagugauugcgauuuuguccagcaaauggccaaugccacauacaaaugucuguugccauuguuauaaaaauuuaaagugauuacacugaaucccuccuuucauauucuauaagcagcaucaaacucccuaagagaaauucuugaaaaguccaagguuauacuguagcaucuucuuuuaaagguccuagggaaauggcaaaagucuaauuaaauuuguucucagaaacaaaaauugauuuucuuuuucaauaauucuauuaauugaaucuccuccuucaccucagccaaagacuagaacuuugaagaacaaacucuugucuuugucauuuaaauaaguuaguauuauacuacuuugucaauaauaacaccuuuuacuggcaguuagacacaauacuaaacuggcuacuaaucuaucuuaugccaccucccaaauaaucaaaauaaugcaaauauaaaccaucuucauacauaaaaauuagcaaaagaaacaaaacuaagcaaaaaauuauaauaccuaaugcuggcagaguugcaacuaggcacauauacucaagcauaccuuuugcguaacaguguaaaauguuuugacccuuuugga

SEQ ID NO: 14344 - RNA, 1397 nt, Homo sapiens
guacauuugaucacuccagugaccaauauaauaacuuacguuuguagagcaucauacauuucacauacaggagugcugcaaugcuguugagaucaguggcuuaauuuaauagaugcuguguguccaggacuuuaacauggggugucaauaucugacacagaggaggcugagugaucucauuuggcuuucagcauaacuccgugaguggcuacucuuauugucuguauuuggcaaauaagauacucuaagaaguuaaugaccuuguugcaaguucucuagcuaaucagugauagagccaggagucaacccaccaaagccuaugcuuuauuuuauuuauuguaaaauaacaucacuaacaaugcauuuacauguguggauagguaauaacuaaguauaaaggcaguucaugguaguacugagagggugauacuguguguagugguuagagaugaggcucuggaauuagguaaauuacaaaacuuggcagagucaagcucugagcccagguuacagaaccuuaccucuaaccacuacacacaguaggcucuauaacuugggcucaaaacaugacugccgcuuauuaucugugugacuuuuaucaaguuaccuaaccucucugugugucgauuuccucauccacguggaagcuauauuagcacuuaucuaucucaugacaucuugaggauuaugggagaugaugccauuggcugagugccgggcacaucaccaaggcucagugauagcuuccuaaguggguggcaaguccugaguucugucgcuauggcagugucaucuuccugggucacccuaucuucauucgaaaaaugacaggcuagaagaugugaucuauaaggccccuuccgccuauaaaguuguugccucuagcauaguuuugcagugucuuauggauaaugugagcccccucaguauuucugaaacguuuucauucucuguugaagagagaaaauaguaacaugaaguggguagagagagaggagaaaagaggaauuauaagagcaucaguaggggauggaugaaggacugggugucauaugacaaguagcuaaauuggccauuacggguaucgaacuccauuugguguguaauaguaggugagcacuuggccauaugaaacucauaucuauauaucaacuuucccuaaacaccaucucaacuaaugagcacugaaugaggaauggagauuugguugggcagagauaacagcagaaaauaugagaaauauaaguacaauacuguaauuaaaggaaaaccacugugacuuaugaccuccaucucaauuccuuuauucuuucuuuuccugucaagcagcauaaagcaagaacucuuauggaaaguagacagaggaagcaacauuucuuuaaaaaaucuaaaaaaaa

SEQ ID NO: 14345 - RNA, 57121 nt, Homo sapiens
cggaagcgcgcgcgcgcgcaggcccagcccucgucgccgccgccauuuuagcuguugguuccggccgcaccgugugggcuguaguagcgggagggguggggguccuccagaguuaaguggcuguccucgacugugcccauacagcagccagcuuucuuccuuaauaacugcccguucgaagagugcgaggauguccaagcggcaccgguuggaccuaggggaggauuaccccucuggcaagaagcgugcggggaccgauggguaagccaggccgggggcgcgaggcggcagcucgggcuuuguugggguccuggcagggagcgggccggggcuggccuggccgagcggguccuggagcccgagccuuuguuucucucugggcuggguucacuagcggcggguaggagaagcgcggcgcccguucggcccggcaagggcgcgggggguugcgugcgacggggccgcugcccagcccaguccggaggguggagaggccugcaguagccaugagggcgccuccucccccaggccgaaccgagcgggagucauuugcgagggcgucgggcgggagugaaccgcggaccucguggccucgguucccgaggaaggccuggagccggaggagagggugggggagggcgcggugggaguauucgcuuccaagggcagcaggcacuucccagccagaggggccguggggagggccugggugggggcgcggccaggcacuccagacgggaaaggcggagggcggaaagugagagcagcgcguggaucauaauguaggcugggauggggguggcgggaguugagagaagccagcaaauagggaguucucgggggaggugggaguagaggaccugccgggagaaaggaaaacguggaguaauauaccugaugggcuggaaggcugguguuuuggggcgacugaguuuauaguuuggcgggagagagcgugccuugguccauucaaacacuucaaaguagauacuagcaaacuuccgcucucugccuacgcucccgccaucuccuguauuuccugcuuugguuaaaacugguuacugaacaucgucccauggggagggauuagaaggcauuguuuuuuuuuuucaucauuuauuuucuaugcaugucccacuuuucuucauaaguagcuuuugaaauacagggaucauguucaaaacguguuuuuaguauuuauggcgaaacaccgcccauguggagguugagaguugaaauacuuacacaaacucuugguguuccagauuccuuuccuuaaagguacagaggaauuuagcaguuaauuuaagcaauuucgugaaaaucauuucuugucccuuguguguuuucauugaugaaguacaaagaccuguuuggauaauucaggcaaaacccacaaaagcccgaguagccaaauacuuugcauaauuguaucauuuuauuguguacuugugauacagaaucacugugucaagucaccuguauagcuguuuugaauuuuucagcuaaaguucuucauugaaauugauuuccagggauauguuuagugucauuguagaguauaagccaggauaggguguacuuuuugaggcuuugccauauguugaauuauucaauagaaagcaaaagcaugucacauuuuaauuuugugaguuauuuaguuuacgauauuaggcauuguaaaaaagacaaugacauuguaagacagacucucuuuaggcuaucacccucccccaccauuacgccccacaaaacguuaauaccucugagcuguaugucacagacucagagcuggaagcaacuuaaaaaagacuauacgcggcuccaaucaaggaaugagaaguggagaacagaguuaagguggcuugugcaaguuuacagcaggaucuggaacccugccuuugucauuuucacucagcagcacacaguucaguacuguaguuaagagucauuacagccuauuuuaaugacauuuauaaugcguugguaaaguagggaacacuuaguucuugauuucucuaaggcaaaaauaaauugcugucaucuggaacugaugucucucacaggaggucagauuggaacaaaauauucugggagggaaugaaugaauucauuuguauuugugcauaugugcaccauuuaaaauguuccccuugggauuaguggucccaccauauguaugugcgauuguuuacuuucucuugcaaaaacagauauccuuaguaaaaagguugacuuuuggagucuaaugguagcuuuaugauucccuuguauauuauuuagaauuugccuauggauaaaggagaguucaucuuuggaauaaugcccaaguuauaagaaauaguagagggaaguuuuuauacucauuucuaugucauuugagugccauuuauccuugaacugguuuuauuuaacaguggacuuaagguguuuaucggccucagaauuuuuucauacucgauaauuuuaagucacuuguugacugccaugcaauccugcagauuuuuuuuuucccugauaagcaagugguuuuauuggagagcauaagcuugucagucuuacaaacuccacugccagauaggguuucugcaguacugagaagggaagguaauucagugggagauuucacuuauauuaaugcucccaaacuauauaaggcuuuauuuacuccuggcauauuuuaacuuugaaaucaggugaaguuauuauagguuucuguugcauauucuggccucauuucuucuuuuugucaacccacagaaucuucacuauacaauuaccgaaaguaauaauuuuccauacuuacuguugaaguauggaaaaaaguuuucgauguuaggggcguuuuucauuuugauguugguuuuugauauuaccaccugauaagaguuuuuucuguuaauuaugggaaaguaaagcuaauguauuaauacugugauaacauuuguggagcaugcacauuuucacuacaauccuguaugguagaugagguuaaaugaacuugccacagggaacauaagaaauguuuauacucaaagguuuaaagaaggcauucccuaaaaucuucaucuccaucuuuggauaacaguuuuuggugaacauuuucuaagaucucugcauauugacucaaaaauaugaacuauaaaauuuaauaucagugggaucaacgcguguuauuuuguacuuugauuuuuuuuuccacucagaaaugucauuaacuguagguacacauuacgcuuuuaaauuggcugccauaggccgggcgcaauggcucacgccuguaaucccagcacuuugggaggccgaggcggguggaucacgaggucaggagaucaagaccauccuggcuaacacggugaaacccugucucuacuaaaaauacaaaaaauuagccgggugugguggcgggcaccuguagucccagcuacucugggaggcugaggaagaaugguaugaacccgggaggcggagcuugcagugagccgagauugugccacugcacuccagccugggcaacagagcgagccuccaucucaaaaaaaaaaaaauaauaaaaaauaaauagauugacugccauaguacuccaguuguaaagguaugacaucacuuauuuaaccaauauccuguucauugauauuuagguaguuuuccacuuguugcuauuuuauaaaugagaaguuugaugaacauccuuauacauacguauuugcacacauccuugagagguuccuggaaauaagauugacggauaaaaagcagugcuuauugccgggugugauggcucacaccuguaaucacagcacuuugggaggccuaggcgaauggaucaccugaggucaggaguucaagaccagccuggccaagguaauaaaaccuauuuuugucucuguuaaaaauacaaaaauacacugggcaugguggcgcacugcuguaaucccagcuacuuacuccggaggcugaggcaggagaauugcuugaaccugggaggcagagguugcagugagucgagauugcaccacuacacuccagccuggguaacagagguagacugucuuuaaaaaaaaaaaaaaaaagcaaugcuuauuuaaaauaucaugauuuugaugaccaguuaaugucuuccuuagcaguacuucagugccuguuauuauuccauguagaauuuuuuuauuuuuuagagacagggucuuccucuguuucccaggcuggagugcacuggugugaucauggcucacugcagucucaaauuccagggcucaagugaucuucccgucucagccucccagguagcugggacuacaggcgugccaccccaccuagcuaaguuuaaaauuuuuuuguagagauggggucucacuguauugcucaggcuggucucaaacuuuuggccucuggugauccucccacuugggccucccaaagcacugggauuacaugcgugagucacuaggucuugcccuccauguagaauuuuaacaugguauuagaacuuaaaaagaucuuuaauaauaaccaauauugguggggcgcgguggcucaugccaguaaucccagcacuuugggaggccgaggcagucagaucaugaggucaagagauugaaaccauccuggccaacauggugaaaccucgucucuacuaaaaauacaaaaauuaacuggguguggcagcaugugccuguagucccagcuacucuggaggcugaggcaggagaaucgcuugaaacagggaggcagagguugcagugagcugagauugcaccacugcacuccagccuggugacagagcaagacuccgucucaaaauaauaguaauaauaacaacaacaaccgauauugggcauuugcaaugugccagacaacacuuaaagcacaucacauauauuaacucauuuaauccuaucuauacucuacaaaacauauugauagccacaucuuauaggugagggaagaaauaacugugauccuauaguuggcuuaagucuugagccaagauugaacugagacacaguacagagcaguauguucaacaacugugucaugucauaccucccucccugcucgugguguggcugugucugaagcacugacuugauaccaguuuuuaaaaacccuuauacuucaacuaguaaacuuuuaagaacaaaacuccuuuauaauaaaaaguaucuuuuaaaaaagaaaacacgcaugugcacaauaguugacaaauauuuaugaaguggaggguuugauuuuccccuuuuacucaccuuucauuuguacucccucucucaucgaaggaagguaguuugagccauaagcaacauuuccaggugucugaauuugccuccugcauccucccuguuuucuuacuuuaaucugagacuaaaaguaucugaaaaugcucuucauuuugcagaucaguaaauugaggcagugucuugcaauggugauuccagcauuccuuuuaucuuaauaccacagcugucgccauugcuugaucagcagcuaaccuuuuaucuuuagaauguauuuuauacauccuuuguuugguuugguaaugaagcaucugaugaagugggccccugaaaaaaucuuuguuaguauagguauuacuuuaacaaacuaaggcaauauauaauacaugauuuacuuugucaccucucuucccccaaauuuuguaacucuugaccaugucuuaauugccugguacuaugcuagaaguauagaaaucauuaaacuaggcugggcaugguagcucaucgguaaucccagcacguugggaggcugaagcaagagauugcuugaucccaggaguugaaaaccauccugggcaacauggugagacccuuaucucuacaaaaauaagaaauuagcgaggcgugguggugcaugccuguagucccaguuacucgggaggcugaggugagaggaccacuugaacccagaaguuugauauugcagugagccaugauccagugagccacugcacuccaacccggguaauggagcaagauccuaucucaaaaaaaaggaaguuguuucaauuauauuuuuugucaucuccuccuucccccaugguugagugaauacuagaaacaugaauccuuuuuguucagaccagauguucuuuaagaguucuuuucuagcuguaugauccaugaucuuuaaggugucaaguauuugaaccauuugugaguacagugcuucuuacuuugcugggcacauuucuguguacucuuauuauaaacuacaccucguuggcauuuuggagcaauguaaacacuuaauuaacagucaccuuaggccagaagcaggagaagcaaagauaguugauggcauauuucagaagauagguccagacucucaaguauugaauugugagacuucauuuuauguuuauuaaguuauccuuugacuuuucuuucccauugauuuucuuucuguuuaugccaggugaaaugagaggcuucauacaguucuggcuuguaugcucugugauuuuuguagaaggugaacauugggauggaagaggggaaaaucacuuuucauguuuauauaugcauauauauggcuuuuccccuuuuugaguaaauuuguacaugucacacaacugcacuuggagcacagggaauuuguacuuuuguguauuguggguaaggaacaaugacauguuucggggcuugugucauagcuccgucaugucucauuauuucaagucuggguuuaaagaucuugaggcaaauuucucugcugauggacuuggucugaaguaaacuggauuaguaaaaugaacaagcauagauuauuuuauuuuauucccaccaccagucucccagaggcugcuuucagccacaacgcauaugaacaaccugcagccauucugcuugugaaguucuuagcauagauacuuuuaaaaugacuuauuaaggucaaucucuaguaacuggaaguagauaccagcauugacuacuuaaaauugacccagguuuaauagaguggcuaccugcauaauuuuaacauguuaaacaacuuaauaguguuuagcaaagcuuauuuuuaauuuggcuauguuucauuuuaugguagaccaagguacauagauuuauagagugcuuucaguguuuugcuguugcuguuuagguuaaaaugcaagaguaaacaagcaagaaggaauaaaaguuuuaauuucaguuuuuuuaauaaagcaauauacauuuacugaacaaaauugggaaagugcuggaaaguauaacuaagaaaacaaauucugcaguccuguaauucguauuuguauuaguugagauauugacagguauaacauuguacuaugcucuuuucacuuugcauuacaaccgaacaucguccuauggcaaagaaaggaauauuaaaguaauuuauuagaaguggauuauaaaaguauugagcaaaacccaccacuguugacuguaaugaugugagguggaguugucuuuaucuccaguagcaguguuugugcuaacuucugaauauacuuuuagugcacaaaauaccucuucacaaauugaaggagaauuugagaaagauugagaugccaucuucuuuuacucaauuuggaccuauccuuucuucauccuacccucaguaucugauuucuguugucuaaguaggagggguuuuacuugcagcagacugaguucuuguguuaccucaccuaauguuaaaaguuaaggaagguggggcaucagcaaggaagggaaagauguuugugguggagaaugggaaacccuugauuguaggguauuuuuuauuauuucugauaguuacauaauccauuggacuuuuuauucauuugaacguuggacauuuacucucuuugugauuauaacgcuaccgugaacauucugcauaaaauucagaaucugaauucuaaauuuuuguuuuuaggaaggaucgagaucgagaccgggaucgugaagaucggucuaaagaucgagaccgagaacgugauagaggagauagagagcgagagagggagaaagaaaaggagaaggaguugcgagcuucaacaaaugcuaugcuuaucagugcuggauuaccaccuuugaaagcuucccauucagcucacucaacccacucagcacauucaacgcauucaacacauucugcucauucaacgcaugccggacaugcaggucacacgucacuuccacagugcauuaauccguucaccaacuuaccccauacuccucgauacuaugauauucuaaagaaacgucuucagcucccuguuugggaauacaaggauagguuuacagauauucugguuagacaucaguccuuuguacugguuggugagacugggucugguaaaacaacacaggugaguuauuguauaccaugguacauauuucauuuauguuuaaguuuaccaaauguugcauauuugauucugguggucauuucccuugucuguccuauagaacaucuugaagaauagcugauuugauguuuaauuggcacucugaauuucagaguggaaauccuauagagaauaccucuccccugaaucuaggggaaaauaguggugcucgcuuuucaaauuuuguuaccuuauguauggcagagguauuuugacucccggacaguacagauuuagggacccacaguuuguuuucugguacuuggguggagaaaucacugggguagauuuuugucguuuguauuuaauaugguauuuugaaccaugcaaaaaaugaaaugccaaaguaauauaaagucuauaccggugacuuuuguccaucuagucguccucccucccauagaacuaaacacuguuacuaguguguuauuuguaauauagcuaggauauuuuuuaaacauggaugggcuauuauuaacuagaccccuguugauagacauuuagacuguuucccaugguuguuuugcaugggucaaguguuucuguaggaagcagaaauugcugggucagaagaucauuuguaauugugauacagaaagcuggauagccuuccagagggagcguaucaauuuaccuuuccaugagcauguaggagaacacgugggaaacuauuaaaacgugaauuuuuacaaauccaauaggugaaaaauugcauucuaauguacuuuuuaauuugcauuuucuugcugugggugagaaguaacugucuuuauacacuuaagccugaaccaucaauuaaaaauuucugguuucaaaaguagcagucccugaucauuguagaaacuuugaaaaauucaggaaaguauugaagugaauuaccugucuuaccaugcagagauugaacauaccgcauacacaauuuaucuuuuucuaaaguuacaugugcauggagacauuuugaagguacuguagcaaccaaaauaggaagcuuuuauuauagacugagccuuaguaccauucuucuuuucuuuucuuuuuuuuuuuuuuaauuuuuguguuguuguugagacagucuuucacccaugcuggagugcagugguaugaacacagcgucaaccuccugagcugaagcgauccuccugccucagccucccaaguagcugggaucacaggcauaugccaccagugccuggcuaauuuuuaaauaaaauuuuuguagaguugagguuuugaacuccugagcuaaagcaauccuccugccuuagccuugccaauuuuucuuuuuuaaugaaggaaaacuuagaauugauguuaggguauucaaaaaucaccuuacggaaauuuuaagaauuuucaaacuacaagaaagacuguaacucugaacuuacuauuuaauugauauuuggguaaagccagacacuguauacuuuacauguauuagcucauuuacguuuuucuauaacccugcaggaagauauucaucaccacuuuacagaugagcaaaaugagguuuaaguuuaugagaaacuuagguuuaguggauuguccuggguuacauggauuauggauuuuggugggcucaauauuuaaaacuuuguaccuuuugucuuuauaucuaaaguuuuauauuucauacugcuauucuguggucugauuauggguagccucauuucagagaugaguuuauuaaugguuaguguagaaggaggucaggucaacucaagaugagguuugugauuauuuggauuaauauuuaacuuuuagagggguaauuaagauacuuggauacugaggauugcagcacaucugggggauuugaagggaaaccaaacaguuuaaaaagugaauuucauucaaauguuuccuagcaugcucuuauuaaacuuugacucaaaccauuaaagccagucuuuuuuuggugauuuguucuugucagaaaaauucucuaaacaaaaucuaaaguaaugacuuuaacuuuuuuuuuuuuuuuuuuuuuuugagacaaagucucgcucugucacccaagcuggagugcagugguaugaucuuggcuuucugcaaccuccuccuccuggguucaagugauucuccugccucagccuccugaguagcugggacuacaagcgcgcaccaccaugccuggcuauuuuuuuuuuuuuuuuguauuuuuaauagagacaggguuucacccuguuggccaggcuggucucuaaauccugaccucaaguuauuggccugucugggccucccaaagugcugggauuacaggcccaagccacugcaccgggccaugacuuuagcuuuugacagaccuacaauaaagacauuucacauugcugcuuaguagacacauaacugcacaugaggaaggaauugaagcuaggucaaccaaagggacagugugagcaaggacgcauguugagcuaagggaaugcagguaugcucuggcuagaauacagaggguuugggaagguggagguggggcaggugagacuggaacuguaaguugagccuuaauauaucuuguauagacuggaagccaucagagcucuugaauugaagaggaaugaugaggauuuuuuuuuaaaaaaacuccugucuagugaacauauugaugauacaccauguaagagcucauaacaaaaguuucgauucugugaagggccuugggaauagaaaauaaagaauggauuggagucaggauauuaggaauuacaaguauuuuggaggaaggugagaaauggcuuugcuuuugaaugugugaauuugggauaccaacuagguggaaaugaccguuagcucuaagaugaaagcuggaguuaggauuggcauugauguauuauagguaguauuagaaguuagaacauauaagacuucacaggauauuauguaaaacaagaagacuagaacaccgaggaucaguuuuaagaugcccucaaguggaggaagcaaagagcugaaaaggaggaauggcuuuagaauaacuuagaccuggcuggguacaguggcccaugccuguaauccuggcacuuugggaugcugaggcgggcagauuaccugaggucagggguuugagaccagccuggccaauauggugaaaccccaucucuacuaaaaauacagaaaucagcugggcgugguggcgcacaccuguaaucccagcuacuugggaggcugaggcaggagaaucacuugaacccuggagguggagguugcaguaagccuagauugcgccccugcacuccagccugggcaacagagugaaacuccgucuuaaaagaaaaaaacaaaaaagccggaucccuggcuugaauacaccaguagccuacauauuucaggaccucuuucuuuuccuaaugcuguuuuccuuagaaaugugaacagaugcauuaacugacugguucuccagcuauugccugggaguucuugaaaguccuugaaaccauuucagggauccuagaauuuguaaaaauacaaggaaacgcacucuucuagcuaaguuuuuuuguuugaaaaguagucauuuuuauagaaagcguuauuuuguguuaaaacagaaugaguuuuauuguuaggaauuaauauuuuagcaauuuuucaguuuuaauuucuuaacaguaaauuuauuaguagcuuggcauccucggucauuuucagagugagugcacagggguccugagagcugcuaauugacuuguuggucuuguuuuuaaaguggagguaagcuguugauuuuagcggagugaauuaaaaaaucugaacauucuuggccaggcaugguggcucacgccuauaaucccagcacuuuggaaggcugaggcgggugcaucaccugaggucaggaguucgacaccagcuugcccaacguggugaaacccugucucuacuaaaaauacaaaaaauuagccaggcgugguggcacgugccuguagucccagcuacuugggaggcugaaguaggagaaucgcuugaaccuuggugguuacagugagccaagauuaugccacugcacuccagccuggucaacagagugagauuccaucucaaaaaacaaacaaaaaaacaaaagaucugaacauucuugccuugagaauuuugaauuaauuuuaaauaucuuugguucaccagugagugaauuucacuuucuagaucuuugaaaguacauuuugccuuuguaaaaggguugccgaauugaggauauaucaguaaguaaggcuuuauagccugacuagaaaaccacuuaaaccuaggucuguggauuuacagaacccgauagauacuacuucuuuaguuauuuuuguucauuuaaaguguuuuaaagauauauaugauuuuagagaaucagcauaauuacccucccuuucagauauuuguuagugacaaguuacccccaauugcagaagcaaccuaacuaaaauguaauaauagugcagccaccaauauuccuuaucaguuuuacuguacugauacugugcagaaaacuccauguuuccuguagcauuagaguuugauaggcguuuggaagcuuugauguaaaccaguuaugcucuucuagcaguggauuuccauauaauauggugagcacuuacauuuuucccaugguucuuuuccaguuaagugacuggaaaacuguaaaauuggggaauccauuagcuuauauugauaauggaacugggggaaaauguacugccgucauggcaaccaauuuaacuugugcuugggggucccccaacccuuuggcugcccuuaacgaaguggugcugcucuagguccuguuaaauuugagacuggcaguucuuaaaauugauuuuaagaugguaccuaaggugcuaccauugugcauacugcuccugagggggaaaggauaggauuacaaaagaguugggugcuaagaguuagguucugcuggcuuauaaaccaaauuugaauugaauuaaauaaaaguacagcuucagaguuacaaggggguaugauuuccacuugauuuugcaacucaaauuauguaagaauuuaaaaguuacacuuucuuagaaacguuuguuauaaaguagaauuuguuguaaguuggauuuuuuaaaauugcauagagaaauacuucaugaugggauagucacacugucgaguguauuccugauugugucuacccaacuugggugugugucauaucaguauuacacauaacuguuccuugguuuagagagcuuguguuguuacaaguuuugaaucacaagucuuauagucauuugccuaauuggauuugguuuuaaaucauuagaaugagauaaagugcuuuauguuacauauacuugauaugcaggcagaauagaauuaauuuaaaugugaaauuauuugauagauuccacagugguguguggaguacaugcgaucauuaccaggacccaagagaggaguugccuguacccaacccaggagaguggcugcaaugaguguggcucagagaguugcugaugagauggaugugauguugggccaggaaguugguuacuccauucgauuugaagacugcaguagugcaaaaaccauucuuaaguaaguacuauaucuuuaaugacgcuuuuaguccucugcuugccauuuucugcuauuagauagaagacuuugcuagugcaggcuuaugucauccaaauuuagaauuauccaaaguaggccuucuuagacuuaccacaugaccuuaguuuaauuauauauuauugguaaucuauaguuacuugguagaaauugaaguucaaaggucagauuuuaguuacuugguucugcauuuuaggugaaauguuacugauacuguaaaaugugugguuuuaguagacacaaugguguaugacuuaauugugaaagaaaaggaaagugauaugucuuacuuaguaaaagauaacuacuuuuagaaagaagaauguauaggaugggaugugauuuauuuaggggagaggggacuuuuaauguuaauuaugcagcuauuaccgugcaucuguuauaagcuaaaaagaggaaucuuuuguucuguaauacacuguuagagcugccucuagguccuuguuccucuauagcuauggugcagauaauugacuacuguauugagcuuucuaauguuuuaacucuaccaacuuuuuauugucuuauacuugcauucugcauaaguuaugauguaugcuaccugaugaugauucuuucucaagucuucccucugguugcuucugcuuauucuguauuuaugugauauuuaaguccuuuuaaaugugacuuguuugaguggggcucaguggcauaugccuguuuauucccagccacuucguaggcugaagcaggauuauugcuugaggccaggaguucaaggcuacagugugcucugaucaugccugugauagcuacugcauuugaaccugagcaacauagcaagaccacauuucuuuuaaaaaaaaagaaaaaucauaucuaugugaucuucucccugagguuuuuaaaaaccauuuuggagcguuguguaggcagugauaugagucuuuguugucagagucuuuguugucagagagauauauaguguuaaugggauaaaugaaacaagagucucucuuuuuuuuuuuuuuuuuuuuuuuugagauggagucucacucuguugcccaggcuggagugcaguggcgccaucucggcucucugcaaccuccgccucccggguucaagcgauucuccugccucagccucucagguagcugggacuauaggugugcgccaccaugccuggcuaacuuuuuguaucuuuaguagaguugugguuucacuauguuggccaggcuggucucuaacuccugaccucaugauccgcccgccucagccucccacagugcugggauuacaggcgugagccacuacacccagccgcagaaauugaauagaauaaugaacugcauguguuuaucaucgacuuuuaacuauuucagucuuauuuauuucauauccaaucuuaauuuauuucccugucccauguuauuucgaagcagucuuagauaccaaauaauuauauauauaaauauuucaguguguaucucugagauaguuucuuaaaauagagcuaucauaacuuaaaacaauuuauuggaucaaaauauccaguuuucauucaacauuugugucaguuuuuucuaauucuuugauuuaucucauuuuauuagaacuuuuuauucagcgugauauuuaauagcaguugaacuuuaaaauauuuaaauaagcuuauccuuaugacuuuaugggacauauuuuuggcuuaaaccuuaaucuucacugaauaaauucuuguaguuguucagugauacguuauugaucacugguaauuacaguauaauugacaauaauugcauaagcaaaaucauagcucauuauguuguauuacuuuaaaaugcagguaaugucaaggacuugaggauaauaagggggagauuuuacucaucuuuaggaggaauaucauuauucugacuugauucacauugcauugaauuuuuuugguaagccacaguugagaacagaauuuggaaauugggauacaagaaaguuaugcaauauuggugcuguguguauguguaguaggaaguggguggaggauaggcuuucaaaagaugaguaccucugaaagauuuugguucacuucauagggaaugacaaguaacagauuuuauaguucaaaugaaguauuuuuggcauugugauuuuuuuaauggagcauuuucuagagguuauaacuacuuguaaaagcuuacuuaagacaggguaagcuuauugggguuucuucuaggagcuaaccugguguugccuuuaaguaauauaaguaaaggaguguauuauuacaauaaguuagcuuaaaauuuaaaaauuucaaauguaacuuugcuauuugauaggaagaacuuaacuaaugggaaugcuucauuaaauguagcucuuaucauauauagauauaaaaugcuuauauauccauuguguagccagggcgaacuuuaauuuucacucuagggugguaaagaggcuaacuuaggcagauuauguuugaggagcacagaauuuaaccauaguuugagagcauuuuagcuaaauaaaguaucuuuaaauuguccgcauauagauuaagggucuauaagauaguuucuucaguguuugggauaccuauucauaaauuuuagguuauagaucugacacugugcucuuuucggaagauuggaucugguauaacuuagugcacacucuguuagucuagccuuaaauggcuaccccaucccagugaacaaguaaguuuacaaagcugccacuccuaaaugguuuuuauauuuccuuuuuuauguguuugcuuguccccauccuuuucuucugaagcauucuuuuugcaacauacuuacuuuccuguuuucuuggaguggaaauuaugaagaaaaaacccaaagagauaccuaaagagcuuaccagucagggaacaauauauugcuguauuugugacuagucaguguaaaauaccuugauucauuuugauguaaggaaggagagguuguuggcuucugguguagcccuuuugcaguggauuuuaagaagcauuugucugugguuguaacuuuuuuuuuuuuuuuuuggagacggagucuugcucugucgcccaggcuggagugcaguggcacgaucucggcucacugcagccuccaccucgcggguucaagccauucuccugccucagccucccaaguagcugagauuacaggcccccgccaccacgcccagcuaauuuuuguauuuuuaguagagacgggguuucaccacauuggccaggcuggucucaaacuccugaccuugugauccgcccgccucugccucccaaagugcugggauuacaggcagccgccaccacgcccagccugguuguaacauauuuuaauucaggaaaucaccuucaguuuuuugaaggagcugauaauuuuuuagggaagaaaacaauuugauaaucuuguaagcguagaaaaacguaauaauugaaguuguuaauuugguagguaauuuuacuguuauuuuaggugauaugcuuccuuuuuauuuuuucguaagcuguaaaauuagagauuuuuguguugaaggaaucuaauaauuuguacacauaaugauuagucauucagucagcuaauaguuaaguaccuucuauguguugggcaguacuagguauaaugaaaagugaaucuagucccuguucuuguuaaagcaaauaaaaauguaaauaaaaaguuugacauugugauuaaccuucugaaguagaauauggguguuuauaugaaagaaugauuugagaauaaguuuaggugggaagauguuggauuuauuuauuuauuuuugagauagagucucaucucaucugucacucaggcuggagugcaguggugccaucucggcucacugcaaccuccacccgccggguucaagcgauucucaugccucacccucccgaguagcugagauuacaggcgugugccaccaugcccagcuacuuuuuguauuuuuaguagagacagaguuucaccguguuggccaggcuggucucaaacuccugacgucaagugauccacccaccucagccucccaaagugcugggauuacaggcgugagccacugcucccggccaggaaguuggaauuuaagucaaggguugaauuuaaaguagugguuagccagaacagggguuaugggauagggaauuacagggcauugccauagcggauucuuuggugccucuggaaacagcugacugaagcaccaacuguauaaagacuacuuaugcagauuccagaguggguuuccaacaagacaacuucguuuaaaaauaccuugaggccaggagcagaggcucacacauguagucccaacacuuugggaggcugaggcaggaggaucacuugaguccaggguggguaacauagugagacccuggcucuccaaaaagauuuauauauuaaaaaaaugagccagguguggugguauguaccuguagucccagcuacuuggaugaggugaguggaucacuuggacccaagaguuugagacugaggugagcuaggauugugucacugcgcuccagccugggugacagagcaagacuccaucucucuuaaaaaaaaaaaaaaauggugguuugugaagagaaucaaaaggaaauagauccuagagcauagccucuagggucagugucugaguuguccuagcucugcccacguauuagcugugacauuaacuauguguuaaguagcccucaugugcuuguuucuuuuucaaaagauggagcugguacuaacuaccugauaggguuguucugagaucagguauaguugucuguguacaacucuucgucauuuauggcacucuguuuaggggugcaucagucagcauugcugauucuugcugcuguuggugaugaugguagauauccaguuggagaaauuauuggaucuuuuuaaccaguuaacccaguuagagagggacucaauaaaaccaauuuaauaaaguuccuuuuggcacaauaauugaauuacaauuggggauguaaacuuaaaccuugacgugacuugucaccggaaugaaucaauucaaguauucuuuuagggcuggagguaaaggugaaacagauguggcacuuuaaggaccauuaauuauacaaacaauuauaaacuaauuuauugaacaucuguuauguggcagucuugguucuaguucauguguagcacauaaguuagguaaggguaauuuuauuggacucuuaaaaagaggugggaauaaaggauaaaugugguuauuuaacacugaggcaguuucugccagaggacuaaaaaguuacuguggucacccuagaaguagaauucuauuggcuuuugcuaauuccuagaaagcuaacuugguuugcugaggcucuacauguuuuguuaaauuugaccuuuguacuuaaguauuugugaggauuagauagagaaggcucucuuuguuuauacagugccaauaucuuaaaaaauauuaaguagaaccuacacccuacacauucauucuagcuuucugugaguucuguugaggaugaaagaauauucccuuuaaaacuugugaaaauuugaggaauaggcaauauauuuuuaguugucuuuauuuucuauuguuaacuuaggcauuuuuucgugauuagguaucuaacucugaaauacauaccaaauguauuuuagcuguuuacacuaacaaagcuguaugguuugauuguggucuuaaacauuucagcucucuuuaagaguccaggguuugauguuuccuuuuugcccuguuugauguauugaacauugaaacacuguagauucuaaauuauucaaaauauguucccuuuccuugugagcauuuacaucuaguaguuuguugucauuguaaccaguauuuugcuauauguagugcuauugugauuacaguaaguuaguguugcucauguuguguaauaugguugcuaagaacauaccagguugaacuagagccugucuuuguuuauuccuucaccaauaaaagaaacauuauguaaggacucggcuaauaucacuggcucuucacugacuugguuggggaggggaaaacugucaagccaauaaaaggugauuugaauguauagagauuucacagaggaggagguauuucaucugaguugagaaggacggagagacuuugauaggcagauggacuagccaguagcaaauaguaucaauccuuuccugauacuauagguagaugagcugguuucuauuaagguugaaguucucacacugucuuaauugacagcacacguaauaucucaauaauuucuucguaguaccccagaccuaaagaaauauuucagaauuccauuuacuaaguaguuggguccuaauaaccuaaguauuuauguuucuuuuaaaaaauacuacacauacguugaaagaaaaauuauuucauucauaaauaaccaccauuauuuauuaaguguguuaaugcuauuugaucacucacaguuucucaaaccuugauaacagauugaacacuaccucuuuuauuuccuguucuauacugauguuugccucaugcuuuuuuuuuuuuuuuuuuuugagacggagucuugcucuguucccuaggcuggagugcaguggugcagucuuggcucacugcaagcuccgccucccagguucacaccauucuccugccucagccucccaaguagcugggacuacagcugcccaccaccacgcccggcuaauuuuuuuuuguauuuuuaguagaaacggguuucacuguguuagccaggauggucuugaucuccugaccucgugauccacccaccucggccucccaaagugcugggauuacaggcgugagccaccgugcccagccuugccucauacuuuuugaaacagcaacuaucaaaagucuagcuuccacaaauacgacaucaaaaggauuuacggucuacuuuugaaacucucagcuaccuuaaacuuguaguuccugggauguccuacauguugaacauggaaaauaguaaaaaaauuauguuuuaaaucauuaaaaugagaacauacauauucuaggugaucauuuaaugcauuuacagauggaaucaacaacuuacucuaccauuugagugaucuguuuauacccaaaaaaaguaguuuaaucuucuuuuggcugcauggacauuaagguuguaaacaaguccaggugcaguggcuuaugccuguaaucccaauacuuugggaggcugaggaaggaggauugcaugaguccaagaguuccgggauguagugugcuaguuuggcauccauaugguaacuccuuggagagcgggggacuaucagguugccccaggaggugugaaccggcccagguuggaaaaugagcaggucaaagcugaucaguggugggauuguaucugugaguagccacugccuuccagccugggcaacauagcaaggccuugucucuuuaaaauauauacauacauauauauguauuucuuauauauagauuauauauauuucuuuauauguauauaaagauaaaccugaaagaucaguuguaaauagaaaaauuauaccuggacauuuaaauauaagaccuauagguucauuuauuguuaacauuaaucaacaccauuuuguugaguauggguucauuuguuuggaauuccauuuaauucuaaagcuggaauuuaaacucaaacauuuagaaaauacacaaguuguuuuucuggaauuuaagacaguucaaucuuuuggaaugcuugguuucuaggcucuuuuaaaucuuucagaauugucucacagauuugauaguucugugugugugaaagauucaucuuguucuaaacuucugaaacauaugacuugguguucauauauaugacucuuuucuaugcuugggguuuaucauuucaugucaacuguaauucucuugacccaacugauggagacaggauuauguguauauuacacuauguuuuauaaaguguauggcuaucccaaggauuuaugaguuacauggaggcuaguuaagagugugguauagaaccguuuauugaauauuucccaagugccaggcaguuaguguacugaggacuuuauauauguacauuguuuuauuuuaaacaauuuuuacccuguucacauuuuuacaaggggaccauuacggaagaaauuguccaagaucagacaauaauaggaaaacagggacuuaaacccaguuuugucuugcagcaaguauguauucuuaaccucuguguuuuauuuccuucaucauuguuccucaucgcuccauguaauucucugaguguauuguaaagcuuuccuagguaauauggagaacaguaaaucuaauuacucagauuaaacagugccauucauuuauaauagaugccuuuuucagguugcuuuauuuaugcuuuuuuaacuuuuagguucaaggguauaugugcagguuugcuguauagguaaauugcauguuguaggaguuugguguacagauuuuuuuuuuuuuuuuuuuuuuuugagacagugucucacucuuccaggcuggagugcagugacccaaucucagcucgcugcagccugugccuccuggguucaagcgauucgauucucuugccucagccucccaaguagcuggggcuacaggugcacgccaccacgccuggugaauuuuuguauuuuuugguagagaugggauuuccacauguuggccaggcuggucuugaacuuugaccucaagugauugaccugcuucggccucccaaagugcugggauuacgggcugguguacagauuacuuuguuacucggguaauaagcauaguuaccugacagguaguuuuucugauucucuuucucuucccacccuccauccucugguuuguuguuccuuucuuugugugcauauuuacucaaaguugagcucccaacugagaacaugagguauuugguuuucuguucuuguguuaguuugcuuaggaugauggccuuuagcuucauauauguugucacaagaacaugaucucuuuuuuauggcugcauaguauuccauuguguauaugugcuacuuuuaaaaaugaauucuacuuuuaauggacauuuaaguugauucuaugucuuugcuauuguggauaguacugcagugaauauacacaggccugugucauuaugguagaaggguuuauauucuguauacccaauaaugggauugcugggucaacugguaauucuauuauaaaucuuugagaaguugccaaacugcuuuccacaauggcugaacuaauacaaucccaccagcaguggauaagcauucccuuuucucuacaaccuuguuauuuuuugacuuuuuaguagccaugcugacugguauaagaugguaucucauugugguuuuaaguugcuuuauuuuuaauggcugcauagcauuugugauuguaccuuaguuuacuuaacaaauucuauugauggaaccucauuugcaguuuuugcuauuagaaacauuugcuguccuccguauccucuuacaaacuuguacacacauuuuuuucacgcauacacaucugugaaauaaauucccuacaagugaaauuguucgggucauagaguauacuugaauuuuaucagcuuuuggcagauugcccuccauagagauuuuuauauacucucaccaguaaggaaucaguaaaugagcaucuguuucuuuacccuugccaacucagcauuauaaaacuuuuuaucuuugucaaucuuguuaagugaaaaaugggauuacuuuaugguuuuaauuugcauuuauuuucugugaaauugaacauuuuuguauauuagccauuuguauuucuuuuuggaaucugagacuggugcuuuuuucaucuucucaggauuucuaccuaguugauagcuguuuuuaaggugcuauuuuaaaaugcaucuuaguuucagagaauuuaaauuugaccaaauaugcgguauuauaaaauugauagaauuagauguuucaucauaugcuuugcccauauuucuauaguggauuggccuuuuucuuauagauuuguaggagcuuauaacagaauuagcaccuuggauauaaguugcaauuuuugcucaguuugucauacauuucuuugcuuuaugacacuucaugcuacauagagacuugaauuuuguacacguauugaauuaaccacuuuuaugauguccagguuuugcaucauacccugcccaguguugguuuaaauaauuuaauccauguauuuuacuauuuuguuuuuguuuuaaacauuuaaccaagcuggaauuuuacuggggagggaucauaagcuuugagguagggauuucugguuuucauuuuauaaaaaugauuuuuugccuuucuuaggcuuaguuuguaauuuuuuggaauguuucauaaaauauauauacauauauauaaauacaaaaauauaaauaaguaauauauuugcaggauguaauguuuuaccaugguuuguucaaaucagaauuagugauguguuaggugucgucaucuugcugagaucauaguuggcaguuggcuuguaguuauacuacgccaucuacaugugccuguugcaaaaaaauacuuaagcuagguugauacuguucaguacaugggguuuuugguauauuuuauuaagcagucacaguugaaaagcugaacuguuacuuacuccaaggauguuuuugcuacuuuagacaucuuuagguaaucugcuucuuguuuaauuugauuaauuuagacuaguguuucuuaaacuuuagcaaucaucagaaucacuugaaaacuuguuagagcagauugcuaugccucaccuucaaaauuucugauuaaguagaucugagaugagacucaaguuuuguaguucuuacuaguuccaaggugaugcuaauaaauuuuuaagagcaucucugcccuaaaacaguuggaaaacacuguagauaguaaggcacccaguaaaguguggaguuuggcuauccuguggcacuuuuauuaauucaucauugaaacuucaaacuuaaaauuuuacuauugugacucauuccuuagccuggauaaauauuucauuacuacuaagaaaguuaguaaaacuugacucuuacauaaaggaaaauggacuguaguuuuuaucuccagugccugauucugccuuuccugaguucugugucaaguuaguuuuuuguuguuaagcaaaggguuucauacauuuaacaguauagcaaaucgucaaguacuguuucuuuuuuuuuuuuuuuuuuuuuaguggcuuaaaauugacaaauucauucucucacaauucugaaggucagaaguucaaaaacaguauguuggcagguuaguuccaacuggaggcucuaaguggcaauagucuuucaugauucucuccuagcuuuuggugguggcuaacaguccuuagcauuccuuggcuuguagcuuuguaaccacagucucugccuucaucuucacguggcuuuccuuuuguguucaaaucucccucucuuuacauuuuguaaggauacuggucauuggauuuagggcccacucuuaaauucagggcgaucuugucugaaauuuauaacuuaauuacuucugcaaagacccuauuucugaguaaugucacguugauagguaccagagguuaggaccugggcauaucuuucgaauagcuuuuugcuaugaaauuuguacguacaauggguuccuuuaucugggacuuugugaagaguguguuaauguaggagagacuuaggacugggaaucaguacagugauaccuagucuuaguaacugguuuugagagucuggaaaaguugacuacgguuuuuuucguuuucuucacuggaaaagaaguaaauuugacuauauccuugagaccuuugaaauuuugaaauuucauuuuucuugaaauuauucauuguacaaacagcaguaucccauauuaacuggugaugcaagaaguaauuaagugcagcaccucauggaaugggaucacugggugaugaucaguauugaggaaccauugggaauugucuggaugauagaaguuuuggccauuuaacuaaguacuugcaauaugcauaguuaauaaagcacaauaaaauauuuccauuaaucuaauuuauaauauuuauagucugccaucuguaacauuucuucccuuagaaaaauaaaaaggaaugucuguugguuagcucugcuccauauugugauugauuaaagcuugaggaaugugaggagaaaaaagaucaaaauaaagaaggugacuuuuaaaacuaguuuuaagaaguuuucaacuuaaagucauauuuuaucauuucugugacuuuuuucucaaguuuuuauugucugaaguuacaaugugucucacaaucuacugaggucuuguaguugguggcaguuugguuauuauugccugugaaugcuugaacucgaucuagcuguacauauuuucaccucaaauaaugugaauuguugggucuguauauacugagaguauuugcuaauuuaaaugccuucagaaauauuaaauauuacacuaugauuccauguugaaaugagcacugaguaucaagaggcugggaaauggagcaauaggguguaaauaugcuaguauuugagcaaauguuggaagaguaaccaauccuuuuuuuuuuuuuuugccuugcaaaucaacagaccgcucuauugaagcuaagagagguaacucacaaauagaggaagcuguauguuauguucugcuacugagaucauguacaagaguauugccucucucgugucugugauauaucggaagacaggaaaaauuaccaaacguccucagaucaaagaaauuucaaagcagcuaagggcuauaguguugcugauucuugcacuaugcuuuacugucuuuaaggcacugagucauaauuuaauuggcaguguuuuuucuuuccuggucuuacauaaaauaaccuuauagcuaaugcuguuugucccucccaggaaugugguaguuuauuuuuaaaaauaugaccaaggacaagaagcauaaagcauauaaaugaguuaagauggauuuguuugccaauaguuuaugaaauuuagaauuaaguuuaggugaaauaaagagaauucacuucuuuuuguuguacacuaucaauuugcugaacuuaaugcuccagcagauggcaugagcuaaaaauauccaguugguccaugaaagauuagguuagacuaaucauaaaaagagccaaaauggugaauucauaaaugauggcuucagauuuuuuaauaccacuuuuaaauccguaaauaaaauaauggguuuuuaucuaacuggaugagcugugacuuaagcaucuaaaggcauccuguguuuuguccaggugccaaaaggaagauaguuguuuuucauagugacaucaguaaccaguguggaauggacaggagauagcugaccccugcaaaguuauacaaucuugacccuugaucucauugccuucauucuuacguggcgccugucuugugauaacuggaguccauauuagcagccuucacuugagccaucccuaacuaagccugguuucccuuuuugguucauugaucaaucugacgucauuuguuuuuaucuuccauuuauguaucagcauuuguuuaguguugaugcugccccucagucccacuucuuuuauuauugaauuccuuuugugcuuuaagauuauuucuuuggggugggaggacucacgcuuucagcccuuuugaaccaagagccuguuguuagcuuauuaaguaaggaauuguuaaggcuuaacaaaaaauguuuauuugcaugugguaacauuuuaguggugugacaugaagcaacuuaaaaugguuuauuagauuuugcguguugaauauuuguauguuuuuaaaagguuuaagaaauugaaaaugacgaauuuugccuuggcauucaugugaaaccaugugaucauuauguuccauaauuggucauaucaugucuucccaguacauuucaguauuacauuuuucaagaauugaugaagcauaucuuguuucauuguauacucuuaaaagauuuucuugaaacuuaauuuugcaauugaucaugaaacaguagcacauuuguuuggggcagaaguuuauuuuuaauuuaccuuaugucuuugcauuucauuuuugucacgaaguuugguuuuaaaaugaccuaacggaaccuuuaaccaacauguucuuuggaauauagguauaugacugaugggauguuacuucgugaagcuaugaaugauccccuccuggagcguuaugguguaauaauucuugaugaggcucaugagaggacacuggcuacagauauucuaauggguguucugaaggaaguuguaagacagagaucagauuuaaaggugaaguaauuucuucucuccauuuaacuauauauguguguaugugggcauaaaaauggggaauacauacugaucaauaaccaacuguaagaaaucaccuguaaaagaaggaacuaguaaguaccuucuuguuuuguuucugcuuugcugugcuuucauuuuagacuuuauuucucccccuuuauaguaaugcauuuuuaagcccaaucuucucaauuuguaacccaccuaguucuuuuauaaucuaauaacauauauguguaacugugcuacucacuguacccuucauuaaguacagaggcuuauuuuacuuaaggaucaaaucuuucucccucagauccauguccuugucucaucacaaacacccauuguaacuuauaaugcuggagaguggaaauaacuauacacaggacaggcagcuccuuagaaauguagucacuuacccucguguauuacuucuuuccuccauaccacauguaccuuggccccuguuacuguauugauuaagggccuaaaacuauuuucugacauuuuugucccccaaagucuaugauguuccccuuuuugcuguguuguguguguauacuauucauuggaauguagacucaucccuuguugauacaaguguuauagaaggguucauagccuggugacagagugagacucuuagcagaaacaaacaaacaaacaaggguucaacacuggcaagaaagauucugggucuuuagaaaaaaaacugaggccugagcauguuuuuguuuauacaaauuagaucaaugcuuuaaaaaauauauuuaaagaauaaugugaguacuaucauuauuuauuaaauuuauugugcuaccaagguuuuagugagaaccugaaaguagaaauuaagaacucuuaugaaacuuuuuauggaggaaccuuuuuauaucugguccacuuauuuuuuuuuuuugcauuuucuguuuuuuccuauuugcaaaguuuuguuuuaauaaugguagcaauaauuauacugcauauuaauguuuucuuuuagcaaucugaauuacauauaauuuuauaaaaucugauuuuaagguauuuuaugaagaaaugcuguaguuugugcauuuauuuuuuuucuaaauuuuuaaaaauguaaauaacuuuuacuauaguucagccauuauguauuugauuuuucauuuacaguuuauuugaagguuuucaugggcauuuuuauagcugauauauguagaauaguaaauauugcuauacuguaagaccauguaagaauccuugaagacagcuucaaauaauuuacuguuuucuuucagguuauaguuaugagcgcuacucuagaugcaggaaaauuccagauuuacuuugauaacuguccucuccuaacuauuccugggcguacacauccuguugagaucuucuauacuccagaaccagagagagauuaucuugaagcagcaauucgaacaguuauccagauucauaugugugaagaggaagagggagaucuucuucuuuucuuaacuggucaagagguauuguuuuaauuuucuucauuauuuagcuuuugacauacuguuucuaauaugcagcaaccuuaaucauaagaacauguuaaucauauuuuuuauuucaauguucuucaaccugauuguauuaauauguaaaauauauaaccccuuuuaucugcauacuguaggaauacuucuguauaccacuagaguuuguguuauaauuauuuuaagaguguuaaaugcuuuuggaauuucaagauuuugcaauuguaguuuaagagaucccugggauauaagugcuauuaugcugaagcaugaaugugcaucacagcugcuuugaaaucagguuaucuucaucaguauuuagcuugugagugaacuugggugccuauucaucaucaaaacacuucaguuugguuuugucuucccauaugcucaugaaauuugggaaggauuacuaaaaguucuuaguuagaauuuacuucauuuaaaauuuuauucucagauguagcauuucuuuuuuuuuucgagacggagucuugcgcugucgcccaggcuguagugcaguggugcagucuuggcucaccgcaagcuccgccuucuggguucacgccauucuccugccucagccucccaaguagcugggacuacaggugcccgccaccacacccggcuaauuuuuuguauuuuuaguagagacaggguuucaccguuuuagccaggauggucucaaucuccugaccucgugauccacucuccucggccucccaaagugcugggauuacaggcgugagccaucgcacccggccagauguagcguuucuaagcuucuuuucaauaggguguuuauaggugugcuguggaauaccugaguggcuaaauaaauucagaagcuauuuggauaauacaaaguuuuaaaaagccuuuuacgaaaggguuuuucuuuuucuuuuuggggguggggagggaagacagagucgcgcucugucaaccaggcuggagcgcaguggcaugauuaucggcucacugcaaccucugccucccggguucaagcgauucucuugccucagccucccaaguagcugggaucacaggugcccaccaucacaccuggcuaauuuuuuuuuaauuuuuaguagagacgggguuucacuauguuggccaggcuagucucgaacuccugaccucaggugaucugcccuucucggguucccaaagugcugggauuauaggcgcgagccaccacaccuggccccaaaaugcuuuuuugauggcauauaaacagcauuugugcuguaauguaguauugaggcuguugggauaaucguuuuguccucuugugucuggucucuaguuucucauuuccuccaaagugcauaguauauuuuuauuuuuauuuauuuuguuuuauuauuuauuuauuugagauggaguuuugcucuuguugcccaggcuggagugcaguggcgcgaucucggcucaccgcaaccucugccucccagguucaggugauucuccugccucagccuuccgaguagcugggauuacaggcaugcgccaccaugcccaacuaauugguauuuuugguagagaugggguuucuccguguuggucaggcuggucuugaacucccaacuucaggugauccacccgccucggccucccaaagugcugggauuacaggcgugagccacugcaccuggccauauuuuuauuuuuuaaaucacuauuuaaaauugucaucauucucagauaacauaagcguauugagauucuaucagaaauaucaaauggccucaugguuaaggacccgaaagguuuuucucugagacaacuuugugcgguauuuucugugaaucccacagcuggggaaaggaagggaguaagccgaaggguuuucagauguaugcuagagugucuuucaugaaauaaaaugcugcucuaguugucagcuguuuuuuugcauaccauugcuucuuuaaguuaucuuuagauucccagucuugaauuugaagaguuuuggggagaagguagcagaaaaccuaacguuuuguuuacauuucauuuguuguauuuaguaguagagcuggucuaaaguaaauauuaccuucucauuuuugugaaccuucauuauuuuuacuugguaaguuaaaugcaacugcgaaaucaguacuccuuucuucauaaauuugaauagccuccaugaaauugaguaaucucauaaaaauuuaaaacugguuuuuaagaacauauucugaccacuaaauaaaagugcuucuguagucacaugaguuaauuugggagggagagagaacaguuuaaaguguugccuagauaguaauuagauaagagugauuguaauuaaauaauuuuauuuuuaauuuugcuuaguaaauuuuuuuuucaacaugcagugaguuaauugguaagguccagauuaauuuacuaacauauugcugcuuuuggaguuaaaaaucuuuucucaaaucaaaaacuccugaacugucugucuuuauucucaguauugcuaaugacuaagcagauggcugcuguugaaacuucuuuuccuccacuaccuguuucuguuuauauucugaugaaugcagauaaguuuuguggcauucucagcugauaguguugacuucuuggaaguuuggcaaaccucagggaaaauuuuuauugcaaguuuuaaagcuguuuaggacuuuaucuaaaaacuuaaguguuacgggauuucuuccacauuuuagagaugccuuuauauccuacauagucaucauuuuguuuuagcuccuugcauacuuagcagauuggguagucuaaucuccaguaaaguuggaauugucauuuuaaaauacuggaaucacaaagcaaaugucuaauuuaagcacuuaauuuuuaaugugugaaaucuggauauuuugugauuucugagcauuuauuuuucauuuauguacaguaaaauuaacaaaauugcagauacucuuaaauguuggaauccuaguuuuauauuauguucaaauguuuuuuaaguuggagagcucuuaauuuuuuauuugcaugccagcagggggcauucuaaucuagauacaacauuugaaagcaguauuuucaaaaaauauuuguucgcuuuguuauauuuuuuauuuagaugaauagcaucuacuuucauuuucuuuuagaaacuugagauuucaaaggaggaucuaguaacauugaaucuuuaauaguuuucugugucacaauuuuugagacagauaaccuuuaaaaaaaacugauguguuugaaauaagugaaaaguaauuuauuuguucuuacuguguuuaagaacguuguguuuuuugauauagagacacaguuggacauuaaaaaaauauaaaguaaauguccuaaaauucuuccucaccguuuaguaucauuguccuuugaaaaaaacacgcacuuuguugacaaggguagcuucugauugggucauuuauuggacaggcugccuaguguauaauaagcguuuuacauacuucuggguuuaauugaauuaauacuucaauaaaauuuagaauacauuuguccgcagugcugccuuccauuuuuaaguuccuuugccucucccagagcuaucauacauaaucugucucucucuuuuuuuccgucuugauauucauuaugucuccucuugaaugcacauguguuagaauauagucaugugccacauaacaacguuuuggucaagacaaacuucucagauagcuguggugcugcucccguaagauuauaguggagcugaacguaaccuugcagcaucacagcacaacacauuacucacugcuuugugaugaugcuaguucaaacaaaccuacuuugcugccaguuguuuuaaaaguacuauauaguauguacaauuauguccaguacauaauaauaaugauaauaggacauuguuagugguuuuuguauuuacuauacuacauguuuuaucauuauuuuagaguguucuccuucgacuuaaaaauguuaacuguaaaacaggcuuaggcagguccuucaggagguguucuaggagaaggcauuguuaucacaggagaugacagcuccauguguguuacuggccuuuggagaccuuccaguggguuaauacguuaagguggaagauagugauauugaugauccugacccugugggggccuagguuaaguguguguuugugucuuuuaaccaaaaaguuuaauaaguugaaaaaguaaaaaauuuuaaauuggaaugaagcuuauagaauaaggauauaaagagaaaauacuuuugcacagccauacgguguguuuguguuuuaagcuaaguguuacuacacaagagucagaguuaaaauuuagaaguuuauaaaguuaaaaaguuguaguaagcuaagguuaauuuaaugaagaaagaaaaauauaucaaaaaaaagaaaauacauuuuuuuauaaauuuuguaucgccaaaauguacaguguuuaugaagucuacaguucuguacagaauguccuaggccaucacauucacuaaguacucacucacucacagcaacuuucaguccugcagacuucuuucauggcagaugcccuauaugaguguacugauuuuuaccguuuuuuuuuuuuuuuuuuuuuuuuuuuuugagacggaguuucccucuuuuugcccaggcuggagugcaauggugcaaucucggcuuauugcaaccuccugcgucccggguucaagcgauucucccgccucagccucccgaguagcugggauuacaggcaugugccaccacgcccagcuaauuuuguauuuuuaguagagacgggguuucuccauguuggucaggguggucucgaacucccaaccucaggugauccgcccaccucggccucccaaagugcugggauuacaggugugagccacugugccuggcgguuuuuaucuuuuauaccauauuuuugccaugccuuuuguuuagaugaacaaacacuucccauuguguuacaguugccuacuguuauucacuucaauaacaugcuccucagguuuguagccuagggagcaauaggcuauacaguuuagguucgugaauacacuagaauguuuacacaacaacagaaucgccuaacaaauuucucagaacauauuccugucaguaagcaacgugugacuguaguuuucugagaaaaaaauuuguagcugccuaagacauuuggguuagccuaguucuuaaauaucuguguugauacuguaaagguguuuguucucauuaggcacaaugaagcaaaucuuccauauaauugcauuagugauacgugacauuaaagccuaauuggcuuauuuaaaaugucuagcacaucaauuucuuuuagauugugaaaauugaaaaggucgugagugcauuuaaauauuccugagugagaaauuucaauuuuaguacaauuuguugagaauuaauuaggaaaucugacucuaagaaaagggguguggaaugcaaauaaggcaguuauauauucauuugaauacaaaaaugaaaguuucuuggauuguuuuggaaaucccauugaaauuugcuaaauuaguuuugguuacuaaauugaaaacaggguauccaugaagugaaagaagauggcauacauaaaacagacugcauagaacuaggauuauaauaaauacuuuaaaauguuucaguauucguuuuuagacucacuuuuauuuuguaggaaauugaugaagccuguaagagaauaaagcgugaaguugaugauuugggcccugaaguuggugacauuaaaaucauuccauuguauucuacacuuccaccucagcagcagcaacgcauuuuugagccuccaccucccaaaaaacagaauggagcaauuggaagaaagguaacauuagaaaugcucuuuauaaauauuucacuaauaaugauuuaugagauauaaacuguauucaguuauaaaggacuaaguuaugggugauugugaucuagguuuuauacaacaaaauaauauccauuuguaggguuccgcauaucucuugacccuaaaguaagaaugaguacugcuucuucuagguagugccuccuuagcaaauggaagauuaguuaggauggguuaagaaaggauguuggccaaguacugucuuuucuccuauuaaaucacuuguuauaaaguaagcacuuuuucuuuggugccuuggccuucugcccauaauuuuguuuaaggcuucccaaauguaaugucuauaggugugaaauguugacccugugcagaccucuaauaacaguagcacugaucuggccgggcguggcggcucaggccuguaaucccagcacuuugggaggccgaaguggguggaucacgaggucaggaguuugagaccagccugaccaacauggugaaacccugucuguauugaaaauacaaaaaaauuagccgggcgugguagcgcgugccuguaauuccagcuacucaggaggcagaggcaggagaaucgcuugaacccuagaggcggagguugcagugagcugagaccgcaacacugcacuccagccugggcgacagcgcgacuccaucucaaaaaaaaaaaaaaaaaaaaaaguagcacugaucacacugcauaaguaugugaguuccuggaaugcagaagcuucaucuagauccugucaaacggacaggaacaagauuauuucagcccuauuucugagauacuuuguugaggggcugggaagacaucuuugauuccccaucagcagauauauaguccccaucagcagauagauauagauauagauauagauauauauauauauauauauauauauauauauauauauacacauacauacauagagagagagagagagagagagagagagacauauaugucuuaaauauuuauauaauaaguuaaugcauccuccaggcaaagcuuuaauuuuuuuuuuuuuuuaaacaacauggggucucacuauguugccagggcuggucuuaaacuccuggguucaaucaguccccccuccugggccucccaaagugcuaggacuacaggcauuagccacuacgcccagcccucagccugccuaguuuucauuugucuugaaaucauguguacuuuguauaucuguauuuguuuuauuuuuaaaacguuguguuuguuuaccauugagugaaacugguguacaacaaagauguccuguuugugcauccuuuuguguacuucucguuucauugaguucuucuuugagauauaugggcccauauuuacuacaguuacacaucugagcucuugcugucguugaaguaaauuaaaguuuuuguuucuguuuugcuuuuuguguuuuaaauccuuaggaugcugaggagaauuuugucuuacugaaaagagugacucagcaguggcuggauaugugaugauggccacagcuggugaugggcucacucugaggacugaucaugagcuuauaauucaaaacuaggggcuauauugccacuuugccauccagugaugguguuucagccgaaacuguaggaccucuugcugggaaaucauguuauccuugccuugagucaauuucaucuuagagguugagaaaagcacugauguagcuucccuggacaguccuagggagaguaaaggaagacuuccuuggcaguugcugcaucauuuucauuaugaggaagaacauucugaggcgcagcauguuaagcacaaauuuaaaguuuucauacaagccuggcuuauagaggagggaucuauacaaguuuuacuguucauauguaauuuuaaacuuacuguuugugucuaauugugaaaaaauauuugauuuuuuuguuaaacuguucuaauauaaggauaguagcuagcauaaagcaaauauauaaaaguugaaaguuuuugaacaaauauaauacuuaauacaaauuuuaauuuccaucaaauuaauugugauucuguauaacuuuauauuugagucccuuuuauaaggcagugccauuucuuauuucucuauuaguuuaugaaaaauagauuuuauaacuugauugugguacuaauaaaaaacagccuuuuaaacauguuacagcacuaauggugaacgauuucaaguuuuuagcaaucaagaaagguugagaaugcaacauauauuuauaugaggguaaauauuuuuaccucuugauaauuuuugaaguuuauucaaguauuugacuaaguuaaaaguuacaguaauucuuuacaugcauucaaguuuacucuucaguagauaacuucugcauuuuuugacugagacuuaaaauugcuauuuuguggauuugguuguuauuaaaauacaacuauaauuauuuuuuaaauauuuaguguucauuaauuuuguucauacaaauagcugacuuuucuauaguugauccuacauuucgcugauuaauaugguucagagcauacauugcucagugaaaaagagaaauggcccuuguggagaugguccuguaguuuuaaagaaagacuuaaugauccaggaucugaagauagcuuacuguggugcugcugggauguuuauaagcaaauaaguugauguccuuguguuggagaccaccacagaguucccuggggacuaaaaguccaaauuaguuuaaaugcauuauuguguccagacaguauucagguagggcaaaugaaguacugcgaguucuacuuugaaguggaguuauugggggcggaguggggggaagugguucuauuagaaaaaaagugaguucuauuagaaggcagguuauugagggaggaaaauuuacucuuagcauguccugacagugaugccaagcuuuucaccauagggucuguuccauauuagucaaugcgguuugaacacuuuuuaaggcucuuugaacgcuuacugcaguguugcagucuagaaagcauguaacaauuauauugauucuuacuggucauaauguaaaucccuugacaaauucaaggucauuuugucuccugauggguuccugguuguauggugugccauuuacaauuagaacaugguuagggcuugccucacucaacugcugaaguaccaaagaagcuuuuaucuugucauuuauuaguucgcuuuugcauuguguguguguguauuuagccuuagcuauuuuuaguccuugagaaaggccuaaaacuugugcuuuuuuguuaaggacucaauuuaacacuuguauuuuaggguuugacuuuuggcuggcaauaggcucuuacuaauaucaauaaugacgaggguuugccaaguuggcauaaaucauuugauucuuaaacacuugcagaaucauguauccgcgaauuguuaaguauuacagaauuuaauacacucacccagacaaaaaacauacacacaggaugaaauuauuuuguggagaaaaauuaacuuuuuauaaugguaacuaaagaguuggucacaugagaaauuuuuaucacauuguauuauguuauagaagaaauaugugaaauguauuuuuucccagaacaacuuuuuuaaaagugauuuucuucauaaauauuuucagaacuaugguuuucaccccagaauuccagaaagccagaagacgucuucuguauuuacaggcauguaguugguucuguauagauuugagauagggucucagucuguugccuaggguggaguucugugccaugaucauagcucacugcaaccugaaccuccuggacucaagcaguccucccaccuuagccuccucgguagcugggacuacaagcaugugccaccaugccuggcuaauuucuuuuauuuuuuuguagaggugggguuuuacuauguuguccaggcuugucucaaacuccuggacucaaauaauccuccuuggccuuuuuaagugcugggauuacggaugugagccaccaugccuggccuauucuguauaguuuauagagcauuuccacauccuuacauaauuuauucccuacaacccuguguuauguagacuaaguaauaugcaaguuauaaaaggaauacaagcuuggggguguuaaaaccuuuccaguuacuuuagccacucagguuugauugcuaggucugccaguuaccucuaaauucaucgcuucuuuaacuacaagaaacugacuuucuagaauauuaaaugccgguuaugcuuauucaaguuucaccuguuaaccuuauguaugucguuguuugcuucaguucuaguugcugauuauuuuucuaaauguccugaagaauguauuucagcaacaucaucaaaccacaugugguuucuuauuccuuugcuaguugucagucuuuucaacugacaaaaggaaacauuuugguuuuugacuuguaaauuauucugaaauacccucuugguagauugcuauuauguuuuuaaaucccugagguuuccuguuaguauuuugggaagucuacuacuuaguaaauaugaaaucagaaaaugaaaguguuaauauuaaguaaaauaguuaaugcagcaaaagccuaugauuuuuaaagcuauuugauuuauaaaauuaaguguuuuuaaaauaaaauagggauaaauauaaaucuuuucauuuuuuguaugugcccauaggcauuucucccacauguguuuuuuuaagauggaacuuuagugcuagugcuguuuccuucucucaugaguaggucuuaaccuuaccgucaaggacuguccuaaaugcuauuauuuuucaguaaagcuuuucuugacuuugcuauggaaguaaaccuuuuuaaauuucacagugugucuuuggugccacucacacuuucuauccaugucuaaucaucccuuacaaaugguaaaagcagacucuguuugauucaucuucuguaucaauugcuugcauauacagacaucuucaacuuaauaucaguaaccuguuccugaaaaucauguccugaguuaaaauacuaaugaggaauccccauuucccauuguuuaaaaaaaaauuauauguaacauguauuucccaaguccuuaacuaauuuucuaaaacauauguaauauauaguaaaacaugcacguauaccaaacaagcuaucauauuaguauguaaaugcuuuaaacauuuuccgucaauaaagaauuauaguucuuaacaguugcuuuguauguaguaacguauuacaugucaucccguugagaccaugcacuuaccgaaauauuuacauuugauucugcugaucuguccauucuuacuggauuauaacuugaguuuuuuuccauguggcauuuuguuuaaaauguugaguugaauuuuggugauauaaauaacgaaguuuucauuuguaaauauugcccaaaaacauugaaauauacacuuguggaaauuugaauacuaauuauaagggcuguuuuaucagacguuuuguaaggcacguuauauugcuucaucaguauuuuucuuuuuaugcuguccauuaauuugauuaagcaaaauguaaugcgguugagugauaaccugaaguaauagcuuuguugagaaagaaguugcuguugugguguaaacaaaauuuugguuccuuaaauauuaauuuaccuuuuuaaagcauuggccauugaagaucaaaugauauuucuaguuuauuugcuggcuugaaauuccuugugucagugaaaguuaguggcugaucuuuaacaguccuguuaauuuuauuugauauguaauauaauuuauauacucuauuucuuaacagguaguugugucaacuaacauagcagagacgucuuugacaauagauggugugguguuugugauugauccuggauuugcgaaacagaagguacauauuuaguggauacuuuauaaauuagaguugguuuaacaguacuuacaaccaauucauuuaauggcuaaaauuuaccuuucagaauuauuuuccuaucuuuuuuuuuauuugcaaauuucugcuguaugaacccuuuauguuuuggcuggcucucagaaauuaagacaguauuuaauauguaauucuaggcuuuuuuuucuuuuagaguugcuuugcuuucuuuguuucaguguagugacgguggguguuuuggcuuguauauucauuuaacaguauggguuuaguaauaaaguacaggauuucuaucccugcaguucagucacuucucccaacauuauuagaguuacugcugucaacuaggcacacuauuugaaaacaguacuauguuacuccucuaguuuaacagugcuguauacuaaaugaagugaaaugcaggugaaguggcuauucaauaaauacguuuuauuuuucaaauaucuuuuggauaaauugauuacauuuuguuauugauggaaauuuuuucauuaaacaguaacagaguaauaguacucagaccgucgaguuuugaaagugaagguuucuuuucgggcagaauccuugacugcccagcauauaaaaagcaaggaacaaggucagccugauagaacugaaauuaggaggaguaaggauuauauaagcuguguguuugacaagaaguuuuucauguuagagucuuucagaugaucgaauuagaaugucugaaagaacuuuaagguucaggaugguggguugucuauuguagcagcaugauuuauggcuaucgauauuucuuuauuuauuuuggaauuaacugugggcuuuggauacuucuguugcaucacaauuuuguguuugacugaagaaagacucuuguguuauuucaauuccaauaggucuacaauccucgaaucagaguugagucccuuuuggugacagcuauuaguaaagcuucagcucagcaaagggcuggucgagcuggacguaccagaccuggaaaaugcuucagacuuuacacagagaaagcuuauaaaacagaaaugcagguaugggguauugucguuuccugccgauauguuuaaaauguuagguugaauuaucuuaccagaagaacauugccuuauuuacuuaaucuugccuuuuaggauuaaaagcuccuuagcuuuuccaggagugaaauguaugguguaauuaacuuagauagucguacacccccuuauuccaggcugauacauuccaagacccucccccucccacgccuaaaaacuggaauaugcugaaccuuacuuacauauacuauguauaaauaucuuucuuuacaauuucacugauagaagaugcauucuuucuuuagaugugauuuuuuugcucuuuuguuacuagguuucaacuuuuuuucuuuccuuacuaacuuucagcguuucacuuaaaggaagcacuucagggccucucauuggcauauccaaauugccagcaucaauauucuuggcgcuuuggggccauuauuaaguaaaagguuacuugagcacaagcacugugauacugcaaaaguugaucuaauaacagaugguugcuaagugacaaauggguguauaguguauauagcauacuacuaagaauggugcacaauuuaaacuugaugaauuuuuucuggaaucuuuaaaauuuuuucuguugacacugcuuaacugaaaccauggaaauugcgaguucagaugagugaagacuacuauacgaauuucuuucugcaguugcgaguuuuauggacaguagcaaacacugaauacuauaaagauaguuggagaaaaaugguuucucucuagucuagccuacaaguauuuaucucuacugagacaguguagaaguaaugccaaaacaaauagcucaggaggcagcagauuuuuguuuucuggaacgaggagacugaggcauuuuuaacauaaccaauaaauguuuuuguucuuugcuaggauaacaccuauccugagauuuugcguucuaauuuaggaucaguuguguuacaauugaagaaacuugguauugaugacuugguacauuuugauuuuauggauccaccagguaugacuuaucaaaacacauuuuuaucagaucuuuuaaccaaaauugacucuuaguguuuuucuccauccuauuuaauauauguauuaaauacauuuugcuuuuuccauccaguaugcaucaagauuaagucuuacaugauagcauuaaaacuaaaaaaggugacaguuauaugagcacauuuuuuuuuuuucuucaaaaguuauuauggggggguuuggguaaauugaauuauccucugggcaugaaaaugugagaauuccuaaguuuucuuuggggaaaaacaguuugauaaacacauugaugaauuagcaauuauuuaauguauuucggaagaagacaguuuugccuacaggaaaauuuugcaauguuuuuaugauucauuguuugcuagaucuguauaauugaauuggaugacaguuugaguuugaguuugguccacugcaaaaugaaaaaugagauugcuuauaauaguuuguacuuugucacauuuuugcuugcuuaaggcaccgugucuaauagauugucuuuuaccacuagcuccugaaacucugaugagagcccuggaacuuuugaauuaccuggcugcuuuaaaugaugauggagaucugacugaauugggauccaugauggcagaguuuccucuagauccacagcucgcaaaaaugguuauugcaaguugugacuacaacuguucuaaugagguccuaucuauuacugcuauguugucagguaauagagggaaaggaacaaaaaaaagcccagcucuucaaaguuuggguggacuucacuuuuguuuuuguuuuuuaauuuuuaguaugauaguggauuuuauagaugguuuuaaggaauuaauuuuguuuucuaaauaccuuguaaauagcuucguaaugacauagugcuuacaaaaguaaaguaagucauugugcacaaaagauaaguaaagcauuggcucucuugagugcuaauaaaaauugcaguaaguuugagcacaguuguaacugaauucuuugguuaaagguccaucacugcuaucuuugugguuuuuuuguuuuuuguuuuuuacugcaaguacaggaagaacuuugcucuaguacuuagcucuauuaagugugccugugacaaacugaaagcuauacauuaaguugagccuuuucuauauauguacuccaauggcacccgaacaaacaugaauuucaaacuucauaucaaguaaauagaaauaguaauguauaauuuuaggcuuaaaaucuaaucugauaaugguauucuuuuacaaugguagaaaaacuugguaaaagaaacauaccuaauauauaaaaucgcuaauuuuguaaaauuggaccauuaagcuaaggaaauaaugcuguuuuuaguaacaauaaaauguaauccacaaaugaauaguaacuuggaaauuagauuuucccuaaaggagaagaaauauuguuaagaaacaaaugaauagcuauucuuacagcuaaaaauagaaaauaaguucuuacugacgauuaaaauauucucugcuacuaguuuuagcacgggagagaacugacucccuauugcugagugguuuauugaacuuaaugcugcaaauauuucaaaauauucuguggaauuaaaggauaaauugaaaaaaauuuaaauguaaaauuauggcuuaguuuagacguaugguauauucuaauggugugaauuuuuuauuuaagaaguagcuaaaauguuuucuugcagaguuaugacugaucagacucagagcagaugggcagggcaguauugagucacuuuaauuaaauuguagcuucauuugcggagguggugguagguuguugucugccuuucuuauauguuguuuuauagauucucccaguuguacuucucccaagauuuuaguuuuuagagaaaguguggggcaagaacuaauggauuguguacuuacuugucuaucugccuaguuuuuauuucucuagguucucuuaucagauauacuuacaugauuacuguuguuugaguuuagaauauuagcucuuuaagaaguuuguuguugugauguaguuguaaucuuccaacuacaucucaguuuuauuuguaauuaaaaaaaacuuauuuuuauuuauuacaaauaaaaaccuuuaguuugucaggagaaugagcauuuaugugcagcaauguaaauggacuguuuuuaaaugguccauuuauaggaaaaguguugaaauaagaggcaaguaagaagucagggaauaaaaaauaguuugcugagcuuguaaugcuuuguuugacauuaaaauaguuuuugaaguuuugagguccugauacuaacagugcaaaucuagaggccuuugagagcacuacuuauuuauucccacuuaacucuaguggcuaguucacauuaaaauucacagcugugagaaguuugugugcuuuuaugaauuaccuugcuucaauuaaauuaagcaagaguuuuaauauuuauuaugaucauguuuuguugucacuauuuggcuauuuuggcaucuuuuuaaaggggaaacuguaugggaaagaguaauaugauacuguauuuuaucuuguuguugauuauucccauuaucuucuauccgaaccgauaauuuaugaauuuuuucauugacaagguuuuaagagcuuuuaaaauguguugaaaaagucccaagcuguuaaguauuuuuauuuucauacugcuuuuaugacuauggaauugcuaaacugaauuaaggaaaguuguauuucaaaaaauguaguacaugcuuuguaacaauuuaaaguuuuaugugaauuaauauugaggcucuaaacaaauaacuguaguuacauaucuugaugacccuugauaugauuguuucagacuaauugucaacuuuugaaauauuggacuuugcuuuuauauugagguuuugauucaaauaaguuuguuuuuuuucuuuuuuaaauuugggacuuuauuuucuaauccuuuuguuaaaaugcugaaacacuaggcugaauaucccagccuuuuugaauuuucuuaauucaaaggcgguuuaaccuuccaccacuacugcuaucauccaaacccaagaauucuugauauuuuuauguuuacauaugcuucugcucaccggugcuaauagugauacccaccaguugguaauagccacaguauuagggaaaaaauucugauagaaacauggcaguagacugguuucaaaguuguuguuagcucugcagugggcaagcauagcuuccuaacuuucacagccauucaguagauuuaguggaugcccuuuugaaaaauuacaguuagcuaaaaggcaauugacaccguuauucugguuauugguagagcuaucagcacugguuuuuuuaaauaaguugagcuuuuuaguauccugauggccuucagaauagcuguuuugaugccuacuuuuagaucuaguuaaaauaaucagguacucuguagcuuugaaacccucuugucuuacagaugugguuagguguugauguaccaaaucaagguaguaaacaauccaagaugcaguuggaggccauccugcccugcccuaugcucugugaacugaccuagcuaggccuuguuccucuaucugugaaugcgugacucaucgauaugggcguuuguguugggcccauaccaaccuuguuuagucccacaguguuuuguucgccccacggaggccaagaaagccgcagaugaggccaagaugagauuugcccacauagauggagaucaucugacacugcugaacgucuaccaugcuuuuaaacaaaguaaguguaaauuugauuggagacacucuugucuaaaugucacuugcaguguauaagauguuucuuugucccacuuugauuuauuauccgugacaacuuauauuagaaacccagagguacuuuugaaaaacuccugacgagcauuuaaaauagaaauugccaaucuuuuucaaaguuguuuauguuuauaaucaggggauaaagcaccaauuguagaaaaccugaaaaauaacagugauaaaaaugacagacuuguauaacauguaucacuaacauacacguuuuuauauacuuuuauuucugugcauuuuacauuuuuaagaauaguuuuauauuguuuauacaaucauuacucuaacauuuuuacuaauaaagaacuuuuuacaccaaaauaaaacuaauagaaaaaaauggacaaguaugaaugaugguucuuaggcuaccaguggucucuaaacaugauauggaaaaguucagcucuacuguuagcccaagaagugcauuauuauuuuggcauuauuauugauaaugaaaggcauuaccauuuucucacauaaaauuugcagauauugaaaaauauuccuuagcuguaugggagugggguuaguuguggucuuuaugaaaaguugauuuuauguuaccaggaacuuuagcaacuguauacucuuugacccagaaauaauuuagaaaguuauuuuuugguauucuguggacacugauuugauuaaauaauuucaccagaauuauuuauggugguaaaaaaaaaauuggcuaccuaaaugcccaccaguggaaaaauugugaguuaugcuguagacauaugaaguaauuguucuagcuuuaaaucaucuuaucauagaauauuuagugaccugaaaaacauuugucagugacuuguaaaugaggaaacauaauaacaaugaaguuauugcuagcugcugcuguuggaauguaccauuugcaaaaauugagaggaaaccuuaauaaauuuaaaggagaaaaaaaauacagaaauugcaacuggaucugacauuuuuuuuuuaacugauagcccuacaucaucacccugugccaaaaauguggaauucugucacuaaguuuguaguuucuucucaugagaaauugguuucuuaauuuauaaaguugacguuccaauuuuguaugucugguuuuauuuguaacucauuuuuauuaucucauaaacaucucaguuauacucuuaaaauggggagccuguugacuuuggcacaucucuguaggggugauggugaauuuauuugucuugggguccagaagugcuagagggccagugugugcaccagacguaguaccuaacuugauuuacaucuguuccuuacuccagaacccugauaugaguugaaaagaauugaugacuagcagugagaaagaauggagcccuucucugcccaggcccagaaaacuugggggcagauaugagaguuaagggaaaugugguuaugaaaccacaggcugaagaccagcacaugguuuaccuuagaacaguuauuuaaucuuucuuguauccaaauacugguauuaccuagcguuaaagacuuaccccugauuagacagaucuacucaaaaaaccuacuguauuccucuucuaugcgaaacaugcugggugaccaagagauacauaaccuauuaaagccuugagaaggaacagauucagucagaggggauguaguaaguuaaaaugguguuauccacucacuagauguaugaccuauuucugauaaauacaucaaaauacuacuuucuacaucaaaauacaacuaauaaaauagaaaaacggacaaguaugaaugaugguucuuaggcuacaaguggccuguaaacaagagguggaaaaguucaagucuauuguuugcccaagaaaugcauuauuagugagagguacuaugaucucucacugccaaagggaugauuagccauuggugguuuuuagggguuugcaguaugugaugacuugacauuugguagagcuguccuuauuaguuaaaggugaggauuuagccuuuaaucacugauugccaccuuuucaaauaagagaagcucuuaaaaaaaaaaaaagcaaaaaacuuugccagauccccacguguuauuauuucgauauauccauauauauauggauaugaaaauauuuggaauauuuucacgaaagcuuuuuaaaugguuguauguuauuaauugaaacauugaguauauuugaaaaaagcguguuucagauacuggucaagauguuuugcauuagagacaauaguugauuacauagugaagcuaaaaugucaugucaauuaaaauguugucuuaauacuauuuauguaaauaacccuuugaaaucgaaaacuagauucaaguuauuuugcaguaccuugaucugucuagggaggggagauuucucucuaaaaaucagacaaaugguuuggcuuuagaucuuaggggugguuuacuguauuggugagagauaaacagcuagaauuauauuaauguuuccaguuuuagauuuaauuuucccauuuacccaauuauuucucacaaguuuagaaauacaguagaaccaucagauguuaguuacuagucauuuguucuuaacaaauaacuuagauuugcaauuuuuccaucuguaguacaugaauucuaaaaauugagaaccacacaaaaaagcuacauuucaagccauagucugcaaaucaacaaccuuuucaaaaauuugccuuuuuauuguccagcuugggcauuuuucugccuuucagcuuguuacagagcaucagcauaaguaaaauuaccucuaaggugugcuguuucagcucccaaagauauucagugcuuugauuuaaaugucaauggcuucagaugguuaacuuuuauuucucauuccagauggauuaauuaauggguguucuaauauguuauuguauucuuuaauucaaaaaucuauuuccuaucuccaccucacccauccuuaauuucugaaauggggaugcauuuuguaauggauaaaaauguacuuauauauuuguuaugucuaaaaaacauuaaggcagaguuauacacuauaacugguagaauccuagaaccaaagagaaaagaguaugcugaagauaagcauacaucacaguagcaagagaaggaucaacaguuuuaauuuuuguuuucucucucccauuucacaauaacccuguuaguuuuauuuaucaaagguccucugaaauaaauaaugcaauucuuugccaugacugucuuuggcacaugaaagaugucacuguaaaauuucuuucaugaugcuacagguugagcucuuuaagugagcaacacuaggcuaguuggaagcuuaucaaggauucaucaguggagaaauauccuuuugauaauacauguaauaaaauuacuugaagugcuuagacuuaggucuuguuuauuaaacaugaguggagguuucgggcauccuuguaaacuuucuucuguuucaggacuugcucauaaauugcugagagacacgugugucgcaauaaaacuuugccgucuuuaagucugaggugcucugugucaggcauaaagaacaauacacaacaauuguuugcaguuaucuuaaucuaaagcuguaguuucauugaaaaugaacaggccaugacuuuuaccaaauacuuccagccuucccuuaucugauagaccaucuuuuggaaacaaccagguggauguuaaugggagaaguaauucacuaaaaacaguuaauucaaaagcauuguuuuggcauccaaauccaaaagccuuguuacuguuucuaauguugaaucacacuacagaucuuugagaaaguugguaacauugcaguucauuuaaagaaaauguuguggguaaaucuccuuucugguuuauuuagcuuauucuuuauaacaauuuuuuuaauuagagaacauuccugugugggugauucauggugccuucuuuucuccccgccuucuaccuuuuuagaucaugaaucgguucagugguguuaugacaacuucauuaacuacaggucccugauguccgcagacaauguacgccagcagcuaucucgaauuauggacagauuuaauuugccucgucgaaguacugacuuuacaagcagggacuauuauauuaauauaagaaaagcuuugguuacuggguauuuuaugcagguauguagauaauaugggaaugaauaacuaaguauucauaugacacugauuucuauuaacaguccuuugaauccacucaaaagcaaaagugaguuugugcaugcucauaaaaauuuaucuuaaauguugguacauccaguuucuuugagugaauuaauauacuaagaaauuuuaaguauuuaaugaguaacaaauuaauguacuaaauggcuaagguagucuaguuauacaggaaucguuuuuagaauuauuuuauuaauagagccuuuguuauacaaaauggaaacuuuggcuacuuucagaugugauuaggcaccuguuucuucaggaaugugaauauugaucagugcauuaaaguuucucugaaucuagggcuuaauuggaaauacauugucauaacagaguacuaaaaggaagcaauugagcggauccaaaaguacauacaguuggcuuuagucuuuaucuaaaaacuaagcaccuccaaauucaaauauucaaauacguggauuucauuuacaguccucuacagagugaucauugguaauuaugaccaagacccuugcguacugcaaaagccaaaaacgucuguugaguagcaauaaagaugaaacauaauuuaaaagguuuuauuuaguuuaaguaugcuguguuaacggcuauaagaacagaaguaaaacuugucaaguaaauacugugaacaguuauuuuaagguguuuauaaaauaagagaaacuuugagaaaaaugcaagaaaauuuuguggugauaaaauugaaaacaaaucaccugauuugggauaagucucuucuaucucuuuucuguuuguucauucucucuuuggcugugucuuuuaagcacgauguggcuuacccuuaaggccagaugggcucaguagcuagaauaugagccugaggacacucaguuucagaaucaaaaaucaaaggagauuggugagaugucuguauuugaaucuaaguaacacaguguuuauuguggcaucuuauuauauaauaggcuuauuagaguuuggugaaugauagguaugagcauucuuucuugaaacucuuaacuauauucuuaauauuugauauguuguacuggcuucucuuugacauguucuguucuuuuuuagggggaggggauggggugagggaggcaaugucucacucccaggcuggagugcaguggugcaaucacggcucacugcagcuuuuaccucccugggcucuggugauccucccaccucagacuccugaguuccugggacuacaggcacgcaccacuaugccuagcuaauuuuugccuuuuuguguguguagagagagggccucgccacguugcccaggcugaucuugaacuucuggcuucaaaugauccuccuaccucgaccucccaaagugcugagauuacagacgugagccaccaggccuggguugacauguucuuaaauuugcuuuuuauauuucagaaaaaaacuggccgggcgcuguggcucacgccuguaaucccagcacuuugggaggccgaggcggguggaucacgaggucaagagaucgagaccauccuggcuaacauggugaaaccccgucucuacuaaaaauacaaaaaauuagccgggcgcgguggcgggugccuguagucccagcuacucgggaggcugaggcaggagaacggcguaaaccugggaggcagagcuugcagugagccgagauagcgccacugcacuccagccugggcgacagagcgagacuccgucucaaaaaaaaaaaaaaaauugaugaaacuauauucaagcauuauacuucuuaauuauguagauuaaaauuuguuacaaacagcuaggcaccacagagugugcuuguaguccuagcuacuagagaaguugaguggagagcaaggagcguugaagccagcccaggcaacauaggaaaacccuaucucuuuuuaaaaacaaacaaaaaauuuauuagaaacagcaugcauuauaguaccugacaccuaauagguguuuaguaaauauuucgaaugaaauugaguuucuuuucuauuauucaugcucauucuuuaagcacagaauauuagaauuggaaagggagaacuguccauuuugaugaguaucaccagucaagguguuaccaaaaaaagaaaugagagggaagcacgugcaagcucuuuuuuuuuucccauuuuuauuuuccugucuuuguagguuaccuuuuucuuuuccucuuugcccucuuuaguuuucuaccuuauuuuuuauucuauuucuuuauuuucuuuuuugaaauggagccucucggucugucgcccaggcuggagugcagugacuugaucucagcucacugcaaccuccgccuccuggguucaggcaauucuccugccucagccuccugaguagcugggauacagacacccgccaccacgcuugucuaauuuuuguacuuuuaguagagaugagguuucaccguguuggccaggcuggucucgaacuccugaccucaggugaucugccugucucagccucccaaagugcugggauuacugcaccuggcuuuaguuuucuaccuuagacaugaauguucugguaauugucugcucauaguuggcgcccagugcugaagagccugcucuagauggucucaggcaggaaagaucagauaguaaauguugggcucuguggacccaugaaguccuugucaaaacuaccuaacacugccugcucuuggagcauaauagguauagacaaaugggcaugccuguguucuaauaaaacuuuccuuauggauacugaaguuugaauuuuacaugcuacucaugcuucacggaauguuuuuuguaugauauuuuuucuuucuaauuaaagauaaauaaaccauuuuggauucacagaccuuacaaauagaggcuaugaguuggauuuggcccacaggcagcaguuugcuuaucucugcuuuuaucagacagugauaaauaaguauagccauagaaugaaaaguaaaagggaggccugccucuuccuaauuauguagguagcuuuacaacuagcaagucagaagcauuguauuaauaauauacuggguuuugguuucagguggcacauuuagaacgaacagggcauuacuuaacugugaaagauaaccaggugguucaguugcaucccucuacuguucuugaccacaaaccugaaugggugcuuuauaaugaguuuguucuaacaacaaagaauuacauccggacauguacagauaucaagccagaaugguaaguacaccuuuuguucuaacaguuuuuuguuaguacuuugcucaaaauggaaccugacuguugcuagagucauggccuugcauucacucauugagaauuuauauuucaguguguagguaugagggaauugacuggauggugugauuaaucuuucacacccuuccuuuguuaaguggacagugggauuguugauauuuaugggcaggauuugaagccaaaugugaaguuacauuugaauagcaugaaaaguuucuucaggggcugggcaugguggcucacaccuguaaucccaggacucugggaggccaggaugggaggaucacuugaagccagggguucaagaccagccugugcaauauagccagaauccaucucuacuaaaagauauauagguguguacaaaaauuagcugggcaugguggugcugcacgucuauagucccagcuacuggggaagcugggcaggaggauugcuugagcccaggaguuugagguugcagugagcuaugaucaugccacuguacuccagccugggugacagugagacccugucucucagacauacuuuuaaaaaaggguuuuuuuuuaauuuuuuuaauuuuuagaguuucuuuggagccauucucuugcuguugugauucucaagucaguacuguuucuugcuugcagaaaucuguuuuuuuuuguuuuguuuuguuuuuuaacauuuuuuuugucccauuacaauuagcccucaacuauuuauuauuuauauauugguuuuuaggaacugugcaggcauaaaaaugauagcucuuuguguuuuaacauacuagcuucuacaaaauguagaguaagaacggauuguuuuauuuuaagcaaaauaacccucaccuucaugguuuuuuguuuuauuuaugccagaaucuauucuauaaccuaugacaggaaaugucagccaagaguagugggacugaaggcacauauucuaggugcugucaccgcuuuauauugugcagcugcuuucuuauacggauuugggacuuuugacacuuaaauuguguaggacauuaccauuuuaucuuaaacgcuuuguugagaaaaaaauuauauagcuaaacuuuauaaaagauuucagucaaguguauuuuggggguauagaguuacaguuauuaaaacauugaaaaugaaaagauccaaucauuugaauaccacgauguuuccuacacagaaccuguuauauauuacuauauccuuggaguggcaaauuaauagugugccagaguaaagaaaucagugacuuuaucuguuaucuuuacauuaauguaucuugagggguuuguuauuaaguuuaugguaaguccaacaucagaaaauucacaucuuacuaaauaaaauacuuaacacauuucuaaaagugcuauuuguaaggauuaguuauuuguauuuuucugagacuugaauucauagauuugccuugguucaucaguauauuaaugaauaaugccuauccuauuaacaacuccaguacuucaauuaaauguuaauuuggaaauuuuucugcccacuucuaaacagguuggugaaaauugccccucaauauuaugacaugagcaauuucccacagugugaagcaaagagacaguuggaccgcaucauugccaaacuucaauccaaggaauauucacaguacugaauucagugcuuagaacugaaguuauugagaggacagcuuuaaaagaugaaugaacucaaaaguucgaguugugcucuucacguugguucgauaauggccuuuauuugaaagcuuuuuaauuuuucuuuacaguaaauauuccauucugauuucauaaauuaaacauuuaugccucccuuuuguguugacacuguagcucauacuggaaaagucgaucaauguuuugcaguuuauugaaaguaguucuauauauaacaauguuauaagcauuucuuuagaaaugguugaaaaugcuucuaaaaugugauuaucgaccaugguaugcaugaucguuguaauuguugacauuccuuuuagaaguugugaaauguuacaacuugugcuuauguagacacaaucuucugucucaguacagaggcacugacuucaauaaagucuauuuauacuaauuuuggccaaag

SEQ ID NO: 14346 - RNA, 7813 nt, Homo sapiens
gagcgggaggagguggaggcgaagcaauucuacaacccggggaggucuggccugcuuuuccucccugaacuggcccaaugacuggcucccucacgcugaccacuccucugggcuggccuccugcacucgcgcuaacagcccaggcuccagggacagccugcguuccugggcuggcugggugcagcucucuuuucaggagagaaagcucucuuggaggagcuggaaaggugggugcuaaguugagguucauuuuguucuucucggagugugcuuauugagucugaagcuggguuggggcaacgggccucuucuugggaacaaauuggaucaucuucuugggaaggaaauguacuuucccuggcugcucugagggguuaguggggagguggagugagcggggaggaaggcaaggaggggaggaagaaaccguuccuccuguggaucugcaaagaccaguccaagaggauuuuaguguuaggaaaaggaaucuggagugacgagaaagggggccuuucuagauguugcauggcuuuggugucgggagccacuuaugggacagcagguacucuaaaaagccaccuccuuaggaaagcagagaggcccuggccagcucaggcucccagcaagagcuccuucuaggagacagcugagggaugaaacacacccaaggcucaagaggggcagguucuucccagauacagacccaggaaggagauaaaggcuuggugccucuauuugguucaggauaagggccccuguccucuuucucugauaacacuguccucuuucucugauaacaccguccucccuuccagauccacguacaaaggaggcccuuaaaaaggcacuuggucauucacagcucaaacugagcaagaggcugugggagaagaaucaaguuggucccgaggggaagaggugucaaaggcuuaagaaacaagaagucagaguuuaccuggguuugagggagaauuuucuuucccccuuuuccuccuccuccuccuucuucucuuuuuuuuuuuuuuuuuuuuuuuuuugagacauggucucauucugucacccagcacccaggcuggaauguaguggcacgaucacuaucacggcucacuacagccucuaccucccgggcucaagcgauccuccuaccucaaccuccugaguaacugggacuacaggcacaugccaccacacccagcuauuuuuuuuuuuuuuuuuugcuagagaugggggucucuaccagguuggucucauacucuuguacucaaaugauucuccugucucauccucccaaaggggugggauuacaggcauaagccaccaugccuggcucuucuuuugguuucagagaaaaacaucuccuuaaaauguuuauuucccaaggauucuugaaaaagaaagcucacugacacacccaaaacaaucugguuuugcucugugcuuuuagggagaacuuucuaagcagcagagcccuucugaguggcagggcugucuuaggaggaaggugucuuugaugauggggaacuucauguccaggucuggcaggagaguuaccccacuuuccugccuacucccuggggcuuugggguaguaguaccacauugggccaugucauuuaggugaguccuucaacaucacuuucucugcuucucccucuuucuggauccuccuucuuggagccuuucaaggggaccuccucucacaguguccauagcaucucuuagcuaaugguccuuaaaaucucuaccagcagcucucucugauagcuaagagcugccauuuacugggaacuuucuauguacugggcucugugcuaagugcccuagaugagagaugugcaguguggugccuaaaccuugggcuuggagcagacacacacuuucaaauccugccuucagcuccuuagugaacaugucaccuugggcgggacacacgccucucugugccucaguuuccuacacuuuagaauggggauaacacugaauaauguucuugugaggaugcagggaauuaacccacgcacaguacuuauaauagugucuggcgccuguguucgauaaguuuuagcaauucuaaucaucucuuuuaagccucgcagcaagccucuaagguaagucuguauuaguaucccuauuuacagaugagaaaacugagguucacaggggaugagacaguguacagucugcaguccagcaauuacucugcuacucagcaauaaaaauaguaacagcuaacccuuagacuaaguggcagagucaggcuuuagauucaugaggugaguucuggaauccaucccuuuaauaaccacacuaaauugccuuucugaaaugguuauauaaagcauaucuacccaaucuuggaguuuuuuaaauggcaccuaguuuggugcuggaaaugcaguugaccuucaaagcaauucuuuggaggcagcaucaaucccucuggaaauaccucgguggcauggcuggccuuauucuacagguaaggaacuugaagcuaagcaucaguaaccccgugaagucacaguuaguauagguuggaauugggauucaaaucuguaccugacuuuauaauuccuagcugggccccagaaucuuugauagaggugucuucuuucuuuucuuuucuuucuuuccucuuucuuucccuuccuuccucucucucugucuuucuucucuccuuucuuucucacagaaucaaaaucucuugggguggggccugggcaucugauuuuuaaaaaccagacaucugaugugcagucaacacugagaaccccugccagcuucaucuccucuucuaagugccagacccaaguuuccgacugucugcccaccugucuucccaccugggcacccgccagcgucucacccucaggagacuccagcugaacuaauccucucucccugcuuuuccagaacaggucccacccucccuccacucagucucuccugcugggaacccuggucaucugcacugugccuucaucuuccauccugccagugcugcccggugugucucuuaaacccaugccuccucugugugcaccaccugcacuuugguaaaagccuucauuuccugcuuggguuacuacaacgcccccuaacucaucucacugucucuauuucugcuucucugucucucccuaggcuacucccauucuuccuccccuuuccucuucaucccaaaguccaacccauauccuuuuaccaguaggacuuaaggaacuaaagacuaucucaucacccacuuuucuucuuaaaaacuuccacugcacugccugcugagauggccuuccuacccaacuuggcuggaaaacuccuacccaucuuguggaacccaguucaaaagucaccaccucugagaagccuucccugaggcuccuagggagauggguacugccuccucuguccuucuccagcacaggccccaucuucaaucacaggauugugcuggaaugauuggaugccaagucugucccucacugaacuccuuaugcaaaauccauauuauauguuuccuuuugccaggugugggcccaggugcuggggauaccgaugaauaaaacugaguuucugucuucaagaagcuccaagucuacugaguguagcagagaacagggagaaggcacuucagggagaaggcguagcacaugcaaagccccagaaggcagggacagaagccuuagggaugucugugggggaggauggaggaagaggguaacaggagaccagguggggagaugagggagguggucuggaagggccaugagacaccccucacgcucccugagacccccuccacgcuauagagaugggacuggagaggacgaugaucauuugugacucagaucccuguggguuucuucagauugggucucacccaucuuuacagccacagcaccuaacacagugcccggcacacagcaggcccuagacaaacguuugccacaugaagucaugcccacugggccaggaagcccacuggggacugggggguugguucugcgauaauggggucccugagauucuauguuucacgugacuaagccucacucugcccccaccuccgcgggggcgucccgcaggugcccgacuccagccaugcuggcgcuacuguguuccugccugcuccuggcagccggugccucggacgccuggacgggcgaggacucggcggagcccaacucugacucggcggaguggauccgagacauguacgccaaggucacggagaucuggcaggaggucaugcagcggcgggacgacgacggcgcgcuccacgccgccugccaggugcagccgucggccacgcuggacgccgcgcagccccgggugaccggcgucguccucuuccggcagcuugcgccccgcgccaagcucgacgccuucuucgcccuggagggcuucccgaccgagccgaacagcuccagccgcgccauccacgugcaccaguucggggaccugagccagggcugcgaguccaccgggccccacuacaacccgcuggccgugccgcacccgcagcacccgggcgacuucggcaacuucgcgguccgcgacggcagccucuggagguaccgcgccggccuggccgccucgcucgcgggcccgcacuccaucgugggccgggccguggucguccacgcuggcgaggacgaccugggccgcggcggcaaccaggccagcguggagaacgggaacgcgggccggcggcuggccugcugcguggugggcgugugcgggcccgggcucugggagcgccaggcgcgggagcacucagagcgcaagaagcggcggcgcgagagcgagugcaaggccgccugagcgcggcccccacccggcggcggccagggacccccgaggccccccucugccuuugagcuucuccucugcuccaacagacacccuccacucugaggucucaccuucgccuuugcugaagucuccccgcagcccucuccacccagaggucucccuauaccgagacccaccauccuuccauccugaggaccgccccaacccucggagccccccacucaguaggucugaaggccuccauuuguaccgaaacaccccgcucacgcugacagccuccuaggcucccugagguaccuuuccacccagacccuccuuccccaccccauaagcccugagacucccgccuuugaccugacgaucuucccccuucccgccuucagguuccuccuaggcgcucagaggccgcucugggggguugccucgaguccccccaccccuccccacccaccaccgcucccgcgggaagccagcccgugcaacggaagccaggccaacugccccgcgucuucagcuguuucgcauccaccgccaccccacugagagcugcuccuuugggggaauguuuggcaaccuuuguguuacagauuaaaaauucagcaauucaguacugcgucgaggucuugguuacuuuuuuguuuguuuguuuuaggcuucucucccaagcugagcuuuuuuuuguuuuguuuucguuuuccuuuuuuuucuuuuuuuugggaguggcaaacaugcuucccaaaucccuacaggacuucuccuuauccucugcccccaccucccuaacccugcuggcaacaacguucagccacugcuugucuugcccuucaguguggcuccaagaggaagaucaccagaaucacucagggaaguuaaaaaaaaaaaauacagcuuccugggcuacaucccagagcuguggaauccaaagggagaagagaaagugaauuugcgacaagcgucgggaugauucuggcacuggacccucuggccugagaggggaagaggccuuccaucucaccugggcugguagcuugucacaucugccuccgaguacagccuuagguccauuucccagauaucagagacagugccagggaagccaggugacugcaucuugccuaggcacagaagaguaggguuggaaugugacguuguuagcauuuggcaggaccaaaaccagaggcaaacggaggcagugggauggaaaggcaguugauuuugaugaaggcuuguugggaguucagcuuucuuuugaaacuuauaaucuauacccaggcuagaacagucuuguguauacaccuucauucauggaauaaacguacuugcaauaacuuuuuagccucccaggguagccucacuuccuagcugugacuuuuccacccugguuacugggaggcagcuuccauuucucccagacuagcuaggcagugcguccaacugaaccgcagccagaaaccugucuccagggguuauuuuuaccucuaacuaggacuaacuuauuuuaaaaucuuuccuugagcccaagugacaacugaagagaaaggcuauugccuggugauuuugcuccaccaguugguucucacugguuugaauacuaacuugaacuguacucaucgacacugaaaggggaugagcaaacagugucucuaaaucuccugauccugaucucaaauaucccccuaauuacaaguugcaacaaggcagcuauuacacggggacacaggauggagaggaugggugccaaacacccaucgucuacucugcugccucgguuauggugaauucaggaccaucaagggagguguggaccuuuuuuuucagaaggaggcugacacuucuugucaauugcauuguguucuuaguuuugcucuucacaacccuugaccccguagaugggggcugaagaggcacccuggccgacucacucuauuucuguuuugggaaugggauggauaaacuaucccaugggccuccagagccaaaaaaccaaaacgaaacaaaacaaaaaaccccaaaacaaaaaagcaaaaagcaaacaagaaaaaaaaaaaaagaggaaauaauaggcagacaauuuacaguucauuguaagggcaaagauaugcauauagcaugaugguuaacaggucagacucagguagaaaggcccauuugaaccccagcucugccacacucagaaacugugugacccgaacaagucacuuaaccucucugagcauagguaaaauaagaucaucauaccagauuguuuugaagauuaaaucaaguguuauucacgagaggugcacagcauagcaugcacaacaaauaaggaccugguaaguaucuaauuaauaacaauggcuaagauccaaaaaacagcuaccuacuaauaaauagauggagcugccuuguaaggcagugagcaucaugcaaccaggauucaaaugaaggacaguugcuaccucugagguucccgagaaggauuucugcauccauugagagacugaaugacaugaacucugcgaucccaucucuuguggggagggaaccuagaaugaagggaagauugugggccauaaaggcagacaucugguuccuggcacagaaccauaugugugccaccaaagccacccaccggaccccacuuggccccuggagucuauuuuuacuccucucaucuuacagaucuauuuuguuaaucuccuuauauuugcuguuuugacuucccagccagcuugcuaaucaguuugccuauuugacucacaggguuugcauuugucacggggacugaaacacacgcuuguuuugauuucuuuuuguaaaauuagaagcguuugauguaaugacucuaccuagacacagcugguaaagugagaauaaugcucaaguuugcacaguuuaaacacaauguagacaauaauuagaaaugcuaucuuuagauguuuaggauaagcuuuuucucagaauugcacugauuuuuuuuuucugaguggggcuuuuuagugcauauauacagaaauacu

SEQ ID NO: 14347 - RNA, 7813 nt, Homo sapiens
aguauuucuguauauaugcacuaaaaagccccacucagaaaaaaaaaaucagugcaauucugagaaaaagcuuauccuaaacaucuaaagauagcauuucuaauuauugucuacauuguguuuaaacugugcaaacuugagcauuauucucacuuuaccagcugugucuagguagagucauuacaucaaacgcuucuaauuuuacaaaaagaaaucaaaacaagcguguguuucaguccccgugacaaaugcaaacccugugagucaaauaggcaaacugauuagcaagcuggcugggaagucaaaacagcaaauauaaggagauuaacaaaauagaucuguaagaugagaggaguaaaaauagacuccaggggccaagugggguccgguggguggcuuugguggcacacauaugguucugugccaggaaccagaugucugccuuuauggcccacaaucuucccuucauucuagguucccuccccacaagagaugggaucgcagaguucaugucauucagucucucaauggaugcagaaauccuucucgggaaccucagagguagcaacuguccuucauuugaauccugguugcaugaugcucacugccuuacaaggcagcuccaucuauuuauuaguagguagcuguuuuuuggaucuuagccauuguuauuaauuagauacuuaccagguccuuauuuguugugcaugcuaugcugugcaccucucgugaauaacacuugauuuaaucuucaaaacaaucugguaugaugaucuuauuuuaccuaugcucagagagguuaagugacuuguucgggucacacaguuucugaguguggcagagcugggguucaaaugggccuuucuaccugagucugaccuguuaaccaucaugcuauaugcauaucuuugcccuuacaaugaacuguaaauugucugccuauuauuuccucuuuuuuuuuuuuucuuguuugcuuuuugcuuuuuuguuuugggguuuuuuguuuuguuucguuuugguuuuuuggcucuggaggcccaugggauaguuuauccaucccauucccaaaacagaaauagagugagucggccagggugccucuucagcccccaucuacggggucaaggguugugaagagcaaaacuaagaacacaaugcaauugacaagaagugucagccuccuucugaaaaaaaagguccacaccucccuugaugguccugaauucaccauaaccgaggcagcagaguagacgauggguguuuggcacccauccucuccauccuguguccccguguaauagcugccuuguugcaacuuguaauuagggggauauuugagaucaggaucaggagauuuagagacacuguuugcucauccccuuucagugucgaugaguacaguucaaguuaguauucaaaccagugagaaccaacugguggagcaaaaucaccaggcaauagccuuucucuucaguugucacuugggcucaaggaaagauuuuaaaauaaguuaguccuaguuagagguaaaaauaaccccuggagacagguuucuggcugcgguucaguuggacgcacugccuagcuagucugggagaaauggaagcugccucccaguaaccaggguggaaaagucacagcuaggaagugaggcuacccugggaggcuaaaaaguuauugcaaguacguuuauuccaugaaugaagguguauacacaagacuguucuagccuggguauagauuauaaguuucaaaagaaagcugaacucccaacaagccuucaucaaaaucaacugccuuuccaucccacugccuccguuugccucugguuuugguccugccaaaugcuaacaacgucacauuccaacccuacucuucugugccuaggcaagaugcagucaccuggcuucccuggcacugucucugauaucugggaaauggaccuaaggcuguacucggaggcagaugugacaagcuaccagcccaggugagauggaaggccucuuccccucucaggccagaggguccagugccagaaucaucccgacgcuugucgcaaauucacuuucucuucucccuuuggauuccacagcucugggauguagcccaggaagcuguauuuuuuuuuuuuaacuucccugagugauucuggugaucuuccucuuggagccacacugaagggcaagacaagcaguggcugaacguuguugccagcaggguuagggaggugggggcagaggauaaggagaaguccuguagggauuugggaagcauguuugccacucccaaaaaaaagaaaaaaaaggaaaacgaaaacaaaacaaaaaaaagcucagcuugggagagaagccuaaaacaaacaaacaaaaaaguaaccaagaccucgacgcaguacugaauugcugaauuuuuaaucuguaacacaaagguugccaaacauucccccaaaggagcagcucucagugggguggcgguggaugcgaaacagcugaagacgcggggcaguuggccuggcuuccguugcacgggcuggcuucccgcgggagcggugguggguggggagggguggggggacucgaggcaaccccccagagcggccucugagcgccuaggaggaaccugaaggcgggaagggggaagaucgucaggucaaaggcgggagucucagggcuuaugggguggggaaggagggucuggguggaaagguaccucagggagccuaggaggcugucagcgugagcgggguguuucgguacaaauggaggccuucagaccuacugaguggggggcuccgaggguuggggcgguccucaggauggaaggauggugggucucgguauagggagaccucuggguggagagggcugcggggagacuucagcaaaggcgaaggugagaccucagaguggagggugucuguuggagcagaggagaagcucaaaggcagaggggggccucgggggucccuggccgccgccgggugggggccgcgcucaggcggccuugcacucgcucucgcgccgccgcuucuugcgcucugagugcucccgcgccuggcgcucccagagcccgggcccgcacacgcccaccacgcagcaggccagccgccggcccgcguucccguucuccacgcuggccugguugccgccgcggcccaggucguccucgccagcguggacgaccacggcccggcccacgauggagugcgggcccgcgagcgaggcggccaggccggcgcgguaccuccagaggcugccgucgcggaccgcgaaguugccgaagucgcccgggugcugcgggugcggcacggccagcggguuguaguggggcccgguggacucgcagcccuggcucagguccccgaacuggugcacguggauggcgcggcuggagcuguucggcucggucgggaagcccuccagggcgaagaaggcgucgagcuuggcgcggggcgcaagcugccggaagaggacgacgccggucacccggggcugcgcggcguccagcguggccgacggcugcaccuggcaggcggcguggagcgcgccgucgucgucccgccgcugcaugaccuccugccagaucuccgugaccuuggcguacaugucucggauccacuccgccgagucagaguugggcuccgccgaguccucgcccguccaggcguccgaggcaccggcugccaggagcaggcaggaacacaguagcgccagcauggcuggagucgggcaccugcgggacgcccccgcggaggugggggcagagugaggcuuagucacgugaaacauagaaucucagggaccccauuaucgcagaaccaaccccccaguccccagugggcuuccuggcccagugggcaugacuucauguggcaaacguuugucuagggccugcugugugccgggcacuguguuaggugcuguggcuguaaagaugggugagacccaaucugaagaaacccacagggaucugagucacaaaugaucaucguccucuccagucccaucucuauagcguggagggggucucagggagcgugaggggugucucauggcccuuccagaccaccucccucaucuccccaccuggucuccuguuacccucuuccuccauccucccccacagacaucccuaaggcuucugucccugccuucuggggcuuugcaugugcuacgccuucucccugaagugccuucucccuguucucugcuacacucaguagacuuggagcuucuugaagacagaaacucaguuuuauucaucgguauccccagcaccugggcccacaccuggcaaaaggaaacauauaauauggauuuugcauaaggaguucagugagggacagacuuggcauccaaucauuccagcacaauccugugauugaagauggggccugugcuggagaaggacagaggaggcaguacccaucucccuaggagccucagggaaggcuucucagagguggugacuuuugaacuggguuccacaagauggguaggaguuuuccagccaaguuggguaggaaggccaucucagcaggcagugcaguggaaguuuuuaagaagaaaagugggugaugagauagucuuuaguuccuuaaguccuacugguaaaaggauauggguuggacuuugggaugaagaggaaaggggaggaagaaugggaguagccuagggagagacagagaagcagaaauagagacagugagaugaguuagggggcguuguaguaacccaagcaggaaaugaaggcuuuuaccaaagugcagguggugcacacagaggaggcauggguuuaagagacacaccgggcagcacuggcaggauggaagaugaaggcacagugcagaugaccaggguucccagcaggagagacugaguggagggagggugggaccuguucuggaaaagcagggagagaggauuaguucagcuggagucuccugagggugagacgcuggcgggugcccaggugggaagacaggugggcagacagucggaaacuugggucuggcacuuagaagaggagaugaagcuggcagggguucucaguguugacugcacaucagaugucugguuuuuaaaaaucagaugcccaggccccaccccaagagauuuugauucugugagaaagaaaggagagaagaaagacagagagagaggaaggaagggaaagaaagaggaaagaaagaaaagaaaagaaagaagacaccucuaucaaagauucuggggcccagcuaggaauuauaaagucagguacagauuugaaucccaauuccaaccuauacuaacugugacuucacgggguuacugaugcuuagcuucaaguuccuuaccuguagaauaaggccagccaugccaccgagguauuuccagagggauugaugcugccuccaaagaauugcuuugaaggucaacugcauuuccagcaccaaacuaggugccauuuaaaaaacuccaagauuggguagauaugcuuuauauaaccauuucagaaaggcaauuuagugugguuauuaaagggauggauuccagaacucaccucaugaaucuaaagccugacucugccacuuagucuaaggguuagcuguuacuauuuuuauugcugaguagcagaguaauugcuggacugcagacuguacacugucucauccccugugaaccucaguuuucucaucuguaaauagggauacuaauacagacuuaccuuagaggcuugcugcgaggcuuaaaagagaugauuagaauugcuaaaacuuaucgaacacaggcgccagacacuauuauaaguacugugcguggguuaauucccugcauccucacaagaacauuauucaguguuauccccauucuaaaguguaggaaacugaggcacagagaggcgugugucccgcccaaggugacauguucacuaaggagcugaaggcaggauuugaaagugugugucugcuccaagcccaagguuuaggcaccacacugcacaucucucaucuagggcacuuagcacagagcccaguacauagaaaguucccaguaaauggcagcucuuagcuaucagagagagcugcugguagagauuuuaaggaccauuagcuaagagaugcuauggacacugugagaggagguccccuugaaaggcuccaagaaggaggauccagaaagagggagaagcagagaaagugauguugaaggacucaccuaaaugacauggcccaaugugguacuacuaccccaaagccccagggaguaggcaggaaagugggguaacucuccugccagaccuggacaugaaguuccccaucaucaaagacaccuuccuccuaagacagcccugccacucagaagggcucugcugcuuagaaaguucucccuaaaagcacagagcaaaaccagauuguuuugggugugucagugagcuuucuuuuucaagaauccuugggaaauaaacauuuuaaggagauguuuuucucugaaaccaaaagaagagccaggcaugguggcuuaugccuguaaucccaccccuuugggaggaugagacaggagaaucauuugaguacaagaguaugagaccaaccugguagagacccccaucucuagcaaaaaaaaaaaaaaaaaauagcugggugugguggcaugugccuguagucccaguuacucaggagguugagguaggaggaucgcuugagcccgggagguagaggcuguagugagccgugauagugaucgugccacuacauuccagccugggugcugggugacagaaugagaccaugucucaaaaaaaaaaaaaaaaaaaaaaaaaagagaagaaggaggaggaggaggaaaagggggaaagaaaauucucccucaaacccagguaaacucugacuucuuguuucuuaagccuuugacaccucuuccccucgggaccaacuugauucuucucccacagccucuugcucaguuugagcugugaaugaccaagugccuuuuuaagggccuccuuuguacguggaucuggaagggaggacgguguuaucagagaaagaggacaguguuaucagagaaagaggacaggggcccuuauccugaaccaaauagaggcaccaagccuuuaucuccuuccugggucuguaucugggaagaaccugccccucuugagccuuggguguguuucaucccucagcugucuccuagaaggagcucuugcugggagccugagcuggccagggccucucugcuuuccuaaggagguggcuuuuuagaguaccugcugucccauaaguggcucccgacaccaaagccaugcaacaucuagaaaggcccccuuucucgucacuccagauuccuuuuccuaacacuaaaauccucuuggacuggucuuugcagauccacaggaggaacgguuucuuccuccccuccuugccuuccuccccgcucacuccaccuccccacuaaccccucagagcagccagggaaaguacauuuccuucccaagaagaugauccaauuuguucccaagaagaggcccguugccccaacccagcuucagacucaauaagcacacuccgagaagaacaaaaugaaccucaacuuagcacccaccuuuccagcuccuccaagagagcuuucucuccugaaaagagagcugcacccagccagcccaggaacgcaggcugucccuggagccugggcuguuagcgcgagugcaggaggccagcccagaggaguggucagcgugagggagccagucauugggccaguucagggaggaaaagcaggccagaccuccccggguuguagaauugcuucgccuccaccuccucccgcuc

SEQ ID NO: 14348 - RNA, 18283 nt, Homo sapiens
aaaguagaaauaaaucauuuuaaugucuauuuuuucacuucuauuaauugauuauugauuucuacacaaguguaugcaucuaguuugacuugcuucauauuuauuuuccaacacggugcaaucuucagcaugaggugcacgaaguaccuuguccucaaagagcuuuaucaacucgaacauuuucgaagagcucuauaaggcagcucagcauggcaguuuuuuacugaaaucucuuaucuggaagauggcagaagagacccggaccuucccgagcccacugguugcuuguauucauaucacagcucgcuugaguaagugguaacgacagaauaauaagcagauugcuccuccaaacccagcugggugagauagcuucauuuuuggaaaaucaacugaaucaugaaaaccuuccuaaugguauaauuuguuccagaguucuuuugauacuuaagaagggaaauauuaauccuugugcacagucuuuuauuacaagcacucuuauuuaugguauuacagaguuuucuucuccagccgucauucucuggugaggugacuggcuguaccccaugcagaaucgaaagcaugaagaaaucuccuuucuuaaucagagcugaugacagcccucucauuuccugccaaauggaucagaccacacuuuuaacccuauggaaagaaacaggaacaaaaacaggauucauuuuuaaauguccuuccacuuuccuccaccccaaacaaacaaaaugacaucagaacugagcugugcaauuuacaguguaguuugagauggugugagcaggcugccggaaccuuggcauuaaauggccaggaagccauggcugccauaagggacuuuuaaauggcucaggaauuguaccccauagcaggaagaccgacaucuggccuaguuaaaaaauaaauaaauaaaaaagaauguugccacagauuauaagagcuuugguuaauaaaugagaaaccucucauuccuggcuaacuuggauccucugaaaggaacuaaccauucagccauaaagggagcuuuuuagcccuugugcaaagcagaaccccacaucaauucaaacagcuaacaaguaaacacuauuuucccaugaggggaguguuuaaauaggugcuugguaaauaagucugccaaacagcuauucacgucucauaucgaaucacgcacuuguuaacauuuuuaugcccacuuauaaaauggaaaagaggaaccuggcaaacgugcaaaaaguauucuggagugaaauauuagaaugacgccuuggguggcaucuauaaauggcaacuguugagaaauaaauagcaaaaucacaaucuugucucuaagcuaaaaggcauuuucccacucuccacgccaaggcaaacacacacaaacccgcacaacacaguaguacaaauaagauuugguuuugauuuuuuuuuuucaguuuaccugguggcugcacauccucuugaacaauuccagcccgauuuauagcuuguuccuucucugagaaacauaagagaaaaaucauucuuuagaaggggggcggggagagagaaauauuuguauuuacaugggccaaugacaugggacaauuagaaaacaguauuuaugagugcuguuaaauucagauacgcuauuaugcaaagcuuuuagguuguggaaguuagauccuauaaugcaaaagagauuggguauuuucaaaagaauaaagaaauccauacuucaaaagaaaagcuccccaacuaacaucucuucucugugaucucagcauuuuggaaagacaagaaaacaacaacaaaaaaagaacaauuuugaaagaacuggugggcgugauaucacgaggggaaagcugcugaauugaaggaacaaguacaauuaagaaaacgauguaguuuauaugucuaaaaugcacuccaccaaaggacuagacucagagcuaaauaugcuauguuuuugauaggaaauagagcagaaaauuaaucuuuggguggguggcuuugguuuggauaauugaagcuucccuaauugauugcaggugcugcgccaauuagcacauuguagcgacagcaacuaagccagucucuuuggagauguccaacaggcaagggccaagagaaauugggcauuucauaucugugggcuugaagcacucugacacauuuuucuaagugguuuagaauaaacccaaggucuguaaaaacaaagaguuauuauuuuaaguaucuugacaaacaaaugacagcuuuucaggagaaagccuuagagccaaaggacguuuaccacuaaauuauaguaaugaaaugucauaaucggaccuuuguuuuaaucaggcugacaguguuucuuuaaauccacauuuagcucuuauuuaguaucaggccauuuucuuuacuuuggccucuggauucucauaaaguuacacaaacguaacgguacaagaaacaggguuuggccaaaucuaauauucauugaacuugcuucucuagucaugugacagaaagucaauccuaaaugaccgaccugauaguuuuaucaauacuaaguuuugcuguggcaaauaaaacacugggcaauggggauuaugggaauccugauauccaagucuaagagggauggagagaacacauaggauacucaggccuauuccaggcaacaagcggccugaugguuucacugcuccucucugaaaaguagcggaugaauggcaaccaagauucucucaagauauaucaaaagauuucuuccauuuagaguggauauuauggagccucuaaaguguuagacuuucugaaauaacacaaaagguguccucauuucuuaagacauuaaaucauuguagaacugagccccaccauccuauagacauguaagucucaaaguauggaugucucgaacaugcucuuggaagauaccaacauguaaaagcccacagucaucagucuuggcaggaacaaaaauagaauuaauuuucuguaucuaacuaaaaggucuauuuucugauacuauggaagagggaagauuugaguuuuaaaaaaucacuaucagaaagcauucuagacuuagagauuucauaaaaucagacauccugguguaccaaacacauuguccagaggcagguacugcaaggcaaaagaagcuggcagacugccaagcaucaaaggaagcugacuuuugguggcaaggaccgaaugccuaauuggguucuaaccucuuaugaugcaacggagaaccaaaugaaaagaaagaaaucccugucuucacacuuucuugcuaauugcuaaugaggcugaagcaaggcugaagauuuauuuuaaauagaccauaaucucuuuauaauccuuguccuaaugcaaacaccucuguaguuuggcuuggucaggaaauuuaaaccacuuugcugagccaguuccuaccaaaugauaaccagguauuagcauccuaucuacauccccugguucuuuaauccauuaauguuuuauaaauacucuaaggccaaagcagucuuauguaaauucaugauguaacacaaagacacuuuaucugugaaugcagaauacucuaaaaggaaaacagaaacgagucccucacgauuuagcagugcaucuugauugagguugacaguaagcuucuauuucccuaucuuuggaaaagagcaaauguauauaaaccucaggaaaagggaaauggcagaagucagggguuuaacuauguaaacaaaucaggauaaacuuauuaccaauuucacuagugagcacauuucuaucaggagugaaauaauuuaaacccaaauauggcacaccggguuaaaaaacuccccacuccagugucucagcaagcccgacucugcccccuggugcuaaggcaguggugugauuuguaguuuuaauugaggacguuaucucugguccaggggccaaaguguauuauuaaaacuaguaauacaugcagaccggcugauuuuuuguacgauaguaaaagaaucuaccuaauaauguugaagucuuuaaaaacaaaaacauauccuuauauuaaauguccacaccggaaaauacaucgacugugugacuuguuacuugaacauucacaacaaugcaaacacugcaggauacucaagccccagcucccucagcagucucaggauuauucguugagggugcucuaguggaggaccagcagacagaaaccuaaaauaaaaaagcaaaugaaagcuggugcaagguaugaccuugggaaccuaccucccuauuucuuccugccaauaaauacuuaaaagcaacucugccgggcgcaguggcucacaccuguaauccuagcacuuugggaggccgaggcggguggaucaccugaggucaagaguucaagaccagccuggccaacgugacgaaaccccaucucuacuaaaaauacaaaaauuagccaggcaugguggcgggcgccuauaaucccagcuacuugggaggcuaaggcaggagaauugcuugaaccugggggucagagguuguagucagccaagaucaugccacugcacucgagccugggcgcaagagcaaaacucugucucaaaaaagaaaaauaaaaaaauaaaauaaaauaaaagcaacucacaacuugaauugugacaaauggcaaaauuugaacgugggcuguauauuccauacaaguugaauaucccuuaucugaaauugguugagaacagaauugguuuggauuuaggauuuuuuucagauuuuggaauauuuacauauauauauaacaagauaucuuggggaugggauccaagucuaaacauuaaauucauuuguuucacauacaucuuauauacauagacugaagauaauuuuauacaauguuuuuaauaauuuugugcaugaaacuaaauuuauauuaaguacuuaugugugguauuuuccacuugugucauuuuggaacucaaaaaauuccagauuuuggagcauuuuccauuuucagauuagaaaugcuccaacuguaauagcacuguaucaacguuaaauuucuuagauuggaaaaccgcauugugauuacauaagagaaugcccuuguucuucggaaauacaggcugaaguguuuaggaaugaaagcucacaaugucuuugaccuacucucaaaugguucaacaaaauaacaguaauaauuauaauauauaguacauauaacuauaucuguauauauguauguaucuguauguuauauauagggggagaaagcaaauguggcaaaauguuaacaacugguaaaucaaggugaaggacaauauaggaauuuacugcacuguucuuggaucuuuugucaguuugaguuucuuuuguuuauuuauuuauuuuuugagaaagagucuugcucugucacccaggcuggaguacaguggcgugaucucggcucacugcaaccucugccucccagguucaagugauucugcugccucagccuccccaaguuugaguuucuuuuuucacuaacaaaaaccacauaacuguacaacaugcauacgaaaaguccaacaccauuuugacucuuccauggugauuauuucaaagaagcuaucuuuuaaaaaguagcaaauauaaaauuuuuuucaaaagcuuuucaguugcuuuuguugcugcuguuaccuagauacauacaccaucugccucugggguauuccagaacuggagguucacugguggugagugugaaccaggggccaaggggaagccauaugaccgcagcagcaagugcaacccaguuggcugaaggggaccaaauggacguggugacaagaaagaaccagggacggaggggaagccauaugaccacaggagcaagugugacccaguuggcugaaggggaccaaguagccacuugaagcacugcacuccucccaacagugucaacaggucuguuuccucaccagagccugguugaauccagggaacuguguaaugccaguuagaaaacaagacccagucugccugcgcauuucauucgauuauguggugaaaggacugaaaagcauauucuaagcaccuggcaugucacaaggaaaaugcccugacaagguaagaauucuuucugcaucaggugauuuccaguaccgugugcugccuaggcauagccuccuuuugggcaggggcagcaaggugcagcggaaaucaacaggacugagaagcagcagaacugaggucucacagcucuccccuguggccuuucacuuggcuggcuguugaacauucuucacugucugaaggcaucaugaggcagggcauuaaguacaggcaaggucaaggaguuagggccuaguguccacccagcaacuaaugugcugaguaaccuuggacaagucacuaaaugaggggacggaaaugagcucaagccccuucuggucaaacccuaugauuuuaugcuucugaacauccaauuaaaauuucaaaugaaaaggaucacagaaaaugaucuuauucugucuaauuucacaggcuggccucaaaugcauguuauuuguaaaaggccauauucagggucacugucuaguucuaggaaacaaagacagauuagccaucuguacucuucccuaacuguggccucuucagaccaaacaugcuaugccaacagggugaaagcuaaaaagugucugggacucccuccagaaguacagcagaacuguacccagacuucugguuuugggucacugacccacugaugccaucaucuguccagcgcucauuucaguacuugagguaucauguacagaacugccuuguacuccacauaacacuuaggaaagccuugcuaaguuaacgaaagaacugaagaucaugcugaacgccaaaaugaaauccaauaaggcagucuggugauaguggcugccugcucugcaaccauggaagaucuccuuggcuuuguuuuaccuaagcaggcuuccccuucuuuucugcugccuguaugcuuguuccagcagagacccuggaacguaccuguccccauauccaugcuggcacaggugaagggcccggacugaucugacacuuggcucuacauggacugccuugccaguugccagcccuaagucuugcuuuuaccaguaacccaguucucagggaguaggcuucugcccuguccauccaagaaugaugggcuucugccccacagucucaggauccuggggaaugaaauguaugaaggacggucaggagagaaggccuaacaagaaaggcuaacaggaguggcugaaaggcaggagcaaaagagcaaacccaggaggaccuuccacgguggagaggcccagggaagacagugcuccaaggaaggagaggauggccuagaguuggugccucuuacucauaaaugaccugacuuccugugucacaaagagaauagacgccaucaccuggaagugcccacaacuugccaacaucaaaccuagauauggcagcauccacaccauccuuccuccugagcugguggaagaggugccuugccuuugguccaaggcucuuuccucuacuugagcucaggaucucaugucaccucccacucuacggacugucuucucucuccagcagcuuucucugucuaagacuuucuuggcccuccaucucuuccagccaaaacuaaaagaaaacucuucccagacccugugaccugcuggaaacuuugccauucuccucuccauacagcuaaacaucuauaaauagucaacuuaauacacuauuaauagucaacuuaauacacuucaauccacugcaaccugccuucugccuacuuccaaaccacugaaagcauguuuaacaauauaaccaaucacuucuaacuuauuucuguuaaauauaauucauauuuucacuuaucucuuuuacugucucuaagcagccuaacccugcugaccacacucccuuuucaugaagagcugucuuuauggggcuugugacugcagccucuccugguuuaaaaccugucuagccacuccuccucagucuccuuagagggccuuucucuuccucugacccccuaugcuucagcccuucugacacugguguuccccagcacacugccccgggccagcuugccccuuacaaucucugaaugcugccugggaacccuuaccuacugcagugaccugauucccagccacgugcugaugaugccccaucuccagcugcagcucacauccggcgucucagccccagaucgguauauuccauugucuaugggaaaucucaaagagcacaucagcuaccucagccucaaaagcuacccaaaugcccaaaagcaaacuaacuugucuuuucaccccuaaaaccaauuccuucuuguguuuucuagcuaaugaccagcaucuccaucuccucagcugcuggagccagaacacugggugccauucuccuucuuugccccguggcuaaucagccacagaccccuguagaguuuacuucuuuucuuuuuuuuaaaugagacagggucgcgccauguugcucaggcugguuugaacuccuggacuccagcgauccuccugcgucagcuucccaaagugcugggauuacagguuugagccaccaugcccaccaguuugcuucuuaaauauggcucccaaaugcagucacuuaucuccacucccauagccaccacucuggucucccugaggucacaggaaacacagccuucccguaccuggccuuccuguccccagauuugacuuuuccaccuucuaguuaacauacaaucaaucagagugaugcuuguaaagagugaauaugaucacugcucuuacuaacauacaguccugugucacucaucugugggaguacauucugagaaaugcguccuuaggugauuucauuguugugcaaccaucauagaguguacuugcacaaaccuagacaguguagccuacuacacacccaggcuaugugauauagccuauuguuccuaggcuacaaaccuguacagccugguacuguacugaauacugcaggcaacuguaacacaugguaaagauuugugugucuaaacauagcuaaacuugaaaagguacaguaaaaacacuguauaaaagauuuuccaaaugguguacccaaauaggauauuuaccuugaaugaauccugcaggaguggaaguugcucugggugagugaguggugagugaaugugaaggccuaagacauuacuguacacuacuacagacucuauaaacacugcacacuuaggcuacacuacauuuauuguuuaaaauuucuuucuucaguaauaaaugaaccucagcuagcuuuuuuacuuuauaaacuuuuaaauuuuuaaaacuuuuugacucuuauaguaacauuuagcuuaaaacacaaacaucuacagcuguacaaaaauauuuucucuuuauauaucuucauucuauagacaucuuucuauuuuaaaauuauuauuauuuuuuccuuuuuaaacuuuugugugagaaacuaagauacaacauauauauuagccuaggcccacacagggucaggaucaucaggacaucacuaggcgacagaaauuuuucagcaccaugauaaucuuaugggaccacugucauacauggucuaucgcgggccaaaauaugauacagcacaugacuauacuucaauaacccuccacuggcuggacuuccaagacaccaaaggguuacuggagcacuguaauuaagcaagugagaugauuaaauuuggauggcgugacaaacuuuucaaaaaccauggcagaagaccugcaguucuauacauuuuccaauagacaaaaacagagguucccaguuacaaauucuuaccaaagaaguaguaacagauguaugucagaagggagaaaacugaagcuagaaaggagugaaauguaagcagcgucggugaguaaagaacgcgggugaagauaaacagucagugaccauauacaauagugaugguguuaacugauuugcugagucacaggcaccaggcaggacaaauauauuaugucaggugcaugggacaaagguuaaggcauuauaaggaccuuguauuguucaaggguaaagacacugacuaacucuaaacuuuauaaaagaacaaaaauagaauuuaaaacuuucaaacuaguagcgggaagagaagaauaaagaaggcuugaggcagaaaagaagaaaaaaaggaagcauagaaauagaacagaaggccgggugcaguggcucaugccuguaauccuaacacuuugagaggcugagacagccggauugccugagcucaggaguuugagaccagccugggcaacauggugaaagcccaucucuacuaaaauacaggaaaaaaaaaaaauuagccgggcgugguggcaugugccuguaaucccagcuacuugagaggcugaggcaggagaacugcuugaauccaggaggcagagguugcagugagccgagaucuugccacugcacuaacaaucuggugacagagcaagacugucucaagaaaaaaaaaagaagacacaaaaugaggugagaaaaauaaaugcaaauauaucaguaaauagaauaaaugaaaauuaauccaauccaauaguuaaaagagcuuaucagguuggauuaaaauaucuaguuuauguugguuuuaagauauucacaggccaggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaaaaagauauucacauaaggacaaagucugcguguauaaggagagaaacagauaagcuaggaaaauauuaaaagaaaucugggcugggagcaguggcucaugccuguaaucccagcacuuugggaggcugaggcagguagaucaccugaggucaaagaguucgagaccagccuggccaacauggugaaaccccgucucuaguaaaaaauacaaaaaaauagccaggcgugguggugggcaccuguaaucccagcuacuugggaggcugaggcaggagaauuacuagaaccugggaagcggagguugcagugagcuaagaucacaccauugcacuccagccuccagccuaggcaucaacagcgaaacuccaucucaaaaaaaaaaggaaucugguagcacaauaaaaucagauaaaauagagauggggaagaacaguggagauaaagauaauucuuauauaaugauaauuagaaaaaauuauccagaauuuucuagauuguaugcaccuaauaacauggccacaggacauccaaauacaaacagaauuaagaagcuugaucuguaauuaacauacacagauacagaacucuguacccaacaagagaacagccaccauuccaagcacacagggaauauuuacaaaaacugaccugggccaggcgcgguggcucacgccuguaaucccagcacuuugggaggccgaggcaggcggaucacgaggucaggaggucgagaccauccuggcuaacacggugaaaccccgucucuacugauaauacaaaaaauuagccgggcgugguggcgggcaccuguaaucccagcuacuugggaggcugaggcaggagaauggcgugaacccgggaggcggagcuugcagugagcagagaucacgccacugcacuccagccugggcgaaagagcgagacucugucucaaaaaaaaaaaaaacaaaaaaaaaaaacugaccuguaccaggccccaaagcaagucuugaccagugucagagaaucaaaaucauauaguccacauucucugaccauaaaugcaaauaagauagaaaccagcaaccaaaagucaccagaaaagaccacuguggcugcuagguagagaauggguaguaggugggacacaauggaagcagcucagucccaggaauggguggagcgagguggacaggacaaggguaggaagagcaugauggaaggaagugacugaccaugcuguuugguuaggugcaguccacacccagcacagugccaggcacccagcgauugcuagaauccagguuucuucuaaaaaagagagugcuaaauaaaugcuaguugaauguguuggaaugagcugaagauccgaccacacaguggguuuccaugaccugaucaugaacaccucaucccaguuuacugcuaggucagccagcuccaggccuauccaccugcuaaaaucuccaugucucacauuccugcccuuguggcucauuauuuuguaaacauuuuaauaaaauaucuaauauaagacuauaguagguguuuccacaccuguuaccccauuuaauucaccccaaacccuguaaauucaauccagugaacuacacugcuacagaugaggaaacaggcagggcucagagaagugaaguaacuuagaugagggucauucaucuaguaggcuaugcagacacucaucucccccauugccuuuucuugcccccuuagacaagcaguaugcugucuugguuuagggauuaaggauauuaauucaagucccagaucugugacucaucagcuguagguccuuguguaaguaauuuaacuguuucacaccucaguuuguccacauauaaaauggggaugaugaucauauagcagcugccacaaagggcuguuaucaacacuaaauggguuaauauauaggaagugcuuagaagagugccaaacauauaguaaacuucccacaaauauuaccuguucagcaauauuuaccuguuuaaaagaaucaguugcuggcacugaaggcgaaagcuguguaaacgcucugcccauuacaaauguuacagcagucaguuuguaacacuagcacuuugggaggcugaggcaggaggaucgcuugaggugagguguuuaagaccagccuggccaacauggcagaaugcugucucuacuaaaaauacaaaaauuagccaggacugguggugcaugccuggauucccagcuacuugggaggcugaggcacaagaaucacuugaaccugggaggcagagguugcggugagccgagaucaugccacugcacuccagccugggcgacagagggagacugucucagaaaaaagaaucaguuacgauccccagaaaagaguuggccaaauuaaucaaaauggaaccagaggccaggcgugguggcucacaccuauaaucccagcacuuugggaggccaaggcggguggaucaccuaaggucaggaguucgagaccagccuggccaacauggugaaacccugucucuacuaaaauauacaaaaauuagcugggcaugguggcagguaccuguaauuccagcuacucaggaggcugaagcaggagaauugcuugaaccugggagauggagacugcagugcgccgagaucaggccacugcacuccagccugggugacagcggaaaaaaagaaaaaaaaacaaaaaggaaccagaaaagugggaaggcacagacugccugccuucuaguuaaaaaugcagauauuauaguuacauucacuaaauguucacccacagaugaacaucaccugauuugucugucucaagacauucagacaaccacagauucuggaguaucccuaaaagacuguugcugggauacacaguacaaguccccaucuugaccauuucaucucaagcaggguuucucaaccaaggcaccacucgaauuuuaagcuggguaauucuuugucaugggggucugucuuguaugcacugcaaaaaguuuagcaguaucccuggcaucuauccacaagaaaccaguagcaacacucgaccccccccccgccccaucccaaguugugacaagcaaaaaugucuccagauugagccaaauauccugcggggcaaaaucaccccuagaugagaaccacagcucuaguuuucagaacugacuuuuccaaugggaugcaaagcagacccuuugucccaaguucuaguggccucaauauaaucgcuggggcaggcguccgcugaagaaggaugguggaaacagaucccgcagggcuucacacagcccaccuuacucccacgcauggugcaugcagauaagcuggaaggcagaacacaguggccauuucagucuuggcuaaugaaaagaagcuacaaggaaaucugagugugcacuuaaaacgcucugccuccagaaaucgacugcugcaacauuuguaaugggcagaacauuuacacggagcuuucgccuucaauucgccaagcuuucaguguccguuaauauucccaagggacaggguuggcccucuuccaucuucaagaugauucggguuuccuggugaacaaaaugagccucuaaugccuaauauuuucugucugacagaugguuucagauguaucaaagugcuaauccuugcugagguauaggucucaaggaagaagaguuuggcuuuuagaaugauaggacuggaaugauuaagaaggaaaauuacucccaggauuucaccauuaccaugugagcaaucggcuuaaaacgaaggaaacaagcagaaucggaaaaacaauuugaggaaaaagaagagaaaacacuacaaaccccagguuaacaguuuggguuugaaacagucccacucaaaaaacaucuuggggaguggaaaugaagugcaguaaaagcaccuuuccacucagaaggaucaggguuccaucuggcucccccagucaccauucucagccugggugcuuggaggaggcucuggacagaggccugggguuggauauauuugccuugucacuuacuugcugugugaccuugggaacguuauaaaaccucugagccucucaguucccucauuuguaaaaugggcauguuuuacauauauacuucaaggugagcuugugcaaaugaaacgauccaacauaugccuaaccugacguguaauaggcauucagugaauuuuaacuguaaauaugaacugguacuuagcgucgacuuaugugaggacugcuuucauauacaugaucaccugagucucacaggaggcucggcauuuuagcauagaugacguagccacaaacauucacagaugaggauacugagaguccuagagguugagcaacuuguccacggucacaaagcugcacauggcaggauucgaacccggcucucccuaacccucgagccaaguucuuuccacggcaccacguggagcucacagaggggagguguguguguuggggagucaggucaccgcaagggguuagagaucacucacuguacuccuccaaucucauuaggggccggaaguagaugggauagaaggcggcgccgaucagggagaugaagccgccgaaaaugagcgcggugcgcagguuccgggacauggcgucaggccccgggcugcccugacccgccgaccgcccggcacucucggaaaccagguuaccgacggccgggccgugaccccgcucggaagagguggagaggcuuucgcuuccgggccuugagggagggacgaggaggaggggcggagcggagaaagagacagggguggagucagaggcggggccucaaggcugggggcggggccaggaaagggguggggucacaggcggggccucggaccccgcccuccgccuuccccgggauuccgugcugugcgggccgggcgcuggcguuggauugagguuggagcuguuuugcugcacucgauucccgcgggcccuguucugucuacuuuccuuccuucggcccgguuccucccucagcacccuccagaccuccuuuaccaucgccuucuuuaccagccagcuuucucguccaucccccguuaauuucuuaauuagcgacuguccgccgugcgccagaugcucucugucgcucgcgcaauuaauccuuuuaucagucugcuuaguuuacaggagagggaaccgcggcuccgcugcgcggcuuuggacgagucacucguccuucuugagggagguuuguacguaucagagacaaaggggcaaaucucuggcccgagagggccugcugggggauucuaaaaccggagcugcggggcuucugcaccaagacuagccuaggaggaacguuguuucagcauccgagcuacucucuuucuccaucccauccucucucccuccaucccauccucucucccuguucccugugcugggaugccuuggccaaggcagagagccagcauccggucccauccauggggccacggggcgcuuccguauugucugggugggggccaccgagaacagauaccuguuuccuccuccucaaguugccauccuccgcccucugcaccacacugcccuuacaagugggcugugccugacuaugaccugcccagggauacugggcagcugagacacagauuccuugggccuccaugccuuuauaaauaggaaucaugccagcagcugggccuggggagcaaagaggauaucugucuugacccuagcagcauuauuuaggccacaacagaucuacaagcguuucaaaauagcuuggagaggacagguuuccucuuucuuuguaaucuuguaguugcaucaagcuacugucuaccucuguggcucuagaagcauguaaaucaguuauucaaucucuccccagauucauggacuaucugccaugccccaaacaccaggcagagugcuaaggggacacaaagaugaauaagaugugaccccugcucucuaggauccugucgcauagaugaagagauagaacauauccauaaaaagauaacuaaugaccgacauugcgugcugccgacacguguuaugguccugcgggcuacagaaauucagaggaggaagacagaugacugcaguguggcagcugcuccucgggcacuuacaggagcuuguuaggaugaggacagaagacuucauagcacagagggaacugugacaccagcuuuauaucacacgauagaaaauacccaggugagggcuguggacaguggcucacgccuguaauccuagcacuuugggaggcugagguggguggaucaugaggucaggaguucgagaccagacuggccagcauggugaaaccccgucucuacuaaaaauacaaaaaaauuagccgggcgugguggugcacgccuguagucccagcuaccugggaggcugaggcaagagaauagcuggaaccugggaggcagagcuugcagugagcugagaucgcuccacugcacuccagccugggugacagagugagacuccgucucaaaagaaacaaaaaacaaaaagaaagaaaauacccagguguagugggcaucgucguuuuaucagcccuguggccacuucccuuuuuucugugaauaguaccccaaguaucuuucugggacccacucuuuucccacucuugguccaugagauaaccuaggacuccccauccucauccuacuucuucccagcucugaaaguuaagcauaagggccugaccaagcuuccucgucacagggauugguuggcacccaggacucagucuugagguuaguauugauuaggagucaguccugaacaccuaauguaguugcauccuccuggccacaugacccaagcugagccaaccauagucuauuccagcuacuggaaaguuggauuugaacuugagcgaaugagacucgagcuacugggggccaucauuuaggaacugaaaaggaagucaguacagcagaaggagggcugagagguggggagaaaucagaugcuaguguugcauuugugccagcuguaucucagaagagcucuaccccuagacugcucaguaacaugagcaauagagucccccuuucucugaagccaguuugaguuggguucugucuuuuacaacagaaggaguuccagauaaaaucucugaggaugugacuccacuuggagcugcaaggcaaggauuacugagcugcaaggcaaggauuacucuauuuuauagaucuggucacugacagccagagaccagaacucuccugaggucacacagcauuggccgaggucuuagcucuugugaugucugaucugaaaugcuccuccaugagaucuugcugucuccaugagcaagcuuggcaggauggccagccaagcccugcucacgggcaccugcaagccaguaaggagcguugccaggagaacagagcauc

SEQ ID NO: 14349 - RNA, 164747 nt, Homo sapiens
ggaggcgucccggcggagcgugguacuacgaccagcgcgggccggagggggcggggggaugcgccgcggcggcggcggcgcgggagcugggguugguguuuggcggcgccagagcagcggaucccggucucgccgcagcagcagcgcgggugucgugcaccgccugaagacgccguaccuuucuaccccccaccuuuuuuuuuuuuuuuuuuaaauaaccggaaccaaugaacgcagccgggaucagagcuccggaggccgccggugccgaugggaccaggcuggcgcccggcgggagcccgugucugaggcggcgggggcggccggaggagucgccggcggcggugguggcgccucgcggagccggcgagcugcaggcggccggggcgccgcugcgcuuucacccggcuucuccucggcgccuucaucccgccucgacuccuggcccagcguggggcuggcugcugcggcggcggcgcugggcugcguugcuggugcucgggcugcugguagccggagcggcggacggaugcgagcuugugccccggcaccuccgcgggcggcgggcgacuggcucugccgcaacugccgccuccucucccgccgcggcggccggcgauagcccggcgcucaugacaggugaggggccggggggcggcgggcggggcucggccggcagcgaugggacccccaacccgugcagaggucagcaucuccgccggacguccgcuauuccgcggcuccggccagggcgcgaugcggagcccugccugcugcuucgucgcgguccccugcacuccggacgucuuuccuuuucaccccgacaccccgcccucgccgagccucucgacggcacugauuccccucccuucagucgggcucuccgaucuuccaagcugagcaaugcggugguuucucuuucgugcugcagaagugccagcagggucugcaggggacugggcugauuuuuuuuuuuuuuuuuuuuuugaggcugcuagaaaaagucagcagcagcauugcgguauugagucuaccucuggugcugcuuuugcaaaggcagcuggcagcgagucucaccgguucaaagcuccgcuugagcacagcgucccaggggagccugcuaaaggggauucuuugagagccauaauaccuagugauauuagugguuccguguuaguaugcagaaaugccuaaguuuacagugcauuuuuugcgggguggaaggaggccguuuuaaguggugauggaaaguguuugguggugggagcaucacugggugacaaaggguguagaaaccucagcagguaaccagaaauuauaccuaaaauuugcaaagugcagcauacucggggcuugcagcuggcagcacaguucugauagacugcacuagcaccuuuuuuuuaauauauagaacgaucucauaauugaaaacuuggaaacguguuuuguaagguuaagugcagaauuguauccuuuuuaaagccuuccgguguuauguacaacugaucaguugugguuuaaguaaaaguuauuauauaaggacccugaaaugauuucuuugggaaaaguaauggagcuaaaauaaugguuuuuuuuuuuuuuuuuaguauuucacuuauuuuuaaaguagaucuguagauuuccuacaauaauuguaagacuaaaaaguuuaaaguggcagaagaugacccgugauuaauuuaaccaaaaugauaguccugcgggcgucuggaaguuacuaacagcuucucugacaagugcucaggaacuguauucuuuaaagccaagcaguuucucugauuucuaugauaggauauuuacuauucuagagagaagaaggauguugguaaacuuuaaaagcuuuggaggauguagaguauagaacauaauggucagcauguuuaacuuuacccugaagcauaucaagcccuauuaaauggaacuugauacaucaaaccuaccaauuggguaacugggauaaagugauuauagaauaaucaguauuaggagcauaguacaguuugagugagaagauaggucagacagcuuuaugcuugaauaguauuuauucuccaaauaaaaauguggcaaguaacaguauagugaagaauagugauuauuaggaaaguugauaaauaagacuauaauuugaagauuuaaugccucaugcaggaagggaaggagcaggaauauuuaggcuucuagaagguauaagugguucuagguuucucgagcagaaaaaugugguuaauacauaauuggcuaaugcucugugaaaaaguaauugguaaaaaggcaagcaauucagaaaauuuaguauuuauugacugcuaauaaguauauuuuauacuguguagaucacaucaagaaaauuggucagauggaauuuuaauaagccauuuacaaucccuuuuaagacuuaaauuucucuauacuuauuuaaggcaugggggaaaaaggugauucuuauuggaaaaaaauccgauguaucacacaaaaugaguuugugccauagggcuuuaaaauaaguuugcuagaagaauacccuggaauuauuucuaacguucuuuuacuuuccuuuugucagaauauugauuuuuaacaaguuaaacguuuccacuuaaaguuuaaaucauaaaacuacacaauauacaaauuaaauuguuauuuuaauaaguuuauguaaauacagucaauagcacccauaucuugguaaagguaaacugaaaaucuaugaugaaguuagaaaauauugaaaauuucuuugaacuauauggccucuauagggcucuuucccauucuuaagaguguaugaauagugcuuucuuuuaugguucuauuuguaaauguuaugcaaagccuagaaccuaauuuauuagcauuaguguacacuucaggaaguaaaaccguagacugaauuuacaaaauacuguggugugguaucauauuguaggcagcguuaauggauagagauggaguagagcaucaguaauaagagaacuaaacgucacgugaauuuugaaaauugaaaauuuuugaaagcauucugagagaagaauuggucucuuugucuccugauuaaaguugugauuuagcugugaguauucucaauagcucugcaaaaugacagccaaaaucacuuuucuguuuucuucucgagauuggcauuuuuaauacuuaccuuuagaagcucccuaagaguuagccuuugacuaauaaaauguauaaaacauucuuuuucacugcagcuugccucucaaguguuuuacuuuagggauuuaguguacuuuaagaguaaauugccuuuaaauuauccuguguuuauuugcucaaauaaacuguuauugcucaaaacuauacaaaucauccaaauaaacagacccauugucauaaugaauacagguuuauauuuucuuuuccuuuuuaaauauuaccuuuucagaauucagugugcaaauguuuuuggugagacagaaccaauauucauaacauuauauaguaaggguuuuaaauuacauauacagcgcuuauauauuuagggcacuuacuuugaaagugauugaaauuuaaagcaaguuagggauaggugacugagagcuuggugauuguauucuaaagcagugcuuuaauaacucaaaacaauaguuuuuuuuuuccuucuuugucuaacagauuuagaguugaugaauugauccugguagggagugaccgaucucauccagauagggucccugagaaauagcuuaugaaagggaaacaaacaaacaaaaaaaugccgaauaauugaaacauuacauuauuucuuacggaauuguuucagaauuuuugggaacaaauuuuaacugaaaauauuugccucuauccuuuuaaagaaugaauuaaaguaacauucuuuagugccuaugugaagguuuuaucuuaacuguaauaccauuucacugauuuggcauguuauuagaaauaacauauauaaaaacauguuucuuggaaguauuaaaaucucaauuaagauuuaauauauucuuaguucaacauauaauaccacauauaauagcauuuagaauggccacuuuacccaguacuguuacacacaucuguguuguggggcuuucauuaauuuagauggaaauaccucaaauuagcaugauugucauuggcaaaaugugaaacugaacuuuuaaugaaaucaguuguauuccuuauuuauuuuuauuaguaguugguuugccugugggauauauauguugcuuucaguaauauuuuacaaauaacuuacacauguuaauguuuccauugugaccguagacucaaaguggauucagauagccugagagaccuuuguuccucuuaugacguuguucuuucugaacuuccuaaagccaucauuuacuguauucucuuucucuuuccccuuuaguaucauuaccagugcuuuucuucaccagucuuuggucauugcuguaguuguauuauuguugcuaacuacaggauuaaagaaucucuucauauccauuugaucuagucgauucugaacauuuaagaauugauaguaaucuaauuggucuggaaacauugcaucccuugguacucuuaagaauacauggcagaacuggccucuguugggaaucucauagaacaggaagcauucagagggccaguuagaaaaguggauccaagauuuagcuuccuuuuaugcaaaaggaggacacaggaugauuuagcuugccaaagacuugcuuuguggcuggauacaugcuaguauuuucagauuaauuuaggcucuuuuugcguaaugauaucaaggauuuuugauaguggccuaaucauugaugauaauuguggugugaacacuuucacaaugauuguuggacgucugcauuuauguaauaugauaguuaauguauauauuggcuaagcuaauacuaaaacuaacugcuaauaauauggauaauaagccauuuuuugacauuuacuggaguuuggacuucaccuuguuaagaucuaccuaggaauuuacuucugaauugaucagauuuuauuaacuaaauaauuauuaaguacaagcagcauaacacaaaagagaagugggaaagaauuaaaaaaaagaauaagauguaggugugaccauuuuggacucagacuagguaauaauaggcacauuuauuaaacuguuccuauguguuaguauugugcuaagugcuuuuuauauuauacaucacuguuuuugauucugagacuaauccuguuagauagcuacuguuuuuuuuuuuccuucuaacuuuuauuuuagauucauuuuagauuccaacuuuuauuuuagauucauaugcagguucauugccuggguuuauugcaugauauugagauuuuaguuaccaacgaucuugucacccagguacugagcauaguacucaauaguucaauaguuuuucaacccuuaccccuccucuuaccucccccacaaguaguccucaguuuucuauuguugcugucuuuaucuucauauaguagauuaggaaacaugcuggaugaucuuaaguaacuugcccaagcucacuucuaguagguagcagaguuagagguugaccaggguuucucugguuccaaagcuuggauucuuagcugguauguuguaugcauccuuauacaaacaacaugcgauggauugugauuagcaccacaagggacugcaaaguguaggagaaaggaagaggcuguuagagaguauuaccuggaggagggcaggauuugagcuggaccuugauguauagguaggacuucuuguggagauaagugaaaaggcuuucugggaggaggcauaugcaagaauaggggauaaauacuuuucuuuagaguuaaguauaagguauauguagaguaguggggaaugcaagaaggaagaagauuggggccaaauuaucaagagcuuuacaguccccuaguguauucaguauguaucaaaaugucagcacauuuaaaacugggguacucggcuguauacuggcaagaaugagacauccaggacaaauaugguaccuuuucuuggcauauccauuuuauuagauuauuugagagauauaaaacuauuugaagguuucuaaauaugcacguuagggaaaauguacauauauuuuaauuuuuaagguaaaaggcauuuugaacuuucagaguguuuuguuaauaaacucuugaaguugcaaaucuauauccugucauuaggaggugagaggcauugugguuuuugaagaugggggugacauguccuuuguguuugagaaagcuaauucuggguggauggcaaugaggagauaacagagauaaggauaucaguuaggaaacuauuuagaaggagaggucuugagaauucuaauuauggaguggcuaugaaaauguuuagaugaaauuuuauaaaaucgacuuuauucuuagcuuaggaaucuggcuauuuauaugaaguuuaagauauaaaaauuaccuuuagcauuaagcauacagaauuuauagaaugauuuaaauuaguauaagcccuugaaaaauccaagaagaaacacacuauuugugauagagaaucuucuuuauuucaaaugugccuauuucuuaauauaaagauuaguuuuuaaaaaaauauaaucgggcuuaugugaugauuuacaaaguugucgacagaaaaacaguugcaaauguauuugccaguuguuugacaaauaaaaccaaacaacuuuugauauccaaagacaauauauuugccauaaaaugcuuauauaaagcuuuuagaauuccauguauaaaaaggauaaguguuuccagauuaaacuaaaguuauaagucaagagucgaagucucuccgaccccuuagcuaugaauaacaauauuucagacuacuggcauauuacuuguuucaauauuaacuccuaaauuucauuguugugugaauuucaagcuuaaucuauagaugaugauuucuaaugccaaaucuaaaagguuuguucuguucuuuagcuaucuagaucuuuauauuaguauacauuggauauucagucuuucuugacacugucuaauucuaccuucuguaacuguuuuccuugacugguuucauuguugcugauuuuaagggugguucccucuuaagucucuguucucagccuccucuuccucuagucuagcugaacauuuccuccucagagaacuucauuacuaggaaaguucuaaauuggggguagggaaccccaggccaaugauugauuugauuuuuggcuuuauuuccuuuggcccuuggugugcuauagcacaagcaucauggcugcagucccgagaguaauuuccuuucuacuaggcuuugucagccauauccuuuaaagugaaacaauuucaggauuaaggcuaggagcaguugcagaauguuuaauaaugucuauucaguguuuucauaagauagugguaacuccccuccaguacacacaggcugauuggagccacagagccuggcaagcgcaguuuacuuggacuaacauucaucucagagcccaaguaccuguaucuguccaaguguuucuuuuugcguauggauuuguuuuuuugugugcuuauggaucuugaccucuguguaacuuuuuucucuagucauuuucauuuucucuaccucuuuuugaucuuccuaaacuugacauuauauggaacugaaacaccucaaaaacuguuuuguuuaauuaagugcugggauuuuaauuuaaaaaaugcuugaaaugaauaucucauuuaugugauuacagaauacuaaacagccuuaucauaagcagccucaucaaaacccccuaggguagugaaagugauuuguaguuucuuacaauauucucaauaaguaaaaaggcuuuuuaaacccuuguuugaaguuuuugucuccuacucagcacacugcaaguugcacaggcccauguuuucuauuacugucuuuuuuuucuuuuuuaaaaaaucugauguuggauaacuagauaaucuuaaucccccuucuuuauuccuauuguccagcaauacaucucuaacguuuucauuaaugacguguauguaauuuuugcucuguuucccugaugccuugaaccauugucauguuuagcucuuauuucugcuuugccacacauauucagacuguauuaauccucgccguuucuuucuucuggguaccacauuaagaaagaaaagcuaaagugcaauuauagguaccccuggcuauuuuugaauuugcauuuguaacuauacccucugauguuuauuccguguuuguuuggggucguacgcuguagcuuaugccuguaaucccagcacuuuucgaggccaagaugggcagaucacuugagcccaggacuucgagaccagucugggcaacacggugaaaucccaucuccucaaaaaauacaaaaaaauuagcugggcgugaugaugugcgccuguauuccuggcuacucaggaggcugaaaugggagaaucaccugagccugggggaaguuaagucugcagcaagcccugaucaggccacugcacucuggccuggacggcggagugagacccugucuccaaaaaaaaaaaaaaaaaaaaaggaagaaaaaaguuuguuugguucuaggucuguuacauauggguccuaaaaagaacuauagaggguuaaagugagaaagccagucguuggugaauaugucugugugugcauagaguuuuaaacauuauuuagugacuguuuugugccagcuaugguaugaguaacuggaaauauaaagaugcugaaauugacuauuuaaaaacauuuauguauuuauuuauuuuuagagauguggucucacucuguugcccaggcuggagugcagugacaugaucauagcucacugcagccucaaacuccuggacucaaucaaucuucccgccuuagccucccaggcugugaggcaccacagauggcuaauuaaaaaaaacuuuuuaaaauguaaaccugaaaauugccugagaguggauugcauaaucuaaaaauaugaaaauauguauaaauauuuuguuucuuaaaaggccacugcugugguagcuuaucuaguauccuugcuacauuuacugaaaauauauguuagagauaucugcacugcuauguucuuuucagcauuuuucacaauagccaagauauggaaacaaccuuaacguucaucaaugaaugcauaaagaaaaugugauacauacgcacuugcaccaugaaauauuauucagcauuaaaaaagaagaaaauccugccauuugcggcaacauggaugaacguggaggacauuaugcuaagugaaguaacgcagccauagaaagacaaauacugcauggaaucugaaaauaucaaacuuacagaguagaauggugguuaccaggggcuagggaaaggaguaaauggagagauguugaaacuucaaguacaaagauucaguuaugcaacauaaauaaguucggagaucuaauguacaacagugugacuguaguuaauagugucauauacuguaauugacauuugugaagaggguagaccuuaaaaguucuuaacacaccaaaaaaaaaaaaaagguaaggaugugaugugauggauuaugugaauuagcuucauuguggugaauauuucauaauguaugcauauaucagaucaaauuguauaccuuaaauauaucuacuuuuugucauuaugccuuacugaaguuauaacaaaauauauguuagaauauuuaauggaaguuuuuguuauacauuugcaguauuaaaaaauaagucucccuucccccuucuuuggaacaaaguauaauuauaaauaacuauaauuuaaaaaauuuuuaacugauauaugauagauguacauguuuucagguaucauuccuuuuucacucuuuuguauacuuuauuaaaaaacaagcaagcaaacaaaaaauuucagugagucccaugugccagacaccaguuggguguuuggaauuucaagaucaguaagauauucacccuagcuuguagucuacuagaaggcauacccacuuaaagggugaugauacauugugauaaggguaaaagggccuaaggcuaugugcuguauuuuacugaauugcaaagauggaguuacuaauuuugauguggagaugcagguuauuaguagguuauuagugaauccuuuuuuuuuuuuuuuaaauauccagaguaggaaguaugugccgagaauguaugaguuugucagacagagaaaggcaugguggaaaaccauaggugugaagugaggaagcuggguggggagugagauuauuauaggcauugacauuugagaaugcuaaaugugguugugaauuaccaaauacccaggaugacagagucaaugcugggccuguucgcagugcagcagcauccauauuugcaugugggauuuaaauuuuugccaggcauuuuguauguuucauccaauuuaauccuuagagaaucccugugagguuaucuccaugaguuaguacauauaacagaaauuuaggauugcucucaaauaguucguacuuuaaaaaaccccccugugccaaggaucuuuauguuaaagcauaagguauauauggaguugaaucaggaaaugaggcuggagaaguagcagauacaaacauugugauuaauguuacauuguagaucuuuauuguccaauggccuuaugaguuucuccuucauuuacuucugguaaauaacaaaauuuugcuauuaaauauucugaaaucuuggaauaugacuccuauaaaauauaucugaggcccaauaauuuguccuuuuuaaaauuaaacuuugacucgauuuguucaguuugacucggcuuuucaguaagugcguaauuucuguuugugcuuuguuuucauaaauacaaggaugacggaauguaauuuuuaagaagcauagcaucuuauaucuugaacuuuuaucuggcccauaagucuguuuucacccuuuuuuuuuuuuuuuuuugguagagacagagucugaguauguugcccagggcugaucucaaauuccugggcuuaggcaauccucccaccucggccccgcaaaguaauuagauuaugagugugagcugccaugccuggccuguuuccacuuuuguauagugugaugaagagcauagccucuagacuagggcaggauuuccugaguuugaaucccagucugacagugguuuuguaauuuuggguagaugauuuagucuguuagugccuaaauuuccuuaucucuaaaaugggaugcaaagaauaaaugaauuacucugugugugcuuagaauagagccuggcaaggguaaguauucagguauuauugacuuaaccauuauucuuuuuaucuauagauacagagguaggauaguuguagaaaugugcuuugauuuauugaguguuauuaagauauuuuauguugcauuuaaaaaaguaugaagacauaguuugaggcaguuaguugaucuaaauaaccggaccaugagugguccgagauuaguuaaaacucuguagaaauaugaagcuaaguauagacagugacauugagaagcagugugauauuaaaaaaaaauuaguuguaucauaagccugagucauuuuguaccuuuauuauuuuauaugauuuaaagauuuaaagcauuuugcaguugaaauguuagacuuuaaaaucuuuaauuucugagcuuaaagguuuacuauaaaaaauuuagaacauacugaaaaguaaauauagaaaauacaucuacuucaacagcuaaaaauaacaaagauaacaucaaaauuuuguuuuuuacaaucuuuuauagauauguaugcauauugauauauuuaauaauaggcucauagagugauuuuuuaaaaaugugaaauuacuuaguaaauauuugaaugccaaguauauuacaagcauaugauaaguauuggggacacaaagaugaaugagauugagguuuuuguucucauggagcuugcauuucaguugggaagauagaaaauacaaauacuauuuugaguugugagaaaugcuauugaggaacaagagagacauaaaauagaaaauaaugugggguacuuuuuaauuuagguaggcuaguuagagaaggcuucugagaaggucacauuuaagguggcaucuugaaggacaauaaagagccaagucugaagaauuggggaauagcauuccacauggacaaagacugugaggcaagaaagaauuggaauuauuugaagaaaugaaagaguaucauuuugacccagcaucuugagggagggggaauguuggaugagaucuggcuauagaaaagggaagggcuggaugguacagagccucauagaccuuguuaccuuguuuggguuuaauucagaggguaacaggccgggugugguggcucacaccuguaauccccacacuuugggaggccgaggcgggcggaucaccugaggucaggaguugaagcccagccuggccaacauggugaaaccccaucucuacaaaaauacaacgauuagccaggcaugauggugagugccuguaaucccagcuacuugggaggcaggaaaaacucacuugaacccuggagguggagguugcagugagcugagaucgugccauugcacuccacuccagccugggugacagagugagacuccgucuuuaaaaaaaaaaaaaaaguccuuuccauucucaucgcuacuguguuaguucugaacuaaaucauuguggcuagauguggccagagcaggggggcucugggucccuuguuauuuccuuguuagcaguagcccaggguaacucugacuacuuuguccaggaagcucauggggaagcacagacauacugggugugaaguuuuggugaucagacagggcuuguuuccugcagggcacuuccuuagucauaaaugagagagacgcucaugucaccacucucuucugccauaauggcuucauccagcucuugggacagcuucuggagaugcugaauuucugccuccacaggcucuaggucacugucagacucacugggagagcagaggggcucugucaagggguaaggggcucuacaaggcagacucccgccucaaccgccguaguggguggguacgugaacccauccgggcagagaggcagugaugcuccuucucccaggggucugcggcugaguggacaggggcgccuccagacagcugggugcucuucuggcucaggcugugagucagggauccacugcucuucugugccccucucuuucuccuccuggccuucaccugagucuccaccagccacuuggugucaggacuccuggauucucugggacuuggcaccugagguacucuuagcugagcgagcugcagcuuggaggcucugcugcccuggcucugggguuuccaaguguuugcaggaggggucuccccagagauugagguugauggcugucaggggcagccuccuuuggaacugucugcacagggaacccagggcugcggcaggggucuccuggauggcuggccacaggcugcagcuccuugcuguucuugagcugcuccugguacuggagagaucuccggcgcacagaggccccuacacccugccgcugagaagccaucugccugcccaagagucuugucugaccacuagggcccagcacccccaacgucugcccgacgccaaguacuguaaaguacuuuuaggaagaacuguggcacaucuuuauuggugacugguaacuucuaguggacaaauguuauaggaucagcuuucaguucuucauuuacauaaaccaagcaguuauuguuaauauauuacucauuuugcuuaaguaugaacucuccucuuuuaauggauaauuucauaucuuuucgaguuuagggaaauaaaagaaugggauuauuuaaaagguuacaauuauauuugauuuauagucucacagauuuuaagaacauuaaaaaagugcugguuaauaugaaauuggaaguaguaaaaucaguaaguauuaggcauagacugugagguuacauugugccacuuaguuguggaggauauuuauuaaacaaauguuugaaugucugcugugugcuagacagcagacacuuuuuagguaccggagaaguaggagaaaacuaaacuaaugaaggugcugcugucauaauuuuacuuuuaaugcugugguuauuuguugggcaaauguaguuuugcuacaugcaguaugugaucuuagaauaaaauuggcagcuucuucguauuaugauugcuacgcguuccaguacucacuaguuugcagauuccuuuaauugaagcugaauggcauauugguuuuauugauuaaucuuuuaacucauaguaucaguuauacaauucacaaugauaaaucucuuugaguuuuauacaaagcauauccauauucuuaacuuacuaucaaguuuaacuuaguguaaucgaccuaaaauuagaacucagaucuauuaacuccuuguuuuguguuauuuuugccauaugcuauauaguauuuuuuaugagaucuguucaaaaaucuuauagaaauaugcacauaugccgguccucugaauguaaccaaacuuauauaugaauaaucuaugaugaguuguuuaaacguguuuauaaaauuaucugguaacuuuuauaguguacuaaaaauuuaguuuuacguuuugaagucuuuaaguuuguuuucaagcagguagcugguagucaugauagauucaucauaagcccuaaauauguuaauaauuaggauuauuuuuucuuuauauucuagauuaguaaaggaguaggaagccuguaugugucucaggccucuaauuuaucauauaacaacgugagaacacucuguaggaaugaaaagauaauaagucuuuguauuuugucagucuucaagauuucuagacaaaugggagcuguuuuuaguuaaauacaaauucccaagcaagacaugacauauuuauagacaauuccuuucuaauuauuauggggauguucuugaaaaaucuuauacuagcagaauuucaaauugaaaaacagaccuuugggaaaaauaggcuuuagagauacuguagccccacaaaagcccuuacuaauauuuauauucgcuaaaagaaaguaccauaguaaucauuugcguguucugaauuaguaauucagaaaaguuaguuuccauuuaucauccuuuuauuauuaggaagaguucaguguuuccuucuguagcuuaugagauguuugaaaaaccauuuucgcuuguaguauauaguauguacacaaaggagcauauuaguggcucaguauccaguccauggaaaagcuagaugucuuguuuuuguuacuuggaauuguugauucacaugucuuggggguccacacagucucagacauguugacugauuuggaugaaucaaauggaaaagguuugggguaaacuuauuuaagaagucuuuaauuucuccgcuacuauggaugaaaccacuucaguaacaggguauugguaaaauuagaauucuuccuguagagccuuuauauuaagacaugaagauguuagacagucucuccuggcucuguucccaccacuuagguaggucuuuggaucguagcacuucccacuuuugagucacaggaauacacuuuuaaggucaaguggacuuuaccuagguuuccuuuaacucaggguugcauuuuaaaagucuuaaaacucgcccugccuugcuuuacucuuaucaaucucuagaucccuucuuuuuccaguuacucuaacauaaaaagucucacaauaguggaaaugagaaaccauaaauaaauuuguggguauuagaauuuucacaaaguggaauuaucaucuuagaggauuuauuaaauuuauauauaauaguuuuuguaacucauaaccaaaugccuuuauuuaauguacuugcugaaaauugacaguuuuuuggccaaagcaguauagucaaugucuucauugguuuaguggcuuuuggcagaaaacuauaguauguguuuaauuauuggauuauacuuuacaguucagguuuuuucugucucuuacugucuuuuuuucuguuuuagacuauuugaguuuauuuucauguggagaugguaaauagaaugucaucuuuuuauaggugauagaaaauauuuuuacauuaucuguuacauauauacuuuccaauaguuauuucaagcuguauuuuuuuguauuaaccuuuugcuuugacuugccugauuuaagguaacuauaacuuaaccaauuuuaagagggcuuucugaccucuuuggaucuugguugucuuuuguuaauuuuggaaaaucuuggcuauuaucuuuucagauaauucuuuuuuccuuugcuuucucuauucucccuuugggacaccaauuaaguauauguuagacuguuugauaaugguguuccuuuaugguuucuuuauuuuaaaaaacacaccuucccuuuuuuuucuguuucaguuuggaugacuucuguugaccuaaguucaugaagaauccugucaaagggauucuccaucuuugauaaauucuuauuuuuaauuuuagcauugccauuugacucucuuacaguuuucguaucccugcuaaaauuuccugucuguucuuauguuguccagauccuuuaacauauuaaucuuuuccuuuaccuuuuuuaacauauuuaugaaucauaguuauuuuaacaucucugauuaguuccaacaucuggguaaucucuguuugguucuguuguuugcuuuaucucuugacgauggguuguuuuuuuuuuuuuccuucuuuaaaugugucauacuuuuugaaugauagaagaaccugugucuagaaaugcguauaccuccucugucacacuguugguaugguagguugaguuaguuuugucacugcuugggcugguuauggcucuguuguuacuaccauccccuucagugcaccacagaccuaaauuucucuggcggcaaguugcuguuauuuugugcuuuagauggacugagugguguuccuacuugcuaugguuugaaaauuuguccucuccaaaacuccuguugaaauuuaauugccuuugugagaguacugagaaaugggaccauuaagaggugcuuaggccaugagagcucuacccucauaagugggauuaauguuguuauaaaauauagggcaagcauggcucccuuuugugucucucucuuugcccaucugccauguagugaugcagcaagaaggcugucacuagaugcuggugucuucaucuuggacuucccagccuccagaacagugaggaaauauaaauggauugcugugccuuauaaauuacacugucucagauauucuguuauggcugcacaaagggacuaagacacugcucuguuggcagcuaucagcaacauccuguucuauaguggauucuuuuuuauaugugcuagguuugugauggggguggagaaguucuugguuuuccuggucuacccucagucuuagguagggcucguaagccugagucuugagaguagaaccuuuucggucgucccuucucccccuaaucuuuccccucccauggcagccaaauuuugccuugugacugagguaguacuugggacagagaguuuucuguccuuccccuagcaguaguauacuucugauuaguuuugguaugggaucaugggucaggagggucucuguguccuugaagcauaguaggcuuuuacuucuaucucuccccuaggagcaguggaucuuugccugggccuugugggugggagagguaauuaccugcuucuccuagucuguaauugucucucagacucugacuaauccugauuuuugguauaucucuuuuucuuuuccuuccagguuuuguguucuguucucuuauuuagccacugacuuguauuccccaucuguauuaguucauuuucacacugcuauaaagauacuaccugagacuggguaauuuaugaacaaaagggguuuaacugacucacauuuccaccuggcuugggaggucucaggaaacuuacaaucauggcagaaggcgaaggggaagcaaggcacaucuuacaugguggcaggagagagagagcaagagcaaggaagugccacacuuaaaacuaucggcucucaugagaacucccucacuaucaugagaacagcaugggggaaacuaccccugugggccagucaccucccaucaggauccuccccccacacaugaggauuacaguugggggucagauuuggguggggacacagagccaaaccuuaucaccaucuaacuuuugacguuauuuuaauauuuucuugcugcuuugucuccccugucgugugcucuuuuuguauugcauucagauugacucaucagccuguaaguaggccaguaaacuuuucaauuacuuuugugacucagaaacuuaccuauaauucuaguuaaucuacuugacuauguaguuacuuaauuauguaaucgacaugacagcauagaucuuccauuuuuguauaguuuguaccaaaaaucucuaacgaggauuucaugguuucacuuaguugauuucacaaucuaaugguugugaaacuguuaaucuuuuuuuuuuuuaccugccuguggugaagaaugcauaguuuuguagaaggauuaugggauugagucaggugaccugggauauuauaccauuucuuuuaucugcuugucuauucaauuacaaaacauuuauugaauaccuuuuuuauucuggguggugagauauuauuacuaugaauucugauagcuuuacacagucauuguguuaaguuuuucauagguucacauuuaauucucccaacaacucuaugagagcaguagguauuauauguaguaauuauuugaggaaaccgaaggacuauguaaguaucaugcccauuaucucauagauaguaaagagaagcaagccuuccacaaacauuaguaauauuccaucucauggauacuucauaauauauguaacuauuccuugucauuagaaacacacuuuaaguuuuagcuuuguaaguaaugauucagccagaguccuaagagguauacuugauuguucugggcccucaucgcccacauucugaccuccugccaguaaauacuauggguucuagccaccacauuaugucuugaguuucucugcuuuuuucuauuuucauugccaucacucuggucugggcuaccauucccucuuacugggauuccugcaguaccuuccuaacuucuuguuaucauucuuuaccuucugcagucuaaucucagaaguacacauaagauaauuuucuccccccgcuuuagaggcuuauguaauuaugauagaauagaaaccuuuuaugcuggccugcaaauugcugcaugaucuggccccugucuaccuuuguagcuucaucuguuuuuaccauuuccaucuacccagcuuccuuucugcugcuggaguaugugaaacucuuucucuguuucugggcccuggcgcuugagguuucccacaucuugauuguuccuucucaucuuuuugcaugucuggaugcaguauauuuuugguuuuguauuuuuucaggacuuuuuuuggugacuuccuauaggagcaggcucugucuuugcugucccugauaaacauacacgguauuuuguuaauuuccuuuauaauacuuacaaccagaaauuacauuuuaauaugcuuauuaacuuguuaucuguacuuauccacagaaauauaagcuguaaaaggauugggcccuuguacucauguaguaucuagauaguacacagugucucauagguaacuacauaaaacuuuuuggaugaaugccuugguucauaccuuuugugcauaaaccuucauauauauaaauauauauguaaauauauauauaaauauauauguaaauauauauauaaauauauauguaaauauauauguaaauauauauauauguauauauauaucuaauuuucuuuuucccgaggauagacagccaaauuagaauuaagcuagaggaaauauuuaaugcauuuuaaaccagauacgguaacuuaaaauguuuuagaagugauuuuuuucaaagaucuuagaauucuuaaaauugguacuuuguuauuuuuauuuuauucuucucuuguauacauagguucucuuauuuugaacuuggaaaauauaugcaaguguagacaagagaauaaaacaaauuuuacucuucagaaagaaccauuuugguauuguucuuuucuauauguauauguaguauuauuuuauguaguugugcuauguucugaauauaugugucuccucaaaauuuauauguugaaaccuaaaccucaaggugauggugguacuaagaguuauagcguuugggaagugacuaggucauaaggacaaaacccuuaugaaugggauuagugcccuuauaaaagaggccagacgggggcugggcgcgguagcucaugcugguaaucgcaguucuuugggaggccuaggcagguggaucaucugaggucaggaguuugagaccagccuggccaauauggugacaccccgucuuuacuaaaaauacaaaaauuagcccggugugguggugcaugucuguagucccagcuacuugggaggcugaggcagaauaauggcuugaacucuggaggcagagguugcagugagcugagauugcacugcugcacucuagccugggcaacacagugagacuccaucucaaaaaaaaaaaaaaagccacuuuugccuuucccuucugucauguaaggauauagcaacaaggugccaccuguaaagcaagagagcccucaccagacacugaaucugcuggugccuuuaucuuggacuucccagccuuuagaccuguaagcaaaaaaauuucuguucuuucuaaauuacccaguauaaaguauuuuguuauagcaaccugaguggacuaagacaaguugcaauccuuuuagauggaauuuugcaucuuuuaaaaauccaacguauccugagcuuuuucuuaacuauugaauggaagauauaaauuauuuccucauuguuggguagauucucauuguuggauaguuuucaguuuuucuuuaaaaaauauuguuguagacauuuauuugccuaaaucuuuucuccacuguggauuuuaagggcagcuuccuagaagcauacuauuaaguuaaaagauauguauauuuuacgguuuaaaaaauaucuauuuguauguauuuacugacagauugcuuucuggaaggauuguguuuuugagugcccaauaguguuuuuauugaaacagaaucuuugguauuuucagugaaaugucauguuuuuauuucuuugauuauuuagaguaugauugguuucccuuuucuguguuguuaaauacacugucccuuguaacuggggguugagauugcuccagcaaaagauguguuaaacuaaugagaagaugaagacugauucuuuucugacauucucuuauggugauucuuguaaaaaugugcuaucaugaaaaggguugagcuuucuauuaauaauaaguuaauugugguuucauuuuuuccaguuuuguaaaguuucaguuguugcuaauuuuuuuucccccaauuguaauucuacuccugaucuuagccaaaaggccaagaagcaaugcccccuuguaauucugguuuuaucuagaaaccuaguuucuuaaauuucuuucuuucuuucuuuuuuuuuguuuuuguuuuuugagacagggucuggcucugucacucaggcuggagugcaguggugccauuguagcucacugcaaccucugccucccaggcucaagugauccuccugccucagucucccuaguagcuggaggugaauucaggcaugugccaccauacccagcuaauuuuuguauuuuuuguagggacaggaucucccuauauugcccagguuggucuugaacucccaggcucaagcaguccuucugccuugaccucccaaagugcugguauuacaugagccacgguaccuggcccauuagucucuucuuauggcuucaacuacuauauguaaauccaggugcuaucugugugucuuuucuuguuuccuuuucuuucuuuuuuuuuuuuuauugagauggaaucucccucugucacccaggcuggagugcaguggcgcgaucucagcucacugcaaccuccgcugccuggguucaagugauucucaugccucagccucccgaguagcugggacuacaggcaugcgccaccauaccuggcuaauuuuuuuuuuuuuuuuguauuuuuaguagagacgggguuucaccauauuggccaggcuugucucgaacuccugaccuccggugauccgcccaccuuggccucccaaagugcugggauuacaggcaugagccacuguacccggccuugugugucuuuucugccauggggacugaugaucagagaagccugcccugaagcaugagaaagaggggaggguugggagggaaacagugugugaaauagaggaauaaacuaggcuuuauaaauaaacuugcauguaaaugguauauuauuugcuaacucagaaucucuuugccucaauuucuccuuggguuaaaaauaaagagauaaucacuaucuuucaaggucaugguaaggauuaaauuggaaacauauguaugcacauauauaccugucuuauauuguauauaauuugguguucagugaauuagguauuuuuuucccuuggaaaacagagggauuggcacaaugucuuggaauuacuguauuauagaaacacaggaaugagguauauuaguauaugcugggacauugccugaggugccgaaaguguauaauaaguuacauuauggugggcaaagcaguuuaacagauccauucuuuguaacacagcugcaguaaaaauagaauuguauaauuaaaauaagauaugaaaagacucuuugaagguuaauuuaaaaaugaaaauuuacugcuguguuuauuaaucucuuugaaggagacuuaaugcuguaucaaauguuccuuuuguaauugacagaaacaaagcaccauguacaguguuagaguguguagcugugcugagugagccauguaaaucugcaagguuauguauuuugguaugauggugauagcuuauuuucauauuauauagccaugaaauugauccucagcauuuaucuuagucuuugaaaaguuacugugaacaguaguauuaucagauuguuaccugauuaauacgucacaaauggaugagccucucagcaaaccaaggaaguuaucucaaaugggacugaaauaaugguauuagauaccugaguuccuuauauuucucuggaaaagaaggugcucacuguagaacucacccaaaugcaaguugggcuugagaguuacaggcaaucaucuguauaacgaaccaguuccugcaaacaguccugagccccuucgaugugggagacugugugugccugguuaggaaggugaaaaaaaugaaauaacauguguucuccaguaaaagagacuuaggccauuuuagucagggugaacaacauacccacuuaauaggguuguugugagcaauaaagaucaguauaggaaaauguuuaguacaguguuugccacauaauaacucuuagaaagcauuagcuguuacuguauuuuaaaauccuacaguuuccuucuaugaugaugcucugcucgaaaugguuauuuaauucuuaaaccuguuuguaauaaagguuuagaaaagaaccagaauagggcuggagugugacuuacugcuucuacugcaacugcuuuaggaaauuuaaauauaaagaaaacuaacaggaaauugugucguuguauaggcaggguaauguacaagcuauuuuaagaaggggcucuuugcauuucaguguucaucugucaguuggcuguaguagaaacacccuguuuauuuagcaccauugggggauuaaguaucccacaugagugaacagccauuuauugaguacuuacguauaucaggcaacuguucugaaugcuucacaugaaauaacucauuuaguccucacaagcuuaugggguagauccguaucuuauagguaauguaacggagacccagagagguuaaacacgaguucacagaacuggcaagugggugagacagaauucucacaacaagauucacauccuuaaccaguacucuugccucuugaguaauugaaccuugacuccuuugaauuauaaaacuugcuuuauuucaaacauuuuggagucaaauuauuucuaaaacgugugacuuauuucucuacuuucuuaaucagaauguauuggguacaguuaauggguacaauauuaggguuaguacacaugcaaaaacacagauacucuuaaggauuguugauuuguguuccacuguucauguucaaccuuauuuuucaugguuuugaauugcuguaauaucuaguuuuccaaaagcuuuuuacuuaaauacaguauaacaguacaggaaagggcucaaaucaucaguauacagcucauuucaaccauuuuuaacaaagugaauacucacauguuauuagcacccagaucgagaaacauaauguugccuuuacccagaaguccuucauguccucuugaaaucaguaugugccuuugccuaagguuaaccacuguccuuacuuuaauaccauagauuugcuucccuauuuuugaaugugaauaaauggagucaucagcauaugauuguaucagcuuauuuacuggacagcugucauuuuauuuuuugguaucugcuaagacuggaaaauagggguaucaaggcuugaauuguaaaucuugaugguaugaaggauccuccuuuaacuaaagcauguaggauuuuaaugugugauauuugugacauaguuuucauuucugacuauuuuuucagguuuauguuuugccugggugaauucagaauguaacuuucagauauacaaauuguuuaccuugguuaccaggcuauguaguuuauaagagcaguaaaacugaaaauauagcauucagugcuaguuguauuaugagaaugaagccaaauuuagcaccucagguuauauauauauauauauauauauauauauauauauauauauauauauauauauguauaugucuauucauguaaauaugcaguguugauuuauccuaauuacugagacauuccauuauggcuuauugaaaauuacauauaaaccuuauuuuaaaucugauuuuuagauacuugaguuuuaagaagcugaucaccaugcgccaguuccucuuauuugacaaacaaggaaguuguggcuaugugagcucauaauuugagguucaguggaacagaggagaacugugacgggcagaacauuuacuuucauauucucuguaaaaccaaaucagugagaaggaugcaaggagaacuaggacaguauaugaacuuuuuccuucuuaaagcuuuuucuguguaggagcauauucauauaacugagaagauuguuugaaauuuuagcuuaaggcuaauauauuauuucaauauauacucauugaacacuuacagauauuguuguagguauuggagcaaugaagaaaacgaugagcuuaauuucacugaggauaagacaguuaacaaguagacaaauauuuaucaggagaugauaaaugcaaugaaggaaaauaaaauaggugagaagguagagaauguuagggaaaguauauguguguuugcuguuauuuaagguggucagggaaaucuucauaguugacauuugacaagagagaagggagagacagagggaugagacccuucagguggagagaauggcaugugcaugggcccugauggauaccauuguuggauuuuuggagaaacuuccaggagaccacagggcugguguagaguaagcaauggagagaguaauagauagaucagagagguugucugggcuagaauguacagucuuguagacaucaucuacaagaugugaggacauugucauuguaugucauguacucugagauggggagcuacugcaggguuuuugagaagugugacaugauuugauuuauguuuggaaaugaucacuucagcucuuucacugaaaugacacucuagaaggucuagucuuagagcagggagaccaauuaguaggcuuuuguccggggagagaaagugcuagagcucccuuguuagcuauggaggugguaauaggugguauagguggagcuauauguggaugcuaaauacagugaaagcccuucuguucuguuguccugaaaaucaaguucauuguuauaugaacuuuauugugaaguaaagacauaaaagcuuaugccuuuauaggauauaauuuaaagagcuaggaaauuggaacaacccguaguguucaacugcugaauguuacaagauacaauaagcaccaaaccaaauaauuaaacuuuuuuuuuuuuuuuuuuuuuuuugccucuugccuuguccgugaucccuuuaaaacuuagaauuuauuugagcuuuuuuucuuuacuguuuuguuugauguugcuuucauuuucuacuuggguuaagauguaucuugcuaauaaucuaagaucacaccgugcuguuacagaauuacagacuuugauugaacucaaggaaguggacaaagccuaaagcucaaacugucugcuaauuacaggaacuucuccgguguaucccuuauagacugucauucauuagcuccucagauacuuugggugguugggaacuuauugcuccugaacaacuuuuccauuaguaggcaguucugguuugugagaaguucuuuguugcauuaaacuaaaaucuuucaguacuuucuuuggguucuagauguauccuuugaagcaaagaguggcuauuuuuucucuuaauguuuuaaaagacccuguauuaggguucuguacagaaauagaaccagaaggaaugaauguauauguucauuauuacaaauuaauaauauaauuuuauauagugcauaucuguaauuauauuaccaauuauuuaguugcacuuaaaauacucaaagauguaacuuaaaauaauuaauuguuuuauacauguaucuacauaucuacauagauagacauagguaaaacauagagacuuauuucaaggaauuggcugagguaauugaaaagauccaaauccaaauccaaaauccauaggauaggcuggcagauuggaaacucuugggcaggcgaugaugcugcagucguggggcagaauauuucuuucucagaaaaggcuuuccugcugauuggaucaggcccacccacauuuccaagaauaauuuccuuugcuuaaagucaacugauuguagauguuaacuguguuuacaaaauaccaucacaguagcacccagguuaguguuugauugaauaacuggauacuauaguuuagacaaguugauacauaaaacugucauaguccauccuugucaacuuggcgcccauacacaucuucuuaaaugauacuuaaucuccaaaugaacgcaauaacaaagucauacuucugccuaacauaauaugaauauccuucaaacaacugaaaacaugccaacccuuuccccagaagaggaugcggagucccuggguaauguucauucucccuaauaagcuauaacuuaaauaucaugauguaaaguuagcuauuauuaauauaucuuaugucagaugauaaagggauuaaagagcaagaaaacaaagauauuugcuaaauauuugaauacauucguuacaaaauaagacauaacaguuacaguuuucuguggcuggucacauggucguagcugguuuuuguuuaugauuaccuucuugcacuauccauuccauuuuucccuuucccuuagcaagcaccuuagcucuuugugguucuuugccuguuggggugauccaaaacuuuguuccugaagggucugggcauacccaauuuaaguaguccuuaaauuggguuauuguaguuuuccauugacuuuaaucacagagcauggcaguaauuacaagaucucuuguauuccggacuuagucuuuuaaucacagagcgugaaaguaauuacaagaucucucguauucuggacuuagucuuucauaccuccauuguaugguagcaguugaauuucuucuuaguaaccagcaacccuggucaguacacuaacccugggucuucuuugccuguucauucugaggcaugaggaguucaaaguggccaggugguagucuuaaugucgguucaguggaaucauucuaucucccaguggaaacaguccucuuuuuggaaauaaggccucuagaccagcagaggauaagguuaaagaauaggcaacaaaaauuucgcuagugaaacaauagggauaauagugaguggccccacucuuauuucucucucuggauucugggauccaugaauccuggccaugggagaaauagcaccauacauuggaugcugauuuagagcauacauagccucauggaaaacauugcacaaguuuuugucaccuugcugacaacguaacugagucuucaaaaauccauucuaccauucuauuaagccagcugcuucaggaugaugaggaacaugguaagaccagugaauuuuauuaguauggguccacuguuacacuucaugugcuguaaaguguguuccuugaucagaagcaaugcugugugaagcaccuagaugguggauaaggcauucuguggguuuggcagaaugcuugcaugcagggaagagaaauccauaucuagaguaucuguuguaauaagaacaaaacagugccccauucaugauggcagugguccaauauaaucagccuuucaugagauaguuggcugaucacucuggggaacggugccauaucagggacucauuauugguuucuguaacuggcagauugggccucauuagcaccuguagccaggucggccuugguacauagaaguucauguugcugagccaccuuccuccuuccuauggccucuucguucaugacagaaguggcuagggaaaaaagcuggcugggaucugcagaaugaguuauucuaucuacuugauuauuaaaauccugcucugcugaggucaccuuuuggucagcauucacgugggacacagauuccuucacauuuuuugcccaaagaggucuaucuacauuauuucuccagauccucuuguuaccauuuucccaauuauguccuuccaauucugugaccaucuagcuaaacaguaggccacauccuaugaauugguguacacgguggcaccucuggccauuucuucuuccaagcaaaaugagagccaagugugcugcccaaaguucuguccacaggagaguuuuccuucauuacuaucccugucccagaaaggcaguuagugcuacagccaucugcuuugugaugguuugugcauauuguccacagucaucuguaaacuaggcccacuuuuuuuucuucggucaacugauaguaggaaacuuccccugaggucauaggugugggcugggagagagaagggaaugugguaggaauggggaccgugggcauuuguacaacuucuucauauaacuuacuugaaccuucagggccugcuugaucuugaucugucauauuccauuuucauucagugauggaguacugccaugcaugccccacuuuaugaaucguggggccagauagcacccaguucauaaugggcagcucaggucucauggcaacuccuuggcacauuguucagcauuuagucucuaauaaggccccguagcaagccaaaaucuguuucucaaaaggagaguacucgguggcucacgccuguaaucccagcacuuugggaggccgaggcggguggaucacgaggucaggagaucgagaccaucccagcuaaaacguugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaggagaguacuuuuccagagaggauggcagagcuuugcucuaagauccuaagggucuucacucugauuaaccuauaugagccugucaguagaggcuucacacagaagcucuaucugccucugaaacuugaagcacuauuggaucuacuggaucacaugucccaaguggcacagcagcuuacaauggcagccuagucuguugcaaagccuuuucuuguucugggccacauucagaacuaauagcuuuauaguucaguuugugugauggauaauuuuuugugugugucaacuuggcuggucugugguguccaguuguuuggucaaacacuagucuagauguugcaugaaaguaauuuguagauaugauuaguaucuguaaguaguuaugcugagagauugcccuugaugauaugagugggccuuauccaaucaguugaaggccuuaggagcagaaacugagguuuccugaaaaagaaguauuucugccuuaagacuguaaccuagacauuuugcuugaguuucuagcuugcuagcuugcucuugugacagaauuuggacucaaguaaaacauaaacucuugccugcacuacagauuucagacuugucagccuguauaaucuugugaacuaguuccuuaaaauaaaucucuauauuuauacacauauauguguguuugugcauguauauauacauauaaagauauguguauacauacauacacacacacacacacacacacacacacacacacacacacccccuuuugguuauugguucuguuuuucuagaaaacccugacugauacacucaguaaaugggcuagaguagcacacccaaauaaggaauauguugccuuccaaauacaaagaggccuacuagacauucugucugucuugauuuuaggagggacuagcuaaaacaacuuuuacuucacauuagaagggauaugucaacauguaccacaucacuagacccuuagaaauuucaccgagguggaaggcuccuugucuguucaggugauguggguuggcucugugucucuacccaagucucaucuugcggcucccauaauuccuauguguugugcgagggacccagugggagaugauugaaucuugggugugggucuuucccaugcuguucucaugauagugaaugggucuugugagaucugaugguuuuaaaaugggaguuucucugcacaagcucugucugccgcuaucuguguaagaugugacuugcuccuccuuaccuucugccauaauugugaggccuccccagccaugcagaacuguaaguccaguaaaccucuuucuuuuguaaauugcccagucuuggguauaucuuuaucagcagcgugaaaaugaacgaauacaucaggcuuuaagaaauuaccaaagacugcguggcuuaaacaucaaacauuuauuucucacagcucuggaggcugagaaauccaagaucaaggugcuggcagauccagugucuagugagggcacucuucuguuuugcggccaucuuuuuguaucuucaugugguggacagcagagagagcgagugagcuccuguuucauaagagcacuaauccuauucaagacggcgccacccucaugacugacagaccucccaaaggucucaauuccuauuauuacuuugggaguuaggauuuuaacauaugaauuuuuuuggggggggacgcauauauucaguccaugacaccccuggauuuuugucuuacucauuucuuaccuucugacaugcauauguuuuaccaauaagcuuagaguaauugcaguuucuugcucacuagguccaauuagcauaaggucaugaauauaauggguuguuguggugucuuguggaagggaaaguugaucaaggucucuggauuaaauuaugacguagggcuggaaaguugauauaacccugagguaagagugaaaguguauugccuuucaaucuugcuagcuaaaaacaaacuacuucuggcaguuuuuauuaacacacguugaggaaaaaaagcauuuuucagauccauauuugcaaaccaguuaccaggguauguguuaguuugcucaagcagugaaaccacaucugguacagcaauuagaauuggaguuaccuaguuaaguuuauaauaaugcacugucauucuccaaaauucaucuguuuucugcaugagguaaacagguaaguugaauggggauguguuagaaucacuaccccugcauccuucagguccuugauaguggcacuaauguaugcaguuuuagagugaaacauauuuggagugacauauaaaauacacagaagaacauuaaauguuuauguagucuaaugaauaauaaagggaaccauuaaaccaccuucaggucaugaaauagaacuucaucaacaccccuagaaguucccccuccccauagucccucuucuuaaucacaaccucuccuacugccagaguugucauuauuucugucaugauacuuuccuuucuuuuuacuuuuuacaauuuguguauguuuaccuagauaauauuauuuaguuuugucuuuuuuggacuguauauuaauaaaaucauuguaugugcuuuuugccugucuugcuuuugcucaaaaaagugugagauuuguccauuuuguucuguguagcugcauucauucauuuuuauugcuguauuccaauuuugaauacacuguaguuuauccacuuuucuuaugaagcuuuuguuucuaguuuugaccuuuuaugaacaguacuucugugacuauuucuuuauugcacauuuuuugagugaguuuuucaaggguguguaaccaaggagguugcuggguuaggugauaucagcuuuccuuaguaaugccaaauuauuugccaaagcggauguaucaguuuacuuucccagugucacgaacauugguauuaaacauucauuuuuuuuuugaaguugagcaucauuucauauuacuaguuaucuagauuuccucuuuuggagauugucuauuuaagucuucuguucauuuuuuuauugaguuggaguguuuuuuucuuacagauaauuauuuuuugagacagagucuuguugugucgcccaggcuagagugcaguggcgugaucucagcucacugcaaccucugccucccggguucaagcgauucuccuuccucagcuucccaaguagcugggauuacaggugcccgccacugcgccaggcuaauuuuuauauuuucaguaaaaaugggguuucaccaucuuggccagacugggcuggaacuccugacuucgugauccacccgccucggccucccaaagugcugggauuacaggcgugagccacugcaccuggccuaauucuuuauauuucuguuauauuugaucacaauugcaauaucucuuccgaauuuuugccuugucuuuuuauauacuuauguguguauauauauauaugguguauuaauaaacagaaguucuuaaugagaguacugccaaauuaacuggauuuucccuuuauaguuaaagcuuuuugugucuuacugaaguaauccuuuucuauucugucuuuuauugucuuuaguuuaacuuaguuuguauuucaaauucagguuuuuauucacugagaauugauuuuguguuuuuugagaaucaggucugauuuccauuuuuuuccuuccguguggauguucagccaauugcagcaccauuuuuuuuuuuuuaacaaguuugaauuuuccccacuaaucuguggugcuaguugugucguauagcaagugucuguaugugugugagucuguucugggcucuuuauuuuuucacugaucuauuuuucuguugcuuugacaauacucacaguguuuuuaagucacugucaucuuauaugucuuaauauuugguauagcaaguuuuauuuguucuuuuucaagacugggcuauucuuugcccuuugcauauucauauaaacuuugcaauuagcuugugaagcugcauggaaaaaaaccuauuggaacugcacugguucuauuaaauugauuuggaggcaguugacauacuuauaacauucagucauccagucuaaaaauuugauaauuauuucuggccgggugcgguggcucacaucuguaaugccagcacuuuggaaggccaagguggguggaucaccugaggccaggaauuugagaccagccuggccaacauggugaaacuucgucucuacuaaaaauacaaaaauuagcugggcaugauggcgcacgccugaaaucucagcuauccaggagggugaguuaggagaauugcuugaacuugggaggcagagguugcagugagcugagauugcgccacugcacuccagccuaggcgacagagugagacugucuccaaaauaaauuaauaaauacauaaauaaguauuugauaauuauuucuauuuaagucuguuuuaguggcucucauaaaauuuuauaguuuuucccuagaggucuugcagcuuguuguauuuauuccuagguacuguauuuauucuuagguacucuuugauucaaaacauaaacguuuuuauuuucaaaaugguuuugccaguucccaauguuuaaaauaacaaauaccaucauggauccauacguuuugaguuuuuuugcauguuaggaagcaugaacuugcaaauauuuuucuccuuuuccuaacuuuuuuuaguauggcuagagaaaggcaagauuuugaccuuaaguugcgaugagaaauggaagaaacuuuuuuuuauguuuuugaauuuguccauaacccaguuucaucaguuuuaagucuccaucuugcacugucauuuaugagagcaaacuagaguugcagucccaaaccauggaacuucuuuguguaguuuguucucaugaaacauucagccagaacaggagggccuaaguuucagacaaauuuuaaauuaguuuggaaaaguaaguggaucuauuuuuggcuuaucuacuaccucaaagucauucucuuuguaaggguguuugaagaguaauaaucaaacucaguguguuaguuuucuacugcugcauaaugaauuaccauacacucagcaccucaaaacaucauaugcuuguuauuuaagaguuucuguuggugaugagucugggcaugguuuaccucaauucucagauucucacaaggcugaaaucgagguguugguugggccauguccucaucuggagcauggaguccucuuccaggcuuauucugguuguugagguaauugaguuccuuguuguaguacugaggucuucaauugcuugauuugaccacuuguugcuccuaggaauagccuguuguugccugauacaugacuccacaacaugguaguuugcgccuuccaggccagcaggugaaucucuuucacacuuuucaucucuuugacugcuuuuaagagcucauuagauaaggucaugcccaccugggauaaauuuccuuuugaagugaagucaauugauuagggcucugaauuacauuuguaaaauccuuucugccauguaauguaucauaaucacaguagugauaaucccaucauauucacaaguccuaaauuauacaggguguaucaacaggggacaggaaucuugggaacaauuuagaauucugucuuccacacucucauccauacaugaaaauuucguaucuucauaugagaugaugccuugacucuucuugccugaauuuuuuuaaaaaacgcuuuuauuuugaacuaaguguauucucacaagcaguuuuauguguacauuguaauauugaaucuuccaauuuuaaaauuggaaguuuuccccagaugugacaucuuacauaaauauaguacauuaucaaaaccggggaaaacugauaguagcauaauacaauuaaguaaacuacagacuucaacuucaccaguuuuugcaggcauugguauuucuuuguguauaauucuuuguacagauucauauaaccaucacauuucaagacacaggacugcucugucaucacaaaggaauucccucaugcuuccccuucauagucaaacccuauuccuaaauccuguuuuccacuuuuauacuuuugccauaucgagaauguuguguuaauggaauccuagauuaugaaauguucugaugguggcccuuuucauucagcauaauacucuuaagauccauucaaauuguugagaguaucaauuguuuguuccuuuuuauugaugaguaaauauuucauuguauggagguaccucaguuuguuuaaccauucacccauggaaguccauuugaguuguuuucacuaugggccuauuuacaaauaaaaugcuuauaaacauucauguccaggagugauguuuaacuuuuuaagaaacuaccagacugaucuccagaguggcaguaucauuuuacauucccaacagcaaaguaugagagagagaguuucucugcauccucaccagcauuugguacuuucuguauguuuuacuuuaguuguaauaggccuauggugcuaucuccuuggggucauaauuugaauuucccuaauggccagcaguguuaaacaucuuuucauauuuuaucugucaucucuguauccucuuuuuucaugucuuucacugcuuuucuaauuggaauuugauuggauuuuacuguggacauuuucagguaaauacaaaagacacaguaguguaauaaauuucuauuaucaagcuucaagaguuaugacguuuuugcucuuuuguuucuuuugaguauuucaaagaaaaucagauauauaaauaucaugacauuucacuuguaaauaccucacuaugcauugcuguccuuuauuaggacauuugaaaacuguaaccacaaggauagcaucauauuuaauuuaaaaauaauuccuuaauaucaucuaauacuuaguccauauuuacauuuucucucucaaauauguauuuuauuuauuuuuugagacagggucuugcucuguuacuuaggcuggagugcagaggugugaacauggcucacuguagccuugaccuucuggggucaagggaucuuucugccucagccucccaaauagcugggaccacaggugcaccaccaugccugacuaauuuuuauagaaauuuuuguagagacgagguuugccuguguugcccaagcuggucuugaauucuugggcuaaagcugucugcccaccuuggcuucccaaagugcugggauuauagacauuagucacugugcuuggucccaaacauguauuuuaaaaaaugguugauggaaaugagaauucacauaagauugauugcauuuaguuauguucacuuuucagacagcacuucuuuuuuccucaggcaauugauuugucuucuggacuaauuuggauuuggcugauuccuuccuuauuuugucauuuaacuuguucuaucucauuuccucuaaacugauaguaagauuuagcagcuugguuagauuuggucuuaaguuuuuagacaagaauaccucguagaaguacuguguacuucuuguuauauuacaucaggagucacaucauguuugguuuucccacuuuuugaauuacuagguuugaucaguggguucagguauugucaacuccauuccuccauuuaaaaaguuuucauuuauccuucauguaguggcugugguuuuccauuagucuuucaucuaaucaucacuauugaugauuguugccuagauccaauauauugguguugcaaaauagugauuuucugauuuauucugcauuuaguagcuggacugucaagaacuuugaucaguauuuugguuuucaugaaauacaguugauaaaaggcaggagaaaugcucauuuuuuucacccuuauguaucaauuuuuagauuaauaaguugauauccuugcaaucuacagaagacaccaaugggauauuuuuccuuucauuucuuuauguaucauuuugaauuuguaaauuuuuaaaaaggcauuuuaugcauuuugaugacauuaaaaaauucauuuucugucugcaggcauuuagaaauacaauuaauuuuuacacauuuaaaaaaauuuagcaaucuuucuaaauucuuguuaauuuuauuucuagauuauuccucugcaaaugacaguuuuuuuuuuaaucccaagucuuuauaccuuggauuucuuuuuuuuccuuacuguagaauagaaccuuaguaaauguuugaauagaaaugaagauaauacaacccuucucuuguuccucacuaauggcuguauuuugcuauagauuauuuaucaagauuaagguauucccuuauauuucuauacauuuuaucaagcauuaauguuuaauuuuaugggcuacuguuuuacgucuauucccaugauuacaugaguuuucuaccuuuaaccuguuaaugugaauuauguuaaauuauuuucuaauguuaaaccaaucuucugucccuggaaugaucucaacugucaugauguauuauuauccuuuuugugguuaaauuuaauuuacaaauauuuuuagagcuuuacauuuauguucaugaaugaggcuggcuuuauaauuuucgugucuaguacuguucuguugguuuugguauaaguguuucacuaccuuuuuaaguaaguuucuucuuucaaaucucuggaagaguuugagaguggaauucuucuuuccuugauuuuuguuagaacucacuaaugaaacaaucaagguuuagaaguuucuuugugggagaaauuccuagauaguuuaguuuuuaguucuuugaagaauauaggguaaaaguaucuuucuuugaugacagagcugauaauuauaagugaaaaauucagucacugaugaauacuuuuuccugaguaguuugaauugaucuguuuugugucuauuuuuugagguacaugcuacauacauuuugucuguaaacaacuauuuagcauauugaauaaaauuacauuuuaaaaauagacuuuguacuauauaucacuuuaauacaauuguuuagauuuguguuuuaagcuuuucacacuuguaaaauuucugaauaaugaauuuuuaaggaaucuuugaagggcuuuugagcuagguucuacuucuggcucugccaauuacugucuugagugugucucuuauuuucugggccucacauuuugcauuuguaaaacaaguaucuaucuauuucauauaguuuucaugaggauaaaccgagaagucuuuuauuaaccauaaacggaaaguuuugaaauuagggaauguaggcaaaauguucaaagagagggaguagaaggagccuuugaaaucugugugagucccuccaguuuauaggaaauagaagccacagaagcuagagaaacgcccaagguuaucucuaaguagcuaguguacagaacugaccuugcaacccagucuuccugcuuuccaaagcagugggcuuuuucaguuuugccuuucuucaaaugaaauacuagguaauugagagaagcuuugacuuuagcagguacauaguugaguguauuauccccaagaguuaaguagaaaaguguacaugacauuagggggaaagaggaauuuuaagacuuuaguuucuuaaguuacuaauaauuaaaacugcugucaaaguaauuauugaauuuuuuucccgcucagaaucuagacaaagagagccuuguuacacuuuucagggauuaaaauuaaucuaauacaguaagaaguaaagucuugugugguuacugcauggcuuuguacuagaaauucaguugaaauuuuacuuuaaaaacuauuacuucaguauaauuuuaguaaaaucuuaauuuauaauuggcaugaaacuuccaagcuaauuguuagaaauaguuucuuggaauccaguuuuucuacuuaauuccuuauuuucuccagguguacucuggaaaauuaauauugucuuuaaauucuugaagucgauacuacaaauggaaggguuuaucauuaucucaguauugaaggcucaauauauugcacaguguuuguagugucuuauccccuggaaggggacuucauuccucucugucacugcuguagcuuacugaagccaagagcaggaaaaggaaaucccagacugcagaccccucuucccuccagcauugucuuuucuccccacacccuucaaaaggcacagcacauauuucaguugcugauccuugucccuuggucugugucugaucucauuuaagaauuuccucuuuccuucccuucuugcguuuccucuccaggguguuugcugccugagagauggggagacaccuaggacaugcuacaaggaggggcccaaguuugcagaggcaguuuuaaaaucucaagcgugcuuguccguguagcuuuguagaaaauauguuuugcacauuuucaguaaguuuuaaaaauuuuuacuuagguaauuuucaacacacuuguaguuuuuuuuggagguaacaccaucaaaugcuaaauuugucaaguguuuugaauaaaaaauuucuaggaacugagguuauguucuuucuguuuaaauacuaauuucuaugaggauucaauaaacauauuaaauucauuauacuuuuauugacuuaaagcugaagggaagauuuaaugcuguuuuagcuguuuuauaggcuugugacuuuuuuccuuggaaaaucagaacauuuucuuuuaaaaacauuuauuacauauccucauugcaaagguauaacuugcgucugccacagagaagaguuuguccuuuaaauaaauuuuccuuuuugggccuuauagauguuguuagcgauauuaaaucugugguuuucuagaacuauuuauuauucuuucuuuauuuuuaaaauuuauucacaggaacccaugagggugaauauuuuaugcuaauuuugugguggaggaagcuaagauccaaagauguuaagaaguuugccgaagauuacaucuuuaauaaauaguggaauugcgauuugagcuuaggucugacuccagacuugguggucuuugugaaauucuucuuaucccuuugagagacugauuauuuggaggaggauauggguugauagguaaacaguuacuugcaacuauaauaguuaugcauaaaauguuauuaagagugcagaguaggaagcaucuaacuguuaggaaggucaggauggcuuuauagagugaaucaauggcgaagugauucuucagggaucacagugugccuguauuucaugcuguggagguuggucuucauucuuuuugggggaaugggaggcacugaaggguuucaacagaaguggugaugugaccagauucauauucugaagagauaugguagcuguaaaggggaauacaauguagcgugguggugcuagagauagggagaccauuacaggaacacuucgggagaagggaugagguuguuucuuagggaagugguagagagugggagaggagggaacuggcuuugaacuuuuaauaauuagaaaauaugcagaugucguucucacuuauuuucucacgcugucagaaauaguaagagccaaauguuuguguuuagaagauuguccuagucuugugauuaccuucaaauuacugaucugcaaagaacuuuaauccuaaguguuaagaguauagcuacauuuaggagagaaaucacgucuuucuugacaaagccgugucuccagauggaagccaaauuuaugccuggauuaugguaauaauggaauaagacuuuucaguauaggaccuacacaguaacagcaguucaggaagcaaagcuaauauuacuuugaaaugaucagcacuguuuuaugaaugacuucuuucauuuuagaucauucaaaaucauuucuuagaaauuucugauuugaguucugcaggcaggaagaaugcgguaauugucagucuuuugacaguguguccuccaaggcccauuucuauccauuugaugccacacugcaucuuguccuuuccucauguccugagccggaggggaacuauugcagaguuccagucuacuaugugguagguggaguuuucuuggauuguccguaagaacacucuuccuguuguuuauggggccaaaaauaaaaguuugugauaguauguguuuaguuuuuaguaucuaaucauucauaaauuuaguuuaacuaccuagauuugucuuucucuaauauuacaaaauacaaagggaaaugguagccgucuuugugcuugauaaugaauaaggucuuuuccugcucggugacaucucuguauuauggagucugcauacuguaguggaacuagugagaguucuacgaaauaguaaaauguuccuuguaaaaaaguuuuuuuuggccuuaccucauuaacacagccuuaguuuagacuuuuauugcuugggauaauaaaauaacuuggcccccuaccucuagucuguugcccuuaaauccauacucugcaacuguaugaauauuuguuacaaaauacaaaucugacauuguccaacaugugucuccuugcaucucuuauugcuaaugaguucuguuaaaugcuuggaguuguaaccagagaggcuccuuggacauuugauuuucgugaagucucacuagcugaacgguuuuguuauacacacgugcauacuuguacuugauuuuugcaaaacauuuuaaugaacuaguuauuucuguuugcuucaaguacucuuuuacuuauuugcuuguuucuuaauggcauuuauugaaguaccugauacugguaaauguuaauugagacaagagcauaaaauuauaaaaagauagaaaagaggauauauaacuuauaauaaauaagaaaauggcacaaaucucuugacagcugucuucauaauacuaaaggcuagcucagcugaggccugcaaagaauacuaagaauaauaaaagacauuuucagauguuagguuuggagaaaaaacaaagaaggcagcagguuauuucugauccuguaaugauaauagaugacaaaaagugucaaauucgauaccacccaucugauucuuuuuuuuguuaggaaaauaauuguuuaauugaaaaugguagagccaaguuauugagagauaauuggaugagaaaggagcuaacuguucucaguggcuaggauuuuuuuuuaaucuuagggucuaaaaacaacuuuuuuuuuauuauacuuuaaguuuuaggguacaugugcauaaugugcagguuaguuacguauguauaccugugccaugcuggugugcugcacccauuaacucgucauuuagcauuagguaucucuccuaaugcuaucccucccccuccccccaccccacaacaguccccagagugugauguuccccuuccuguguccauguguucucauuaauaauucuguuuucaugaucucugagcaaucuuggagacuaggaauggcauguacaggcuggcagguuuuuuguuuguuucuuuguuuuguuuuuuaaacauuuuuucagguauaauugacagacaauaaaugauucauacuuaaaguguacaauuugcuaagugucaauauauguauauacucaugaagccaucaccauagucaguauaaugaacauaauuaucauucccaaaaguuuucucaugcccuuuguuagaggugacugagaaggagcagucaguaaggagaacaaggcuauugugcugucuuggaaauuaaaugaggaagaaaaugaucagcuguggcaaaugcuuacuuauaggcacgauaacaugagaaaugagauuguccauuggauuuaguaauguugagguuauaggugaucuugaccaggccaguuuugguggaguggugagagcagaggccugacuggaguggauuuuaagagagaaagggaggagaaaaauuagagacagccagcgggaauauuuuuaagauuuucugcaaagggaagaaagaaauggagaaguagugaagugggguugagaguguuuugucuuuuuuuuuuuuuuuuuaaaggaugggagcaaaagcccagcauguuuauaugcccguggcaacaauucacugugagaaaaauguaaaggaugaauuaguuccuggagugauacccuugaggggcuaagagauuuaguuuacaaguguagggauugacauauagaaacuuggauaauuuaucugugucagugggcagagauacaguuugaaaguguagacaguggauggugguugaguggguugugggaguuuauggaaguucucuucaaauagcuucaugaaaaauauuuucuuucagugaaguauaggaagcaaagucuucacugugaaaaaagauaggaaggaggcauuggaguugaggaucaagaagauacgaaauagaaugggagagugaauagaccagaaaguuaugguauguuuggcuggcagcauuaaggguucaguugcagucugugguuauuaauuuaaagcaucaugauuagccauauugagauaaaaaguaguugacgaauuagauuuaaccagguuauggcuuugcuagccaaguaugaugaaauaagagaagggcaaggaagucgaggguguuuguaggugggugaugaugaguggccauggguuaagcugugaaaggaagcaagagaggacaucaaagggugagggacaguaaucuaugcaagagguguugguggcuuaguaaagggcagagucugguuaauauuuugaagauagagccagauuuccugaaguuggauggaugugugugggaagaauaaucaagaaagaguguuugaccugagcaguuuuaggaauggaguugcugucaacugaugugcuuaguccuuucuuacagucuuggucguguuuuguugauccuuauaaaaaagagaaaauuuuguagcauaauuaacauagaaaaauauaaaucggcuaaauccauggcuauguauuaaauuucuaugcugauuuauuuauucaguaaauauuuacugagugcuaugugccaagugguguucuggguaggaauauagcacugaacaaaacacauacauuaagaacuugcauuacuuuuaguucacacagagaaaauagcauuuuggaaaauguaugagauaaaagggauuacuguaucuuaaauuauauuguuuuuguauuuaacuguuaauaacugguuuaguuggcuguuuauguguguguguauauguauauauauacauaaaauauauagaccuaaaaauacauauaaggccaguuuuauaucuuuaauccagaaauuuaugaaguuauuuuuugaucauuauuuuuuaaaaauuaagauauuauagaauacugugcagccauaaaaagaacaagaugaugucauuugcagcaacauggauagagcuggaggcuguuacccuaagcgaacuaauacagacacagaaaaccaaauacuguauguucucacuuauaagcgggagcuaaacauugagugcauauggacacaaagaagggaacaacagacacugggucaacuugaggguggagggugggagggaggugaagauugaaaaaccaccuauugggugcuuugccuauuaccuggguauuaugcuaaucuguacaccaaaccccugugacacacaguuuaccuguguaacaaaccugcugauguauccaugaacccaaaauacaaguuuguuuguuuuuuuuuuuuuuuuuugaaaagcuauugcagaguuucagcaauaggugauauaaugauuggacuagugcgaucauaaugaagaugcagugucaucucaaaaaaaauuuaagauauuaauaguauauucuaaaaaauauaaaauguuaguaaauuugagggcuaaugaauuggaauuuauuuuacaguuuguggaccacaugagaauaucuguuuuucuuuccuagcaugugauaccucauuuggacuggaaaugauauucuguagauugauugccugagcaguuuccaaaguuuaaaggcacacugaauguaagaaauuaugcuauuauuaaacacaugcagugaaaccccaucucuacuaaaaauacaaaaaaauuagauaggcaugguggugggcaccuguagucccagcuacucgggagacugaggcaggagaauggcgugaaucugggagguggagcuugcagugagccgagauugcaucacugcacuccagccugggcgauagagugagacuccgucucaaaaaaaaaaaaaaaaagaauaugcagaaaacauugcaugugcuuugguguaauuguuuuggguaauuaaugagucucaggcauuugggauaguggcugaguuguuggaguaagugcggguaucuuccuaaggagaauuuuuugaauaggaagggcaauauuaacuuauaugcauauauuuugauguauuaauuaaauuauuucauuauuuuuaguguuauuuucaguaaaacuugguguugagagagugagucccuaaaucauuaucauggaagaguugaaguaaacacuuagaacuauauaguucuuagaacauauaguuagaacuauaugguauaaaaacauuaugugaaaaaggauagguagaaaggaccauagugaagaaugaaguuagugaucuuagaguuagcugucacuucucucuuaaacuauuaaacagaugcuuugccugauucagcuuuuacgugaaggcuuuuugcaggcuguuaacaaguacugaagucuccauuuucucccucuugcuuuuggaugucuuaaagaggguauuaaaaaaaacuuggaaaauaguuuccuuaacauugagagacacaauuacauuuucugcuuugauguuuuaauuaucaauaaagauuucaguacacuuugcaacugugcauuacuuuagagccuuguguguuggaagcuaaauuaucguacuuuaauauggaaggguuuuguaagacuuccuccuccccaaacaaaacaaaacaaaacaaaacagaggcuuucuauuuuuggagguuuauucaugagaaaagggauugguuggcuguuucuuuccauguuggauaagcaguucccaacuuaaaaauacuuaauuuacaaauaucauugaacaucaagucccuggucuggccucauuucccuugcuauguggcuggcacagcgcacauaugucugauucuccccucuucccuuaugauuguagcauagcuuuguaaaucuguuagcuuggaacaguacacggaaggggaauuacccauuuuuguugcugagaccaaauuggugggacucugcuucucaguuggaaauguuuccacuuagaaacauuaagaacuuucuaagauaauuguucaaaaaaaauccaguaaacacauagcaacacuuacgucucaaaugaacauuuccuuuuugaaaguagugcuuuggagguuauacuucugggaagugauagcuuuaaugaaccugcuuuuagaguuccuguuuuggaauuuacuuucagaauauucucuuuuggguauuuugaaaacuagaaaaccuuuuucuugacagguugugagauauagggaaagauagaguucuuuggauuuggacagacgugggcugaauuucaacaaaacaguuaaccagguguuuaaccuugggcaaauugcuuuuccuaugagaaucuugguuuagucaucaugagaagugguaguaugagacuaacacagcauuugaauuagauaaucaaguaaagcacccagucauuuuguuuguuuguuuguuugcuuguuuugagacagagucuugcugucgcccagccuggagugcaauggugcaaucucagcucacugcaaccuccgccucuuggguucaagcgauucuccagccucaggcucccaaguagcugggauuacaggcacaugcuaccacgcccggcucauuuuuguauuuuuaguagagacagaguuucaccauguuggccaggcuggugucgaacuucugaccucaagugauccacccgucucggccucccaagguguugggauuagaggcgugagccacugcacccggccacagucauuguuuuauauaauacaguaaaugcucuauuuccacuuuauccucucucuuuguauuuuagacuauauuugguuuuggaaucagucaaaagauuuagaacaaagucuaauuuucauucuaaaugaaagacugauauuuuugggccaggcauguuggcucaugccuguaaucccagcacuuugggaaauugaggcaugaggauugcuugagcccaggcauuugaggcugcagugagcuaugauugcgccacugugcuucagccuuggcaacagagugagaccuugucucuuaggaaaauaaaagauauuuuugauaacuguuaagguaacaguaauauaacaaaaagcuagacuuagauuucaggagacuuagcauugaauuccgacugugucguuuauuaacuaauuacuguaggcaccuuacuccucucuguccaugauaguauuuaguuaucuauugaguuacaaauaugugccauacucuguuagguguuuuauacauugauauaucauguaauucuaacaauaaccuugcaagggugcuauuauuuccauucuacaggugaggaaauuaaggcaaaguaguuauaacuuucccgaaguuauauaguaaguggcagggugagaaugaauugaaaguucuuuuuuucucuauggaguauucaaccuuucucaucuguaaaauugugaaacuuacuuuauuuugcaugauuguuguuaaaaguccuuguacugagagagaaguaaaacaacguauugcacuuggaucaaugccuggaacuaacaacaauauucucuuuauuucucuaguguugauauaguuaagauaguauuaaucaucuuuguucacuguagcuuguguuugguuguagcuuuuauugugguaaaauauacguaacauaaaauugaucauuuuaaccguuuuugagcauacaauucaguagcacugcguacaucauaauguugugguuguagcuuggaauuaccauauucugccuuccaaaacaacacaaaauaaauagaaauaagcaaagcucuuccgcugcucugugcucauaacgugguuaaugaaaauguuaguagcaugagcuagggucucaaaagggccagugcugcuuggaauccugguucuuaauuauuuuggucacuuugguuucacuuguauaagucagugagauuuuuaucaucuuuggagagaaguugaaaacugcuucugugauuuuauauauguguguacccaaaucuuuugcuuaagacauuuuucauuaaauuuucaauagcaucccuggaaaccaggagucaagaaauuugcaugcaccuguuaacuuucuuuuucugcaccuagucaacuauuuucuaagauaaugauagaugcuacaauguuauauacagaaacaucauuguuuucuaggaauuuacaguauaaaacaguagagaaaauuagaaagccggcuggucacgguggcucacgcuuauaauuccagcgcuuugggaggccaaggcagguggaucacuuguggucaggaguucaagaccaggcuagccaaacauggugaaaucccgucuuuacuaaaaaaaauaaaaauuaucugagcguguuggcgagcgccuguaauuccaguuacuugggaggcuguggcaggagaauugccugaacuccggaggcagagguuacagugagcugagaucaugccacugcacuccagccugggugauggagugagacugucucaaaaaaacaaaaaaacaaaaaacaaacaaaaagccaaacuaaaauaaaaaaauuagauagcugucagugaauauagagauaaauacagcuguaugaauacaccuacucgcuuauuuagauacacugaaggagcauauugguuaaccaugaauauaaguguagauacuuuuuggauagaggaguauguuaguaaaugaauugcauauuaauaagacaguugcugagguagaggcauuaccuucugguucccaccuauagagaggcucugagaucagcaggaauuuaaguugcuugguggugguguggugggguacagguggggaaauauguaggagugaaauaaucagaauaugguaacuuuuuaaaugucucuggaaggugggaagggaccuaaggaauugaguuuguaugauagucuguuuaaagcauuugaggucgggugcaguggcucacgccuguaaucccagcacuuugagaggcugaggcgggcagaucaccugaggucaggaguucgagaccagccuggccaacaugcugaauccccaucucuacuaaaaauacaaaaaugagccaggcgugguggugggcgccuguagucccagcuacucaggaggcugaggcaggagaaucgcuugaacccaggagguguagguugcaaugagcugggaucaugccacugcacucuagccugggcgacagugugucucaaaaaauaaauaaauaaauaaauaaauaaaaugaaaugaaauaaaauaaaaaaaaugaaauaaaacauuugaaagguauagaugaaguuagcaaucauuuaggggaacuuuuagcuaacaaucagggaaacuacuuuguuuuugcuaggguccagguaaauuagcagguacuucuuaugcaaagugagugauuacagagauucagaguucuaagaggcagucaucagucagaaggaguuuucaccaaagguccuguauuuucuguuuagaauaguacuuaagccauaauuagagaacaucugcagugguuucucagcccucuguugguaaagucugucuccuuuaauuguugaacuuuugaaaagucugaauagauaaucagagauuaucuagagucuucuuccugcauuuuuauagcauuccugguauagcauuugguauaucuaguccaguuacaacuuucccuuucuuauuugcuguucuagcauguaauauaugcucucaauaaauauuaguauuuuuugaaugccuaucaucauguaacagguaacauguauaaaaggcugaaacucauuuuucucuaaaaaauaugcagcagcuuuuauuauuuaugcauuacucuuuuuggagaaauagccauuaauccuguuaugugcuagguguuuguaguaugcuagauacuggaaauauaagggaauacuaggaauaugaaaaagacuuugcccuagagaggguaucagaagagaaggaagacauuauucacuuuccuuuugaguuugaaucaggucuuugauauauugaaaaaugacaccugaaaauuuucucgagaauuuacucugaaaauacucacguugaauauuugaaguauugaaguauuugauucgguaaaugcuugagcgauuaguggaaguacuaaauacaaacaauacuuauuuaaaaaguucucucagugguaguaaugaagaaaauccuaaucaugagauucacuaaauaguugccagcgugguaagccaaguucucggcggcauaugcuguuaaacacuguuagugggcugcaguccuuaguuugugauugagucaccuggcuccccuucuuaguuguucuuuucugcaugaaauuugcugacuuaaauaauauuauaggagggaaccuagcucuaaagacuucacuuacuuuuuucagcuucauuucuuucuuaagcucuuaauuucauaaguuucugaacuguauuccccacauauaucaauugacuaggaugacaaaguauagaauaugccauauuuauuccucuagugaaggcaaagggaauagcauuugaugcauuuuguaauucuguguuugguguggcucagcuagauagaugaaaauguaccuuguuuuaccuaggaugacuuuuaggccugaaaugccagucauauuugucuguuuucucuuaauauauuuaguucucacuucaauaugaucuuuuauuucuguccccacuaucauuucuauaguuuauauucuauuacuucuugccuagacuguugugauaggcauucuuugguagcaaacauaugcuguagauuaaaaaugaaauggacacauucaccuuugauugcuacuucaccugucuuuugcugguguuucuucuuuccauuggggaguacuguugguauagcagaggacaguucuuuguugugugggaguugucaggcuugugcauugcaguuaacucaguauucuugcccuccacaacacccccgccauugaccgccaguagcagcugagagagggugagugagcagggaggcggccuuaccacucucaguugagaacuagccugcuagccagucugugcuuauuguggguuccagagcucaucuuauuuccuguuuauguuuauucuuguuuucccuuuuucuacucccaauuaccaaaauccaguuucacuuucauaaggucacugaaaaugcaauugcuuacauguaaaagucaggcaaaguauguauuagauuugguaacauacaauaauaauuuacauauaagauguauaacaguaguaauuauauauaguaauauaguauuauacuauguauaguaacuauacauaguaauauuguauaguaaucaauaaaacagacuuuauuuucgacuucauggaguuuucacucuaucacgagaguaugagagccuuaagcacugucuuaaauauuuuaaaguuccccuugguuauuuuuguaugguauguugcauauuuuguucaauaaguauuuaaacaauaauauaugacagugaauagaauuuauacuuuaggccuggggaauacugaauaguuuuaagcagaagaguaauguuauuagauuucuacuaacuacuuagguuuaaauucaguguuaaaaggugaguuuuguuaauuucuccauccugcuuuucuaaucagccaaauuauuucuugaaaagcuuuuuucuuucaaacauuuuggaaauccaauuagguaaguaauuuaguaaacaacuauauuuauauugaaaguccuguuagauaaguaauuuaguaaacaaauauauuuugagcacuuacugugugccagauacugguuuaggcacugggcaaagaggaaugaucaaaacaaagccugugaucucacgguugcauuauggcgggagaguuaguaagcaaacgaaucaacucauauacugcccugugauaaagugcugugaagaaaaauuaaacaaguagaaagagugaaggagaaggcuaucuuacauagggaaauaagacagccucugaggaggaucauuuaaguuggaaugaaaggaguuaaccaaccauggauauauuuggaagaaagagcuuugccaauggaggaaacugcaaguuagggcuuucagugaauaauuuauuaauguuuuuuucuccuugauugucacuuuaggauaaucuguagaucccuccaugaucuggccuucgcuuauacuuuuucuguuaauuaucuaauuaagugggaauaaugccuacuuugugggcaaagugaaauguguaacacuuaauuuuuauauaaguauauuuuaugcaauauaaauacaaggaugcuccauauucauaguuauuaucacccuuuuguuauauaauaaucauuagcuuauguucuugccuaucccugucuuccuagagagcacuugcucaucuuucaagaaucaguguaaaugucacuuucucuuugaagccuuucuugcugugcauguagacaugacuauucccuuaguuuugucaccauuguuuauuuguauaucugucauuguaucugccaucuuuauuuauuuguuuuuaccuuuuguguacccagcuucuaaccuagacucuggcauuuagauauuugcuacauaaaugaauuguauuuagaagcuaauucauuuggcuucuaauauuuacauauacuuaaaccauucaacaaauaugucacugugguagauacugagaauaaaaaauuaauacaaugcauguucccaaucaaguuuaggguaaaguuacgauacaauauaauauacuuaauauaaugguuuguucaaggggaguguaaauuaaaguggagauagauuaucuaaaggaaaaguaaggcaggaaguauagauauguauucuagauugugaauaucauuccacaggugucugaugaucuccuuccacggggcacauuuaugcuucuuggugcagucagcuucucagccagguccuggcaauaucugugauagcgguacuuaauucucugaugcuggugacacugacccauuuauguucguuauacugacacuugagcauagauuuggaguugugaauacuuagaaucccaguugucauuucuaggagugugaucuuaagcaaguuacucaugagucuuacuuccucaucuggaaaauagagauauuaucugccccauacaggguugcagggaauaaauuaugaagauaaaauaguauugguuucuagaauguaguggauaauauuucuuccuuuuuuauuuuuuauuuauauauauuuuuugagacagagucucacucuguuacccaggguggaguguaguggcaugaucuugacugacugcaaccuucgccucccaaggucaagcgauucuccugucucagccucccaaguagcugggacuacaggagcaugccacuaugcccggcuaauuuuuguauuuuucguagggauaggguuuugccauguuguccaggcuggucacggacuccugaccucaggugauccgccugccucagcuucccaaagugcugggauuacaggcguugagccacugugcccagccuguaguagauauuucuuggugggugaaauaauuuuaauucauuuuacuuuauuucuguagaaccauacugagcauuuggcucuaauuacaggaaaacaagguggaauuuaauaaugguguugauagcugacuuggguuaggucucauucuguugcagcugguuucuuuucccucagcgcaaagugcugcuguuaauccagagaaaagaaugcuuagcauauaauacucaaaagcuguaucacacuauguugcauuuaacacaaggugagggcacugaggggaggacauuugucuuaguuguugccuugugugcccagcaccaagcacagagccugacguauuauaggcacugcauaucguguuuaaauuagcgagugaauucuguuuagaugaggaagauguacuaguauggaguaccugauguccacuggggcauuuuggguagcuaaagaaagugucuauaaaauauaagcaaaggagaacaauauugguagcaguugccuuucaaaccauuauaauuauaggcacagaccuuuuuuagcagguuguauauuuuaaaauaaguauaggccagcuaauuugaguuaaaaugaucacaugugcugaauuaacuagaagguaaacaacuaaaaacgaaaagagacauuagaacagguaauagaguucagaauucacagcuauucuaaauuagauuuguaaaagccuugagucuuacuuuaaaggaaauaaaauuucaugugaagaaauggaucacuguugccauaacuucaacuccugucuuuccucugcugcucaaacuuggcaaaacaccaaacccuagagcagucucaucaucuaccguuucuguuccuuggaggcauggucuguugagugcugccaggcugacugucagcugugucucucagucuugucaccauccuauuccacugucaccagagggaucuggugaauugccaucaucccauuccauugucaccagaguuaucagauuuuaaaugaaucugauuguguuauuccccuccuugaaauccauuaauagcuucucaguguuuuuaggauaaaaauccaaauauccugguaugagaaacagagcuuuuagagaucuggccuuuuagcagucucuaccugaucuucuuuuuucuguauguugguaucuuuguacuacagacauauuaaaccacuugcauuuuucuuaauguuuuauguuuuuuuuuuuaugucacugaacguaugaugcugcuucuaggcaugcuguucucucuucucaagguugucagcuacagaugauuuaaaauucuuuaaguuuaccucuagaaaacuuuuaccuaacaugauacauuguaggagucuacaugucuuccuucucacaaaacugugagcuuuuuugaguauggauacucucuuaucucuuuaauuccuaaugccugucacugccuugcacaggauagaagccuagaaguuuguaauuuaguuaauauaugaaguaacagaauuuaucagaggcuuaaaauauguucagcuaaaauggguauuaugugagaaguggagaaacauggucccugcccuguucauaaucuuaguuguguggacaaaaaugacacauaagcaauuaaagcuuaaucgaguacagcauuaagugaggacuuagguagaaugauuagaaaaugaagauaaaaucgaaaauuucaaaucccuugacauuucauaucugcuuuucacuuuccccuuaaauguuuaccacuacuaacaugccuauaccguuuacuuauuuaucuuguuagguucauaguccccaguaaaauauaaguuuuaugaggauuuuugucuguuuuguucaccaugguauuucuggugccugacauuugguaggugcucauuagauaguuguugaguggauugaauggagugcagagaaggaagugaucacuaggaaauaguguuuaugaaagacuucauggagaaguauuaacaucuugaaguagacuugagagagaguauuuuauuagauuagcuaguguuuaugaaauacgccuauuuaaauaaauaauuaccaauuuuauuuuccuaugacuuuuucaagucauguugcuccuaauuucucuuaaagcuuccugugguuauaugguccucacuguugacuccucuuagagacuuucacaacaaggccuauuuaaccagagugagagaugcuggcccuuuccuuauauaccaguuggaaugaacaccuucacuuuguucuuuagcagauuaaacuauguguaaaaaauaggucugcuggaggcaacuacguauuauauacagaucuuuacacuauauguuguuuugguaccugagcucuuaucuucuauuuugcaucuuuuaaauaauugcaaauaaauccaaacuuacgggcacaucagggucuugauuguucugugaauuagggaucaugauugaccauuaugccuccgaguucuuggauuuuagcaaaucuugacuggcguuccaaauauuuguauguacacguauuuauauaucacacagaacuuauaauugcauuuccuacuuuuauaguuuccuuucuuuucugauuacuucccuucuaagacuaaagaaauuaaaauuagauuuugaauuaaaacuauuaaaaauguuaaaacaccaaaauauuuuuucagcuguaauuggaacauguuagguaauaucaguuugacuuuuuuuuuuuuuuuuuuagaaaauaaaauuaucugugggccucaaauauuggcuucucuucucccagcuuuuuuucuccuaagcacagaauuagauauucuuaggcccuuauagcugcaauagaucuuaguaaguaucucuacuugcuuuauuuuagggaugaggcaacuaagaugcaaggacaagugauuuguccacaauuaacuaaugacagcuaauugauaguagggccagaugauagacuaucgaugagauaacuaagcuguggcuaaccucugucuuaugcuaaccacuuucaacuuuaaggccauacuauuucuggaaauauaugugguucugauggcauuuuaaagaaauguuauuguagugacuugauagaagagaaguaaguuccuagaauuuugucaguccgccagucagccagacuggguauaagugaagcugcggcaguacuuucccauuuugguauauagguuguuagcuaguuaugugcacaggaaguaauuuccaucagucauguuaagccauugaaaaauguuucaugcuuucuaacuuaguuuuugacaaccugaaugugaggauucacauauauuccauagggaaaggguugaccaguaaauguguauuaaagauaacaugaagaacaagauuuaaaaacaucugguuagucuuuuucuuuuguuuguuguugucauaguugaaccuaagaacuuacguauuuugaaaaaagcuauauggguagacucuuggauuaucuuaaauagaaaaauggaaacaaaagggucaugugacuauuuuacauuuccuuucccuuuuuuuggugauauuuucuaggacucauuuugauuaaacuggauugugcaaaaauagcacuuuguauucugugauuuuuuaguguuuuuuuuuuuuaauggaaggagaucauuuguuuuuuugguagggggaaugauuaguaaaucaugauuaguaaauauucagguuggauaagaagaaaugguuaaagauguagagauuuuagauaaccugaaguuaguacugacauaacuccugguuguaguugccugauguuaauuaaauuggauuauuucuuuuuagucaguuguguucauauauuauacuuuugaugugaagaauauucuguuagacguuuuaaagucucuuaguuuaacuuagucugaaguuuaauucuguugguuuucuuuuaaauuauacucucuaacuauagccuuuguuuugguauggcaaguuaguaauugcccuuuguucucuuucagaucccugcaugucacugaguccaccaugcuuuacagaagaagacagauuuagucuggaagcucuucaaacaauacauaaacaaauggaugaugacaaagaugguggaauugaaguagaggaaagugaugaaguagguggaaaaauguuuuccuugcuauugucuuagaacagaaugacugcauuucuguuucuggucuucaauuuucucuuuccucauguggcucauugccuucaucuucaacaucuuuaauuuuucuuuuuacauguuaauuuuacccuuaauaaacauuuacaugguuuuucuguuuuuccccccauuuggauauaagucuucccaguuguauaaaaauuuuccaucucauguuccuguauuucucaaacauguauccuauucugacuguauuuuaucuauuguugcuuuacaaaccacuccaaauguagugguuuaaaaugacaacaguuuauuauuucuccugauucugugggaucacuggccccagcugagcaguuuuucuguacccuuagauaugggccgaggucacuauggaaguugcauucucuugggagcucuguuggggcuggaguaucuaagacagccucuuauucugcauaaugucuuucuauguuaccucucaucauucaggagccuagcucaaacuuuauuacagcacggcagcuaguguuccaagaggguaaguucccaugugcaaguguuuaucaugccucugcuugccagugguugcuaauuuauuggccaagacaagucauuuggcuaagcucagaaucuguguggaagaagauucuacaaagauauagauaaccaggaaaugugauuccuuggagaccaccagcaugguaauuuacuguacccacugucuuuaguuuuuaagcauucccauuuacccuaccggucugguuucugucuuaguuucucccuaaaaguuggcuucuuugaguguugucucauucuaaccaaauccccuggucauuuuucaggccucuucagucccuuuguuggauuugucacuguugaauugcuucucuuucagauuauauuauaguaaauuacauuauuuucuacauuauuaucucgugauguaacagugacagugucuaguaacauuguuaucuaacggagacauucucugaagaucacuucuuggcuugcuauacaaaacguuuauuugagaaugcccaucuguuuucagauugcccugauuccucuaucucuaggccagucuagaucccugaccuuuugcuuucugccugauguuuuuagagggcucuuacuguugcuuuaaauuuaguauguguaaaacaaaaucucaguuuugcuauuuuaaaucucuuguuguucaguugcaccucuggaccuauuucucgauucuucuucuucuaaaguagauguuggcagacuuuuucugcaaagggccaagauauggguugaaauguguucucuaaaaacauguugaaguccuaaaccccagcaccucagaaugugaccuuauuuagaaauaaggucauugcggauguaguuaagauaaagucauacuggaguugggugggccuguaauucaauaugacuaguguucugcuaagagaggagaacgccauguggagucacagaacaggagagaagaugacucugugacaguggaggcagagauuaguuuuauauaacugcaaaucaaggaaugcuaaggauugcugccaauaccagaagcuaagagaaaggcauggaacagauucuccccuagagccuuugagagagcaugauucuguggacacauugauuuugaacuucuuucuagccuucagaucuguaagagaauaaauuucuaucgugguaagccauccaauuuaugguacuuuauuauggcaguacuauaaugaauggaaacgaauacaggccaguuggcaaauuauuuagcuuuagugggccaugcaguugcuguuguaacuauucaacuccgccacuauagugugaagcggccauagacaguacaagaacuaacgggcauggcuguuuuccaauaaaacuuuauuugcaaaaacaagcagccagccauauuuggccugcaugcuguaguuugccaaccccugcuguaaauuaagcuccuguguucuuaaaauauguuccuuuuucuuccuuuccccacuaccuuuuauccauucuaguuauuugcuuguucuguucuaaucuagguauuuauaaucuugugucuagauuacugucucuaaguuuuuccuuucuaauccaucaugauuaucacuuugagagugugauagcuaagagacuuagugauuucuaauugcuuauuaggucagauauuaaaucuucagucuuauaauaucucugcaucaguugauuucugcuauuuaucaugauuaaaaucauucgauuagagcucagucaguaccagcgauaccaaaaucauuacuuucgauucaaaguagaucaauuuauuuauuucuagaaccaccgacuauaugauaauucuaucuuacauagcuuccaacuuaaaaaguauuugaacuguauauucuguuggucauaaggaagagugagguaaaacugauggauuauuaagaguuuuauuguuauuggaaaacaacguaaacuaguugucauuuauugugggccguuuuauuaaaaugaguggauaauucauucucucaacaucauuaucauuacuccuuuucucuguuuguauuauauuuuuauauuuauauuuuuauaaaauagagguaauuuauagagguaauuuauucucuaaaccaaagagauuuucuaaaauuauuauuguacauuuucuuagucauuuacaauaugacaggauuagcuuugucaaacaaauuccaugucaacucugagaguauacaguguuaaguagaugaaugcucugugcaguuuuagauuuuaacccaaaaacugagcuucugcaguuucaaugacuugcuaaaauggcucacagaacucaggaaaacacuuuacugguuuauuuuaaaguauacaacucaggaacauccaaauagaagaaaugcauagggcaagguaugggggcggugugcucagagcuuccaugucuucuucauuccacccucccagcaccuugauaugcccaccagccuggaagcucuuugaaucuugaaccuuguaacagaguuuuuguagagcucaguuuuccuggaggucagugggugggacuuaaaguuacaacccucuaauuacuuggucuuucuaguaaccagcuuuauccugaaacuauuuagggcccuauccuaaaucacuuuguuagcauaaacucagguugguggaugggggcaauagugaauaacaaaagacucaccuaucaggaaauuuccaggguuuuaggaucucugugccuggaaccuaggacaaagaccaaauauauuucucauuauauauauuauauauuaacaguaaccucugcagacuuaaaugucccugucugacagcuuugaagagagcagugguucucccagcaugcagcuggagaucugagaacgggcagacugccuccucaagugggucccugaccccugacccccgagcagccuaacugggaggcaccccccagcaggggcacacugacacgucacacggcaggguauuccaacagaccugcagcugaggguccugucuguuagaaggaaaacuaacaaccagaaaggacaucuacaccgaaaacccaucuguacaucaccaucaucaaagaccaaaaguagauaaaaccacaaagauggggaaaaaacagaacagaaaaacuggaaacucuaaaacgcagagcgccucuccuccuccaaaggaacgcaguuccucaccagcaacagaacaaagcuggauggagaaugauuuugacgagcugagagaagaagaauuucauauccagccaaacuaagcuucguaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucgagacuaggaagaaacugcaucaacuaaugagcaaaaucaccagcuaacaucauaaugacaggaucaaauucacacauaacaauauuaacuuuaaauauaaauggacuaaauucugcaauuaaaagacacagacuggcaaguuggauaaagagucaagacccaucagugugcuguauucaggaaacccaucucacgugcagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccugagugaccuacaaagagacuuagacucccacacauuaauaaugggagacuuuaacaccucacugucaacauuagacagaucaacgagacagaaagucaacaaggauacccaggaauugaacucagcucugcaccaagcagaccuaauagacaucuacagaacucuccaccccaaaucaacagaauauacauuuuuuucagcaccacaccacaccuauuccaaaauugaccacauaguuggaaguaaagcucuccucagcaaauguaaaacaacagaaauuauaacaaacuaucucucagaccacagugcaaucaaacuagaacucaggauuaagaaucucacucaaagccacucaacuacauggaaacugaacaaccugcuccugaaugacuacuggguacauaacgaaaugaaggcagaaauaaagauguucuuugaaaccaacgagaacaaagacaccacauaccagaaucucugggacacauucaaagcaguguguagagggaaauuuauagcacuaaaugccuacaagagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccaccgaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucacagccgaacucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguauuucaaaauaauaagagcuaucuaugaaaaacccacagccaauaucauacugaaugggcaaaacuggaagcauucccuuugaaaacuggcacaagacagggaugcccucucucaccgcuccuauucaacauaguguuggaaguucuggccagggcaaucaggcaggagaaggaaaaaaaggguauucaguuaggaaaagaggaagucaaauugucccuguuugcagacgacaugauuguuuaucuagaaaaccccaucgucucagcccaaaaucuccuuaagcugauaagcaacuucagcaaagucucaggauacaaaaucaauguaccaaaaucacaagcauucuuauacaccaacaacagacaaacagagagccaaaucaugggugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucauacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcgugggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcgaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaauacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauauccuuuguagggacauggaugaaauuggaaaccaucauucucaguaaacuaucgcaagaacaaaaaaccaaacaccgcauauucucacucauaggugggaauugaacaaugagaucacauggacacaggaaggggaauaucacacucuggggacugugguggggucgggggaggggggagggauagcauugggagauauaccuaaugcuagaugacacauuagugggugcagcgcaccagcauggcacauguauacauauguaacuaaccugcacaaugugcacauguacccuaaaacuuagaguauaauaaaaaaaaaaaaaaaaaaaaaaaaaaacuugaauaaaaaaaaaaacugacugaacuuagccaacugcuaaacccuuaaaaaaaaaaauauuauuaauauaauaaaauauauaaauauaauguaauuauaaaaucuauuaaaaauauguaauuauauaaauuauauauuaauauauaauuauuauauaaauuauauauuaauauauaauauaaauauauauuaauauauuucuuagucuggugcugcuauagcaggguacuauagacuggguaaucuauaaugaacagaaauuuauugacucacaguuguggaaguugggaaguccaacaucaaggugcuggcagguuuggugauucugauuucaagauggcuccuugaaugcugcguugccuggagggaggacuguuuucuuuuuaugggguggaaguagaaggcccaagaggcaaaagguguguaacuugcccuuuuauaagggcauuaauuccucuccugaggguugggcccuuaugguccuauuaccucccagaaccucccuguuaccucuuacuuccuaacacugccacaauggcaaauuucaauaugaguuuuggaggggacaaacauucaaaucauagcacaccacaauuacaaaaauauuuaaauaugaaaaauagcagaaauccacauuuccugaaucauuaaaaauaccuucaaaggaaagagcaguuaaaauugugcaugauauauacacagagaaaguaucaaggaagcuuuugcagauauuugacagccuauuuguaauugauugcauuauaauucuuagaaguacaaguuauuuuaaucuuuuuuaccucaucagauauacuuuuuuaauuuuuaauuuuuuuuacuuuuauagagaugagagucuugcuguguggcucaugcugguuucaaaagccuggucucuagcaauauuccugccucggccucccaaagugcuuggaugacaggcaugcaccagcguuuaucagauauuaaaugcacaugugcaaaguguuaucaccacucugcaaaacaaauuaagcauacauggcuguguaauuuauauuucaguggaaaucuuauugagucuuuuaaauuucaguggaauuuuaggcauguuguaauaaaaguuagaacuaaauaaaacuuaggcuuaaaaaguagagcuuagaauucuuugauaugagaggugaauuuuaauauuuaaaaacagaagaugauaucuuucuguauuucucuuacuauuuaaaugcaaacacaacaugccuuuauauuuuacuacuaccuaaaagaauguagaaauccacuguccagugugguagccacuagccauauuuggcuauugagcauucgaaguugaggugugcuauaaaguauaaaacacacuugaaauuuugaaggcuuauaugagaagaauaauauuaaauaucuaauuugaaaauauugauuaccuguuggagauauuuuagacauauuggguuacaugaaauauaauauuaaaauuuacuuccuuuguuuuuacucaguguaacuucuagaaaacaaaauuauguauguagcucacauuuuauuucuauuagcacugaucuaggcucugugugauguguuuguaugcuuuaaaggaugaauuauuaauucugcaguucuuguacuauaguccuucaguucaauauaggugcauuuugguuuguauuucuuguuaaggugucuuuuugaaagaaauaagcaauaauuauuuuauggaccuuuacuggccuucacuaggagacuuuauacguuugauaggaaaccuuagcccaaauuuuaaaguacuuaauuucuugugauuuuagcccaaauuuuaaaguacuuaauuucuugugauuuuuguuuuguuuugaaauguugcuuuucuaaaaaaaauucagaaaaguauuuagcauuugaaaauucuguuuaaaaacuuauuuuuuuuucucuuuaguauccucuguuuuguauuuggucauaugaaaaauucuuuauuuuuauaauuuauuuaauauugagcuaauaucugauggccuauuuuauaccagauacucaaauaguugcuuggaauagauuaggaacaagauagacaaaaucugugccuuuaagugaacauucagguagggcuugugggaaggagacuaaacaaaauaaguaagcaggggcagggggaucauuaucaguuagagaugaugggggcuguaauguucuauaggguggcaggcaaagugaggguaacacuuaaaguguaucauguguacaguacuuggacaaauaagagaauaaaugucugauaacuuuccagggcuauguuaaaacugaauuuggaguacuuugggugcuucagaucaggaauaggauauaaagcuuuugcugucuaggucaucaucuucuggaccaacauaaaaaagguuagaugucaaugugugcagaaucugugaucuguuaagauugaauuguugauugcauucaaggcugcacggucugucaauuuuagugaaauuuuggaaaguguagguauuuggucaacaaauaauuuaaauaagagaaauuaaugguuuuguugcccugagcacagcaguggaguucacauuguuauugcucauuuugugacugaaaaguuuuaucauagauucuaguguauaugaauuuuguuuucuguucuuaccuuucccucuuuuucuuugaaugaacauuuuuuucauuccuuuccuuguucuaguuuuucuuuguuuuuauuuauucuuuuucauuuuaccaccuggaauagguaguuuuagagguuuuuuuuuaucaguuuguuugauauacauauauaaaacaaaaucaacuuuaagaccuacuuaucugaaaaguccauuguaccuaguauuucaguauuccuuauguuacauaugcugccuucacaauacauucuuugccaugauuuuuauaccuguuggaaagcuuaguuaacaacacagaugugucuguggagagucacuuaagaaaauaggcaaaauuaggauuagacaaaaaagaaggcaaugcauuuuaaaauugaacaguguguuuugaauuaugugggguauuguguccaaaagauuaaauacauauauuuuuugcugaaguuuucuaagguuaacuuuuaacuuauguguuaguuuauugcuauguaacaaaugaccccaaaacuuaguggcuuaaagcaacacacauuucucauuucaugguuucugugggucagaaaucuuagugcagcuuaggugggucuucuggcucugggucuuucacagggcugcaauuaagauaucagcugggguugugucaucucaaggccugauuaggggaggauccacuuaaaaaccuacucauauagcuguuagucucagagguccucaauggcuguuggagauaccaguuuucugccguauaagucucucuguaggcaguuuauaacaugacaaugggguucccucagcccacuguuucacucucucagagugagagggagcucugagagaaagagaaggggcaguaauguggacgucauaaucuuuuugugacuaaugcuggaagugacgucccaucacuuuugcuguauucuacucaugggaagugaguuacuagguccagccaaccaucacggggagacaaauacaaggauguggguaucauugggagccauuucagagacugcuuaccacaguuuauuuugauaauuuacuaacuagaaauauuugaugggagauucucaagccauagaaauauagaguauaaaagcaguaaaguuauaaaauuuccuuuaaaaggcuuuguuuuggaaaugucccacaauaaaacccauuguguucaucuuuguaauaggauauguguagaauuuuaaagccugauuaaaaguuaucuauugaguagagcuuugcagugaauggugacucuaauuacaugcacaaauguaccaguguaauuuguuugacugaaggaucacuugacauucuucugaaagaacaagcagggcaaagggaagggaagggcauaggugcuagagaagucuugcugucuauuaacuuacaguuacugagguacuuuccuauauacugaaauuuucauaauuucaugauuuguuuaguuaauauaacgauaccauaaaaauagagacuuuaauucuuucuggaaaauaauggcaaucagcacacaauuaaaguagcagagaauguuaguaaguguuuuaugggaaaauggauuacguggucaaaauugggaaaugcuggauuaguuuuguaggacuucuuaaacuuaaauuuauagauuuauauacuaagauaacauuuauugagcauuuacuauuuguuccaucguauaagcacuuuuguauguacuaugguauggacuccuuauaacaacuguauuagcuaagaaucuacucuuauuaucuuauaugcagaugaggaaacaguuugguggauuaggcaauaugcccauaguuacaagcuuguaaaugauagaguugagguuuugaagccaggccaacuccagaacccauguucuugacuucuaguguuucuuguuucucuguguuaauguagauuauuaaucuucaaaggauggugaaucuuaacgucuguuugacaaggaacuuuuguaauacaaacugucucuuaaguuuggcauaauguaaguggucagucgguuuuuguuugaguuuuuuuuccugaaaauugauaauugcuaccaaaauaacaccacacagauuuuucagugacuuuaacauaacucguuaguacugacacuaaacuuacuguagcaucugaucaaagauaaagucauuuuagcaauugauaaauugaacaucguuugcuaaauuugaugcuuuuguuuugcauuuauuaaauuuuucaugguaguauaucuuggcuauaaaugucuaaauaguacuuaauaagcaucuaauaaauguuuguuuaacgaaugaauauuggaaaaucaaacuuuuggaauggccugggccuguaagugaccauggagagcccauggugaucauggguuaggagcacucucuggagcuaagcagcagcagcaacugcuuaguacuugucaacaacagaaaaauaauuaagagcugaagaaacuaacuucgguucagcagucuuuuauugagcaccuauugucugccagacagugugcuagauguuggcuuugcaaagauaaacaaaggcaucuggucauuucauggaaaaaacacauaacgacuuguccugaaagaacugagaaguaauaaagaaucaauguguacaugagagacuagaagugagaaaagacaugagaaagcagcagauuaaugcugguaugaucuguggauaucaagaaaguaaggcaacaguggaaaacauaaaagagcuugugggagagugaaucugagguaagaggucucuguaccccggauauauuagcgcuuaaugcagagggcacgcaagucauaggccagcacuucuagucugcagaacugcuauugagagcucaaaaaaaaaaaaaaaaguuagugucuggaauucuucauuuuuucauaucuguucuuaugaaaacauuuuaucguacuuaaagguaaauauuaaggggaaguuggaaaguuaacagaaaaguuauuauauguugaagaaaauuauggauuuuuagauauagaagugagucuucugcugaacagauuuacaaguugaggaaaaggugaaagauaccuaguagauuugaugcaaauguggagaaaccugugguucaaauacaguccuucaaauggcauuguugaaucaauuagcauuucugauagcagcaaaaaggaaaaugacuuucuauaggucaaaaguggcucuacugucauauuuuuccaaacuguuuuuauauuaucauccucauauuuuuccagacuguuuuuuaucauaugcuuuggguuuugcagagggugguagcacacacuuguaaucucagccaacucaggaggcuaagguaggaagaucacuugagcuaaggaguuggagacuagccugggcaguauaacgagaccugaucucaaaaaaaaaaaaaaaaaaaaaacaagaaaaaaaagguuuuugaguaugugcuuccugauauaauuuuaaaauaaauagcuguauauaaguaguguguauggauacauauauaacauauauaaacacauucaaacuauuguacuaauguuacauguuuuuaaaauacccgcaaaaauacggcugggugcauuggcucacgccuguaaucccagcacuuugggaggcugaggggagaggaucacuugaauucaggcauuugagaccacccuggccaacuugcugaaaccucgucucuacuaaaaauacaaaaauuagccgggcgugguggcacgcgccuguaaucccagcuacuugggaggcugaggcagaagaaucacuugaacccaggaggcggaguuugcagugagccgagaucgugccccugcccucuggccugggcaaaagagcgagacuaucucaaaaaaagaaaaaaaaauacccacaaaaauauagauuaaaaaaaugagauaaaauuaaauguaaauguaaauucuaauauuuucucaaaauuucaaguggauuagauuauacauccuuuuugggugucggcaacccaaauuuggagaccacugugcuaaugaauuguaaagcaaugucauauuauaagucacacagauuucauuccauuuucauaagaacagacaauugugagaauuucucaagaaagcaaguucuagagacacuugcuaauguuaauauuuguucuucucuaauuuucauggccacuguuugcagguuucuucaucauauagcacauuaguugcugaccuuuuaaugauguccacugugcauuuuaugauuaaaauuaguucugauacuugugauaccuguaagaagugguaauauaagaauagaacaaggcuaggcgcgguggcucaugccugcagucccagcacuucgggaggccgaggugggugaaucuccugaggucaggaguuugagaccagccugaccaacauggagaaacccugucucuacacaaaauacaaaauuagaugggcauauuggcacaugccugcaaucccagcuacucaggaggcugaggcaggagaaucacuugaacccgggagguggagguuguagugagccgagaucgcgccauugaacuacagccugggcaauaagagcgaaacuccaucucaaaaaaaaaaaaaaaaaaaaaaagaacaaaguucacuuauuuauacuaguuuagggaaaaaaagcagagaaugagugaggcagaaaguguagauaucauuuugauaagggaagacaugauuaaacuuuuuaaaauaucuuuuccuauaaauuugccacuaugucuuuauauuuuagcugcaaauucuauuuuaaaauuuaauuuauaucuggauuguggaugucuguugaucugaagagacccaggaaguaaugauuuuggacgccauugauuaggaaucuggaagaaagauucuuauguagguggaagucaucuuauaggguauguguaagguauuuuggucuucagcaacucaccaaagcgugcugagcauuacauacuuguuugucauuuugguuaccucuucuuuguuuacguauauguaacuauaguuuaaauuauucaaaaugagauaggcacucuauacaucuuuuagaagcaagauauuaaauagaaaaagguuagggccacccuaauacuucucauuuagcuuacagagugagaaaggagggaaagaaguagaugaaaauggaguugguguaguuccaagaaauugcucuaaggaguaaauaaauugaugcucccuugacaagcaguauuaacuuaacaugaaaacuuguuagaaaugcaaauucuugagccccaccccaacccuacugaaucagcagcuuggggaugggaccuagcaauccguuuuaacaaauccucugggugauucugaugaaguuugagaaccacuagacuuucaggacucugauaguagccagaagcucuuuaucuugaccuuuuaugaguagacaguauaguuacaaaucuuacuuuuuuuaugauuaggucuuugaaaauaugguucaugacuuacucuuuguaccuugauaaaucuuaaaguuuugcauuauauuuuuacaguucuuuuaaucucaggcacaauauuuauaaauauaaauacuacugugaugcucuugcaagauaccuuguuuucugcuccuguauuuugugacuuuacuuuugccaaguucaaccuuaaaaauuucuuuguauguuuuauaggaagucauugacauucaguuacuauaaagcaggguuguauuugucuuuuuuaugugggggaggaucuuuugguuuuuaaaguaagaugguucuguaaccuagaugguuaagaaucauugugcaaguuauugagacagauuuuaagaaaacaucugaugauuuuauauuagaauauuucuuacuuaaauugugaaacuucuaccuggucccagcauuuauuuaguuuaguacuuauguccuuauguccugacaauuauaguaaccuauuuacuggaguuucuucucugucucuugcuuuuccaguucauuuaccaacugcuguugaguuaucuuuuuguuuaugacauuugauaagagcugauccucccagagcauuuguggucauguaucugcuugucccucaaagcaaccacaauagaaaacagcuuucucuuauucuacuguuucuuaucauccagacuaucuaaucucuaugcuugaguucugauuuauuauuggggguucccucuugcugaggcugucuuagucauaggccauuugagaaacaccauugguuguauauaguucaguuauauacagauuaaauaggauuuugugaacuaggaaguuaaacaccauaacauaguuucuguggaaagauaugcuucacuuaguggauacauacucuuaaaugcaaccuacuuauaaacugagaauaacugacuguaguaugagaucuguguaugaagaaccaaaaacuucugaaaucauuucauaguauggagcaucgaaacauucaacccagugccuuuugccuuuuuuguuugagacagcaugucgcucugucacccaggcuggaguucaguggcgugaacaugacucaccacagccuugaccuccuggacuccaggcauccucccaccucagccuuccaaguagcugggauacagucaugagccaccaugccuggcuaauuuuuauauuuuuuguagagaugggguuccagcguguugccaggcuggucuggaacuucugggcucaagcgauuuaccugccucaaccucucaaaguguuagaauuacaggcaugagccacugugccuggugccuuuugcuuuuuucugggaguugccacaaccccugcuucaacuaaugacuguuuuagccccuuucccaaauuauuuuugcuuucauuagucagaccauaugguaauuauguauuuuuuauuaaaaauuauuucuaauuucuguuucauuaauuuuuaguuuacugcaacaagaauuuccuauuaaacauuguuacagaccggaagggggcagagcagugggaguaggguugugaauuaggacaggacagugugucugcacuucccuuuuucaguuccagccugaugguacugccagugcugccaucuccccacuccuucccucagccuuuucagcaucacagcacagcauugcauugaucuaauauacuuuuuugcgaguuuaggacacuucacauaguaucucaccuuaaagauguuuugaugaguacagaccuguuuauucccauuucacaaaugaauugaauugugccuuuacuguaacauuaacauuauuagccuuguauuauuauuauuauagauaggauggccauauaauuuauuaucccaacuggcauuuuuucugagugaaagagaguguuauuaauaauuacauccagacaaaggguguaaacgaggacuguccuaagcaaaugggccauauaaucaccuucgccauauggcuuaucagccugcuucaguuguacuuaccuuuaucuuugucuugcucccucacuaaguuguuauuaaauugaucuaaguuuugugccaagauuucugcuacugcuaaacacuggcucuaccucaguuugguuuaucagucugagucuuuuuguauuguauagcuuguuuucuacuaacaugacggaaacacucagcaacuuuccauuccuuuuucuuuuuugcagauaagugauuuuuugucuuuuuuuccucuggaaauaaauuuaaauagcuuaauaauuuaaauagcuuaaauuuaaauagcuuuuaaaauuuuuaaauaaauuuuaaaagaaaaauagcuuuuucuuauauuaaaauaauguugacucuuucauugacuuuuagaauuuuuuuuucaguagcacauuucuugguuuucccaaauuuucuuuuuuuuuuuaaaacaaaaaaauguccccagcuuuauugagguauauuuaacaaauaaagauuguguauauguaagguauaugauauggugauuugauaucuuuauacauugugaaaugauuauuaucgcagucuuaucaccucacaugucaaaggguacaaacuuucaguuauaagaugaaaaacucuggggaucuaauguguagcuaguuacuauaguuaauaauacuguaucauauauuugaacuuugcuaggagaguagaucuuuuguguuuuuaccacaaaaacaaagguaaccaaguuuucauaacugaagaauuuuauauaauagucuuaaguuuuccuaugaaccuauccagcauuuagccugcaggaaguucuccaagcacugacugcugcagucacugaucacauagucucaggagagaguucugcucuagaaagcuguuuggauugucguaagguaaagugcuaagcuauaucagggagguguaagguaaauaguucuuauccucagauaaccucacauuuaaugcugucucacguuaucuucagcaguacuuuuuugagauggacagaaguguucucucuuauagauaaggagacagaggcuuaagagagauuaaguuauuuaaguuacauaguguguguaaggagcacuaggauuagaguccaacuguuccaacuacuguucauucuucauaacauguuuaggcauaauuuccaguuuguuuuuuuuuaaauuuuaaaauuuuuaacuuguauucaguuuugagccguggaagcugaaagaggcucucugcauacauucuugaacuggguuucuguuaauauuggauggucuguuaauguuaauauuggaaacuucuggguauuuaguucauuuacuaggaccucauacccugcuuguucccuguauuuugguuugaaucuuaccauacugaguaaauuagcacucuaggggcuugcuuuaguacuuuuucccuguccugccccuacaucuuggcaugugcuuccuaucaucuaaacucgugagaacuauuccuauuugacacgguccaucuuaaggacucuaccaagaguuaucuugagucuuaucuugagcuuggcuggaggauucaccuugccucuuuccccugcuuacuaaaucuguauuagacuuucuaucuuggccuuucugggucuggccugauauuguucuugacuuagcauugguacuaccaaauauugaugacaugcuuuguaccaccccacuggccuuuuaauaaucuuacuggaucuaaagggcugaaucggauaaagauaacuuuuuaaaauuaaagaauauuuugccgggauccugaaaauguuacaaacaauugauaaugaauauuuaagagccuuuuacuuuaauugucaguccuugcuaacugaccuuuauuauuuuuuaauaucauacaaguaccugaaaugucuuuuaaguguuaauuggggauguuugaaaauuuuuaugcgugguuuuuguuuuguucucauuuucccuuuguuuucuuuucuuuggccuccugaagggcuuggcaaacaggucuaagggcauuguugaccacuugguuaaaaacaaaacacauguaagauuuugaaguucucguuuauauauuuagcacuguacuaaauauggggcagauugaaaaacugaauauaggccccaugaguuaacugucuaguagggcauauaaugucauguauguauauaccacaaggcauguuacggcaaacgauguccuaguaauacacaugaaucguggcaugcucuugugaugcacaucuguuaggggagcaucaaacaaagcucugcguagagucguuaagacgaacuuugugaaaugggaauaguuuucauggguuuagaugauaggaagcacaugccgugauguaggugcagaacagggaaguacuaaagcaagccccuugagugcugguuuacucaguagcaaaucaugcggucugacuggagucuuaauguuguugaggauaggauugaaaagaaccugcuugguuuuccuucuuccugcucuugccuuuccuccaccauaaguguguauguuuucgguaagauuuuuaucuuugggccucuuucuuucacuuccuaggacauuuuauucaggcccaugguuuuaaugaucacuucugcaaauauucaguucuuucuucuguccacaauuucauucucauguuuggccugugcagaucuccaacucaguguccuaagugcuaaugaaauacauugcuuucugucugugcuuuucuuuuuagaaagucucaugcuggacccaucacugccuuccuuaaaaacacugauucuuauuucucuuuaaaugugguguuguuuuuauuagugguaucacuguuuuaccuacaacggaggcuuagugcuccagccuuaucuuuguuugcugcuuugucugccucucugaguugaguuuuauuauuauuauuugauuucuaacuagucuugccauugcuuaucuuuuccuuuuuguaaauccauuuugacaauuauuacuuaguuuaaacauuuuagaacauaauauuuugcuauucucuccccuacucaaaaauuuauauuagagccccauaguccaguggucucaaauuuuaguaugcauuaaaauugccaggaagacuuguuaaaacacagauggcugggcccacccucagaguuugugauucuguaggucugggaugagacccaagaauuugcauuucuaauagauucccaggcagugcugauacugcugguccagggaccaugcucugagaacugcugccauagucuuccaaauaugguuugggcuucuuaguuugacauucaugaucuuuuacagucuggucauauucugccuuuguagccaugaucacuuacugugaagcuucuuugugugcucuuuacuuuaaccaaagugaccuacugacagacagcuuuuuguacacauccuguauucucaugaguauacaggcauuucccuuaggauuucguucagucucuuguuucaucuugcuugucaaaccaucuuuuaagauuaauuuaaagauuuaguucaaguggaaucuuuucucuguuucuuguuuuuuguauuuucuucuaucauccuucuuccaagccaaaguaaucucuugcauugcacuauuccuuuaugguauuuguugguuuguaguuuagcuugacccguauuuccauuuuccaucccuuauccaguucacucuuuguguuuuaccuguccaacauuaguuacagagcauauguuuggugaugggggaaaugaaauuuucuguagauuauaagcagaaggccuaauaagccaguauucccugaauauugauagaggauuuucauguucaaagaaauggguuauaguuauuacccugaaucucacugauggcagcgagauuuaaauucuuacuuucuccccuuaaaaaaggacauuuaaaaauuauacuauguagcaaauuaaugggaucuccuaauuauuggcuuucuuaaagauccuaagagaugagcaguaccuuuuaaagguaaguaucuuuuuaaugaauaaaauugugccuauauaacauaaugaauuccuucaaauucuuaauggcuuaaaguuuuuugaguuauauuuuauauacaauucaauguagagauuuuagguguauaguuugaugaauuuugaaaacuacacacucaauuguauuaauugagauuugauucucaaauuuuaaaacuuucacuuucuuuuguagaagacaaugaagagaaaucuuuguauuacuguaaaaccuguuguguauuguuuggucacuaauuuaaaaauaaauuccauugcuaguuuauuucccauacuuggugauauguuuaaaaucuuaucccagcaaucuaacaacuaacuguagauguuacgauugggguugggaaguuuuuuucucucacugucugugucagauaaccacugggggcucaccaucugcauuuguguccauaagcuuuaucuucucuccuacuacuguggauucacugucuguguucuugcaaagugaauuucuuuaccuguguacuugaucucauccccuaucccuacucuaaggcaguccuuuugcaauuuuucucuccucagcaaccauauuuucccuuuucuacuguaauuugcucauguguucaaaccuggcauuauuuuucuuaccuuuacacacaacagaagaacuucuugacucuccuucucccuuugguuauugccucauucuucccuccuuugauuagaaaacaaaaacucucaaaaggacuucuguacuguuucucuccucuuguuuuuucuugagcucacuuaggcuuuugacuucauuacaccaccaaaauuauucuuauugugcuuauuagugauguccauguggcuaugcaguguucaguucucagucuucauaucacucacuagugucaugauaugguuuaauauauuuuccuuuuuaaagcaauuuuuuaaaaaacuugaucuuagagaaaccaugccauccuuauuuuauuucuacuauauugguugcugcuuuucaguuuuuuugcugguuuccccuuuaucuccuuggacuacacguauuagucuguacauugcuuugcuuauuuuuacugacccucuugguuaucuuaccuaauuucaaggcuuuuacauacccuguaaccgaguccugagcucuggcuucauauauccaacugcaucaacaucucuacuuagauaucuauuagucaucuuaaauuuaagguuuaaaauugaguccugauuucuugcuugacucaaaucucuucucucuugucuuuguuuuuuacaauggaguugcuguuuaaacagcugcauuauaacaaucuuugagugggcccaaaaauuuggcaucauccuugauguuuugugaucucaucugccauuguugaucguugcugggauucauuaauuuauuaaugguugaaaaaaugccaguauuuuaauucuauccuuuuuuuucauuaauuggaauacucuuuaaagaaacauuuuaacacaucaauuauuugguuuccuguuuguauaggaaaggcaagaaaaaugauugauugaauccccuuauuuacacauauucaaaauaauuagguaguuuccaaggauccucuaaaggcaaugagaggcaggcuuguguguauguuuaguaucaugaacucaugauuuuaaaugagcuucaggcuauguuaucuuuuuuguuguuguuuaaauugccccaguuuuggccaguggaaacuuacuuaggcucgcaccuggauccuuuaggcacaaccucgccuuugauagguuucuugcuuuccgcagugacaaaauguuccauguccagcuuguacauuucuggccccagaguucugcuuucuucagcuguuucuucaaggagcuuuaauuuuguuuagucagaaacaguaucugauagaccccaauccaagugcuagcagcgcuccguuagucauuguuucuaugucuucucaguggauggggcuaagaaauauuuuguuguuacuuuuuuuucaaagauaauauacacuaugaauucagucugauauuuaugauucagauuuaguacuacaggguuuuaauuuaacuuuauuggucuuaccccuguauuuuccuguagucacacugaaaauuuugauucuuaacaauaccagcauaacuagucaggauaagaauacuaauguuaaaaccagugguguaauuaccaaaaacaguuuaauuaucuuggaguucuuuuuuuuguuuauagacauaucccucuaggcaaauaugauuaaaaucagugaggauaguuccuaacuguaugguuauaccacuaucuagauaaugugguuagguugaauuguuuuauuuuacuugugauuuuuaaggauuaccuuuuaaaauuaauuuuguuuuuauaauuauuguuuuauacaaauauauacaugguuccacagucuaaucuaggaaacaaaguauaugcaaaaaguaucacuucugucuuugucucauauaccguauuuucuccaucccuuuaaagauaaccuuucccccucuuauuuuaugguuuacuuguucuuuaauuuuuaaaauacaagcaaaauauuuaaguauuuuuauucccuauuuccuuagcagauuaaccuuacuugcuucgaguaacaauauacuuuugauuugacuuguuuucuuaguuucugggucucacaugcuaggaaguaugcucucugaggguagggauuuuuguuucuuuugucuugcucuauucccaccauugguccauaauagauacucaguaaauauuuuuguaaauaauugcauugugcauucaugguguuuuaucucaaugcaaauuaaaauuuguuaaaauagaagccauuacuaaauacuccaauuaagagugacaagauaccaaggagcucacacuaguauuguaaaaguuuauuuuuuucuauuguguaauaaucuuuucuaguaacuugugagaagcuucucacacaaaguuacaaaauguuguuugucaauuaacaauaaaugaauaucuguuuuucucgucaaucacgugaauaguauuuuccccaacacuaucuguuaacucuaugcguauguauucuuauguacauggauuugugaaggugguucaauaaagauuuucaaaucuaauagugcauggugaauguuuaaaugaauaaaguguauguugugggaauagagaguauuugggaacuuuuuuguuuguaacuuuuaaguucaggaguacaugugcaggaugugcagauuuguuacaucauuaaaugugugucauggggguuuguuguacagauuauuucaucacccagguauuaagccuaguauccacuaguuacuuuuccugauccucucccucuuuuuaccccccacccucugggagucuccaguguguguuguuccccuccauguguccauguguucucaucauuuagcucccacuuacaaaugagaacaugcaguauuugguuuucuguuccuguguuaguuugcuaaggauaguggccuccaguuucauuugugucccugcaaaagacaugaucuuguucuuuuuauggcuguguaguauuccaugguguaaauguacugcauuuucuuuauccagucugucauugaugggcguuuagguugauuccaugucuuuacuauugugaauuguacugcagugaacauacauaugcaugugucuuuauaaugauagauaugauuuauauuccuuuggguguauacccaguaaugagauacacuaguuugaaugguauuucugccucuaggucuuugaggaauggccacacugucuuccacaaugguugaacuaauuuacacucccaccaacaguguaaaaguguuccuuuuucucuacaaccucuccagcaucuguuauuuuuugacuuuuaauaauagccauucugacuggugugcagugguaucucauugugguuuugauuugcauuucucuuaugaucagugauguugagcuuuuuucauaugcuuguuggcuguauguaugucguauuuugagaagugucuguucauguccuuugcccacuuuuuaaugggguuuuuuuuucucauaaauuuaaguuguauuugggaacuuuucguacuuuucacucaguguugcugugaacuuaacaagccugugaaccuaaaacugcucuagaaaauaaagucucggaauccauggcauguuuacaacauuauagugaugucaguuagauuugugcuaugugucuuauauguaaaauuguugcauuuguauaugaugucauuaauguuaguuggacaugcaaaaaucauuauuuuucuucuauuaguauuaaagugaaaaaaguaaauggaauaucccagaaacagaacuguguauguuuaugguuaaguugaaccauaggcaaacauugauguccuaccauguuucaguuguauaaagauaguguugcagauuauugggaauauuaaaguuauuucaauaaguaaugcuugaguaaugaguuaagauuuagagaaugaaacucaauucugaccuuucaccuuauaucaaaaauaaaccagauauauuaaaaaauugacaaaugugaaacuauaccaaaauuagaagaaaauauaggugauuacuuaacagaacuuauuggaaccugugauaagaaccuguccguucccuuaauguagucugaucaaaccugauucuuuaagauuaguaauggaggaagaaucugaugaguggaacugcucaagucauagcuuugacucuuacuuccagauaucuuucuucucugugugaggggccucacuauuugcugcuguagucaccugacuaguuugugugugugugugcgcacgcaugcgugcacacauguauguccacaugcuccuguaugcuugcacuucugugcacucuuuuuuucugacuuuccgauggcauaucccuuuccuuuugcuuccuacaaagcugaaacaaauuuugaauggcuuuauaucccuuaaucuuuagaaaaaggaugcauagacauaaaaauaugcaguuggauaaucugguuuauuacaucaguuuaccaguuugguuuugugguuucuuauaauucgcggucucuuguguuauuucccugugucaaaaaccaucuuugcuuacuacuggucauuaaaugauuccagacccuguauacuagaccuaagauauggggacuagcaagcuagaguuuuauuugacuauauuuuaggaugauuuuggcugcaaguaauagaauaccugaauucaaguggcuugaacaauaggaguuuaauauuugaaaaugcauuaucauaagugaggagcuaaaugguuuuaagguuaguacagaggcucagugauguguaggucucugcguuagcuuuucuuucauuggcuuucuacucaugguuggacauggcugcaguagcuccaaguguuguauucucccaugauaacaucagaacuuaggagguuggagggaugcuguucuucuuucaucucugucucucuuucucuguuuuauuagagagaacacugacagauucccauauuaaaauaaguauggaauaaacauuuuacauacgaaauacaaauaguuaauaaaaguuugagaauuuauaaucuuaaaauuauaauaaauucauaucgaaacguauuacauuuuauuuuucaaaugguacaaauauauauauaaaaugauaaagcuugugaaaaugucuugauucagguacucauaauaccaguguggguggggagugggggaaauuggccgggccagggcucucuuugcagauuaucugcagucagaagugugggacuuggaggagggggcugaggccacagccgcaucuugaucaggcuuucuccagcccuccaucagccucaccagaucuccauucuuugccacgagggccaacacgugagaccccaucuuccugcucgccagcccuagaccuguuggagcauaaagcgcuuccuccccaggucugaguguguggggcucugcuuuggcacugccccacggaagccacggccucuucauucuguuucuguuguuuuguuuuuaacaacuguacuuugcacacaugaaaaaaaaauaauaaaaguuguuccagaggcaacuugacucuguguaucaaaagccuuauaaucguaugucuaucuuuuucuaagaaccuauccaaaggaaaucaucagaaguuggcaaaaauauauauacagggaucuuucuuuauaaucaggaaaauuuuuacaugcuguaaacauuccauaauagggauauugcaggugaaaauuccauucuaauuuacaaaagcaaaaaggaaauguauugggucauauagcugaacaaucuagaauuguucagguaugauuggauucuugugcucgaacaccugucaucagaacucugccacucucucucagcuuugcuuucuuugcuggccguauuauucucagguucauucucccuguauaucucucaacagcucuaggucaaauccugcuaguuuucuguggccacagcagagagagcuuauuuuuuccagguguuccaacgaaagugcugagugggauucauauugguucuaauaguucugacauggucauaugccuaccuccagccccucccuguggaauagggauagucuuauuggcuaggcuuccucaauucaaacaugcaucuccacagaggggacgaacuggcagaccgugacauguuugcaaaaagaaguaguguucaaaaugauggccuuguauuugaucaggcacaguggcguacgccugaaauccuaguauuucgggaggcaaguuggaaggauugcuugagcccaggaguucgagaccagccuaggcaacauagugagacauugucucuauaaaaagaaaaucuuaaccccuccccaaaacuucauaugauaaggcaguuuauuuuagaauguuuuccacuaaaauugcuuaaaauuagaauguuuuggugcuaaaagaggcagccuucaguauucuggaaaugccuucauuuucugacauugugggauaaauuauguauuacuaauucuuuaguuuuuuuuuuuaaaggaaauuguaauuaauauugcagugaccauuaguagucuugggauuauuggguaacaaagggcuagugacuucucagaaaccaagucuuugguuguuagaagauucuuguuagcuuccuugagaaguaaaaaugaggagaacuacagaauaaugacuauuaaguggugaugauagguaaggcacacccuagugaauugacacaguacauacaguguauucauuuuguuucuuuguagaauauuauuuuuucuucagucuuaaucuuccaauaucacuuuuuacggacuuagaauagaauugcuuuucuuuuuguuuagauagucucuuauuuuuccuuauccuauuacauaguaaaucuugacaaauuaauuuugauacauuauauuuuggguuuuauuaauauuauccauauuuauagccagaguuauucucugaaugcugagugccacaaagcuuucucauaauuaucaaugucuguauucauucaaaauauuucuaaaaguagcaacuccagaauuuacuuugguaugaucugucuuauggucuaaauuauugaccuuuauuuuaucucacaguccucuauguauuuuaacauaguuaaguaguaaaauucuuuuauuggugacuagaugaacuauauaacucaucauuaaaauuauaaguacuaauguaaaguuucuuuuucaaugagaacuaugugugguuuauuauauauauguauagugaaauaaaggcccuauagugguuaugaaauugguauccagcuucucuuuccaaagaaagugguaauaaccucuaaucagugugcuugaggaacaguucugauacaguuuuaggucugcuuccugugucucacucugaaaugccuccaucuuacuucagggucuuuaugguugaauuugcguauguguguguauuaacuuaagcaggugcucacaguuuaauguguaaauauuguauuuccuccuuggcuccuccucuuaucuuccugauggcccaucccaucccccauucauuaucaguguuacugcuugugauuuuucuccuguaacauucuuuauguucauaaaaucauaugcaaauauauacauaaguuuuuacguuuuugcuuuauaaaaauauuaaucaaauugaauacuuaaaauauuuuaaugaagaauauuucuaaauuguauuuuauaaauacaauauagcuuucuuuuaagugcuuacagguacucacuuaacgugaaaguaaguguaacacacgguauucucagugauggauacuagaaauaauuaccuggccuuccauauaacacauaaucuuaucugcaauauauuuccacuguuagugcucuacaacuuaauuagagcucuaguaucaaaaagaaccagugacagcuauuucauguuuuaagcauucagacuaauuguagucuuuauguuuuuaugacacaaaacagcuuucaguugacucuguugaaauuaaaagcuucuucaauauauaauuuuugucuuauugguauuaucuuauguacaaaaacugcauaccuaugguacaaucuacacacuccuguuuuagauagaaauuuugauucucucuugaaccauaaauucagauuggaagaagcauuauggcuugaauguguuccccaaaauuuauguguuggaagcuuaauccacaauguaacaguggugggugguggggccucaugggaggugcuuagacuaugaggggauuagugccacaauaaaaagggccugugggagugggugcucuuuuaugcccuuuagccuucugcuauauuaggauguaguaacaaggcacucaccagaugaugcuggugccuugauuuggacuucccagccuccagaacugugagaaaaauaaacuuauguucuuuauaaauaaucacacagucucaguuauucuguuauagcagcacaaaauggacuaagacaaagguguuuuuugauagaaugccuccuuucaugugacccuaugacucugggaaugcuguguuguucuugggaguuagcaagcagugccuugguggacccaaguaacauuaggcuagaaguuaagagagaguaugaaaauguacauuagaagcuuucauagguuuguuguucuuuuuuuuuuaaauguaucagaucagccaucaaagcuucuaaucagcaugaaacaaauuccagagugaucaaacucaacugauguaauuuuauuaaauaucagauagcuauauuguaagcuuuucuuuuuuauuaaggguaaacggauauaccugcuuuuacauuuugcccugauggugucauaauuugucaaauguuuauuacuggugggcaguuuggauagucauaaaauuuuuauucauaauauugcaaugaaaacucuugaacuuuuuauacaguuaucugagcguuacuauagaauaaauucugaaaaguagaaauucuugguuaaagguaaugagcauuuaacauuuuaauugauauugcuagaauuuucccccugcaaagguuacacuaguuuguacucccacagauguacgaaugugccauuucccacacaaagucccgucuuuucaacucagggaaacugcguggcacuguuggguucccucuucuugcaccuuuuccuagaaauucucuccaggaacucauuuagggcagucauacggcacaguuguuuguuucuggucaucucagggaucacuguucuuuguguucagugccuuguguucaugccuuguguucaguaucuugaaaacuguuguuuguauauugugucuguuuuuuaguuguuuuuugagggccugugaguaugguaaauccggucccuguaaccucaucuuugcugguaaugcaaauucugacuuacuaaaguuuagcaaauaaaacacagaaggagauuuuuuucauuuguuaaaucugaaaugcuuaccucuacuuaaagugaauauuaacaugaauauuaauguuaauuccaaaugacuugcuauauauauuuuugauguaauggugauuggauauaauguuaacuuaugugauugugugaguauugaucaugucuaaguaauggauggcaagaaacacucaaguggguauuuagguaugcagaguucuggcaucagaggccaaagccuaaugguagauuuuggcuggaucauggugggaggcaaaaggacuucuuacauggcggcagcaagagaaaaugaggaagauucaaaagcagaaaccccugauaagaccaagaccaucagaucuugugagacuuacuaccacgagaacaguaugggggaaacugcccccaugauucaaauuaucucccaccgggucccucccacaacaggugggaauuaugggaguacaauucaagaugagauuuggguggggacacauccaaaccauaucagaggaugagaucaagguuauuaaaacaaagaaugucuuaauaguaaccucuaucucuauacaaauuacggugucuuggguugugaguuucaguuaagauuugguauugcuguuguuuguagauuuaauucuuagaucagugauuaucagcugguguuuguaguaccucacacugucuucauucguguccaagaaaucauacagaauauguaaaucaagguaaaaauucagcucauuauuuugaaaaauaaaugauuuacaauaaaauaguugacauugagugucgacuauguaccaagcacuuuuuuuuugcacuucaugugaaauaaagaacuuaauccucauaacccuuugaaggugaccauuuugcaggggagaaaacugaagcacagagagucaaguaacuuacuacagucauaaaacaaguaggagauuugagauaucuguguagucuagaccaauucugugcucucaaacacugugcuaucuguuugauagaacaguuuuaagaugaagagagaaacaugggcaguucaugcuuuauuaacauguuaucacaucuaagaguuuaggauccaugcauuuauacagaacauccaggugagcaugguggugaagaacuuagacuuuagaauucuuuaaaacuuacuuccagaauugggucuccuuuuaaauagcuauaugaaauagaauacauuacugacucucucuuagccuuaguuuuuucaucuuuaaaagugggaauaauaguaguacuuuucuuguggauuuuuuccucugagacauuauacuaagcuauuuuaguaguauuuucaagaccuugcaauuguuuaugaagaacccaucuguuuuacugacucacauaucagaccuuggacauuguguuguuuugaugacaggugucguuugggaaagucucugcuuacauugucaguaaagaaacuguggugguuuuccgcuccaucccuguuauguauuuuguuucaggauaucugaaauggguguauugggaaaccuuacauaaaugucugauauuccccaaaacauguauuaaaccuuccaauauaaucagagugaugcucauuuauucauguuuuaaacuuugacauugauucaacauggacauauaaaaaccacucaaaauauuuugucuaacacuuuugcauauacuauguaugccuuuuaauuuaaucuuuguaaccuuauguaguagacaauuuuauuuuccucauucuacagaagagaaaaauggggcuaaugagcacuuaaaugcuugcaaaugucuuauaguaaguaguggagucagguuuugaguauaugucagacuugagucugcaugccuaugaugauaaaucaccucuccugaguauugacgucuuaaaauuauguaucuaaaaauagaaggggaaacagacuuauggaaaucaggauaaaaauugugcaaaacaggccucccgaggaacuaaaaguagaaagucaccaagaauggaggcuguuccuggugcuaugucuuucccuguggucaccucuguucucuuucauuauuuucucuuucugcauauuuauuggcuuccucuguuugccuuaccaccuagacugucucgacuacucauaaaaugguacauucaacaucaguguguuuaucacccuaaaaguccagagccauggccaagugguccaguuuuucaugaucucaguuauaauuuacugugagaagaauccugccauccuggcacaggcucaggguuguucuccucuaggugaggugucugucaguccuuugaucagauagcugugguuauggaugauagauugagagggggugacuagacacacacagggaucuacacuaauguuggugaguauuugucugggaaaaggguauggccugaauacagccccagaaugugucuauaauaacauauaucagauuuuauuaaaguggugucauaaaaauaacagcacaaauacaacauuuaaguuacagguaugagaaacugaaaucaguuuauuauaugaaaacuaacuuccccaaacuggauauguaaagcauuaacuuucagugguacuagaagaguuuauuuaaaagaaucgucugagcgaaucuuuuaaaaagaauauucaguagucauuuauuugcugagcacucccuuauguaccuugucaauuuaggauucccuauaguagguuugcauauaauuggguguauuuaccagggaacucuacauuauuugccguacauuauuugaagacucacuucauugaauuucagauccuauuuucagauuucucaauucaugaauuccaaauaagaaguauuugucuuuugacaaaugaauacaaagaagaaguauuugucuuuuguguaugcauuuucaguuauuggugacuguuuuaaaauuucuguaguuacccuacuucauugcuaaaaugaggagggguuuuuaauaaaguuuuugaaaagucugaacaaucagaauuauaugcuuuuuucuuuaggauacugggaaaagguuccauagaaccugaugauuuuuaauguguuugguucauuuaaacauuuucuaaacaaaaauauuucuaauuauacugguuucuagucacauuccgugaucagcauguugaagaucuguaagauacagaauauacuuuuauuucaugugguuuguuacgaguuauugugauauccuggagacauacuucuguuuuaaaacagaaguauuuuuagaugguaauuccagggaaaauacaauucauuguguuuauucaauuuucacccaacuuuauuaggaauuuuauuucuuaggaauucuuuauuauuuuuucuuagaaauuucuuagaaauuaaauuccuuagaaauaaaauuucuuagaaauuuuauuucuaagaauucuuaggaauucuuaggaguucuuuuauaccauaugagcuauagguaucuucaaaaguuuuaaaaaauuaaaaaaaucuuuuauuuuguuaaguauguuuggcauauauccauaagcucauucuggcuuuucuaaaauaguuaaguggcuagaauaccacaucuagucauguggaaauuugcuuauuuucuguaauauauugauccugaaaucacagaacugcacguuuagauuguuugaguucauguaguaaagauaauuuuuuaggacauugucuuuaauauauauuacguaaaugaaacaguugccauuuguuccaacugauuggaccauuuccaaggcagauuuccucccugcuauguccauuauuaugauuuucagucuagaauuucuuuccagcucuuggacuuuuuccaagauagagacaacuucugagcaucucuuugguagucucuacugaauuuugaaggugucagucaagaagaguuggaugacaggaggacuuguagcauucaggcaggcccccuuaaauauaacuuaaggcagcauuuaguaaaaaggaguaaggcacuauuuagagcagacaacagauuacauagauuuuuuuaguuuaguacuuuucaaacuuuugaugacgaaagaccagauguuuaauuuccaguauauauguacaggguggacaaggugagcauauuuaucauaugcucggcccaguugcuguggaaguguuuucuaauugccauaaugcugacacuacucugcugaaugaccacauguucaacaguguuguugauccuagaacauuguuucuuuauuuugcucccaagguuguugagccucagaaaaguuaaaugauuugcucaauauuauacaauuguuaaaauuuucuuuuuuaguuucaguagacagcaacucuacucaggcagaauuugguguuuugucugaaggugauguucauugccaguguaaaagucagaaaaauaugccucuggcauuuguagcugugggggaauuuucaguuucugcauuguggacuucugaaaucuuuuaugugaucuuauaguuuuggaacaauagaaaaaaaagauaccauauaaaauaacgagacaagaaaaauaaaaaauauugagguagaaaaagcauaaacaauuuaaaaacuauuaguuucacauaauuagaguaauggguacauauaugagcaaaguaucaagagauaaggccuaaaagauucucagagauaagauuaauaagugguauuaagccauaaaauggaguuugcuuuuuauuguuagacaaugggaaaugguuuaaaaaguaauauagaacagguuaguuuuuagcaaagaugauuucaaugccuuuuuuuuuuuuuuuuaagagacagguucuugccuuguugcccagguuggagugcaguggugcaaucauagcucacugcagccucaaacuccugggcucaagcaauucuccugccucagccuaucucucucuauauuucaaaguaagauuaauagaagguauacuucaguuuuguaaaguauacuuuagcucuaaacaccauaaucaaaugucuuugaauuaaaaguaguagcuuaaaaaaggcagaagaacauagaaauaugaugcaguaauugagaagauuauuauuuauuauguuuugaaacaucgcugucaccaaguauuugguaaaaaugaaugcagugauauugaggcaguauauuaugcuguugaauauaaccaaauggcuugcguuggaauuucagcucgauauucauuauuuuuucaaccuugggcaaauuacuuagccucuuugggccuugguuucucaucuauugaaugaagauaaauaaugcuuuccuuauaggacugucguaaagguaaaugacuuucucuguauggacagauauacaguggucccuuggugucugugggggauuaguuucaggacucccucuuccccugcggauaccaaaauucauggauacucaaaucccuuauauaaaaaugauauagcauuuggauauaaccuacagacauccucccauauaaauuguuucuagauuacuuacaguacuuaauacaguguaaaugcuauguaaauaguuguuguaauauauuguuuagggaauaaugauuuuuaaaacucuguaccuguucaguacagacacagccauccauuuucccccaaauauuuucaaucccacgaauacugaacccacagauaaggagggggugacuguauacaccuauuuguuauauaacuuagaauaauacccgguaaauaauaaacauugacuaaguacuucuacugcuguugcugguggugguggcguuacgauuaguagcagaagacauuucauuaaauacauuuuacaaacauguaagaauaaugugacuacaauaccaaaaauuugccaguuacuguuugaaaauagucacccacuggauaucagauuucaucuuuuucucuaguugucaagacuaagguaaugaauuuauauuuaacuuaauguuuucucuucuauaguucaucagagaagauaugaaauauaaagaugcuacuaauaaacacagccaucugcacagagaagauaaacauauaacgauugaggauuuauggaaacgauggaaaacaucagaagguaagacugccuuugugaucuggcccccuccccuucugcacaucuagccugcuuaguuguucucaacucacuuauaguaugcuuuuaccaaaaaaaucaaaauaacauuucugugaggauauuuauauuuuaguaaauaauuuucccuucuuguuuuugauagaugauuuuuaucuuucugagagucauuaagcaucaggcuguucucauauaauuauaguagaauaaauaagauaaugcaugucugagagccuaaaguuguaaagcauuauuucagcuauuacgugacauuauuauaaaagguuuagcaaauaaacauauggaaacacaaaguuuuccuuuuaguuguggagaauaguuccuaauguuuuuaggaggcuauuacuguuaagcuuuuucuuaaguaaauccuuuaugaugucucguaauagguguaugauaaaauuggauaauugguauuuuauucccuuucuacuguuaaguucucaagguguauuauggacaguaauuguuuaguacaggaaaagucugugaucuaaaaaucucaacuugguuccauauacuaggaaguuacuaaaauuaaaaaaauuuuacaaguccccuaaacuuacauuuuguuuucaguaacucaacuaaaauuccuucuuucuaaugcuucuguucuuucauaaaagucagcaauuauauuguaagcauauauuuuucucugaaaaauuaaacgaaauuaaagggacagauuaccaauuaagaguguaaagaaauaauaaaguuuacuugagucauuaugauaacauuuagaagugggaaaauaaauaaaacugucccaccaaugcucaguauuuuucuuaguguagaagaugguagauagcuugcuuacauguguuucuguugaaauacacuuggguuggggaagaaagaagaaaacaauuaugcacuuaaaagaaaaauauauagacuuuuaaaaaaaccucuccauuucucuucccuacaccauuuuaaaauaacaugagcucggauaggaauagaaauaaacaaauaucaguuucaugaggaaaagugaaaaugguggggaacucagcaacaaacuuauuuuauugacacgacauagcucagcaauccauagauacuaagaagggagguggagauccauuacagagucuauugcuauuaguauuuuuuuaaggauuaaaauauguaauacauugauuggaacccacuugacuguguuugaaugaagaaaaaaauauuugaccacuuaggucuuguacuaccuuuguucagccaccaucgucucuugccuggauaauugugacagccuaauucaucucccuguguuugugcucugcuguagucucuucuucaccuagcagaguacucuaaaauguaaauuagaucugcucauuacucuguagugacucagaguaauaguccaaaucuuuacaaagacccguaagccucuacauguucugccuucuguuuccaccucucucucaucucuuaccucuucuauuccaugcaucucucucgcucacugugcuccauucauucuggaccuguggcuauucaacaaaugcaggaaugcacacauccucauggcuaacuccaucaccuccuuuguuaaagucuuuaucaaggguuauggucucagugaaaccacucuggccacccuguuuaacauugcuaaccuccccuuuuacucauuuuuuuuucugguacucuugaucuuucuuacucagcuucacacuuuccuuuuccccaucguguaucaccuucuaagauacuauauaauugacuugcucauuauauauaucucccuuugccucacccccaagaauguaaguguuauagagcaggggaauguuguauguuuuguuuauuaauguauccuaaauaaagaggacucuauucuuaaacuccuuuuuguuuucccacccuagugacuuuggugagaucuuuugugaucuaugagaauguuuguuuacuugauuuuuuuuuuuuuuaagcuaaggccuuuucaaguugaaugacgucuuaaaccucuuuuucccuaggcuuucaccuuaaucugagaucuaaccauuaugauaaugagggauuuccucaguucaaacaguuggccuaaguuaucuccucucugcuuccuuuucucuaagccccaguuggcuauauaaccuuacagagucuggcagaaguagucucaguauuccuaguaaugcagcuguaugggaugaaagagagaggagucaagugauaauaaacuuucacuagaagcuuuauaaugaccuaauugauuuuucucaacccaugucagacucuguuuauuaaaggggucauguaagggugggguauuguugccagagcacugguuuuuaaaacauucaggcuccaggaggagucccagggacagggcauguugagugugccgggcucugcuuuuaucuguuauauuuuguuucuguugaaaauuucucuggagaaacgaaaaguaguucuucugaaaaaguuugaaaacugcugaaguagagauuagaauguaccccuaacaauaacauguaauucaagguuguuuacuugaauauauacaaaaguguguguauguguguauauauguauuuauacagaaaguguguauguuuguguguauguguguauguauauauauguauauauaaaacacacacacacauacauacacaugcaaauauaugcauucauucuuugcuuaucauuguugugucucccaugccuagcacagugcauucacuuuguauucaguaguaaauauucacuuugauauucaguaaauaauuguugaaugaaugaaagaguaaugccugauaaguauuggaugcuuaguaauuuaguuggucaaauguuuugaguacaggcauuucuguuauuagacauuaugugcauuucuuaaaaacuuaacguuuuuuaaaauuuuggacuuaaaaaugacaguuuaugggaaaaaugggacugaaggagauuacucaaaaccuguacaacuuauuagccauggcauuaacaguauuaauaaaaauacuaguacaggccaggcgcaguggcucaugccuguaauccagcacucugggaggccuaggcgagcagagcaccugaggucaggaguucaagaccagccuggccaacauggcaaaacccugucucuacuaaaaauacaaaaauuaacuaggcuuguuggugcgcucccgucaucccagcuacuagggaggcuuaggcagcagaaucacuugaaccugggagugcgcuacugcacuccgucucaaaaaaaaaaaaaauacuuguaccgcuaaaaagaauuucaaauuccuaaucaauacauacuauauaguagauauaggaauuuacauuaaaaaauaaugaagauaacuuuauagaaggauggaugggggguucuaguagaguugagguugcuaaaaaaugaagacaagggcaaagugcaugaagaugagaaccgagcaacaagcauuuccaagacagaggcucuggccaaauugagcaaagauaaagaaggaggguaaguagaagcuccuguuuguagcuugcuguauuggcaguuaguacaccuugcauccauuugauaauuacuuggcaaugugaaaugauaccauguuuggaaaagucacaugugaaaugaugugacuuuugcguugaugugaccccuaauuacuaguggcacauaaaguaauucauguuacagcagcacgugcagcaaaauagacuguaucuauuaggugguaaacaagcacugcauuggauccuggggauuaaugaugaguuaaacaugaaucugguguauacagagcaaauugcuggguaggaaagacaaagaaaacaaauaauuacacuauaaggugauauguacaauaauagcaguaaguuuaggguauggagguagcucacuggagggagugauuagcucacuauuauacacagaaggugguguucggguugacccaggaguucuagaaggagacaagaaguagaacauaaaugguagcucccccauggcaucuuuuuuuuuucuugaaauagacaagguuuugcucugugacccaggccggagugcaguggugugaucauaccucacugcagccucaaauuccugggcucaagugagccacuagaguaguugaggcuacgggcguauaccaccacgacuggcuuauuuuuuauuuuuuguugggacgggaucuuacuauguugccaagucuugucuccagcuccuggccucaagcaguccuccugucuuggcuuccuaaagugcuaggauuacaggugggagucaccacacccagccuccuucuuuaguuaccugaaaauuugcuagaagugaaaguggaggcggcaugcuauagaaaguauguaggcuuucaaacuauacagcuuuaaauucuggcucuucuauuuaugaauagugaggcauuggacagauuuugaaaauucacuuauaaaauguaauucuugugugacauaaaucaguaauguagugaaaguacuugacauaauuuauggcaacaccuguuaggcgcuuaguaaagguugauucucucauucaguaauaaugcgaaauaaacuaaaaaguucggccauauucaaaguuuuguacuguuuuugacuuagucucacaauauuuauugauaaaaugaacagacuaagcuauauauuuaccagcauugugugcaaacucuggacagugaaauguacccaagaucuuucuggaauguugucaacugugggaaaguaaaauuguuuuaugcagaaguugauccugaccucaaauagaauuucagcaaugacuuuaaugcaguguguguguguguguguguguguguguguguguguguguguaugugugucugugucuguguguagagagaaugcuuggucaaguugcacauggcagcugucuaaugcaaaugaaagccauuuaaaaacuaguguuagauuucagauagauuuugauaaacuggauacauugugagaauuacugaauguauuuaaauaguagccagauaccuaaugcaggaaauuguacauagaaaauauuuguuauauacaagauuuagagacuauaguagauaaaaaacugauuaaguaagacacuguuuuuaaaaugaaaacucacuggguuaguuauuauaacaugugacaaccaugagguaaucuuuccauccuguucagcacaagucuuaaccuaccuaaggucacuguuuaauuuugggcuuuacaaauugaauagacauuuggaaauuuaagauaauguuuauuuauuuaaggguuaaaaauuuaaagcaacugaaauagucugagagaagaaagauacaggcacuuaauaaugguuauuuucaaguguaccuaaaggcuagccagagacuaaaugaccaagaguauuuucuuuuuguuuaggacagcgaaaauauaaguauuuuauaaaaggaaauauaaagaaaaaaauuucuggccauugauacaaaauuccuaaaaguaagggaaguuauaaauauuuuaaaaauaucuagaaccuuuauauccauaagauuuuucuucuggguaugaaaguauaaagggauuucuaaauguugauaaaauccaccagcucuuuaaaguguaugauguugguugcaaugagacuagaauaaaaaaacuguaaauagaaaaguguguauuguuuagcauuaucagaagaggaacuuaaaacguaagccuugcagaucuaauaagguaguguuaucuuuguggcauccaucaacaaaauauuuauuuguauauuuacaauaugcaucacacucauuaguagaaaauaaggaaguaugagagacaaccuuucuccuccaggaguuuaacaguguuuugcauguaugcagaugaaauguuaaauagcaauucaagaagguuugauuaaauacuauauaaaugacacgauugcaggaaucuaagagaauggacagauuuauuacagggaagucuucauuagggagauggcucuucaacaagacuuugaaagauaaaauuuucauagaaauaagagagggauauacaaguuagcacauuaaaaugaguccagauguaaaugcgaaauccuucaaauaagcauaauuuacacaagagauaauacauuuuuaguguaugugagauaauaauaaacacuuuaaaaauuuugucuuuugcucuuaccauguagugcauaaccaucucaugucuuaguucugucaucuguuaaaugggaguaaaaguugucuaccacauaguaagugaugaacagauaucuauuacuacuguuuuuggaagguaaaucugaccauggcacauuuaugggauauugcaaacucauauugcuggaagaggcagcugaguuggagaauacugggagauugggucagagaaggagaccagacuguagugagucucuguguaaaucugaugggcagcuccaagaguggcaaguaugauuccacucauauuccagugcuuaccaauccauagugauucgcuggagcacuguauuaaggaagcuuggucuguaucugucuugauagcaaaaaaggguauuauuuuagcaauuaucuauuagcaauauuuacugugugggaggugauaguguauuuuagcauuuuaucaucauugcacuaaguauuaagagcuacuauagcuucuugcuuuagaaggccugguaauguagaagaguuauaaaaagacaaauucacuauuggcaggaacauuagcauugaguugaauauaauguggcuuugagugggaagaaugaaacuugaauucugagcaguguuuuaaaggaagauuuggguuaacuuuuccccuguguuuagaaugaauuccaguuuuuuucucccugugauuuuuggauccacugggcuuggaggggggguuuauuuaacugauucauacaggaaaaauuuucuaguaaaugcuuauuaugagaaagcccuuguccuagguacaaaagauacacagaugaagaauguguucucuguccuccacccaucuacaguguguuggagaaagaucuuuuaacaaguaauuaagggaugugcugugaucuguaacugagauuauguagaaggcacugugggauaauaaaaggaaaagcauguccauccaccuacagaaguuaaguaaagccagacgagcugcauuaaggaacauuuacuuucaucuuuugucacuccuucagugagagacgcugugcuagauuaauagcuaggaggauauuuguacuuaauguagagcauugaaaaaacacaaggcuguuaauaugcuacaaauaccugugcuguuuuaguaaaucagguuuuaacacuuuuccacuuuccuacagugcuuuuagcuuuaggggaagcucuuauuauagccacaguggagggauugaguuuuaauuguucacagaaagcaccuuaugcaagggaagguccauucuugagguagaguguaguuucagaguaacagaugucaucauuucuaccacuaacaaaaggucuuuaauaguccggguuucuucugugaagagaauaggugacaccaguauguugcucauucacucugucaaccaacauuuaagggaguuuaacauggguuugcuagaaaaauagugucucucuugauuaauuuacaaauuuggcaaacauuguuuuguauuaaucauuaguuauaauugauuuuuguacuucauacagaguuugcucccuuuucccuuuauuaucaaauaacuuucuuuuauaaaauuauccaaaugaguucagagcacucacaguaaguugcugauugcucuuaaucaugaucuuauguuagcauuuuagugucucuauucccuucacuucaaaucuacccaucagggcuguuuugguuuuauuaauuuucuucuuuuucucuuucucuuuuuguuuuauuauucucaguucuuccucuuucacuuaaguacacuuguguuuuggagauuuuggaucauugcauaugcugauuugcugggauuaauucugucuuuuuaguuuguggaagauacuuugagacaauccugccuucuuuacauagauuguucuugguuuuauucugaaauagagacccccucucagaagaagaugcagagaccacuaccuauuacaucucucuguccuguagaaaacuugacaauucuauucuguaggaacacgugaaauaaauguuuugagccuuguuuuuucucacauaacagguuuuccaguauauaauucaacaugugaagcuuuucuuaugauuuaaggagguacuauucuaagauuguuugugaguuugccuuauuaugguuuucuauacaccugaauucuacauuucuccucugcuauguucacagacucaagggauaccucaagguuggaguacaguaaaagaaccuucugcagaagguaaaaaugagggcuguccacuuuucacugugauggacuaucuaggaaacaguagccuuuuuuggacaucauauuguccuuucuacccuuuuccuaguaguuggaaaucaguugcauaugaauguguguuacauuuuccuuuauccaucuuuguuuugggaaagaggugggaaggagugacucaggaaauaguuuuagauuuugaaauguauguuauugcaggagagucacuauauuauauucuacuuuauguagaacaaauauuuuauuugcugcuuuugaauaaaggacuuguuuguugagaaugacauugucuucaaagauggucaguuaacuuuuguuucuuucucagacaagucuuaugcuuacuuaagucuuuuuccccccauuuaacugaauguuacuuagcauuuuaauagcgacuguaauagaaauaauguaaauuacaaauauuaauacaaugaaaacuaaaacuuuccaagguauuagccagccuuuugaauuugaauaugaccuuugcucuuucuaaaaauucuaaacauuucuaugauucugauauguauauuuauguauauauuacauauauaaauguauagcucagaggaaaugaaugauaaaaauagaauaaaucacuuagcauguuuuuauaucuuauaauuaaaaaccguuucaaucucuggaugguuacucugcauagaauagaacaaauaaagcuuauaucuuucuaucuuucucaucucaucugguuuuauauuuuaaagauaagaaccucuucaauaaaagguccucaguaagcauucuucuaacccuuggauaaucuucuguuucucccucucuuugcaucgacauuaauucuuucaggauguugaaaauaauagaccauuuagauacuuuugauuucaguguuuuaaucagauaauuacuuaauaguuugaaauuaagaaucuauaucagucugacaaaaugaaacagaauggcacuuuucauagagggaaauuuaucguuuuuauuuccagcaacuuuucuuaccaaguaaucagcuaaaaaaaugcaaaacagguguuuaucacugggagauuauaguugcauaagggcaauguucuaaaagcaaacaaagagauuugugauucacucauguaaagguauaauaauugaagucauauaaauucagaguucacuaaaagaaggaaagggagagaguagccuuggggaagacuggcauuaaggcaaaggcaaagaacugaugaaugaaaucaguaauggccaucagagacauggagggagaaucaggaaggcacagugucaugagcaucuagagaggggaguguuuucaggaagggauagacgguaauauaguagggcgcauagacuugccauauugcaaagugucugccaagaguccuccugaauaauucuucauuuaggucucaguaauaagaauagauguacugcugagcagacauuuuguguuuauauugugaauccugugacugauuuugcuuccuucuuugucugccuuuuuuaacuguuauuaaggaucucauauauuuuguaagugucuuuaccucagcuucauuuuaucuuccugguccagcgacaucuuucaucuuuuauucucuuugcauuguaugcaucuucguaagugauuucuucccuccacuuuccucuucccccuccccccuccuccaacaguggggguuagagagaggaaagaugaaaaguggcuaguagcuugacacgagaaauaugauauacgugaaaaaacccauuagauuuggcaagaauaaaaucauuauuaacaggcaggaagaucaguaguuugagacuagccuggccaacaaagugagacuccaucucaacaaaaaaugaaaaaaauucgccagucuugguaguaugcaccuguggucccugcuacacaggaggcugaggcaggaggaucacguguacucaggaggucaaggcugcagugagccauguuugugccacugcacuacagccuggaugacagacugagacccuguauccaaaaaaaaucauuaaccuucaggaaauuuaaauauugguauggggaacggagugacauacaugcacacucacacacacacacucaaaucuugagcaagauuuaaguggaagcaacccaaguguccauugaugaaugaauggauaagcaaaauguggaauaugcauacaauggaauaguaagaaaauucugacauacgcacaacauggauaaaccuugagaacauuaugcuaagugaaaaaagccagucacguaaaaaauauugcgggauucuacuuccgugagguacuuagaguagucagaaucauagagacagaaaguagaauguuugguugccagggucuguggggaggagagaacagggaguuguugaauggauacagaauuucaguuuuguguaauaagaugaaaagaguucuggagauggauugugaugaugguugcacaacaauaugaauauacuucauaccacugaauuguauacuuaaaauugguuaggaugguaaauuuuauguuauggauauuucaccacaaugaaggauuuaagagaaugaguauguacaaaguagaaacagugggugaccuccuauuuaaggaauaggcaagaaaauggagagaaauguaaugguaauuuuaaauggguagucugaugagguagaagguuuucuuaagaacugguagaucugggcugcuuaaaagacaaaagggaagcacuggacugauauuuuuaaaguugaacauuaaaaaauaauucagcaauuacuuuuugaacaccuacuauguguuagugguagucuuauuauauauuuuguuuuaugucagccuuauuacauauuuuguuucaugucagcuuucuuuuucuucauggauaauugugucaguuuauggauugaaaagauuuuguuaggcuaauaagaaaauaauguaagcucagaaaggcaagaaacuugcugacagaauaauucuccauugcuggauggcagugacucacaggcauaucacuaacaauuuuuaaauccuucuuagaauucauuuucugugaugaauuugagugacaauccuuguugaacaaugucuugaacuuuguggaaggggauggaggcggguuggggaaaguggcaguggaggggcaaguaauuagagaagggaggcccaagagauuccuuaacuuuuaaauuggcuuaugcauuuguuugguuucugaauuauauauuguaagcauauagaauucuaacaucauuauuuucccuguuuugaccaguaccaaauauuuuaugggagacuuuuaaugauagugcuacagcucuacugcaaugaauaauaauagguuucugugugcuagcuacauucccacugaucccgagccugugaccuuagcaaagguaagcauaucccagauugcaaugugagauaguugaagauugaucugcuuuguuaguugucuaaauuucucucaucuguuuuuaaugagcaugcucaacugcaugaaucuguugaugaccuuagacugcauuaucuuuuagauguguaaauuggaagcuuuugaaugagggaaggugaaguuuuaaguuagugaauauaugcuuuaggacugugucuggauucugugagugguuuucaaggaugccccaaagaguaaucacucuagauucuaguggaacugcaguauauuaaguaugggaggcugaauuuaugacaaaacuaaacgcuuaauaaauuccucugcauaacugauuguucaacaugcuuuguugaguggcuugaaauuacaguauaguguaucuucucuuuuaguacaaaguuucauuuuaaaauuugagcaguuugucuaagucuuuuuuaaauauaaaaguaaucuuuuuauuuaaaauagauuauauuuuccaaaauaaaaaaaaugagaaggcuaacauugucuugcauuuuugcaaaccucuucaaugucugacuuacuggaguguaguuagauucucauagcugcuucuguauccaaucuguuuuaggauauuguuucgguuuuaguguguguguauauauauauauauauauauauguauauauauauauauauauauauguauguauuuuuuuauuauacuuuaaguucuaggguacacgugcacaacgugcaguuuugauaccuagguauacgugugccauguugguuugcugcacccauuaacuuauuuacauuagguauuucuccuaaugcuaucccuccccuagcccccuacccccucacaggccccugugugugauguucccugcccuguguccaagugaucucauuguucaguucccaccuaugagugagaacaugugguguuugguuuucuguccuugugauaguuuacugagaaugaugguucccagcugcauccaugucccugcaaaggacaugaacucauccuuuuuuauggcuacauaguauuccaugguguauaugugccacauuuucuuaauucagucuaucauuguugaacauuuggguugguuccaagucuuugcuauugugaauagugccgcaauaaacacgugugcaugugucuuuauaguagcaugauuuauaauccuuuggguauauacccaguaaugggauggcugggucaaaugguaauucuaguucuagauccuugaggaaucaccacacugucuuccacaaugguugaacuaacuuacacucccaccaacaguguaaaaguguuccuauuucuccacauccucuccagcaucuguuguuuccugacuuuuuaaugauugccguucugauuggcaugagaugguaucucauugugguuuuaauuugcauuucucugaugaccagugaugaugaacauuuuuucaugugucuguuggcugcauagauaucuucuuuugagaagugucuguucauauccuuugcccacuuuuugaugggguuguuugcuuuuuucuuguaaauuuguuugaguucuuuguagauucuggauauuagccuuuugucacauggcuagauugcaaaaauuuucucucauuuuguagguuaccuguucacugugaugguaguuucuuuugcccugcagaagcucuuuuguuuaauuagaucccauuugucuauuuuggcuuuuguggccauugcuuuugguguuuuggucaugaaguccuugcccgugccuauguccugaaugguauugccuagguuuucuucuagcguuuuuaugguuuuaggucuaacauuuaauucuuuaauucaucuugaauuaauuuuuguauaagguguaaggaagggauccaguuucagcuuucuacauauagcuagccaguuuucccagcaccauguauuaaauagggaagccuuucuccauuucuuguuuuugucagguuugucaaagaucagaugguuguagaugugugguguuauuucugaggccucuguucuguuccauuggucuauauaucugcuuugguaccaguacccuucuguuuuggcuacuguagccuuguaguauaguuugaagucagguagugugaugccuccagcuuuguucuuuuugcuuaggauugucuuggcaaugugggcucuuuuuugguuccauaugaacaguaguuuuuuuccaauucugugaagaaagucauugguagcuugauggggauagcauugaaucuauaaauuaccuugggcaguauggccauuuucaugauauuaauucuuccuauccaugagcauggaauauucuuccauuuguuuguguccucuuuuauuuccuugagcagugauuuguaguucuccuugaagagguccuucccaucccuuguaaauuggauuccuagguauuuuauucucuuugaagcaguugugaaugggaguucacucaugauuuggcucucuguuugucuguuacugguguauaagaaugcuugugauuuuugcacauugauuuuguauccugacacuuuacugaaguugcuuaucagcuuaaggagauuuggggcugagaucaugggauuuucuaaauauacaaucaugucaucuacaaacagggacaauuugacuuccuccuuuccuaauugaauacccuuuauuucuuucucuugccugauuacccuggccacaacucccaacacuauguugaauaggaguggugagagagggcguccuugucuugugcugguuuucaaaggggaugauuccaguuuuugcccauucaguaugauacuggcuguggguuugucauaaauagcucuuauuauuuugagauacauuccauuaauaccuaguuuguugagaguuuuuggcaugaagggcuguugaguuuuuugaagcccuuuucuucaucuguugagauaaucaugugguuuuuaucuuugguucuguuuauaugcuggauuacguucauugauuugcguauguugaaccagccuuacaucugagggaugaagcugacuugauugugguggauaagcuuuuugaugugcugcuggauucgguuugccaguauuuuauugaggauuuuuacaucguuguugaucagggauauuggucuaaaauucucuuuuuuuguugugucucugccaggcuuugguaucagguugaugcuggccucauaaaaugcguuagggaggauucccucuuuuccuguugauuggaauaguuucagaaggaauggucccagcuccucuuuguaccucugguagaauucagcugugaaucccucuguuccuggacuucuuuugguugguaggcuauuaauuauugccucaauuucagagccuguuauuguuccauucagagauucaacuucuuccugguuuagucuugggaggguguaugcauccaggaauuuauccauuucuucuagauuuucuaguuuauuugcguagagguguuuauaguauucucugaugguaguuugcguuucugugggaucgguagugauauccccuuuaucauuuuuuauugugucuauuugauucuucucucuuuucuucuuuauuaaucuugcuagcagucuaucaauuuuguugaucuuuucaaaaaacccgcuccuggauugauugauuuuuugaaggguuuuuugugucuaucuuuuucaguucugcucugaucuuaguuauuucuugccuucugcuagcuuuugaauguguuugcucuugcuucucuaguucuuuuaauugugauguuaggguguugauuuuagaucuuuccugcuuucucuugugggcauuuagugcuauaaauuucccucuacacacuacuuuaaauaugucccagacauccuaguauguuguaucuuuguucucauugguuucaaagaacaucuuuauuucugccuucauuucguuauuuucccaguagucauucaggggcaaguuguucaguuuccauguaguugugcgguuuugagugaauuucuuaauccugaguucuaauuugaucgcacuguggucugagaggcaguuuuuugugauuucuguucuuuagauuugcugaggagugcuuuacuuccgauuauguggucaauuuuagaauaagugcgauguggugcugagaagaauguauguucuguugauuagggcuggagaguucuguagaugucuauuagguccgcuuggugcagagcugaguucaaguccuggauauccuuguuaaccuucugucuuguugaucugucugauauugacaguggguuguuaaagucuuccauuauuauugugugggagucuaagucucuuuguagcucuuuaaggacuugcuuuaugaaucugguugcuccuguauugggugcauauauauuuaggauaguuagcacuucuuguugaauugaucccuuuaccauuauguaacagccuuguuucuuuugauuuuucuugguuuaaagucuguuuuaucagagacuaggauugcaacugcugcuuuuuuuugcuuuccauuugcucaguggaucuuccuccaucccuuuauuuugagccuauguaagucuuugcgcgugcugugggucuccuaaauacagcacacugaugggucuugacucuuuauccaauuugccagucugugucauuuaauuagggcauuuagcccuuuuauauuuaagguuaauauuguuaugugugauaugauccuuucauuaugauguuugcugguuauuuuucccguuaauuaaugcaguuucuuccuagccuugauggucuuuacaauuuggcauguuuuugcaguggcuaguaccgguuuuuucuuuccauguuuagugcuuccuucaggagcucuuguaaggcaggcaggccugguggugacagaaucucucagcauuugcuugucuguaaaggauuuuauuucuccuucaguuaugaagcuuaguuuggcuggauaugaaauucuggguucaaaauucuuuucuuuaagaauguugaauaucgaccuccacucucuuguggcuuguaggguuucugccaagagauucgcuguuagucugaugggcuucccuuuguggguaacccgaccuuucucucuggcugccuuaacauuuuuuccuucauuucaaccuuggugaaucugacaauuaugcgucuugguguugcucuucucaaggaguaucuuugugguggucucuguauuuccugaauuugaauguuggccugccuugcuagguuggggguguucuccuggauaauauacugaagaguguuuuccaacuuggguccauuccccccaucacuuucagguacaccaaucaaauguagauuuggucuuuucacauaguuccauauuucuuggaggcuuuguucguuucuuuuuacucuuuuuucucugaccuugucuucucacuuuauuucauuacuuugaucuucaaucacugaucuccuuucuucuacuugaucaaauuggcuauugaagcuugugcaugugucaugaaguucucgugccauaguuuucagcuccaucaggucauuuaaggucuucccuacacuguuuauucuaguuagccauucgucuaaucuuuuuuucaagguuuuuagcuuccuugcgauggguucgaacauccugcauuagcucggagaaguuuguuauuaccgaccuucugaagccuacuucugucaacuugucacagucauucucuguccugcuuuguuccauugcuggcgaggagcugcaauccuuuggaggagaaggggcacucugguuuuuagaauuuucagcuuuucugcucugguuuuuccccaucuuugugguuuuaucuacuuuuggucuuugauguucgugaccuacagaugggguuuugguguagaugaccuuuuuguugauguugaugcuauuccuuucuguuuguuaguuuucuuucuaacagucaggugcaggucuguuggaguuugcugcaguuccauuccagacccuguuugccuggguaucaccaguggaggcugcagaacagcaaauauugcagaacagcaaauauugcugccugauccuuucucuggaagcuucgucccacaggagcagccgcguauaugaggugucuguuggccccuacugggugaugucucccaguuaggcuacacagggaucagggacccacuugaggcagucuguccauucucagagcucagacgcugugcugggagaaccacugcucucugcagagcugucagacagggacauuuaagucugcagaaguugucugcugccuuuuguucagcuaugcccugcccacagagguggagucuagaggcaguaggccuuguugagcugugguggcuccgcccaguuccagcuaccaggcugcuuuguuuaccuauucaagccucagcaauggcacacaccccuccccaagccaggcugccaccuuacaguucaaucucagacugcugcgcuagcagugagcaaggcuucgugggugugggaccgccgaaccaggcacaggagagaaucuccuugucugcugguugcuaagaccuuggggaaagcgcaguauuugggcgggaguguuccgauuuuccagguagucugucauggcuucccuuggcuaggaaagggaaaucccccgaccccuugcacuucucgggugaugcgaugcccugcccugcuucagcucgcccuccguuggcugcacacguugcccagccagucccaaugagaugaaccagguaccuauuggaaaugcagaaaucaccugucuucugcauggaucacgcugggagcugcagaucggagcuguuccuauucggccaucuugggagucuuuuuuuuuuuuuuuuuuuuaguggcaagagauggagacucaaauuaccucaaguaaugagaaguugauuguaaagaugcuucaucaccaaugauuugauugauugcaaguuacaaaaaucagacucaccugcuuucuuuauuuauauauaaucaaaacuuuaugcuguaaucccagcaguuugggaggucuaggcagguggaucacuugaggucaggaguuugagaccagccuggccaacaugaugaaacccuguccuacuaaaaauacaaaaauuagcuggguguggugcgcaccuguaauuccagcuacucgagaggcugaggcacgaggauuguuucaaccugggaugcauagguugcagugagccgagaucauaacacugcacuccagccugggugacagagugggacucugucucaaaaaaacaaaaaaaauuauuuuuccugugagacaggacaggcauuauucuaggcuuuggggauagagcauugaacaaaauagauauucuucccugauggaguuaacgcucuuuuagagagacagugaacaaguuugcauguauguauguguguagcuacauauacacucacacaacugcugguacagguuauuuaugugaaaaaauaaagcaggguaacaguauaguuagugagcagauggaacaagggcuaguuagauaauguggucaaggaagaagucccccaagaagagguuuuugguuauagaucagaguggcgcuagagggugagucaggggacaaucugggugaaguauauuccagguuuagggaccagccacaccaaggcuuacggcugacacaaccuuaaaguguuuaggaaacuguuggaaggcucaaguagcuagaaaguaguaaggaaugggaagaguggugggagacaaauugaucagggagacagacagggacagaucucauaggaccugguagggccaauaaggaauuugagauuuacuauauggauaauguaaguauauugcaaguauaacuccauuuaggaguuuugagcaaaguagugaugugacuuaucuuucaaaaugauuauuguaauuacugugugaauauuagacucuugaggagaaggggucaggaguagaaguagaagaccuguugaggcuucgcgugaacuggugagaggugaugguaaucuggugagaaggaaauggcuggaaagucugauuucaugauauauuuugaggaaauagcuggcaggauuugcuguggaauugaauucagguuacuagugggggacagggacaggaauaaaaguucauucuuagguuuuauguggcauugaaauuucuugggaauaggaguaauuaggaaaaaacccagaaaucugaagucucaugggggagguuguuaauaaugggggaaaacauugaaaaauacugguugagaucauggcgcaaagagggaaggacugagugcugugaggucaagaaguagaggaggacccuggagagaagguggggaagaaauggccggugagauaggaggagagccaggagaauguggggaccuagacgcuuagugaagaaagcauuuuaagaaaaagcaaugucacauguuccagaaaucugaauaagaugacaacacagacuugacaauuggauuggcaaagucgaaguuaagguuauugaucuuaacagagacagauucacuguaggaguagaaguaaaagucuuugauuggaauggauuaaacaggaaguaaggacaauaaauauuguugacuuuaaaaaggaagagccaagaaaugggacucugauacaugaagggagauaauguugugaauaauuuuuuuuaaaugauaggagauuuuaaucauauauacauauauacacauauauacauauauauuuaaaucauauauauauuuucauauauaugaaaauauaaaucuauauauaugaauauauauuauauauauauggaaugacccaguuaagaaauaauugauacaggagaagaucaaacuaucuuaauuuaaaaacuaucccuauuuaauaggagagugcugguguauagucaggggcuuaauccacccuggcccagguccugucuuucucuguuucuuucuggauuuugguguuauuuucuccuccuguguuuccuagaggcuaguucuguggcugguggcaguugcaggcuuauguuuuccuaggaucauggccaaagagaacuaggagucuugccugccuguucuaguuagagaaaugccagaaaguaacuggcuuaggucuuguggccaaaucuagaucugcugcugugaccuccagaaugggguccugugauuacuucuuuccccaucugccuacuccgggugauuuggagucuugucuccaaagaaggaagagagagaaggaguaaccuagcagccagccagccauuacagauuaaugaccaagaaucacuagacuuugagaagagcagguagaagaaaaccuugaaaggaugcaggguuggguggguggugucuggcagcaugggucaugugauauaaaauauagcuacucuuucagaacaucucuaaguuccugaaacuugcaguucaaaacuuuuggaccauaaauggauuuucugaaaggccucuuuuggucccacucugaauuuuacgguaauugaguguaucacuuccuaaauagagacauuuuauuaaaucccauuuugguauuuuaaugaaaugagcuaauguaacucucaccacugaaaacuuccaaaaucuuccuggcuauuacagauuuuuacuauugccugguacuuuuuacuuugaaacccuaggugaguuuaccuagaaucuccaaacaugucuguauuguuaaagaugaaacauagguauuuuuaaaagcaucaauggaggaggagaaaagugaauuugaggcagcaaaaaguaggcgcugucugugcugaguuaguuugaaaaucuugagaaagagaugcuuucugaauacugguaaauuugaguagaugguucuucaugagcuaaccacucucaaaagagaaauaguaauugucacacuucaguaauaucuaagaauaccaacuacuguuacacuuuguacugaagcuuaagaacguggaagguuuuugcagugccaugucuucauacuguacuagagcucuugucguuuggguuacuggugaauuuuugccaaaugaagccuucugaagaggaaaaggaacaacuauaaaauuuagaggguauauuuaagugagaauauuuaaauauacucauuuaaagcaaauauaauuaaaacauauaaaggcauccagauaauuaucuaggagagcaugccuuuauggaauuacaaagaguuuuauuaaauuuuaaguaguuauugguaauaauuugguguuaucaaauauaggaaaagcaguacuuuuauaugacuucaccugcuaugagaaaugguaguuuuauaguuuauugugcugucuucauuuucuauauuuguuaaugaaagauuugguaguauguuuuugaaaauucauuugauguuauuaugaacauuuucuauuuuucuuuuuuauuuucuuuuuauagagaugggggucucacuguguugacuagacuguucucgaacuacuggccucaagcgauccucccaucuuggccucccaaagugccaggauuacaggcgugagccacugggcccagccccacuuuucuuuaaauuaauagaaugcaaggaucauaauuaucuaaaauggcaaauggguucaguguuuaguguagacuaaaggcauguauaaauuacaaauaggucuuauauuugucuuauagaauauaagaauuugcuuauuuugaaaguaaauuguuuaggcaggauuuagagaucauuuauaguuugucaacacuuccguuaaaacaaauaaucauuacuuccuagauaauaaagauuuuguuugcauaucacaucaaguauaagaaagggcaauuuauaauuuaaaaaggacucugaauuuaauuauuuguuaauaacuuguugguuugucuccaacacuguuagaccagaguaaguagaauacuuucuuccucauuggcauaacuaggagccuggaaaaaaaaaaaaggaaaaaguuaaaaccaguucgugccucuggaucugggaaaucaaucaguugccagagaacaaagaauuaccaaggaauauaaaugggaauuauugaauaggcaauuagaaaaagaaaaauaaucugaaacagguugagggaagauuguuguaaauucuagcccauaaaaguugagaaauggaaaaguuuaaguguuuuaggaauuuaaacuaauguaaucacuguguuucuaaaaagacugcuaaaauuucagauuauuuccaaaugcaaacagagucaagaaaggaaucaguuuuccuuuaaaggcuaguuuucaaaagguaucauaaguauuuuuauagugcuuuauuaauuuuuuugcuagauaaacaucuuaaauccauauuagaagcuuuuucaauauuguggguugacgagauuacauauuagaagcuuuacuucuaauauuguggauaaggagcccuuccuuacuuucuggcacgaaaagauguuugaacuaaaugaauauccagcaacaaguaaacuuagguauucugaggcuucuuaaauacuaauaccuacagaaaccccaagguacagcuauucuuucccagauagacaaaauccaaaagugaguaagaaugcagagcuugacugccuguauucaagucucuacauaacacuuacuagauuugugacaucggacaggacaaauaacuugaucucucugucccuaacuuucccuauuugugaaaucucgcuaauaaguacccaccccccaccuuagaggguugugcugaggauuaaaugagucaacaaguauauagaguuuagaacaguauuugauagcuaauaaagccuaauguuugcuguuauuaauauuguuaaaaggcuaccauacuuucuuggagaaaaucacaagcuacaaaguaauggagaagcucgcaauuaguagaauucucuaccugcauaauugaagaagaacugaaagauuucuuuuuuaaauuuuaauuucuuaauugaaagugauuucaaauuuagagaaaaguugcaggaccagagcaaauaacucccauauacacugugucuagauacccuccgcuccccuuccagugccaccauuugcccuaauaauggccuuuuauagccaaaggaugcagggugaugcauuguacccgguuguccuaucucucuaguugucuucaguauggaaaaauuccauaauacugccuggacuuuuacgacguuggccaguaaucuucaaaaacaucacuuuuguaguaaauaacuaaauuaggauuuguuugauauuuuuacauuguuagacccagguuaugcauuuugggcuggacuaucacaggagugauucuuuuuauuauaucauuuuggguggcacuugguaucauuugccuuauuacaaaugguguuaucuuugucauuugaugaauauagugucugcuguguuuccauaacuauaaagguauuuaccccacaccgaacaaauguguaauucuuuuuuuuuuuugguggagagauacuugaagacuauuuaaaaucacauuccucauuucacuuuuuaguucuagcaucuauaaauuuuuuuugccugacuuaauuauugcucacaugguugcuaaaugguaacuuuuugaauuccaucauuccuucuacuuacuaguuggcguucuacuauaaggaagagaauuaaacagaguguauaucaacaucuuguccgugaagaugcugggagauaacaaagacauauuuugaaacuaggaauuugagaaagacugauucucaaaaacuuaugaaugcuuugaagauugaucuucugcauuuauucauuuauauccuauuuuauucagucaguuuugaguuuguuacuauuaugauuuugaugcucaaauugucccaaauuuaguuaaugggaggccuuucuaacuggcuucuauaucuuuuuauauccuuucuaacuggcuucuauauucuuuaaaauauccuuuucuaacuggcuucuauauccuucuguauccucuuuuaaggauuaaggauauucuuuauucuuuuauauauccuucuauauccaucauuuuuugagcucuucccuacuuauuggcacaaaaaguauccaggcucauuguguuaugucuuaaccucaauccuggaaacagccauuucuccaaggaacccugguuauuuuuagcugaauugcuguuuagaaaccaagauuugggcacuagguauguucauugcuacugagauauuguuguucccagaccucaguggacagaguuaagaaacaugcacaccuuauauuucuuuuuuuuuauacugaaaaucaugaauucacacugauaccugauaaacuccaauuucaguccaacacuuuggguuaauucuagcuuaacuccuuuuucuauuuguacuucacugacagugaaaacuugacucuguuaucuuaauauguuuacguaguugcucagucccucuguagguagccaggguccugaccccacgggcugcuaccucuuucaggggccugccuuaugugggccucggccuucacaaggcugccacccuguuguccgcauuauagagauacuagcugcuguuaaccugucucauccccaugugggaccagauuacuucuggguaauugaaagacacugaaaugaauaugaaaauugaaaaaaaacuugggagaaaaaucggaaugcacacuauccaguaacuugguggaaaugaaucagucuuuuugaguuugaugacugaagcacuuuauucacauuuugccuuucucauaugauucucuggcuguugacaaagguccccuaugaauggggagccuauuuaguaauuuaauccuuuaaccauugugucaguacuacaauuaaacaaacuuuuccuaaaaguuauuuuugccacugauaauauuaguuaaaccacugcuauguauaccagcugaaggccaaguuggaaaauguuauauaccagguaaauguagcuuaauaauauuugugaauuauuagauuuuuaaaugcuaaaugcacuaagaaaaaucauauauaauugaagaucaaacaaauuucugaguacaguugccuugaaaauauuucuaccauuggaauuggcuaauuuuucuauuauugaagaaaucaagguuuacaaguucugaauguauugugucuucuuaccuggaaguuguuuggcaacuagagugaaaacucaauuuuuagcuggccuuugauauaauaaagaagguauuuauuaacuaggcuuuuguauucauuuuuuguugaacucccucuaaaaguuaaugcauuucuuacaucaugcuuucugguagucuugguaauaacuccuugauucugauguuuuauuuauuuaauccagugcccaaaguaauuacugugcagucaguaaauauuugcugcaugaaggaauuccaaguugccuacagaaaaucuuuugaagaaacuuucaaauucuaagagaaaaaaguguuaauagcagaaaauuaaagcaaacaguuguaaagcuauaauugaaaagcuauaauugaaauguuucuuuauuguuauacuuuggaaaauagcacccucuucauuuuaugaagcuuagucacacuuuugaaaguuuguuguuuuaucuagaaaugguucuaaaaagaaucaaugaaagugacauuuuccuuggcagucuugguuaacagaaucauuuugucauccauucacucguccaauaaauacuaauugaguuccaacuaacuauguaccugccauuccauguuuguuaagugcuugcuguauuuuuggcauuguauaacauguugggaauauagaaugaauaagaaacacuaucugcagaacaaccauaugauuuugagacccacuauuucuccaauuuuuuuuguuuuuggagauggagucucacucacucuguugcccaggcuggaaugcaguagcgugaucucggcucacugcaaccuccgugucccaggcucaagugauucuccugcuucagccuccugaguagcugggauuacaggugcaugccaccacaccuggcuaauuuuguuuuguauuuuuaguagagaugggguuucgccauguuggccaggcuggugucgaacuccuggccucaaaugaucugcccgccucuggcucccaaagugcugggauuacaggcgugagccacuugcacccagccuucaauuucuaauuuuaagauauaucuuuguuauuucucaccaucuucauggaacuagguauugauaguacacuuaguuucauugauaauaagauuggaguuucuaauaggaaagguaauaaagccuucccucaguguccccuguaccacuguugggaacaaaacaccuugguaauuuuuaaguucugaauguucaaacauuugccagcauuuaccuagugucucuaaaaauuacauguaauucuugcauaauuaaagagaaggagcucaugagcaaaaguguauauuucucuuugguacaauuacuaauauccgaacucaaguucaggguguugcuuuagguauccaaauauagcauguugcaggaauuuacuccauguuacaaagacaugcccugcugaccacugugcaaaugaggagcucacauucuggcacuguucuaaacauaaaccugucuugacugugcugagcagcugagcaucuaaagucucguucagaagugaccccaggaagucuauaaaaucaacugaguuaggaugaaaugugaaaggcccgaaacuuacucaacuuuuagauuugaaaaguuauuauuuucuuucuuuuauauuaguuuaaaaauucuuauuuuuaaaucccugcaauacugaaccuuagguuaauucaguuuuccugugauaaauuauguguaucaguguaaagagaaacugagauuuuuuguaacuuguaacacucaauugaaauuggauuuaaaaguagucaauacugguguacaccuguguuguuuuagaauaugguauuuuauauaaacauuccaauaacacaaauauuuuucaaacugcuaauaaguuuuuagcuucuaucaacauuucauauagccaacuuuaaauauauuuacuuuuauuaauaauguuuagucuuucuucuuccugacccccuugccaaaccuuuugguagauauaaagauguuuucaugcuuuaagagaaggcaguauauguuuguaacacauacuguuuguaacagucuguacuguuuuuaacucuacucuccugucucaggauaucagaaguugauuucccuaaaaugcauuaauuuucccaaagaaacuuuuaugccaguugcuuuuaauuaaaaaaauuauuaacaagccaguugcuuucuuaacauuaagaaugacauuacuaauguuuuuaaaaucauaaauuuaggacauagcaguuuuaaaaaaguaguaugaaagcuauuaaaaaaugaaaagcagaauacauguaauguguaugcuuguuauauccaaggucugccacagcugauggugaauucggcuguaucuugagguuugagguuuccucagaacgcaggagaugguuaagaguuggccuuugaacucagugggcguaguucuaaauccuguuuccacuacuuacuuggucugugaauuugagcaaguggcuuaaacucugagcuucagcuuccuaaucuauaaaccaaggauuauaauauuacaucugauaccuacuucauaggguuuuugaguuuuaugagaggauucauguaaagcauguagcagaguuucuggaaauugccaagugcucacaaaauguuugguacuacuauuauuaacaugucucuacauacacaaaaaugcuuuauuauuagaaguuagguuuucccccacaguauuuaggugauuucacagaucaucuuuaagauauuuuggauaguauauacuuauauuaaauauaacaaaugaaaaguuauaugguaguacuucacuaggcuguuuuguauuuuuaggcuuguaacuuaauacaggcauauggcuaagugcuuugggugcauugguuuuguaagauugccuuuuacacaugaaaggaacaaguaaauacauauauuuuaaucuuuuaaaguuuaucuuuuauacugauuuguuuauaucagguuugcuuaaagcaaggcacacaaauucucuuccgauaccacugucgaccacacaacuuuaaauugcuaccuccacuauguuauuuauaagccucuuugguucuguucuggagccaaggauucaccagugcugcuuuaaagugagauaucaggcagacaguauuauuuaucuuucacacaauuaugggauagcaaauugauaauuaaaaacaaaacaaaacaaguucuuuuauuuaaggaagacuaaaagucaguuauacauucagcuaauacuuaaauggcaacuugguguguuuucuacaguccuugucuuauagcagcuugcaguauagcaggaacauaagauauaagcaaacaguuacaaaguaaggcagcccauaugaugugccauuuuguagaaauaguuaagcaguauagaaauucaugggagaaagagauugcuuucagcuagaguauuucauucacuuaaaccuaguuguacagcugggauguaccuaugcaugacucgugucuuuuuuggaaggcugcuucagcuggguggccacagccaguugcuuuucuucucuauugguggcuauuuucaccccuuacaaucucuucauucucccugugauuaggaccccacugcugucaaaaagcuuucugcucuuaggcacaguuuucaucccuuuuuaagugcugauccaaaauagugacaugguggugggaccgaaaguagcagacagauggggagaagaaagggaaacugggugcagaaucaggaaccucauucucuguuguagaaauugcccuuuugauagcagcaugggugaggaguaaugaaaaggagaacccucuguuccugugaaaauccacaaauguauagucccgcccuuccccauauuuuaccuccccauacucucucaucuccuggaauuucgauuccauacaucauccuguccccacuuucccaucccccaccaucuccuuuguuccagagccaugcugcaguucugaaucuccuggcuguuugaaauguugccuuucgagcuguuagagccccucuuccaaguuguaggaaucaccuccaugaugaagaacugacguagcuccauugagcuuuucuguuacucccuccaggccuuuaguaggccccaauguauacuugaugucucuaggagaauccugaguccauuaauguaauugccuguggcagauugcucauauauaauguuuaacuuuggcauuacuguuaguacuauaugucugaaagguuuguuucuaagagaaaauauguuucaaguuuuaaacagugagcuguucuaaaucagccaucuauauuaguaguggacuuacagucagaagguuagaguucaauucuagcucucucaguuauucugugugaccaugugugugaucacuuggccucucuuggccuagguuguuuguauagaauguagagauaauagauuucuuucaaagauaguuguuggggguuaaaugagaauguauguaaagauguauaguaaaauauaaagccccauaguccuaaaggaauguggcauuuuuuuguguguuaaucaugacuguguuagguaaaauaacaaguuccugcccucuaagaacucaucauccagaggauaagaugaacauggacaauuacguuaugguauaugauaaauccuauggcagauauaaguauaggugaccaaggagcacaaagaagagcagcucuaaucuggaaaugaauggauagagaaaacuucaugaaggagggagcuucuuaucuaagucuuaaagaagagcgagccuggcaaagaaggaagaaaggaaaaacauuccauauugaaggagagacaguggggccugggggaacauuguacagaaagcuccaaguauggcugcaaguaugacuagaccauaaacuaucugugguaccuuaucugauuauuaggaccacuuagcuuauuuugaagaggcgguguuccugcacaauguuuaacaacucuagaaacagguuuggucugaaacuugguuugaccauuuacgaaucuuuuauaccuaauuaagaaccucgacuccauacacuuuuagauucaauaugaugauaaaagugucuacuuaaaaggcuuauuacaaugaucauuugaaauaauguuugcaaaucuccugguauuuaaugaacacuuaauaaauguuagcaguuuucaucgcuauccugaaaguucuuagggccauucuuucccucucaguauucuguaaucuacuguucuaggcuaacacuuuagcaauguuuuauuaauaaauaccaacucuuguuuauuauaauggaaucauagaaacaguuuaaaugaaauuuuucuuuggagugggggacggagucucacucugucucccaggcugggguacaguagcgcagucuuggcucacugcagccucugucuccuggguucaagagauucuccugccucagccuccggaauagcugggauuacagguauuuaccacuaugccuggcuaauuuuuguauuuauaguagagacaggguuuugccauguuggccaggcuggucucgaacuccuguccucaggugauccacccacccuggucucccaaagugguaggauuacagacaugagccaccacacacggcccaguuuaaaugaauuuuaaagguggucuagaucaauuuuauuauuuugcauguuaagaugcaaggacuguucaacacacaaaucaauaaaugugcuaccucacaucaauagaaucaaggucaaaaacuauaugaucuuuucaauagaugcuaaaaagcauuuaauaaauucagcaucccuucaugauaaaaaccuucaacaaauuggguauauaaggagcauaccucaacacaauaaaggccauauaugacaagcccaaaagcuguguguuucgugccgaauggggaaaaauugaaagccuuuccacuaagaucugaaacaagacaaggaugcccacuuucaccacuuuuauucaguguaauaccagaaauacuagccagaauaauuaagcaaaagaaauaaauaaaaggcauucaaauugaaagggaagacgucaaauuauccuugguugaaggggacaugaucuuauauuuagaaaaaccuagacuucaccagaaaacucuuagaacugauaaaugaauuuaguaaaguuacaggauacaaaaucaaccuacaaaaggcaguagcaucucuauacauuagcagagaucacucugaaaaagaaaucaagaaagcaaucuucuuuacaauagguaccaaaaaauauaccuagaaacgaauuuaaccaaggaagugaaaaaucucuacaaagaaaauuauaaaacacugauuaaagaaauugaagaggauucacaaaaaaggaaagauaugcuuauggauuggaagaauucaucuuguuaaaaugucuuuacuaccuaaagugaucuacagauuuaauacaaucccuaucaaaauaccaauuauauccuucacagaaauagaaaaaaaaauccuaaaauuuguaugaaaccacaaaagaccaugaauaucuauagcaauucuugagcaaaaagaacacugcuggagauaucacacuaccugaauucaaauuauauuacaaagcuauaauaaccaaagcaucaugguaccggcauaaaaacagacacauauaccaacgaaacagaauagagaacccagaaauaaauccauacacuuuuagccaacucauuuucaacaaaggcacccaaaaugugcauuggggaaggaauggucuguuuaauaaauggugcuaggaaaacuggauaucucuaugcagaagaaugaaucuagaucucuaccauaugcaaaaaucaacucaaaauugauuaaagacuuaaauguaagaucugaaacuauuagaaaacauugaggaaaggcuucaggacauuaggcuggacaagaagcuuuuuggguuaagaccugaaaagcauaggcaacaaaagcaaaaacagacaaaugggauuguaucaagcuaaaaagcuucugcauggcaaaggaaacaaugaacaaagugaagagacaaccuauggggugggagaaaauuugcaaacuauccuucugacaagagauuaauaaccagaauauauaaggaacucaaacagcucaauagcagaaaaacaaauaaucugaguaaaaaaugggcaaaagaccugaguaggcauaaagacauaccaguggcccacagguauacgaaaaaauguucagcaucacuaaucaucagggaaaugcaaauccaaacuacaaugagauauuaucacacuccaguuugaauggcuguuaucaaaaagacaaaaaauuacaaaugcuguugaagguguggagaaaggggaacucuuacauacuauuugugggaauguaaaguaguacaguuauuaaggaaaacaguauggagguuucucaaaaaaacuaaaaauagagcuagcauaugauucagcagauucacugcugaauauaugucuaaaagaaaggaaaucauuguuccaaaugauaccugcacucucauguuuacugcagcacuauucacaauaggcaagauguggaaucaaccuaaguguccaucaucagguggauggauaaagaaaaugugguauguauacacaauggaauauuauucagccauaaaaaagaauaaaaucccguuauuuacagcaaaauggaacugaagaucauuauguuaagugaaauaaaccaggcacagaaagacaaauaucacacguucuuccucagauauaggagcuaaaaaaguggauuuuauggaaguagagaguagaauggugguuaccagaggcugggaagcgaagaggggaaugaagagaaguugguuaauggguacaaaaaugcaguuagguagaaguaauaaguucuaguauuugauacuaaaguagggaaauuaaaguuaacaguaauuuauuguguguuuccaaauagcuggaagauaauuauaaugguuccaacauggagaaaagauaaauguuugaggugauggauaucucaguuacccugauuugaucaucacacauuguauacguguaucaaaauaccauauguacucccaacauauguauaacaucaauuuaaaaaagagaaucugagcuguaguuaaauaauguggcuaugauauuauccugaaucaguggcacagcugggaguaaaaucaggucuguuuccauuccagaguucuuuucauuagucuuagaauaaauugccaaaaaucccuuugagacacugaccuguagcacuggccacaacuucaagcagaaacaauauaaguuaacauuuuagaagcuggcauuucuguagcucugcagauugggaaagauaccuuuaaaaggaaugguguaucucucucugcuugcccucugauggaaguguuguuuagcaacagcaucuauaaaagaucagugagaggcagguaauaaggaaccagauaauucuuaaaugaguaauucuuuuaccaucaagaauuucuuauguaaugaaaaaucgcuuguaccccaaaagcuauugaaauuuagaaaauguuaaaaaagaauuucuuauacauacaaauccuugucucaccauuaaaauguaaaauuagauuuucauaagacuuauuaauuaaacauguucuacgucauucaacagcauccaacaaauaauuuguugagugccuuuauaccaagugcuaggguuagagugaugagcagaagacuuauacuuuacugaaauaaacaguuguugaaguaacaaucauacagauaaguaguuauaguuauuuaaaugcuaugcauaaaagcuacuaagggauuaauaaucaggggcuggguguggugucucauaccuguaaucucagcacuuugagaggcagaggaguucaagagaucagccuaugcaacauagcaagacccuaucucuacaaaaaaaggaaaaaaaagguuauauaguaauguucagaaagguucacuugaagaauuaaaguuuuagcugagauaugaagguuuaaugaaacaaaaagguggagggauagcaaaaaggagcuuauacucagcaaacagcacguacagaggcccugaagaaggacauaguaugaucuguccuaagaaaugaaagacaacuagaguauuuggaacagagaaugcuaauaaaaaaugcaaguccuggucaugagaagagaagugaagguguuuacuaaguaucaccaaggaaaccacagcaaaaggagaagugaaucuccccccaaaauaaaugguucuguuagaucuguuguuuuaaagauucguugucaagaccacuacaauuuucaauuugcuaagcagaguauuacuaagauuugggcaguuuuaauauguucuuuuucauuugauuuuucuuccuuucuguacugacuuacuggaaauugugggaugacuuugaugugcugaaguguuuagaucaggaauuuucacuguugaacagucauagagagaaucuuaucuuguuuucuuggcuggggauuuugugugggcgugugagguacagcugcaccaugaguuuuuuggcagugaggacagggcaauucucaaugcaguucaucuugaauaggaagaaacuuaagaguaaaaagucuacuuugaaugcacuaaauucaguggaaaacacccagggccugaaccuucagcugacauccuguuacuugguuaaauggauacagcagccucaggcccauguccagguuuuaugguaggaacacaugaaggggagaacagucaaggcuuuguuucaauauaaaacuaucaguuaccacaucuaguuuuaaauguuuuugguuuuuguuugugguuuauuuaagcuuuuucucuaaagaacacuuaauaaaaaaggcagauugauggaaaccuagcuuugcuugcaaguaugaauucauauuuuuauguagcuuaucagaaagauuuuuuucagauuuauuuauauacagauggauucccagaucugcuuuuauugcucacguuuucuucacucucccuugaucucuucuguagucuauaagcauuaacccucaaauuaaaugcagacaguauagaacuauucauuuguaagcacacuuacauccuucccuuugcauaaacucaucauuacucuucauaagcagaaaccucugaacugcguccagcgcuuaacugcuuguuuauaucuuuacuguuauuuaguauuacuacuuucagaguaguauaaaguuuuguucugugaacaguuugccugaguucaaauccaguccugcugcuuacuuuguugguuccauuagcuuuuuaguuuuuaacuuccaaaauaaagauaauuauguuagaaccucguaaguuuuuuuuaagacuuaagaaaaugcauacaaaggacuuaauuuaaaauaaauauccaggagaagagaugcuaguuauuuuauucuugauuuagguccagucuucuagaaucuauuaauagcugucuuuucugguugaugucauuuagucuaaagaucaucuguauguuggugacuucccaccaauaccucuguuccuaaccucacuuuuuccuaagcuccagacuugcagaucugacugcugcucuauuaucuacacuuaaaugucaaaugcauacuucaaacauaacgugucuuaaaacaacuuuugaucucugucaccggccccugcucguuuccccaaucuuuuccuccccauucuuuucuaucucaguuaaugguagcacccucuguacuuuuggcuuuuguuuagcuaccagccccuguccauuucaucagcgcaucuuaauagcauuauccccagaauauauccugaaucugacuccuuguugucaucuuaucuacuacuaucauagucuaagaugaugacccuuuccugucuaggcaauuauauaaggaauggucuucuuauuucuccguauuucaugauaagacuggaccauuuuuagucuuaucaugaacaaucuauucuccacauugaagaacaacauucuaaaaaaagauuauuccccuucuuuuuauugaaauuagaaaacuguccagaguucuugaaagccuuucaugaccuagcuccucucugacuuucugccagucucucaaacacugcuaguucauuccaucugaaggcuuuuuuuuacagccuuuuccucucuuugggauauuuuucacccaugucuucacaaugggacuccuugcaauuuuuaggucucagaugucagcuccuuagagaggcuuacccugacaucuuuccugcuuuucuuaaguuaaucacuaucugaaauuucccuuccucuucuuccuucuuucauaaagugccccuccccaaacccaaaggaauuuaaguuccauacaaggacuuuauccguuuuauucacugccauaugcccagugcuuagaaugaaaucugguauucagaauguuuucgguauuacaauacuauauggguggauggcuagaugaaagaaugaacaaguauguaucugguaauuuucuacaaccagaaaaaugauagauuauuucauucuuacaaacuuguauagguguuuauuuucgaauuaaucaugcuaaucuuuguccuaauugcuuuuacuaucacuucuguuuuugauuguaaggcuuucuucuucucauagagugcuagauacaguuuugguacuuaauguugauuaaauugaaaaugcaaucuaauaucuuuauauucucugaaauuauagaauauguauuucugaaagcagguguguuuaaaauaugcauuccccuuuuaucuccugcaguucauaauuggacccuugaagacacucuucagugguugauagaguuuguugaacuaccccaauaugagaagaauuuuagagacaacaaugucaaaggaacgacacuucccaggugagucuuuguuaugcaaauguauuuuccacucagggagaauuauaugcuagaugucauuuccccauacugaaucuacaaguuacuuccguggcugagggcacaaaggaaauauaaauauauccauucuuuaaucuuucuaaauuaugcauuuucaaguuuuaaucaauuuuucuugucuaaauaaucaggcucuuggaaaaauuauuuccaaggaacaugauuuugaguuucagaagaugggucaacuauaucauuuguaaauaacaucaagggucaacuuuuggccaaucuaagaaaaacuuuuuuauuugauacugauucauuuuuaugaacacaucuacuugaaugaauuaaugugcgucucuuucuugugacauuuuaaaugacaauaaccaucgaauuauggcgucuauacguuauaccugaauuuuaaaaaugaaauuaauaaaaaauagcaaccauuuuaaaauguaugcuacauagaaguacuuuauauuaucucauuuaacccucaugauuaaaaugagguauauauuguccuucccauuuuacagguuaaaaaaaccaagucagagacaaguuaaacauuuugcccaaggcagcauuuaaacccagauagauuugauagcaaaguccagguugccaguuuaucccuuaggugucugaauccaguuguucucuaaauuuuauuuucuaaauuauaucuaaauuguaucauuugcaaguaccaaaugauauaauuuagaaauuauaauuuuuaauuaauuuaauuaacuuaauaaucuugaaggauuuaaaugucaaaauuugcaaugauucuaccagaauuuuuuacccuuacaagauugcuucuuaaguuuuauuuuucccuggaugauuuccuacauccaaaaagacucuaaucaguuauuacaaucuaaucauuauauguaaugaaauauauacauugugucccuagucaacuuccuuacaugcccuauuuagauaaguauccuuuguugcuuugagguuuguauuuugaucaaguugaaaguuuucaaaucuguuuuaaauguauucugaacaucaacauuaguauuucugauuuuauuauacacaugacuagaaugaugaaauuauagggauaagagucaauuugauaaguacuuacugaauaucuuuuauguucaugguacaacuagaugcuugaaagaagacaaaaaucaaauaaaauauaguuauuuuaauuaaaacaaguucuuaaauuaaaacagagucaaacauuaaaaugagauuagaauuuauuuauuuauauauguugcccuggguaugaggaacaauaggaauuuucuuguugccuuuugagaaacuuguuuguuuaacaacaacaugaaauaaaauaggcuaaucugaguuuugacagucaguguuauagcuacucauuuccuuugguuaaguaaagaugaucagagaugcuuccaauucugguaaaauugugacaucacacacuugucaagaucaacuccuuaaauagugaacauguuacuauagaaaaacauuauaacuucaguuuucaggucagcccauuggaaccuuuuuuaguggaggagaaaggagaacaguaaacucuuccuuaagccccuauuauauaguaauggaaauuagaugagucaacuuaaaggggcaauaucaauuaauuucaauuauuauguaaguuccagagcucuuuguaugguaucuguagacauaagaacuaguuacaagaauguauaagaaaauguauuacauauucuauagauaguuggccuacaacaguccauuaugauguuucuuuucugugacauuaaaacccuuuacauuugcuaaagguagccaaaacuauguuuuauguuggcuguagugguuaucuuaaaccuuucgcuguguuuucuauacucuguaauucuuacugccaaacauuauacuaaggcugucuucaccugacacauaccaccucauuucuuucaggccuauguggccuucccugacacccucacccacucagguggaaucauuuuuaccucuggacucauauugaaucucgcauaaaauuuuguuauguauuuucuuuuuuacuacaucucauugucuuucuuagucuauugauaguuugcuauuaauucaugcauccauaccuacauacauucauucagcuauuauacaaacauuuaucaagcuucuacuuuuggcaaguacuacauuaggcuuuggggauacagagauacgacauagucuuugccuucaugcaauuugauaagugucauguuaaagguguaagggaagcauuauacgaaaguaccuguggagaagauaaaggaaggcauuucagagagggaauguuacaguucuuugcucuuuaagguuuuauagaagccucauaggaguuccuguaauuuuuccauacuuagagaguacugauaucuuucuauacaaaauguaguguuucaaaguagucuuuggaaucguacauauuuggguuugaauccuugccuuaccuauuacuaauuauguaaccuuaggcaaguuacucaaccucucacaaguaucuucaccuauaaaauggaaauacuauuauaagguuuucuugaguauuaagccauugguacaggacccagcauauauuauaugccuguguuuauugucauuguuauuauuauuagacuuuguguaaugaaaucuuuacuagcaucauacuugguuguuaagaaaucuuaguugaguacuggguugcuuguauuuacaguccauaauaaagugauuuuauuuccuuauuuuaccugugccuccuacgugcuuucuucauagcuaauaaaaugguuuaguacuuauuauuauauaaauuccucuaccuaccuaccucaauccaugaaggcuuuuuauuucccacuugugacuucaauguacuuuguucaauuuuuaaacaguuaaacauuagaauguuaaaaguauagauuuuuugauacuuuuaaagaaaaucaauaugaucuaaauugaaaacuuaauuguuuuuuaaagucugcuauagauguuaaauuaaguuacuuaugguuuuauuauccuuugugaaaggauaauaagugacagaaguaauuaaugacuauaaaauauuuucaacuuuaggcugggagcggugguucaugccuguaaucucagcacuuugggaggcugaggcgggcggaucacgaggucaggagaucgagaccauccuggccaacauggugaaaccccaucucuacuaaaaauacaaaaaauuacccaggcgugguggcacgugccuguagucccagcuacuugggaggcugaggcaggagaauugcuugaacccgggaggcggagguugcagagagccgagaucgaaccacugcacuccagccugggugacagaaugagacucugucucaaaaaaaaaaauuuuuuuuucaacuuuauaaauuucuaaaucauaguaagucauaacagaaaguaaccuuagaaaaccaaaacuuuuucaauguagcuacuaaauuauuaacauacaggagucuuucuacagcuaaguuugcacugaagagguuuuugaaacauguaacaaauuauuaaaucacacauggaugagcuccaacagugaucaucaauaauauguaaaguguuaaauguguugcucaaauauuuaaauuuguauacuagaaauauuuucauuuaauauauauauauauguguguguguuuuucaaauaaacaggauagcagugcacgaaccuucauuuaugaucucccaguugaaaaucagugaccggagucacagacaaaaacuucagcucaaggcauuggaugugguuuuguuuggaccucuaacacguuaguauucucucucacucagaggaugauguaaaagaauauccugaucaucucuguguuauuuaaggaaagagaaaaauaagauaguaggccucuaagaagaaucaucuauuaccugugaaagaaguguaauacuaccuuaaaagauuuauaagauaggauuuucugucauugaaacaugagugugaaauuuucaaagcugguuacuaauguaagaaguuauauaaaaaacuauauuuagcuguuaauuuagaauuuuuagauuuaaaacuuuggaucuuuggaggaguuuuaauguugauguuacuauaauuggauauucacugaggaaucucuuaaaaaauaauauagucuaaccaucuugauggcaugaagcaauagagccuaacaguuuucacuaaacaccaagaaaauggauuuuuagguauagauggaaagcaaagacucacuugaagcuuuauaaauuaacaaacucuacuggcaggagcaagaaguagaaaauguuauuugauuguuuugaagagaaacauuugagaaaguguuaugcaauaucuguaaagaaaauaaaccuuguauuuauuuacuuugacaggaauauuuuuuccccagaagagaaauuuaauauguuuguuuuauuuaauuucaauuuuuucagaaagcuuugggagaaaguguuugaaaaguacaccuuuuaaaggaauuauguuuuuuuuuuuuagucaaaaaaguauaacaaaauuaauacaagaaaaaugccuuccacaaguuauaaaguaggaaacuaauguuuauucucccugaauucuuggaguuaggagauuuucagguuucuaugauaccaucuugggaauggcccuucuaaaaaaggguaacuagaauugguugaauagauuuuaugacuuuacuggugguucuuuuuuggcuugggcuaaaagagcagcuggugaaacagcuggaacuccccauaugagagcugguggaaaugcacuguugguggaaauuacaaacccuaggaaauagaacacuacugaaaugccgagcguuccauagagaugaugcccuuuccaaccuuuuccuuguccucacuuccagacugaauccauugggggauugucuucugugggauucuguccaauuuuucucaugugagugguugguaaaaauaggaauuaaaguauagaauuuguuucuauuuacaacuugaucaggaauacucauauuuuauuaaucuuggaacuaaccccuuucuaagccccaaaaauuauauuaccaagucauuugaaaagaaaucaaacuagucucaaaaaagauuguaaacaaauauuuaaauaaaccaauuaaaaaguuaaugauuuuaaauauguuugucuuagaaugguugagugaaugugccccauagucagaacacuuauguuagauuuauuuuaaaaaccagcauugucaaaugaacagagauacauuuuaaaguuuuuuuuuuuuuaaucuuuuccagucuguggugcuuauuauugaguguaggaccuuauuuaucuauuuauuguuauuuauggucagagaauagggcucacaguugaaggagaaccugaauugaacaucucagugugaggcagaaauaaaaaaugcuuuugagauuguagcuuucagcaguacauuucuuccccuacagguggaagggugaagguguacacucuggcaauguggagaacugagagucucugacauagagcaugcuacauaucacacuacacaaacauagccaaaccccagacuugucagccuaggaacuucuguagaacucuuuuaugucaccaaacuucaaaauauguuucugccggaggccugggcauuuaggcaguuuuucacugugagcuguaucucuuuggagcauuaaaauaauauauuagcuaucauugugucucuguucgagagagccccgugaaaauuaguguguacugacugggcuaaaucaggaaaucugaauagugauuucuguguuuuguaucacugaaggcaguaggcccuggcuccucacucuuuguuuuagacauaaggcuggggguuaacaucauaccaguaacccccauaucucuggcauauagacaccuaaaacugaauaauuguuauuacuauuuaacccaggcuuuaucagccuuagcacuagucacucuuugggcuggauaguuucugguuaagucuuugucauccgcagaggggacacagggaggagguugucuugcgcacuguaggguguucagcaauacuucugaugucugcccacuaggugccaguaaccacucccccaaguugagacaacccaaaauugucaaaugucugcuaggggugggugaggaauuaucaccagccuugagaaccacugauuaaccuaaccuaauuaguuauauagcugccuccuuggggaaaauacauuuuggugagugaucagguuuauaagugugagagaaacgugacagcugccuagcuugacugaaggaagggaguugggaugaugguggugauacuuuugaugacucccuucaccccacagaggaccauucuggcagcauaugauuggaggugcuguugcuuuuucaaggguccccaugacuuugaccacuccuucucccaccagcaggggcguggugugucuauauggguuuaccucugcccuucuauaagucuaguauaucaaagaguuacaagaagcacagucauuauuugaagaaagaauuuuaaaaggcuagagcuugugcaugggaaagagaucuccaauuuuugguuuuguuuuagauacuacuuaaaaaaugucuuuuuguauugagguccugucauacucaaagauuaauuuaaucaucuguaauucuuuuaauaggcccaccucauaacuggaugaaagauuuuauccucacaguuucuauaguaauugguguuggaggcugcugguuugcuuauacgcagaauaagacaucaaaagaacauguugcaaaaaugaugaaagauuuagagagcuuacaaacugcagagcaaagucuaauggacuuacaggagagguaaguucagaaaaaucauaacucauuuauguaggcaaauacaauuuguaaaaaaagugauaugggcaugugcuuaaauacuuacauuuagguuauuauacacaucaggaauagaugcauauuugauuucacauuuuuagaaaaguauacuuuuauaauuacagauuuauuauaaauguguauacuugagaauaaaugaguagaagaacaguggagguaagucaaauauaguggaauuagauguguaguuaaauuuuauuuuuaacuugauuuaaauaauuaggaauuuuugaaaagcuuuuugcggaagaguauuucccugcuuucccugucauuugaacccaggauaaccaaaauagcuguauaguaaguugccugauauuuguauuaaccaaacuuaaggcuaaugaaaaaugcuaugauuucugauugaaauauguauuuaaucgcuugacccaguauucauuauuuuguaaaaaaaaauaaaacuggaaauuuuugugaggaauuuuuauuuuuauuguucuauaaggcuugaaaaggcacaggaagaaaacagaaauguugcuguagaaaagcaaaauuuagagcgcaaaaugauggaugaaaucaauuaugcaaaggaggaggcuugucggcugagagagcuaagggagggagcugaaugugaauugaguagacgucaguaugcagaacaggaauuggaacagguauuuacauuaaaaaaaaaaucacuuguaaagauguuaacauugccacucugaggagccagguccuguuuuucuucaguuuccuacauuuaguuccacuguaguuccucaguugauaaaagacucauuuguuuauguuguuagcauugaucaaaguucauauagcaaaauaacacaguaguaacugaaagauaguuaccaucauguucacucauucaugaaaucuuaccuugccaucuucacugucuugaguaaauuuaagguguuuguuuaacaucuguaauauguuuaaguuucugacuauaauguaguaagauauaaaguauaucuaauuuugaacuucucugcaaagguaaaggaucucuauuaaacauccauuugaauccuguuaaauaguuuuagaacauaaucugcuaaaaguucugaagcuccuuuccaauaccugcuucuccuguucaguuacuuaagauagaauauaggcauuuaggcauugcacggaguccuuuggagaaggugaggugcuggcagaauuuaauuauagacagaugcauuaguuuccuguuccugcuguaaaaagaaaaaaaaaagccacaaacuuagugguuuaaauaaacagaaauuuaucaucguaaaguucuggaggucagagugaguugaggcgagccugcaggacuguguucccucugcaggcuguaggggaggacguguuuccuugccuucuccacugguaaaggccacccacauuucucagcucaugccccuucgucugucuugaaagcccaucauuccagccucuacuucuguggucucaucuccuccuucugacuuugaugcuuucuuuacugauaaugaaacugaagaacaaaaugaggauuauaaaacuugcucaaaauuagaggugacucaguuauaaagcaggggcaagaacuuagguguucugccuccacuuuguuuuaugcgcuguugcugccuucuuaauagagugcuaaauaagaaaugcaaauuaagugaugaaugacauaaggucaacucaugagaauacauuacuguuuccuucaagauugucauuuuaugagaauaugucugacugaacacagccaucuuuuuuauaacuguuaaccacuccuucucucacacccccagaugucuguuuuuuggagcucuucccucuaaggacucuuagauguauuuuacagucaugccucauucaacuaacaaaccauaucagcacagaauguagcaaagaaucagggaguugacaaaaaaggccuagucgaaaucauacgguauccgagaaguggguacuaugcccuuugcacuccuguaagaacucccugccuuuuuccaccaagacauccaacucucgguuuguucugguauauuucugucuuucuaaacuuuguauauaaaaaagagcgaaucagaaaacaguaguuuggaauucuucuacagagauauaaacugaugguaguacuucacaggugccugccucacagugagggagaagagacaauauaaaaaaagggcccaagaauuguggacauucuaacuugaagcuuugggagagagaccaugcacaccucaguagaccccgaaguuaccaaaaugugauguauugguauuauugguaugaauaaucucauuagauccuuggucaauaaaaggcgguuuaaaggaaggaaauugguauuuuaaaaagaacacugucuggcaugaucguauuaauaagaaacacaauuuucugagggcuuacugugugccagaaguguaugcuacacacauugccagugguuugcucauaaauuuuaauccucacaacacauagguauuaucuucauuuacaaaugagcuguguagagaggcuagauaacuuacuugccuuggguuacacagcuauuaacugguaaaggcaagguuuugcgugucauauuccaaagucugugucuucuuauacugcuauuaaaagcuuugcuuguagaaauaaguuuaacugagaaaugauguauaauaugacauaacccacaauuccacguaguucaaggaauuacuguauuuugucuggagaauaaucaacauaaauuuagaagucaggaaaaucugguauguuuuuuauauaguguuauuuuuccuagaacagagacuuugggugacuaauaguacugcuuuauguuuugugugauuuaaguaguuuucacaaauuaauuucuuagaaaaagucucaggaagccuuuaaucagggcaagugauaauaccccuauuauacgugagacaauaagccuuaggaacuuacugaagguuacagagaugaaaaauaauacaguugggucuagaaaagaaguuuucagauguuuaggcuguuuuugugacaucauguuuuuacuuacuguuguuuuauuccaaagauacaaaaaucauguaaauaauuauuacauuuuaaacaguuauuuauuguuugcaaaagcuguuuauuacucaauuuuuucuguguucauuccccuguaaacaacaaugugauuuaaacuaaggguugggauuuagaucaaaugaaacauucaugaguaauagcagagaaaacaguuaaauaguugccacuauuggaaggucagacuuuccacagguuugagucauuauuuggcaaucaaucugaacauuguucagcuucaauuuaugcuaaaaauauguaaguaguuuuuauguuaaauguguuuccuuugagcucuuuuaggggaaauacauuuauggaaauauuaagaaaaaucuaugauuaaagagaguaacuugaaugaauuuuguugagauucucuguauaauuccuuggaagugaaaauuguauagaaauuuuagcuuuaaaaucuucugagaagaagggcuugcggacuuacauuuugugguguuaugcaggucugcaugaaccugagcuuaaauuuuaucucccugagagauuagcagggacgccacacagcuuacccaacugacuuauuaaacacaguauugucccaagccauugcaguuaguuauguaggcagauguugcucgggauuuguuugcagugaguuagugcucuuccccuuacuuuaaugugucuuuuugaacugucaccuaguguugcauugugaauuuuguuuuuaauuuuggaaucuuaaaauauauuuuucuacguaauucuuuguuuucacacuaacugacagcuguucuauuucuuuaucagaaguuuguguauaguacucuuguugguuuauucuggcacacuauaaaguuuauucaaauaaguuggguuuguucagaucaaacauuccuuugcucuucaguguccuuaguuagcuuuggggaaaauuaaucugcgggguggugcucgacacgcaggaugcuccguagucgcucguagcuuugccucaaggucuugagugugaguguaugugcacaauuucauaauuacauccugugucuuuauauaucuuuaguuugaaagcucuugcuaguuuuuaaguaaaucauuccaagaaugaauuaucuauuccuuuugugucuuuccuuagugaggcuuuccuuaugauacuuuuucuuagcacuuaucaccuaaccaccaagcauuuuuguuuuuucucugcuuauugucuggcuccauuaaagggcagguggaagaaauacuaugacaucguuauacugaagacuaugcauaguuucucaugagaaaaaucaaguagacucucagaaucuguuuucucaaaaucuguacaugcucugcagauguucacuuagcuaguuucugguguauucaaagcagugaauuauguagcggaagugguaaaacagacaauaauaggcagauauacuuggaaacaguaagaaauaacuggccauaaagaggaugucaugaaaaacuacagaaaaauacaauuuuuaaaaagugaguauauagugaaggagcuacaguaggcucuucuggaaacauuaggaggaggaguagaacguguauccacccaauuuuggacauuucuuuauauaauacuucauaaaugaaauaugcauuaugggaaaaauaugaucaguuuuaauuuguauauacccuugacuuuuuuuucccccucagugagucugguuuucauaacauacaaaacuaaauauugcaacuuaagauauaaauaagcccucucuacccuccuucacaacuuugcuuaguggauuuaagaugcacuugaagcucagccuucauuuuuuuuuuuuuuuugagacggagucucgcucuguugucagccuuaauuuuaaugcuagaaaucuacuguauuuagacuuugcaguuuaaaacgauguuuacaaagagcauaauuaaaauagcuuuuuuuuuuuuuuaguuuggguucuaaaaaauauuuuaauccuuccuuccucccucucuccuuucuugccuccuuccuuuccuucuucuagguucgcauggcucugaaaaaggccgaaaaagaauuugaacugagaagcaguuggucuguuccagaugcacuucagaaauggcuucaguuaacacaugaaguagaagugcaauacuacaauauuaaaagacaaaacgcugaaaugcagcuagcuauugcuaaagaugagguacucucuuguauuucaaaauuuacuaaauuuguuucuuaggcugcauucuuagagggauuacucagcugggauacacagaucugaauaaaaguuuuauuauuacagauucuuuuuucaaacuggaacuuauuguguaaauagacucuaguaaucauaagcuuuaaauuaaaauuacugcauuuggagaaguguauacuuuucaaagugaccuuagugauuuaaacauuauucuuuuuuaucauuaucauaaaaguuuuauacagagcuuuuuuccucuagguugcugcuucauaucugauucagguuaguaguuacuggaaauuaacuuugacacuuaaauuguguggaaugagaauaagucuuaaucugaauucuagccaaaaaauuuaaaagcuuaguucacucacuagcaccauuguaguauaauauagcuaauguucuucuguuacuuuuaguacaagauucgggucuuccugaaccauagaaauaagagaaaaauucuccagaauaaaguuuugaauuacaucgauuggcuuaggaaagcacguuuucucccucaucuguuuucuuuuuuggaaugcagggauaucuuggcuaguaauucucuacugguuuuaugauugcuaauauauucaaaaccaaaacaaacuuuauuauguuauauauacaaaaaugucuguauuuuuuucaaaccuagccuuauuuaguccuuuucgguuucuaggcagaaaaaauuaaaaagaagagaagcacagucuuugggacucugcacguugcacacagcuccucccuagaugagguagaccacaaaauucuggaagcaaaguaagaauguuguuuucacuuuuauuugauuuauguuuauuguguuaaaaugaguaauuugugaacaauuuauauuuaucauuuauauaauuacauaauuuacauuaguuuuaagaguggguuauuucuucuugaaauuaguuaauugccauggucuguucauguauugccuuuuuucagugccauauuaaagaccuuuugaugcaguaaguaauuucuuuauuggcuuuuccaggaaagcucucucugaguugacaacuuguuuacgagaacgacuuuuucgcuggcaacaaauugagaagaucuguggcuuucagauagcccauaacucaggacuccccagccugaccucuucccuuuauucugaucacagcuggguggugaugcccagagucuccauuccacccuauccaauugcuggaggaguugaugacuuagaugaagacacacccccaauagugucacaauuucccgguaaguggcaauuucaacaaaaauuguugguacagguuuuaaaguaauuuucuccuauguccuuuuaggaaucauguacuucgaaaucugugagaaaaaauuggguuuauccuucauuuucucuuucuuuuuguuaguaauuuaaauauuuacuauuugagaauaccauaugcaaugcauauaucaauacuuuguguauauuuauauuauauauuuauacacacacuuuaaagaaaucugaaugcuuuauaaauuugauuauuaaguguuuauuugagcaacuguuauauauaacauuauauuguugaauauaagacuuuuuuuaaaacauugcuuguaauuaaauugaaaugaggagucauauaaaaacauaauugacaguaaagauagcacacuauaaaugccaaaucagugugggaaugaagugcugagcauucagggaaaauauccuuucaaauggccgcuuaauguauaguaggaauaaaaauuaggggaagaucuuggaaacagggauuugaauccuagcucuaccacuaacuaacuccagguauguacuuguauuauuuugcugguuuuacuucucugguuugacagcagacaguuaaugcaaggagagugaggcggcacucaacucuuaaaagaggcaggaagaguggacagauuguaaauacagcaaaacuagaagugugugacugcauucauuucacuugcuccacacugcaaggucaugacgguugcaaaguuaugucuagaucugggccagcucugcaguuagaauauucucaguuuguauuuguuuauuugaauuauaugcacuuaagcuugccaaaugcaacacugauucauaaguacacgcuuuuguuugaaaacuauagcuuuuaaaaguugaauuuccuccuuaaaauccguguuuaauaucugaauugugcaugaaagugcauuaucuagauuaacuaguuuuuuucuuugcuuuuuaaaaaacacuuuuuggguugggggcagagguauuggauauccauauguccguuaaaaggaaacaauuguacuaaaugugaauaauuauucuaguuuuaagugauuguggaauacaggcaaauuuaaacuuuuaaaucagaaaaaaguacaagaguugauuuuaaauuuaauguuuuagaaauguugugaucaggccaggcacgguggccuguaaucccggcacuuugggaggcugaggcaggcaggucacuaggucaggaguucaagaccagccuggccaacaugaugaaauccugucucuaguaaaaauacaaaaauuagcugggcgugguggugugcgccuguaaucucagcuacucgggaggcugaggcaggagaaacgcuugaacccuggaggcagaggcugcagugagccgagauugugccacugcacuccagccugagcgacagagcaagacucagucucaaaaaagaaaaagaaagaaaugcugugaucagauuuauuaucucuaaaaaauaacucaugucaaagauuacaauuugagagcucugccuccacccaguggcaccacagagguacuccacucugcuuaguuacaaaagccuaauuucuggaccugauaaaugggaaacucucggcaauagaagucuagggaaggacgaaggcucuucauuucuauacccuccugagcaguuaaaauuuuuuuuuuaccauggauauguguaaauuuuacaaguuugaaauaaugacaaggaaacaugccuguaguauguuaagaacaaaguaaaagguuguaacaauauacacagaauaauauugucuauguguaauuauauggaaagaaaaaacacagaaaauaucaaugguuagcucuguguagauaggggaauggguguuguuuuccuauuacuuuuuaaaaugucuuuuccuauucuuaaauaucugcuaaaugcuuuccuuggugagaaugugauaacaauuuauuuaaacuuuccuauaaagccauccacacacacuuaaagugacugaaaauaauaugcccaccuaccaaaaagauaaacagguuuuaacauuuuucuuuaucuuuuucucugaaauaaacuauuacaaauacacuuaaaccacauugccuacccuuccccacuguuuuaaaguugugacuuaugcuaaagccuguuguacuuuuauuacauacauauauauccauaacauuauauacaaugguugcguguuuagaaguguauauaaauguuaucaaacuaggugauauuuuacaacucuuuuugcucaaaaguuauguuucaaaauuuuuucauguuuauguagagaugaauuaaagucacugcuuaaugaguuaaccauaacuuauauguuuauuuauuguauuuaaaaauccauaguuuauccguuuuucuacuuucuacuuucuuggcccuuacaaacaaugugcaacaagcaucuuuaccuguauuuccuugugcauaacuuugagaguuucucuguguggacaccuagaaacggacugcugggucauugggaaggcaccuuuuacuagucauugucaaguugcucucaaaauaguuuacauacccacuguuuuauaagggugccugugugccuguauccucaucaguacuuggaauaaccugauuuacuuguuuugcaacucgaaugcguaugaaaugauaccucacaauuaugaaaauuuuuauuuccuugaugacuguugagguugaguaccauuuccuuuauuggcauuuguuguucagauuucuuccugaguugcuuguucuugcuguggaaucccugcaagauuccauacugauguggaaguguucuuucuauuuucugguuauuugagaguugcaaauaucuucuaaacuuuggcuuuuugaauggcaaauugugaaucugauuuguguuuuuuaugucuuuuucaacagaugauagguuguuguuugcucuccuuagaguuuuuaaguuuuucuuuaauccauuagcccuuuaauccaccuagaaguuauuuuuguucauagugugaaguuggaaucuaaauauaucucuugauauacggguaaacaguugucucagcuucauuccuguucuauccuugcugacuuauaauaccacuucucuccauagauacauaagugcucccagcucucccauuuuguuucacuggcccuauucugcuuuaguuucuagaguuuuauaaaaaguuuugauauuugauaagaccaagucuuccuuuauuguucaaauucagaauuucuacccuuaacuaaucuucugaauuuuaagaucagcuuaugaaauuccaugaaagguuccauuggguuuaaaaaauuuuuuuuugaauuugugaauuuauuuguggagaauuauuaaucaauuccauuuaucgagaucuuuucuaucuuuaaguaaaauugauaauuuauuuucucugugcaggucuugcuuuuuuuaaaaaaagauuaauuuuagguaccuuaauaaauuuuugguagguauauauguuaccuuucuuauaaaacuguauuucagauugcuuguugcugaugaggaaaugccguuggauuuggugugcugaauacagaauaccaaauacagaaacauauauuuaaguauuuuaugguagucuuggauuuuucauguuaauacuaguagauuuuuuccucuuuauugcccaagcuaagaccuccaguaaaauauugaaugaaaauggugacugcaggcaauagggauugccauuucugacuuuaaagagaaugcugccagaauuucaccaggaaguauuuuuuuuaauguuuuugguagauuacuuuuaaguuaaggaaagucauuucuauuucugucuugcuaagaaugguuuuuuuugguuaaucaguggauauuaaauuuuaccaaauuauuuuucugcguaauuugaagugaucauucguuuuuuauucugcugaauuuuaaucuguuuaaauaaauccuuuaagugucagugaaacuauauuugucacaauguacaauuuuuagaaugaguugcguuugguucguuauuuaggauuuuugcaucuuuaaucacacauuggauuagccaguaauuuuucuuccugacacuaucuuagauuuugguaucaagauuauauuaacaucauaaaauaaaugaaagaguagucccccucugcccauauaugugguuuugcuuuucaugguuucuaguuaccuguggucaacuguggucugaaaauagugaguagaguacaauaagguauuucgagguggggguggggggaaaccgcauuuacauaacuuuuauuacaguauauuauuauaauuguucuuuuuuauuaucuguuauuaaucucuugcugugcuuaauuuauaaauuaaacuuuauuauagguauguaugcauaggaaaaacauaguguguauagaguuugggacuauccaugguuucaggcauccacuggggucuuagaaucuaucugccaaggauaagggggaauacuauacuccuuauucuuucauuccauucuuuucuacuuuuagagaggcagcaauauaaaguaggguuaagauguggaauucuggaacaagauugcuuggguuugauucuuuguucaccuuguaguaauucuauuaccuuuuacucaggacacugagugggaggcacucuccugaguuucagcuuccuuuucugugaaauguagccuaccuuguggagauaugucaaaauuuaaauuaaguaauaccuguaaaacacuuggaaccagccccugggugggcuacaauaaucacccauuaaaugguaugauuuuauucuguaccuugaaauagucuaagguauggauuauuuguucuuugaggauuuuaaauacauugccuauggauugaccuugauguauauauguuuuggcaaggaacagaguuuuaaacuauaguauuaauuuaacuucuuuaaugauuaaaaguguagauuugugaaguuacauguuucuagaauauuguguuuuaucugaguuuuaaaauuuauuggcuuuaaguuguuuauacuguuuuauaugauguaaaaaaucucaguuacaucuuuaaauuuuuuuguuccuaauaauuacuuaucuguaucuucuuuuguguccuuuaucaggcugacaguuugucuauuuuauuucacucuugucgaaauccuguuuguuuuguuaauauugucuguuuauuucugcucuuuuauuuccuuucuuggaauuuacuuuuuuacuuauuguuuuaauauuuauacaccucccacaugaauuuuaagucuuuguuuucucucauauuauuuuaaggcuaugaauuuucucuuuaagaaccaccuuagccaccuccacaaguuuugauauauuaauuugauuaugaucaucaaauauuaaaagguuuuuaauuacuaauaugucacuuccuugaaauaugaauuaucuagaagcauauguuuuaauuuccaaauauguauguauguuuuuuuuuuuguugucuguuggguuuuaaaaacaucuuugccuauugauuucuacuugugcgugauuagagaauagguuaauaugacuuuuuuuguauuuccugauacuugccuugugacuuaguauuuauuggucauauauuuuaaugguucugucuauaucuggaaauuacauuuucuuaauuguuaguuacaggguacuauacagucuguuaaaucagguguuaggauaaaaucuucuguauacguauacauuuuugucuguucuucuaugaguugcagagagauguuuguuaaaaucucccaugguggucaguuucuccuuacaauucugcccauuucuguuuuauauaauuuguacuaaguuauauuggugaauacaaguucagguauaauaccuucuuuacagauuuaacuguuccuuuuauaguuauguggacacugcuuuauggcuaugcuuuuugccuuuaaguuuauacuaccugauauugaaauaccuauaauagcuuucuuuugauuaauauuugccuaguguaucuuuuucacguucuucaaaauuuuuccauuauuagacacuagauauaucucuauaagaaaauagcaguaacugguuuuauuuuguauccuauuugagaauauguuucuggcuaaguuaaauuuaauccaaauauauuuacucuccuugcugaucuguuugaauuuaucucuggaaucuuguuuugugguuucuguuuuucacaccuuuuaucuucucucauucucuugaacaauucaggaucuucagaggcuuuaauuuuagccacugcucucgcaucuuaaauuauguguuaacguugucugguauuuuguuuuguuucaaaugucucucaaaacagucacuguuuuuguuguuucuuucagucauaauuuagauauacuuauguguuuauuucucuguuuaucauugcauuuugcuuguuauucauuucuuuuuuuucuuucuuaaaaauauguucuucaguaaaagcuacuucagugagcaacugggaaugauaaauucucuuagucuuugccugaaaauacuuuauuuucagucucacuugaaaguaauaauguaacuagauauaaaauuccagauuaacaauuaguuuucaauaauuauuucucaguuauuuugagguugucauuguugcuguugagaaguuuguagucagucaacuugguucggguucuuuuuagauaagcugccauuucucugauugcuugaaaaauauucucauugucuuuguugucauaugguuucccuauaauaugauuggguguggauuuaaacaguuuuuuuuuuuuuuugcuaauauuugguguguuucuugaaucugaaggaugugucuuuuaucaguucugaaaaaaaaacacuagccauuaucucuuugaauauuguuuuuucuucaugccuucuggaauauuaguuauguagaaauauuagugcuaauauuaguuuauuaguuauauauugcaucuuaucuuccacauuucuuaaccuuucuuuuuauagucuuuugaucuaucuaugcugcauuuagagacauuuccucagaucugccuucuagcuuacuaauuauuucuucaguucuaguuuuaacucauccuuugaauuuuuaacucuaauuacuguuuuucauuucuauuaguuaucuuugauucuucaucaacucuauguuuuaaugcuuucuuuucucauauuuucaauuuauuguuauauaguuucaugauguaaaaaaaucccuauuuuuuaguuuucauuugauaauccucuuauuugauauucuuggucaauuguuacagcaguuucuuguguuugcauagcggauugcuuucucucuccuguuuuauaauguuuuacuuagcuauuguuaaggagauuggcauuauuccacccuggaaaauacugugugagugguaaagugccccucaaaaugccuuucuuugcuucuggcaguaguuucaaggauaucaccaaguugggagcaguuuuuuauauuaacucuuuggaauacaguuucauagacccucugguaguaugaacuugcacuccaaucuaauaugagauguaggcucagaguauugaguuuuucacagaagcccuuuaaaauggcuauauuuagagaucuugaaauaaaauaaauuugcuugcuaauugguuagaauuuuacccuuucacugaggaauguagcccuucuagguccaggcuuuuauccagagcacugacucauuauuccaauaccuaacgugggcccaaagccuaaccuuacaagugaaguugcccaugcugaugauggguuguaagggccaguaagagagagaauguccaggaagugacuagugaaguggagguggaagauucagucaugucccuuaauaguguucgcuucagcaggaaugcauuuguauaaaagguuguagaaguaagggugugcagacaguacuggggagcgaagccacccacuuuuuguucugaugcuauagcaucugaaccaugcaggagcgaacagcuucagcuugagaagguuguuauuaggugaguuauguucguucaguuaagaguaagaaauggaaugcccauuuagugaggauauugaagauguaggggaaguuuguuuacccaccugcaugagucucaacugagacugguagcagaaauaguuggaucuaagacuucuguuuaguuccacaguaguggguguucaagaaacaaguuuugcucugaacucugccuaaccagcugugagacugugcauacaguaguuaagugauuuccuugauuuaaaacugauugaguucaaagaacuugugauauuucaagagauaccauugcagccuacuuuauucuguuguccuuucuuuauguuaacagucauaaaaaauuugugauacaauacagguuuuuaaauuuaaagauuuguugucuuagguaaauuuuuaagccuuuuugguuaguacauuuagauuuucuguuaaagccucauguuuauguucacuucuguuuguuuuuuaaaccuguuuuuuuuuuguuucuauuucuuaacuuuccuaguguagguaguagagaaugguaauaacuguacaguaacuucaguaaagggagaugaaacagugacauauuagugacaucaguucucuuguguguauguauuuguggugacuguaaagggaacccuggacuucaugagcauguuucuuucuugguguuuuucagggaccauggcuaaaccuccuggaucauuagccagaagcagcagccugugccguucacgccgcagcauugugccguccucgccucagccucagcgagcucagcuugcuccacacgccccccacccgucacacccucggcacccucaccacccgcaacacacaccacacuccuugccuuccccugauccagauauccucucagugucaaguugcccugcgcuuuaucgaaaugaagaggaggaagaggccauuuacuucucugcugaaaagcaaugguauuggcagugaauaaucuacagggcauguuggggcuggguuggggguaaggugugaggagggggcgggaggaguggugcauguuuccauuuucuguugcuacauaucaagguaccacagacuuugcagccucagacaucacccauuuuuuagcucuuaguucuguacaucagaauuccaagccuggugugacugggguuuuugcucagggccuuacaaggcuaaaaucaugguguuggccaggcugcauucucaucuggagcuugcaguucucaaaguucaugugguuguggcgaacuucauuuccuguggcuccaggacggagguccccgugucugugcuuucugucagcugcauggcggcugcucucagguccuggaggcuguccacuguuccuugccacaggaucucccaucuucaaagccagcaauagagaauuucucugcuguagauuccuccuuugcuuugagucuccaacuuccgucucucugaucucuagacuaaaauguaaaaggcuccccuggauaauaauaaucucucuauauuaacaucaacuaguuuggggccuuaauuuuaucuucagaaucccuuuacagcagcaucuauuuuuauguuugauuggaaaacuggaagaagguguguguacaccaggggcugggaauuugggagccaucuuagaauucugccuaccacagacauguagguagauauuuugagauguaacugcuuagaggucacuggacacgguugacucagaucucagagcauaaacuugucaugaacaauuuuauauguaaaauggaaaagcaugagcuugaauauacuugaacacgaagaaauaucggauaugacugacuuaaaaauauuuguugucacuuaaugauuuauucuguuaugugcugguacuugcuaacacauaagcaguaucauaugccaaagguuuaagaaaaugucaggaacuuagaaaaguaaauuaguaacuuaacaaaaugggcauagcagcagcguauuucaguccaacuuaaugacaucagugcuccaugaaacucuuaauuugaggagcucuguucuuaaaccacauuacucuuuaaaagcaguaugguauugagugguaguuucagguauugccacugaguagcuauguguccccaaaggcuuuacccucuucuaugagaagcaaaagggaguggucuacacucuuuaucaugugacucuuuaggugacauuaucaucaauaaucauuuuucauucauaauuaucuaguaguaaaagaaaauuuuaugauuugcaagugaucagugcagcauauuccuaaggagauaaugcaggcuuuauaucuucauugcaguuggagaaucugaugcgacuuugcuugguuaacacuuuaugacuagcuuuucgucugucuuugcaguaugaucauagucaccagcaagaugccuuuacugacagaacuggucuugugugguuucuggaaaucagaaggaaaacucgagagcugcacugucuaauaaaacuuccugcauugauggaacguucaguucucauuucaauagcaaugucaaaguuucauagcuagcucucauaaauaagagaaugauuugaauuuggaaaacuuuucuuccucuucauuuucagucucuccucuauugaaccaccagaauccuuacaaaauaauaauguugaauauuuacugauuuuuuuuuuuuaugagacggagucucgcucuguuggaauguucuaugccuuaugcacauauaugcucauuuaaaccucauuuugaguuuucuuacaugugaauucaacuccaugucacucuggggaaaaaaagaaauagaaaaaaauagcauaagugguacagauaguucaacauuccaaagaguauguacucugcaagaaaauaaaauuugaacuuguauuaugucuuauuauccaagucagauuaguuaugcagaagaagcaacacuuuggauuauugucauuacgcaauucaaauguuagaacuagaagguaacauuagugauuaaucaaauuuucuuacuuuaacagauaggaaaauugagaccucaagagaucaagugauuuacugaggcuuuuacaacugauuaaugguaggaccaucuuaggaacccaagucuccugacuuaaaucaguauucuuuucacacauuguuuagaguuuagaggcuaguuuuuaaaauacuuuuagccuagcuuagaauuucacacacaaugcagcaaagccacauaacagaagagaaaauauucauaaaauuauaacugaaucagcuucugacuuuggaagcugaacagcuucagggaacagugauauauucuguucaauuaauggacagccauuccaaaaaaggcuuugcagaaaugccucuaucaaugauugauuucugagucugaucauuuccucauaucugaacugcuucuugcuuucuguuagcacuacccauuauugaauuauaaaagcauuugagaauuaugcagcacacguagguguauuaugugaaaccauuaggucguuauuuaggggauuuuguaccuuucgagagcuuguagugcaguaaagacgaucuucauagacauaugugaguaaaguacauagaaaugacuaaauucagcaaucugaauauguaucuaaaaugugguauuaacauagaauauucaucaaaauuaagugccagaccuccaguaaauguguacaucaguaacaugaaaaugauauuaaucauaggccaucuaagguaagagaucauuuaguuuauucauuuuguaaauaugaauuuaguccuugcuaugagaggugcauuugccuauaacaugagcugccaagacaagugagacaaggaccuggccuaguuccagcugcuggguuauaaucauaugugcucuugccuuucuguucugccuucagcucuguucccuucucacacuguauuucuuuugccacuuuuuaccuugacucucccuuucauuucucaaucauuuccuuucauggagugaacaguauucaccuugggcucggugcgugcaaaagugaaugagacuaaguaguaaagcucucaaaaaaaaaaagugaguaagaugugaucccuguucuuuaauaucucacucuguucauucauucauucacccacccuuccauucauucauccaacacauuuuuaugaaguaccuaccguaaacuugccacucuucuagugcagagaagacagaaguuaauaaggcuccuuguccuuauuuauuucuuuuuuucugggauucugccuauaaacaaguuaauauaaaauaucauuuuagguuuugguaaguuuugggguugcaaacaaagacagguaaaaggaaagagaaugcuguuucagacaaggugguuagggcaggcagcaguaaccugcguacccuggagaaguaagccacguggagauggagaguagauaacaccaagcagagggaacagcaaaugcagggcccugaggggucucgagguuggcauguuacaggaacacaagggagugugcaguuggagacagccagggaccacauguacacggccugguacgcuuugacaaggacuuuggaucuuacucugaguaugagagaaagcacugggaaguuucaaguaagugaaugauauguuuugcuugaguuuuuaaaaaucacuuuaauggcuguguagagaaguagcugggagggaagaaugagaaugaaagcaggaagaccaauuaggaagccguugcaaucauuuaguugaguuccuggcuguugcagaggaaggaugggagcaggggacauaauaaggaaugguggauuugagagagauuugaaggaaugggugauggcauuuacuauauguugguuuugggguuacaaaauuuauuuuuccacuguggagaaaaggaggaaaacauucaaaaguaagaaugcugugagaauuuacugaaugucuguuuuuuuuaaaaauagcaucauauguuugccccuccccuccacugccauacucugaugugccucgauucccugccccccuuuuaaauuugguagaacuuacauuuuaguguaauuccuuucauguauauuucuuccuuccuaacaaagcuauaguucaucaaguuaaugacaaagggagaggcagugacuaaaauucaucuuuuaaaauagcguuaacucugauuuagaaagaaaaauaguauugaaacaaaacauaaaaguagcugagaugauagcugaaucacccguaaaauuuaacauuuuaauuuauuugacaaaaaggagguguaccuuauauugucuguaguuuguaagauuucuuuauuaugguuuauguuaaaaauccagcauugaguuuugagaagccauauuauuuaaagaaguaauguucuaauuuugcugaaauguauauagaaucauaucauuucccucuuuuaaauuucaaaaagcaaugaaaguuguuuuaguuagaaugucugcuaguacucuuaagaacauacugauuuaaaauuuguaccuuuguuuguguuucauucagggaagugccagacacagcuucagaaugugacuccuuaaauucuuccauuggaaggaaacagucuccuccuuuaagccucgagauauaccaaacauuaucuccgcgaaagauaucaagagaugaggugucccuagaggauuccucccgaggggauucgccuguaacuguggaugugucuugggguucucccgacuguguaggucugacagaaacuaagaguaugaucuucaguccugcaagcaaaguguacaauggcauuuuggagaaauccuguagcaugaaccagcuuuccaguggcaucccggugccuaaaccucgccacacaucauguuccucagcuggcaacgacaguaaaccaguucaggaagccccaaguguugccagaauaagcagcaucccacaugaccuuugucauaauggagagaaaagcaaaaagccaucaaaaaucaaaagccuuuuuaagaagaaaucuaagugaacuggcugacuugauggaaucauguucaaguggcaucuguaaacuauuaucccccacccuccacuccccaccuuuuuuuugguuuaauuuuaggaauguaacuccauuggggcuuuccaggccggaugccauaguggaacauccagaagggcaacugucuacugucugcuuauuuaagugacuauauauaaucaauucaucaagccaguuauuacugaaaaaucauugaaaugagacaguuuacagucauuucugccuauuuauuucugcuuuguucucagugauguauaugcaacauuuuguugaaagccacgauggacuuacaagcuuuaauggacucguaagccagcaugggcuugcaaaaauuucuuguuuaccagagcaucuucuuaucuuuccacagagcuauuuacauccuggacuauauaacuuaaaagaaguaaaacguaauugcacuacuguuuuccagacuggaaaaaaaaaaaaucucugcaagugaaacuguauagaguuuauaaaaugacuauggauaggggacuguuuucacuuuuagaucaaaauggguuuuuaaguagaaccuaggguuucuaauugacuugauuucuggaaaugaaaacccgcgcuuuuauuaugggaagcuucuugaacugcauuuacuauugugaaguuucaagucccgcuguaaagaucauguuguuuuguuuuccccagggcuuucacugugauuuacugcauugcaggcuguaugauaaaacacacauaauuuaaagagagaaggcucuugauuccuuaugcaaguggaagaguugaaacuugauugaaggacuuaaaacauucacaaccuuaagccgagguggggggauauggggauucaggcaauuguuuacacacuuugaauaacugcaaaggauuuacgguuugugaaaaauguguacuguggaaaagauaauaaauugaagacauuauugugugggauugugcugauuuuuguugauaacacaaaaaacacuauguuuucuggagagcuguguaagcugucuuguugcuuaguugcaauauaagaaauagugauguuuuggacguaaguugucaacaaauuucuauuuuauauuguuauauuuuuauguaguuugaaauguaaaaauguucuaauaucaagauuaacaaauauaaauuuauggugcauuuagauugcguuguauuaauuuauaaaguaugguguucauuaaauugguggguuguauaaggguagcuuuuguuguuaaaaaaacaguagagaguuaaguuccauauagcaacaaaguauguuaacaucuagggaguuucugcuuauaccacuuuaaaaauaugcaaucauaagugauuugguuacugcaaugcagauggauguuuggaugaacaacugauacauuuuaguuagaaugcuuuuucagcauuauggcuaaaauauaugucuaacccagugcuauuuaggugaaaaugcuaauugauaaaccagaaguuucuuuugagauuugcuuuaaagaaaugcuuuaguaagaauaugaacaauuuccugaugucuccuauaaauugugauuguuuauucuauuacuauuguuaaaaacuugaaugguauuuauauuggcugauauuuauauacuuaauagauugaguucuguaagggcaaaaacggauugaaaugaacauagcguuuugcacuaaugauaagauaaccugagagguaggguugaggaacacaggguugaaagcuguuggagaggggaaaaguugugcauaaagaacugaaaaggguucuggaguguucauucagagugaagggaaaacuuuauccuucuauuucuuauaaccagacaggaggaguucuucccuuugaaaauugcaaaaggaaugagaacuuugcaguuggaugaauagagaagggaaaaguugcuggagcacggagugaagaugggaggagcuguuagcaaggcccacugcugcuccugggugagaagggagcucuggagcaggaccagcugggggccggcacugcugcuuagaguggaggaggcuggccaaagagacugugggcuguuuucagucagggagcaugugcauuguuugugcucaauuucagacacucauuuauaaacaaauucaaccaagggauauuuacugcuuuauguugcuuaugauaauuauuuugcauuaauacaguauacacauuuguaaauucaacaggaaauuauugaguuuuggaaagcuacaguaauuucuguauuacaucauuuauaugugaaaaguuggacauuucuguaaguuuuuaaaauuauccauuuguuacuuuaacauuuuaaaauuaugguguuuuccugauuuuaaaagcaauauuuuccuuacuguaaaaaaaaaaaaaaaaagaucgaugauagaaaaguauaaagaagaaaauagcaagcaggucaaauacuacuauccaaaaugaucacuuuuaauauu

SEQ ID NO: 14350 - RNA, 814 nt, Homo sapiens
uuuuguuuuguuuuguuuugaauagcaaauaguuuauugguaaguacauaguuucaaugggaguaauaaauucacaugagcaggagacaauaaucaagucaaaagaauaaaugcuuacuaaucaucagaaaaucuguggccauuaaggcuggcacauaaaaauccaaaaucacucagaggccgaaucuuaaaagaagauucguccucuuauuaguucauauggaauagguccauaguaacuggaaucuguagaauucuguagauuuaucaccuucuaaccaaacaugacccacugggacauaacuguagcuuuuaaagaaaucugauggacuaguggugaggauuuugucuccuuccaaaccaguuacucuuuuacaaauauuugauguuggaucacuugggcuuuuugcaaucacaaugucaccucuuuggauacuaucaaaaugucgacuaagauuuugugcaaagacaguaucugaauuuugaauuguaggcuccauugaugguccagaacacaugacaacaccaccaacguauucagaagcacagugagcuauacagccauacugaauagcauagccaacaagucagaagguuuccccagagcaccacgaagcauaguucuauguagacucugccaccauuggucauagaucuguucuauaauucauuuaauuuuuagggaagucgcagggcuuccagaaaaaaaaaauuaaagcaugucucaaagcguaugugggugauccaugauuucaggaauccucgggucccaaagaacccugaggacccucaaccaggacacaggugggccuuu

SEQ ID NO: 14351 - RNA, 4258 nt, Homo sapiens
gaguccucccgacucggggucgggcggcgggaaggaggguggccguggcggggguggaggugggugcccagggcucagagcuuguggggguucacccacuuguaggugcccucauacuggaaacccacucucuucaucagcucgucugccuccguggggccucggcuggagagugacggguggaggagaggcaugagguagcuccacccucaccccgccccugcccgcugggcucuguccccagcccccacccuuuccucaccugccauaaauauaggggaugggcuugggcuucuccagcucaaucuggugcagcaguggggugaaaauacgccaggccucacggagcucgucgcugaggggacauaguauggcuugggaggccgguggcacacagggagggagggcaaaggccaccccauagcccacagguaugcaggggccggcagcugggccucaccugcgcacgaagugcaucuggcucccgcagaagacguccaggaugaggcgcucguaggcgucagggagcuucacguucugugagggagagagugucuugcugaugccacugccugccaccauguggagucccccgggcccaggccgcccacccuccacacugcuccuucucuguagggcaccuuguaucuguugccguaggucagguccagcuccgacuccucgggguugaagaacaugcccggcuucuuggucaucaucuugguguacacggccucguugggcugcacgcggaucaccagcucguugcgcuugcacugcugguggaagaugucgccggccacaucauggaacugcagccucaccucggccuugcgcucguucagggccuugccgcagcgcaggaugaagggcaccccuacguggcggaaagggcagccucagcaccagcucucucaggguguggaccagugcgugagugucucagugggagcuccagugcccgcacacagggcaugcccaguucugccuugcugggccucgaaggcaucaccuaccaucccaccucucauucuccacauagaggacgacggcugcaaaaguggcggugguggacccgcggggcaccguggggucguccagguacccuuugguggccucgcccucuccaucgggguuccccacguacuggcccaggaccacauuguuggccugcaccucugagaugcauuucaacaccuugaccugagagaaagccaagggagagaaugggcuccuuggguguugaguuggggugcagggaugacuguggccacagaugugcagcccucagggcaggaggaggccccugcuuggcucugcucacccugccagaggcccagcucagggccccucccugaggacccuccaggaccacccugguccaucucgagucuauucugaugaacaagcugaggcccagagaggcaauggccuucccuggucacauagugacugucaggccugggacaugacaacuugggcuucaugacugccaguccaggucaccuccgggaggccacgcugugcucagagguggugacuucuccgggguugaggacaccugcucugcaugcacaccccagcucagugccucgucacagaugggccugcgacagggcaugcuccuggggacuggggugcacccccuaccuucucaucacggacgucaucugaguugguggaggcgggcuucuccauggccaccagacacagcaucugcaguaggugguucugcaucacgucccuggggacggaagaggccagagcucgccuuagcuccccgcccuguucaccugguucaagggcauggggaccccaaacaaggcuuccuagugacaagcugcaagacucacuuccugaucccccuugucuuccagguccccuuaaaucaaggaaggacauggugaugcuaucacugaaucauaaaaccguggggugcuuggcuguguagggguccagcccuuuccagcccggucugauagcucagacacuuagguuuugaacugcagggugaggaggagcucccccaagauagggaagaguagcccugcagggugacuggcucugccacccugugccagccucccaggagagaggaagagcucucaccggaugaucccaaauucaucgaaauagcccccgcgacccucagugccaaagggcuccuugaaggugaggauaacgcaggcgauguugucccgguuccagauggggccgaagauccuguuggcaaaucugcagggaggggcaagguggaggaacugaccuugggccucuguggugcaggggccacaugugaggggucacccuugucugaguucuggaggaauucguccucggggaggcagugggccaggugaggcuccugaguaccacccccacccuggucccccggcccaggcuuggccccaccucagcaccaugagguucugcaccaucuccuugcccagguaguggucgaugcgguagaucugguccucacggaacagggaggagaugugguuggacagccggucagagcucugcaggucccucccgaagggcuucuccacgaugaugcgguuccagccucugcugggagcccggagcugcguuacccccuugaaccccucuucggggagugaggaucagagcugcaucauucagacgcccucccaggggaguagaggccagaaccuccucgcccccguggccaccucccgugccuuguguucccagaugacccucuggcucaacaccuuccgggaagccuucccacccugggugccaggguggcauugcuggcaugcugccgggggcccguuccccuccugccucaugcuggguccccggugggucugaguggccugaaggccuguaggggagcagggggaggaggcauccaagccauggcuuccucauugguuuugaaaaugagaagaggaccuuugcuuuacuacccccgcauucaaaaccagccagaggacaagagccucuggcuggguugggaaaccacccagcgcgggccaugcugcauucgcagagcaaggcugccacccugcggccuggccgggccuuuggggaagcagagcggaaaggcgguguuucguggagcaacgcugccaccuuguggucccgcuggggauggccccggcaccauggaugcugcccagauccccggccccggacacgcucauagaguggugggagcacugccugggccagccuggcaggcgggaagggagggcaacggcaagccuuacaucuggcucaugcaggacucgugaauguucuuggugacggccucguagacggucgggggcaaggccagguagaagaggcgguuggccugugaccccagguggagggcauucauguggcuguugaggcgcugguaggaggcugcaucaucguacuggccagccacauaggaguugcgggcaaagaaguccuccagcuugagcuucuccucugggguggccugggagacacggacagacagacacacagacagaugucagccccucucuuugaguccguguguguucugccccaggggaguggagggucuucccuggagguccagggagggugcccucagaagucaguguccccgucccacacuggguucagccccaucuuagcagcucugcacauccagagggagggaggccaaagcaggcagcacagacacugccccaggcugggaccccugugccuuaggacagaggccagauuucaggauauuuugaccugggagaaauacacuggagaaagcucucucuccaaaaucaugacacccaacuaugauuggcggagaaaacgcagcagagcacagcaggaggggaccuguggguccuggucacgggggcugguaaugggggucucaaggaaguacgagagcaggcggggcggggcaggagaggaggagagcaucccgggaugggauggggggagguccccgaagcuggccaugcugggggcugguagagagggcagaaccaggcugggggaggcccugacaccacccaccuugaagaagggcucacucuguuugcggaugucagccacugugaggcgggaacgggcauagcccacgaugaagguguuuucgggcagaaggccaucccggaacagccaccugagggcagggcacagcuguaaccagugcgggcagggcaggaccaggccugucccuggcgggaggucacaggggcaguggugggacacacuuaccagauggugggguagaucuucuucuuggccaggucacccugug

SEQ ID NO: 14352 - RNA, 79110 nt, Homo sapiens
gagaggcgggaccgagccgagguggguguggcguggggcggggcaauggcggggcgggguucgccgcucccuggggcccagcccagccacucgaucagcccgccggcuccggagcggcucugccuucccgagcgcgggacgcggcgcccugggggaggagggcgaagcgacgcggcgauggcuccgcgggcacucccgggguccgccguccuagccgcugcugucuucgugggaggcgccgugaguucgccgcugguggcuccgggugaguguccggucguagccggggcgccgggugcugagcccggucccgggagcgcggaaggaagcgaggggucgggacggcagccccgcggcguccugcuuucuggcacagccgcgggaucccggcacugaacaacuggcugucccgcggcgguccgggcagggcgcggugcguggcaacggcucccgucccuccccucccgcgggccccgcucccgccuucccucccuggggccuccuccgaggaucuguguuccccagcgcugggcagugcggggcguagggaccaggccuucuucgggggcgcuuccuccacggccgcucgccucggaaccccgcggacccguuucccgccgcccuuguccucaaaggcgccgcgagcggaagaucgugacacagagcaccgggugcgcugucggcgccuccuucucccuuuuaaauaccuuaaaauauccuaaaaccuggaggacuuugaaucucuuuccacguuuccauuuauuugggugguugauggauucuuguaacaggucaaggaguccacauuucuucccauauauccuguauaaaucaggcucggaaaaagggaaggcgcguugguaaacuuacauuuuuuucuucuuuuuguugauuccugucgucacgaaaggaaccuuguguggucagggcaggaagccaccaacagagaugcuaaagugucaccaacgaugaagcaguuuuuaauugaaaucaaucuuaagaggagguguaaguuuuauggaaguccuaugucacauccuugcuuuuauaauuacagacacuagggauuccuuaccaccgcuuccccucuuaauugccaccuaacagcugcaguuaaaaaaaaaacauacuuacuuggccauuugggguuacuacagcugggaaucugacgucagcaagcucuuccaagcuugauuucagcggugguuccuccucaggcccaaauaauaagcaacuggaagccuuucaacagugacugucuccuccauaaacauccauaaacucuuccuccugagaacauuucagucgcuuacaacuuuuacacugacuuagcaguuuggccuucacuuuuucauagaaaccagagcagguuggaagggaaggagauggauaauauugucuccugagucuuuuuagcaggcccguauuuccguuagccauccaccuggggaaauggcagcuagugacauguuuuacuggaugggacaauuuuuuuuuucuuuuccuuauuuugauacaggggcucauuuugucacccagacuggagugcaguggcacaaccucggcucacugcaaccuccagcucucugguucaagugauucuccugccucagccuucugagcagcugggauuacaggcaugugccaccaugcccggcuaauuuuuguauuuuuaguagagaugggguuuugccauauuggccaggcuggucucgaacucccgaccucaagugauccuccugccucggccucccaaagugcugguauuacaggcaugagccaccaugcccugcugguucauuuugauuuucauccugcguuugauugcugggacacauaggugcauaaucagguuccacuuggaugugagguuggagacauucauuagaggguuagagucaguugcaacagaaucuggggaagaguuuaaucugggaguaaaauuauuaaaaauucagcacaugaugcauguaauuagccaucaucagcaggagaaauccaucccuagaguggguguguguuugguuugaccucugagcaacacccaggucucaggacuagaaugugacugaugaaagcucucaucuaauugcaugacagccuuuuuuuuuuuuugaugaaaauuaaugcggaagaagaaacaggugucuaaaaaggaaaggauacagagcacaaauuugccaguaucuugaggcguguguaaagagaagaugcucugaccagccaacaucugauccccuugcaaccaaagaugguguuaauguuuguaccuugagcauagggaaguagagggaaaggaaugggaaauacuguugagugccugcugugugccaggcuuuggguugaguacuuuguaugcauuuuuauuuuuauuuauuuuuuucuuuuugagacggagucuugcucugucgcccaggcuggagugcaguggcgcgaucucacugcaagcuccgccucccggguucacgccauucuccugccucagccuccagaguagcugggacuacaggcgcccgccaccaugccuggcuaauuuuuuauauuuuuaguagagacgggguuucaccguguuagccaggauggucuccaucuccugaccucgugauccgcccaccuuggccucccaaagugcugggauuacaggcgugagccaccgcgcccggccgcauuuuuauuuguuuauuuauuuuuauuuuuauuguuuuuugagacagagucuugcucugacucccaggcugaggugcaguggugcgaucucagcucacuacaaccuccaccucccaggcucaagcaauucuccugccucagccucccuaguagcugggauuauaggcgcccgccaccaugccuggcaaauuuuuguauuuuuuaguagaaucggggcuuccccauguuggcuaugcugguuuguaacuccugaccucaagugauccgcccuucucgaccucccaaagugcagggauuacaggugugagccaccgcgcccagccuucauaggcauuuuuaaacucauugcucauaacccugugaaauacuuacuuccaguaaggcaacugaggcaagagagguuaaacaacuggcugaacaucacauagguacugugccagucagcauucagagaagcagaaccacuaggaggugucuguguauguguguaccuuuauauguaucuuuaucugggauaacccagccugcuugauuccaaaguucauucccuuuccacuguaccccacugcucugcagaggaaaaauagaauaugagucaaccucugcaaucucgcugagauucuaagauaguuuagaacgucauaaaauuguaagcaugugguuaucagaaguugucaaguagagaaaagaagggcagauagcuucacgguggguaguggcaaugccuuuuucacuuccuuccuaguagaagaaucucauuaaacuugucucuuagcagcagcauucgaaacuauauaccacaagcacccaaagggaugauuuuccacgucuuggcuuauuaauguccuuaaguucucugguuacucaaccuucagguuuauuaguuucucucucagacagugggcauagcccucgaguaaggaguggguggaagagguccuggggcuggugagaugaaaaaugcauuguccuugggcugcaggcuucccuccagcauucugacuccuuuuuagaaacuaaagauaagcuuuauuaaauucuggggucucucuuagccagguagcugcgaagcuguacauccacauaauauauaguguuuggaaaguuuugaaaaagcacaccuuggagcuugggaguccauaucuacauuuaauuuuaaaaggaaaugaaaaaugugagaagucucugucaauucccugccccuacccccucuaaaaauggaaaugaaaugaaucuauuuggaaauuugaagaguugaauuugaaugugagagaccaaagccccaagugaacaaacaacagauuuuauuguuucuuuaaaaaugauucuuuggcccuaauguugaaguuuaaugacuuauugaaacaauagagaaaugauuuaaagcugacaaaaagaauaaauuaaauugucauugguauaaacuauuagguugagugguuccuaauaauuucggacacuuaagugguuguaaagauuuggugugcugcugaaagcggguauauuaauaauucuggugugauuuauaaaaacuaaaaucagaauuugguguuaguacacuguagacacuuuacucuuuuaggaaaaaggaauucaauuuuuauuauuaccugguuugugugcaggcgguagucuaaauaccuagaucauuucauucuuacaauuaauuuccugucaguuauauacauaauuuuauuccuguguuuguagaugaggaaauugagccucagagaaguugaaaaagucacucauguguaagcuggauuuugucauggaguccauugagucagaucuguuugauuuugaaguccaugcuuauuauuacuaaacuauuuuuuugaguaagaaaauucuuuuuauucuaacauauuuguaaagaaucaguaaguaacaaggucaugggaugcuaugguggaaagagcaccaagccuuaagucagggccuuggacuugaagucaaaaaucagaaggaagccgggugcaguggcucacgccuguaaucgcagcacuuugggaggccaaggcgggcagaucacgaggucaggaguucaagaccagccuggccaauauggugaaaccccgucucuacuagaaauacaaaaauuaguuggaugugguggcacaugccuguagucccagcuacuggggaggcugaggcaggagaaucacucgaaccugggaagcggagguugcagugagcugagaucgugccacugcacuccagccugggugacagagcaagacuccgucucaaaaaaaaaaaaaaaaaaaaaaaaaaaacagaaggagacccugaugccugcagcauaugguucuguccaccuccauuuccucaccuguaaaaugggcauugugccaacaccugucucucuguccuacuggcugcucugucuuacugagcucuugucucugaaaguucuggguaaauggcaaaguggcauauaucuuuuauccuguguaucuuuaaaaaauauaguauuuuuucuccagagugcgcauuaggcuugauuuauauuacgucauuuaaacugucaaauaaauguggaccacauauauuaaacaguuuuuauucuggagguggugauagcuuugcaaugauagggauuuuuaaaaagcccagagugacaccucagauuagaguuugcuacuguugcauaggaguuaaguagccaagccaucuuuucucauuucccuuuagcuaaaauacagugcacuagguauuuuuggaaaauuuccccaaagaucuaaaguuugugggaggaaggagcgagaaucacccuugauuccauuacuccaaggcacuagccauuguuagcauauuucauucuggucuucucuaauugcauuuuuuuuuuuuuuuuuuuuuugagauggaguguugcucugucacccaggcuggagugcagcggcgcgaucucagcucacugcaagcuccgccuccaggguucaugccauucucccgccucagccucccaaguagcugggacuacaggcgcccaccaccaugcuuggcuaauuuuguuuuuauauuuuuaguagagacaguguuucaccguguuagccaggauggucucgaucuucugaccucaugauccgcccgccucggccucccaaagugcugggauuacaggcaugagccuguaauugcguucuuaacucgcauagguucuuuaauugcauuuuuaacucggauagguucauaaugcaauauaacuuuguaucaugacuuuuucaguuuauguuacacagaaauguuucucuauuucccuauacacccaaaaaagggcugccuacuguuccacuauauggauucacuguauuuuacuucuauguaucuauuugggagauuucaguugcucauuauuuuuaagugaguuuuaaaacucauuucaaugaaugccucugugcaugaaacuuugccuaaauaucagaggacuuccacagaaaauggguuccugaaaaggcacuuugagggucaaagauguucacauuuuugaggcaauugaugacaucaguguugaucugaaggucaucccagguuacauucucacagcaauagccaaaaagacucaauuucauauucuuguuauuuucucugaaaaacauauucgcuaauuuguuaggcaaaaauugguaccuugauuguuuuaauuuguacaugguugguaacuaucagguugauuuuguuuucuucuaguuuuugagccauuugcaaguguguaauccuuuauggauaauucugaaauguaaaaagcucugaaaacaaguuuuucuuguaggcuuuugauacccucuguagguuguaaaacuuaacuugaacuaaugugagguuuuuaauuuuuuuuuugagauggagucucucucugucucccaggcuggagugcaguggugugaucucgggucacugcaagcuccgccucccggguucaagagauucuccugccucagccucccgaguagcugggauuacaggcaugcaccacgcccagcuaauuuuuguauuuuuaguagagaugggguuucaccauauuggccaggcugaucuggaacucuugaccucaugugauccacccaccucggccucccaaagugcugggauuauagggaugcaccaccacacccagccuaaugugugguucuaugguauauauuauucuaucuugacuauuugcauguucugcugaauaauauuaaugaauuugauuugaguguuacagguugugcgcuaaaugcauugcauuaccuuccuaaaaucacaagguuugaacuuugaagcacaucugacuuccagguuuucagauaagggauuaugguccugcauuuucgcuucugugacucauuuauuugugucuguuaggaggcaaauauaaaacugcucaaaguagcaaaauuuccaauggggaaaauaaguccucaaaugagugacacuucagaaaaagaaguacaacuuugguacucuagugugaaaucuaagaaaauaaggguacccccaaaaaacuaagauuuuguuuauuccaagugacuuuaugaaugggugccaauuagaauggaaacuugucggcuagauggagaguuugggccaaauuucuccucugcuuucuuuugccaguuacuaacacaguucucuuuguaagagaaacugaaucuacccaagggauuuucuggaggauggauggguagaggggccggacaucuuaccuuggggauccuuuugccaaaccuguugaacucagaggaccugguuuuccauucccaccugcaauaccccaaggcccccggcuucuucucuuuacuugauagcacugucccaggaucucaaacagagagaacccgccagccagguaucucccauuucccuugccagcugccagcccuaccugauccuccucucccauuuuguuugugcacucuuguggauaacugcauuccagccacuaauaaaagugccuguuguacagagagaaaaaaaaucuuuaaauuacuuuccuuaucgguauuauagagagaauauggcugagcugccucauagcauuguugugucaguuauguaagauaaaacuagugagugcuuggcacacaguaagugaugaaaaaguguauuauuauuauugccuaggcuaaaccagauacuaaccuaucacagcuaaagaaugagacaaaguuccuaaccacuccagaauuuuccuuuuugggccucugccauuacuugagggguuuccugucaccuguugcuccugagcccugggugcugguuguguaaagggcagagggggcuuugaggaggggauguugggcagugcccgaaggaguagggucugaugggcuuggcagaguucucuugggaggcaggggauuuguggggcagagccauuagccaccaaaacuaagcaaagaaggaaggaaagcauuaccuuuauaaggugauauagucuguauauuugucccugcccaaauuucauguugaaugguaauccccaguauuagagguggggccugguggaaggugauuggaucauggggguagauuucucaugaaugauuuagcaucaucaugagaagugcugcccucacgauagugagugaguucacaagagaucuguuuguuuaaaagugugugguaccucccccccaacucucucuugcuccugcuuccgccaugugaugugccugcuccucuguugccuucugccaugacuggaagcuucugaggccuccccagaagcagaugccacuaugcuuccuauacagccugcagaacugugagccaauuaaaccucuuuuuuuaaaaaauaaauuacucagucucagguauuucuuuuuuggggggacaaggucuuguucuguugcucaggcugcuggagugcaauggugugaucucggcucacugcaaccucugccuccuggguucaagugauucuucugccucagccuccugaguagcugggauuacaggcaccugccaccaugcccggcuaauuuuuguauuuuuaaguagagacuggguuucaccauguuggcuaggcuggucuggaacuccugaccucaggugauccaccugccuugggcucucauaguguugggauuacaggcgugagccaccgugcccagccucagguauuucuuuauagcagugcaagaauggccuaauguguaggguagagcaugacauuuucuucuggaagaacuuuggaagauucaccaauugguuuauucuuagauagcugaucuauagguguagucacaaaauugugacaguuuuucuuuaguauuugauguagauuugaugaugacaugcuuugugauuauccagggucugagugcuuauuguucaucuucucguggcucuuugaugaguguuucaaugaaugagacucuuaggaggaggaagcagaguccuguaguauuagggcuggaagagaccuugacuguguccuccaagcuuuuauuuagcagaugcagaaacugagcuggcacagccaggacuuaagugagugucuuuccucauucugggacucuucccauucuguuagacugucuauggaaguggauccagccuugcugccuauggcagguuuccuugaucuacauaugcccuugauccucaugcucaagggccugguuucucagcuccuuggauguaggaugaggaggacuaggaagaacuuuggcuaacugacucaugggaguaauuguguuauucuuagucauauuuuagauucagaagggacuuugauggucaucuuguaauuaacacccucucuuugcagauggggaaacuagcccagaaagguucgguguccuguaggagucaggaguggcuguagcccauagcagaugagcagaccuuuagguuuggugagggagggacuacguguaugucuuguucgccauuguaggcucagauccaagcacagggcccggaauagaguaaauauuuaaauauuuaaaugagggaaggaaggaagccagaguuagaauucagguguuaggacucuugguccaaagcuuuuucuuuauaauaaagugaagaguuacuguuuccaauauucacccacaaaucuuagauguaagccuccccacagcccuucucuugcacuggugagaggcuguuuugucugccagccucugugggccaaauugcuccaaaggcagaaaaaucuggucauggaggaaaaaugaaugauaaugacaaacaagcaauacugccaagaaugauaauaacaaacaaucaauacuaccuuaucaggugauauggugugacauugguagcauuuucagugcagagauuuucgaaacccaaaucucuucaugaaacucuucucaaagacaaacuaaacucagcuguguuucuacaaccgguacuucaaaugcaucuguuaauuguauauguaucauauuccugauuuuauaguacuuuauacuauucaaaaccaauuguuucguggcuucuuugauuuacuuauuuauccaacagguauuaacaaaguaccuuacagugugcaaggcucugagaaugaagugaugugaacaaaauagacucaguaccugccuuuauggagcuaguagguuaucaggaaggcaauuaaacaagcaaaaugacaugcccugaguaccuugucaaggaaaguaugacacagggccaaaauaccuaaccuagggcugggguugggacaugcauggacaaacuagacuccagugcagguugggcaugcucucuggaggaaaugaaagugaaauuuacagcugcaaaaacugcaggaguuggucagguggaaagaacuuguggucaccgaagagaggagguaagaucaagcaaagcaacagcagugguucccaaacuugaguguucagaaguccagcuggaaggcugguuaaaacagaucucugagccccaccugagagugcugaguccauaggacugggaugggucuggagauuugcuuuucaacucucauguuuccaggugaugcuggcuaaguaucaacugugagcaggggagugaaagagauaagaguagauggaauccccucuccucuucuuggggcuguauguauccuguccucugaccauccuucaagcugagaucaaggauagcauuuccaggaaacauuuccuagguauucucacugccuuuauugccuccugugaauacacuguccacaagucuauggauacauguugcaucuuuuccauguuauuuagcccucaguuacaugcaauuguuuccaccauguuuguuuugucuaacuagagcuucuugaggcagcugagcauaugaaauguguacaaaauauuugauugccugaucaaauuuaauucuugcaaccacuguguggagcagguugcauguuauucucuguucuguggagauguggaaacugagacuuacagggaauaaccaagaugaagagaaggggaauuucuugcucaagucagaggaggggaagucaacgugagguguguguucauuguucucaaaugugcuuugcauuaugugaaauugcagguauucggugcccagcaccacuaguagaaggaaaguuuuauauuuaauuuguuuuugagcuuuuucacuauagguucaucuucuuaaagagaauacaaaggcaucuuauaaauugaauguagauuuuguuuuuagcaggagaugauuaucuuaggaauucuacagaaauuguccacuugcuuuuagaguaaauauuuggaggggguaauucaguuuacaugucauuaggcuuagaaaugauuuuuauaaaauuuuggcaugagggagauacaacauaucaauuucaauuuccugaaaagacacacauuagacaauuaugcuauuaccaaucuuugaguggcuagauggauuuugcugcaugguugaagacuuacaaagagccuguacauagcacauucacaagacagguaggguuaaaaacuaacuaaaaagaauuccuuucgauaccaauaaucugccaagccuuccuuccccaugcguagauguaaacauuaucugguuuucucagauuccuguaagagguggaaguuugaagaauucacugggcuuuuguaucacaguacaacuugggaacacuaauuuucaaauguucuaacaguucuucauagcuggaaguccccaacacaauuaugugaauuauccacuuuauaaaaaacagcugcccggaauuuccuggcauuggugaaguggcagauggcuaaugagcaggcguuucuucauuuuucuuugcaaguuuuuucuauaugcucguacggccugaaugcuuuuacugcuuccucaguucuuuccauccuccuucuaaaggcaaaacacagaacaaccaccaaaagaaaaagggaagcauuggauauuguuuaaagcuaugugauagagccaagaagcuggguuuugaaggugaaacucauuucacagucgugauugucaacucagcccuuuuuaauagucauugcagguaaaacuuguagaucauucuuuacagugugcaguuaauuuaaaaaugagguuucucuuauuugagauaucgucaggugcuauguagguauguaaaaugaauaacaaacuucuuuuuuguucuccacaaacuugugauugagaagggggagauaagcuaugaauacaaaucacuauaguauaguagagaauguguuugguguaaucagagaacuacagacaaagugcugugugggaucaaagggagggagacuuuccuucugauaagggcgauggaaaagacuucauucauagccugaaacuuggcauuuucaguggaccuuaaaagggaguguauggaauggugugcugagcaaaggaaacagccugugugcaaaggcauggaggugggaauagagaaguuaaugcagacuggguguggcagagacuccucaguggaagucaugugagaugaggcugcagaggggagacugagguuaggcgacagagccccugaaacugcacuuuacuguguaguugcggaggauaggggacaacaagaggcccccaugcauuuccaugugauagaagagccccagaggcugagccgaaaggagacagggcccugugcugucagcagggcaguucagauugccauucccauuuccuuaucugcagaaguguaggugguagggaggcagagggugagccaucaaacauaauacaguccuuuguaaguaacacaaauaggaucuaugcagcagaauagauuuaaugcaauccauaugauaugcagauagaaacaauuuuucaaaguuuaaggagugcugagaaaugagaaucaugaaguaagugcuaaguauauaguuuuggccuagugugguggcucacgccuguaaucucagcacuuugggaugcugaggcaggaggaucgcuugaggccaggaguucaggaccagcccgaaaaccauagcaagaccccgucucuacaaaaauaggacaaaaauuagcugggcaugguggcaugugccuuucaucccagcuacucaggagguugaggcaggaggaucacuuaagcccagaggugcaaggcugcagugagcugugauagugccacugcacuccagccugggcuacagagugaaacccugucucaaaaaaaaaaaaaaaaaaaaagaaaaaaaaaguauauagucuugauggcuugguggugugaaagccaaggaguguucauuaaugguuaaagcucgcuaauuauguauuuuucuuaaguuagaguaaauaccuucaaauuauacaaaucagcuugucuauugaauucuugauuacaggcaugagccaccacacaugguccagacuauugaauucucaaccauuaaacauuuauauuuuggaaguauguugguauauuuucauuuuuuggcccuacugugggucuuguccuuguuuacuucuccuucccagucuggaggacugucaguguuaaggcaaucucuaaauaaaccaugcauaucagcauugggaugauuuguaaauccugcuuggcuaagggcuccaucucugucacuucuggugaguuuucucagucccuuaauuucuuaugaugugaugaaauagauuugggggaaggaaaacuaaccagcuucaaaguaauucaguauacauccaaugccuacauauuauggaaacaguaguuacacaaacuaaguagaucugguggaucuuaguuccugggugggugggagggauagggauggagaagacuugaaggagggaaagagaauucuuuugcaugaaccauaugguaguugaucuguugccgccacaaaccugugauugagaagguugaucuuuucuacacugguucagugcugcaucuugauauauuagugaguaaagacucuugacuuugagucaaugugguguaauacaaaugauauauuugaucuugucccugauuccugggacuccuaaaaauaacccuugggauuucuugagugauaggaacauuuuuuguuacucauaaugagcuccuuuagaccauaccugaguuugugcuaaugugauccuuggacucuuggugggcccccagguagcuacgggauggggacuaguugccggaggaaccaaccaugugauuacaggguuagaacuuuuagcugcaaucccugaucucugggaagggaaaggggcuggagauuggguucacucaacaacagccagugauuuuaucagucaaaccugugugauaaaaacuugguuaaaacugcagcaaggaggcuaggagcuucuggguuggugacauauggauguguugggaggauggugugccuggagggggcuuggaaguucuguuuucgugccugcuccccaaccauaccuugcccuaugaaucucuaccauuuggcuguaucugaguuguaugcuucauaauaaaacuguaaucauaaguguagggauuuucugaauucugugagucauuguugcccaaaagagucccgaucuugaccccagaagaggguucuuggaccucgugcaaggaagacuuccgggcaaauccguagaguaaagugaaaucaagguuauuggaaaguaaaggaauaaagaauggcuauuccacaggcuauuccacagcagcccucggggcugcugguuggcuauuuuuaugguuacuucuugauuauacgccgaacaagggguggauuauucgugaguuuuccaggaagagggugagcaauucucagaacugaggcuuccuacuuuuuuuagaccauauagguaacuucccaacauugccauggcaucuguaaacugucauggugcuggugggaguguuucuuagcaugccaauguauuauaguuagcauauaaugagcaguaaggauaaccagaggucacuuucauugagucuugauuuugguggacuuucacuggcuucuuuaccacacccuuuuaucagcaaggucuuugugacuuguaucuuaugcugaucuccuaucucauccugugacuuagaaugccuaaccuccuggaaugcaacucaguaggucucagccucauuuuacccagccauuauucaagauggaguuauucugguucaaacgccucugauaauucuagcaaaaugccaaacuuauugaggggggucauggaaagcccccaauuuguagucccuaggcagaagugcaguuagccuggggaccccauuugcggcuggcaucugaaguggggucagucuugugggauugaguauuuaaccuguggagucugcacuaaaugcuaggugguaucagaauuuaauugaauugugggacacccgguugguguuggagaacuggguuuaggaaaaauggaacagacaagucuuuccuauugggaaaaaccaacucauaauaugaaaacguuggggcuggaauaaucucucugaaauugcauaguuuacuauuuagaagauaaaggcucaaaaguguuuuuaaaagauuuaguggggcggccgggugcgguggcucaugccuauuaucccagcacuuugggaggucaaggcgggcagaucacgaggucaggagauagagaucaucuuggccaacauggugaaacccugucucuacuaaaaaaauacaaaaaaucagcugggcaugguggcacgugccuguagucccagcuacuugggaggcugagacaggagaaucacuugaaccuggaaggcagagguugcagugagcagagaucacaccacugcacuccagccugggccacagagugagacuccaucucaaaaaaaaaaaaagauuuagugggaaagaaaaaaaauuaucaggcuguucuuuacuauuuauguguuuacauuguguuuuauaguguaauaaaguagaaguuauacuacuauaugguuuucuuugacucuuguuuccugugguuuucaccaaagauuucauagcacugucucugccuccaaccaauggaaacaucuaaaaugucaauaugauggauuguagguuuaguagucucuuuacuaagggauuuccaguauccugguuuaccgcugucuacacuauuaauauuacucugacacuacagugacaauuucauaugguucaaccuuauaguaaugauggcuccucauugacuguuacuuacaguuaaaaaaaaaaacuaucgauuaugaucaggacauuuuagaaacugcaaaaaguagaaaaagagaaaaaaaugccccagaguuccagcaagaaaacauaaauguuaauuauacuugggagguauuuuuuuuaacagguuccuuuuuuucuuucuuuuuuuuuuuuuuauauuuauuuauuuauuuuuuuauugaucauucuuggguguuucucgcagagggggauuuggcagggucacaggacaauaguggagggaaggucagcagauaaacaagugaacaaaggucucugguuuuccuaggcagaggacccugcggccuuccgcauuguuugugucccuggguacuugagauuagggaguggugaugacucuuaacgagcaugcugccuucaagcgucuguuuaacaaagcacaucuugcaccgcccuuaauccauuuaacccugaguggacacagcacauguugcagagagcacaggguuggguuggggguaaggucacagaucaacaggaucccaagguagaagaauuuuucuucguacagaacaaaaugaaaagucucccaugucuaccucuuucuacacagacacggcaaccauccgauuucuccaucuuuuccccaccuuuccccccuuucuauuccacaaaacugccauugucaucauggcccguucucaaugagcuguuggguacaccucccagacagggugguggccgggcagaggggcuccucacuucccaguagggguggccgggcagaggcgccccucaccucccggacgggguggcuggccggguggggggcugacccccccaccucccucccggacggggcggcuggccgggccggggacugacccccccaccucccucccggagggagcggcuggccaggcagaggggcuccucacuucccaguagaggcggccgggcagaggcuccccucaccucccggauggggcggcuggccgggcggggggcugacccccaccucccucccggacggggcggcuggccaggcagggggcugacccccccccccaccucccucccggacggggcggcuggccgggcagaggggcuccucacuucccaguaggggcggccgggcagaggcgccccucaccucccagacggggcggcuggccaggcggggggcugacccccccaccucccucccggacggggcggcuggccaggcggggggcugacccccccaccucucuccuggauggggcggcuggccgggcagaggggcuccucaccucucagacagggcgguugccaggcagagggucuccucacuucucagacggggcggccgggcagagacgcuccucacaucccggacgaggcgacagggcagaggcgcuccccacaucucagacgaugggcggccggggagagacgcuccucacuuccuagaugggguggcggccgggaagaggcgcuccucacuuccuagaugggauggcggccgggcagagaugcuccucacuuuccagacugggcagccaggcagaggggcuccucacaucccagacgaugggcggccaggcagagacgcuccucacuucccagacgggguggcggccgggcagaggcugcaaucucgccacuuugggaggccaaggcaggcugcugggagguggauguuguagcgagccgagaucacgccacugcacuccagccugggcaccauugagcacugagugaaggagacuccgucugcaaucccggcaccucgggaggccgaggcuggcggaucacucgcgguuaggagcuggagaccagccuggccaacacagcgaaaccccgucuccacccaaaaaauacgaaaaccagucaggcguggcggcgcgggccuacaaucgcaggcacucggcaggcugaggcaggagaaucaggcagggagguugcagugagccgacauggcagcaguacaguccagcuucggcucgguaucagagggagaccguggaaagaggggagagggagagggggagggggagggggaggggguuccuuuuuuucugugcauaccuccucccuuuuuugaaaaacauuuugugauuuuacugugaauaauuaaaauaaaaggaaauguggggaaugcuaagacacaaaacacuaaagaaaaaaaaugacuuauaaucuuaccacuuugauaacauuuugaugucuuuuuuuuucuuauaaaaacugggaccauuuaagcucuaaauacugcuuuguauguguuuuuuuuucacuuaacauuuuucauucacaauugagaucauuuuggacaaagugggugaugacaaaucugaucccuucauacaaaguguuucuauuguuuuaagagugcaaaggaaguuuaggauuucugagaaguaaccaacuguuucaucaguguuauauguagaucaggguagcauuuuaauuuuguaucuuacaaauggcagcagaauuacuuuuuaacaauuagcacuugguuaaaaaaaaagauaaauugacuuggaaagaacguaacuuuuaaauguaccuucucuuccuaauaacugacucacuaggaaaugccauucugucauuguagauuuauugcuguguuacagggauaaugauuaucuguagguuuucuaccuucucuaacucuacuacgugaacccuguaguaucuauaauagagaugagcuauggagaaucccauuccauggacuuuuacugaauguugaaacugugagcccucacauuucagcaguaauggagcagaguguggaguucuggagccaggcugccuggauuaaagucaccuuugauacuugcuaccugugugaccuggcauagguuacuuaaccucucuguucuguaguuuuacaucuuuaaauggggcuggaaauaauagaagcuaccccauagaguuauuguaaggaugaaaugaguuaauaucugaaaaaugcuugaaauaguaacuguacacauuauacaucaauaugugacuauuauuaauaguauuuuuuucugugugucucacugguugcuacugguuuucagaguucuuguuuggguuucaugcuagugacauucauuucucuucuuuaacauugacuucccuacgucuaggguuuuccugguuacuucuguucaaucuuuccuucguuugccuuuucugaagugaccuuuauuuucuuuccuacucccuccuuuacuuugcccuuucucuaacagcaguagcggggacuucacaccaggggacuucagccgggacagauccuuggagcucaacauuuacucaccuuccuuuuccaguuccuauguucucagaagccagcccacgugccugucuugcaggaacauugcccgaccuaaccugugacuaauuggaaaacccuucguuuaggacuuuuguaguucucuguuuagucauuaucugcuuccuguuccuggaaggaagagaaacacuggcuugcauguggggaugugggugccugccuggccuugugguaccaccugagcagugcuguguggucgcugcucacucacccccagggcuuaucuuuucugcaccccacauuuaacacugccccuuccagcccagcucaugugauuccuuguccuuuucuggauguuugauuuuauauccccagcugagcugugagcuuggugaggauagcaacugcuuugcucuuauuaccacagauaauaauaaucacagcaauaauggcuagcauuuaucaagucuuaacuuggauaaacccuaguaaucucauauaaggcuuagaaacuauuauuauuuuauggaugaggaaacugaggcacagagaugcuaauugaccuugccuggggcuucacagcuaggaaacaaauugaacacagugcagccaagaaaaaagccaguuucugcuuuugcuuccaugcuucauagggaguagucuugcuucagaguuggcccugcgugcaacagaccuugguucaaauguuggcccagccauuucccagaugagugacuucagcuucaauacuuuguucuugaucaucuccauuucuaagauggguuuaauauuaacaccuaucucagaguuguagagauaagaaaugauaauguaaguaaaaauuccaguaaagguuaguggcuguuagcaguuggugguaaaguaguugagcauccuagaggcccuggaucuggaaaucauaaacccccaacacuccacaggggcaucagucaccaucucucuuucucccucugccuggucgggugcugggccagucuuccuuucugacgcccuugcuucccuccagccagcucagcaccacccauuuuuuccccaugugauuaguuuauguccuauucugcaggguagaaaugacuuggcuggacuucuaacccugacaggugccaguugugcccagaaaccagggaucuagcuccccaaggacugguuuccugcaccagcucucuguaagcuucagggaauucacugauuuccuaaaggagcaccccuuugaccccauuucuucccguugcuacuggagacaggcugagauggcguguuuccuccuauuugaugguuuuuuucuggcccuugcuacuuagacuuccucccauaguuuaaauaauuucuaaccuaguucuugguuggccucuugcaaggaauauacaugaacaguucuguuaggacucgcagccacguggaaauugggcaguagccuuuggugagguuguguaagcucggauuuagcguccccuuauggaucuggcaguuggggaugaauuggaguccugugaaaauccaguugagagcuaguuccccaagcuggguuuaggaaugugcugcuauuuauagccuuucuuuuggaucuuugcaaacuagaaacuucuguugauuucgaugaacccaggagcaugcugguauauuuacauccuucagaaaggacuuacccaacaagggggugaagcagugggguguaucaguuguccagcucugaaaagaaucuacuuauuuauguuuguaaaaacuguuggcauuuggcaaaugggguguaaguacacuggauauucuguucuaccaaauaggaucuuaacaaaacugcuuauaaaguuacugugaacuuggggacuugauugauuacccaggagcccuucugcaaugagagaauuugcuuucacauauaacauugcugcagcagauguuucaggcacuccuacuguguugcaggaacuguguuagggauuagagguacaaaccuucacuuccccaccuccacuuagggaaagagguguuugacuucagucaggguuuuccggcgaguucuguguccugcugggauuccugccuuugaccgugguaugucugaguggugcgcuguuguagugagguggguggggaaaauguccuccuaagcuuugguucuucugcuuggcucauuucucugccucgacccagugauaucauguaggccacugauuuauuuacagaaugaugauauuaccuaacuucuugggauuagggauuucaaauaaaagaaugaaugugaaagugcauugaaaaguguguuauuugggugggaacuuuuauaucuuguacugugugucccuaucucauguguaugauugaaaauuuucuuuauuccucuccuuucuuuuuaaauauuuuuucugaaagauuuuuagaugccauguaauuaacauugcuaguacaaauuauguuuguggcaaccacugaauaacaguuuuugagcaauaaugugaacacaugcaucugugaauaaggugcuuuucaauagcuagagaaaggucuuuuacuuuuaccuuuaugauaguuauagagggagaugaaguaguuauacaugagugauuuuuuuuuuuuuuugagauggagucucacucugucacagugaugggaucucagcucacugcaagcccugccucccagguucaacccggguucaagcaauucuccugccccagccucccaagcagcugggacuacaggcacgugccaccaugcccagcuaauuuuuguauuuuuaguagagacgggguuucaccauguuggccaggauggucuugaucucuugaccuugugauccaccugccucggccucccaaagugcugggauuacaggcaugagccacugcgcccggucgaucuuuuguuuuuugcaguuaaaauuaauauugggaaauuuugugcuaugaagguuuuuaaaaaaugaagccacuacaaauuucauucaccuacagcugacuucagucuuuuuuuuaugaagaugauuuuuacaccagaagaagauaugugcaaguuccaguguuaaucguauaucauagggucauuggagagaggcagcuucuuaguguuuaagggccuugggugggugaauguugaccuguaugcagcccagcugugugguucauuggugacaguuuaacaaagccaccuaaaugcaugugucacuagauaaaacccaaggccaccgccacuuacagacacuguuaagcaacauggcuaagagugugggccccgggauuccauugucuggguuggauccuguccuccuacacaccgaggcuuguuauugaacccgugugccucauuuuccucaucugcgaauggggguaaugagagaugcuuccuuacagaugcugcgagggaagaaugagauugcccaggaagcauccagaacacugccugacaccacuaacaccccgugugaaugcugcgauugacaauuaaaguagcaacucauucuuuaugacguaccaccuuucagaaauaaucugaagcaaauauuagauuucugaagcccuguugcuuuaaggucacuucaaacaaaugacuucuucagaauuccauuucuuucuugaguggacauaauguguaauuuuaaagguucgcaagagccauuagucagaggcucucuccauuccuguugugcagccacccagccccuucccaggagacagacggugcuaucaguaaauaaagacuuuggaaaaguccccaaauggacagcaccaaaaauagcaaaaggaggaggggcagcgaaagagggagggaggggcuggagaacaggaaaagaagauggggagagagucagcagggagcccucccaguccuugagccccacggguauugcuuuuccucacgccccucucugaggaccccacugaugugugcagccaucagugagggucugugggaaucuccucagucuucugucuuagaggcacaguugguggcuuccuggccuguaucccaaagcaaauaacuggcaagcugaccuugcuccagucuggggugaggccaggucagaugagccuucuguuguauccugaaugcaaaccauuguuugagauacucuggaagaguccagaaguugagguccuuggccucucaagacaccgggauccuagaguuaauuuccucccaagacggagcuuugggcgaggugggaggugggggaagauggggggauggggguggcuguagcugucaucuguguuggaguucuguggcuuuaagaaauaacuucaaaugguaaacccgagacaguguggaguaggcuagggacuuuaucugacucugcaaaguuauuuuucucucuucaguucaaauugaagccagggaugguaauauuuagauuucaucuuuuuuuuuuuuuuuaagauguuucuuuauauugacaucacucaaguuucaguccuuuguucugguagcaacccgggguucaggaaugcucugagugccccagccuccugccugucaagaguguccuguucccuuuuuguccagccaaauucaguuauucuguugaggcucagcauaaaguccuuuuucuuucuggaucaucuuuguuacuucccuucucaaucuaugugguauuuaagaagaaagccccagcuuaaggauagguuaugccccaaauacuacuuuugaguaaguagauuguaaguugaaaugcauuuucccauuaaaaaugauaauuaucauuaguaaugauaauuuuucaaggcauccauuagccaaaugcaucugaaaauaaggauuuauagcuaggcuuugcugacuucugcacguuuuauuggggaaguugucugagcuuccaucuguucccagaguggucuuugcaacccagaaucagacuccagggcucaugacucaugguagcauuucaggaauuuuaacaaaauaaaaguaauugagggacuguaugcagcuggcguugggugggguuuuguuucauggguggguggacuuuggcaggugggugccaucuggguguccccucccugcccagucauagcugccuuuucggggaaaggugggguuguagcagcuguuugucuaggaauugucuggaagcugguagcugccucaaguuucacuacagaguucagcacuuauuuauauacugacuuacaguguucuccaauucuguuuaagcccauuuguucucucuacaacauauucuugagcuugggcaaaugcugugucuuuaugauugccacuguggguagauggucuuagagacugugacuuuaguuaucucuguaaccaaauaggaauaauuuggggaugauuuuauuuuguagaauuugcuuugguuucucuucuuuuauuauugugggcaauugauuuaaacuguauuuaaagaauuaacuuggcuaggugcgguggcucacgccuguaauccuagcacuuugaaaggccaagguggguggauugccugagcucaggaauuugagaccagccugggcaacauggugaaacuccgucucuacuaaaauacaaaaaauuagccagguguggcagcgugcgccuguaaucccagauacucuggaggcugaggcaggagaauugcuucaaccugggaggcagagguugcagugagcugagauugugcuacugcacucuggcguaggugacagagugacucugucucaaaaaacaaacaaacaaacaaacaaacaaacagaauuaacuuaaaacagguuguuuugcacuaguaguaagcuguuagcuacugacuagauaauagguccuagcucuaccaaaguaggacugagaggcuacuagguggacuaguacaccuaguagguauaacuagguggacuaguuacagauucuguccugaaacaagauuuuugucccagguucuuaccaguuuuuguuuguuuguuugugguuuuuuguuuuuuguuuuuuuuuuuugagacagagucucacucugucacccaggcuggagugcaguggcacagucucggcucacugcaagcuccgccucccggguucacgcuguucuccugccucagccucccgaguagcugggacaacaggcgcccgccaccaugccuggcuaaucuguuauauuuuuaguagagacgggguuucaccguguuagccaggauggucuugaucuccugaccuugugaucugcccgccuuggccucccaaagugcugggauuacaggcgugagccaccgcgcccggccucuuaacaguuuuuaaccaugugaccuugagcaagugcaguacccugaccaaucuccuuacucuuagaguugugacagucggaaacccuugggacugguagucuaaacucuaaaugaugugacuucccccgagcuuugugcugaccaaaaucaagauuaagaauggcucugauagcaauucuuccucuccuuacuaggagaguguguguaaauagccacacaucaggucagugcaggguuugcuaccagaugaauuugucagauuugauguugcugucaaaggaguuaugaaaaaauuggauuugagagcuguugggauuuggccuuguggacauggaagaugggcuugugucuucaucuccagcagugucagcccagagugaauuguggaugaggcugcagaagguuggggaauaguggaauuuugagaaucaugaagaacaucagcuccugcuuguaauuuuuuagaugaggaaacugaggcccagggaggugaagugauuuguucaguaucacacagguagcugguggaaaugguggaugaagaaaaaccccuuuagagaaaugaacauuuagacauuuagccaucuugguaaucuagaccaaaaaauagacccuucucagauacugugauuugaauguuagcuuaaaaauaaauaaauaaauaaauaaaaaugggugugugugugugcuuaaaaacuauuuuccagcuaaccuugauguggguuauccacuuaucagccaaguuccuuucccaucaagaguuuguugguucaguuugccaggaaacccuagcuucugagaaugcgcacccuuuccugguaaggagaggaagaauugcuaucagagccauucuugaucuugaucuuggucagcacaaagugcuugggagagauuaggacggcugccuugucuguagucugugguuggauuugagagcuguuuggauuuggccuuguggacauggaggaugggcucgugucuucaucuccagcagugucagcccagagugaaugaggcugcagaagguuggggaauaguggaauucugagaaccaugaaggacaucagcuccugcuucuaauuuuucagaugaggaaacugaggcccagggaggugaagugacuuguucaguaucacagagguagcugguggcaaagguggaugaagaaaaaccccuuuugagaaaugaacauuuagacauuuagccaucuugguaaucuagaccaaaaaauguuagcaacccucaagccaugcccacugggugugagaaaugccauuuccccgccauucugucucggcuccucugaccauuggggucaguuggaaauacaaguauuacuuggaaacaagcuagaaaauugcuuuugacuuuuuagguugacuuccagccaugcuucaugccuccuccucaguucccugcugucuuugaucuuuuucaucucacguuuucuuuuguaaucucagcaggaucuuggcaaaacacacauaccuaguggguccucagaauacagcaaauuuaccaaagcuuacugggcccaggaaaaacccaaagaauuuugacaaacacuggccuuuguguuggacauuuuuuauuuguggugcuguggaagagaaucacacuuaccagcuagagccaagcucugccuauuucaguggcucuugcugugugcaaaagacucucaaaaugaagugaugggcuuguuuuugaagagccagcaaggcuguagggaucccagguuaugaccugcauaaggcgagcugugauuugggaguugggagggagauugauuggugauaagggcaaauaguagaguuuuuuguuguuuaucugguaaaacugcuuuggagucuggugggaacauuuucaaaacuuauccuacuucuugcugugcuaauuggaauccaugguuuugaagucuguggaggcuuuauucuaaaccaaguugugaaauaggaaagaauaggccaucauuuagcauuuuaacagaaaaguggcuaaaugaugaaauauuguugaaagaaaaauaaugaaaauguacuuuaggcauugguagaugaacagcacucucuuacaagucguguuuuacguaugcagacacugagaguaacauaaaguguguuugagcaugcaggauccacacugccugguuugaauccaggcacugccacuugguagccacgugaccuugauguugggaauauugccugaccuuucuaugcuucuguuuccccaucuguaaugugaggauaacacugguaaccauuuuauagguuuacugugaagauucaaugcuuagcuuaguguuggcucauacaugcuccauaguuguggugguggcuguuguuaguauugauagugcuguaauaaacuagugugaaucagauaucaucgauucuggagccaucucacccuaaacuguucucuuucguacucuagcucugucugcuuuccauucugauccugauuuguuauucugcuugguuuccagccugcauggcaugcccugaguggucucauacaguuagagauuuggggugcacaucucagcuguguccugaaugccauugugcauuauuuucacugacaccugccuucagucucucugcuaagccuccugucugcugaaguccccucuucuguccucacccuccuaguuaccaacagaugucauugcuuccucccuggcuguuccuuaggcuggcuuugaacuccugggcucaaguaauccuccuacccaagcuuccccaguaguugggacugcagguacauuuuacacugguuugccauugcuuuuuauguuuaguguguguguauaugugugugugugacagggucucgcugugucccccaggcugacccacccucccaguagaguggcacaaucauggcccacugcagccuccaccuccuggccucauuugauccucccaucucagccacccaaguagcugggacuacaggugugcacaagcacuccuagcuaucuuauuuuuuggggauuuuuuuguagagaugagguuucacaaaauguguaaucucaccuugcccucccaaaaucuugggauuucagguguaagccaccacaccaggccuugcuuuuuauguuaaaaggcaacagaagcaccuguucccgcaacuuucuuccacccacuauaaaggaaggccucaggaaaaacuguauccuuuucuauucagauauuuaacuccccuccuucauauggaagucaucucaaggccauugcuucauacucccgcucugucucucccuuuugcuccuucccuucuacauauaaauacuuugguuucauccacuuaaaaaauaaaccccaaacaaaaauuucuucccuucacccugagggugaacuacccuacccuccuugcuugcucagaaggagcuucuggaaggagcacaaugagcucagugucucuguuccugaacccagggaauccagcuugcaucuugccguccauuucauuggaaaacugcuccagcaaggccaccaaagagcuucuguggauuguuuuucuuucuauuuuauuuuugccuguuuauuuccuuuuuuauuuuacuuuaucuuuagaauuuuuaaagaauguuuacuucaggaaacuacagagaaacagggagcaaaauccaagaagggaaagguuaaaaaaucccaagcugcuccuaaauuagaaacugaagguuucccauguguucuuaggaauuucuguguggccugauuuaucugaguucuucucaagccucuuucuaaagauuucucuuggguugugucuucauuuguuuucuguugcuauaacagaauaccuaagacuggguaauuuauaaagaauagagguuuauuuugcucacaguucuggaggaugggaaguccaagauuggauagccauaucugguaagggccucuugcugcuucaugacaucagugacaaaauggaagaaaucacauggugagagaggaagcaagaaagugccgaggaagcugaacucgcuuuuauaacaauccaaacucccaauaacuaacccccucccaugagaacuaacucacuucugugagaacaacguuaacuccuuuaugagcguggaguccccaagacccaagcacuucuuaaaggucccacuacagcucaacacuguuacauuggggaccaaauuucaacguguguuuuggaggggacagaucauauucaaacuauagcagguuguuuguuucuuuccuucucucuguuuuuaaaaauuaugguaaaaacacuuaacaugaggucuacucucugaacaaauuuuuaagugcacaauacaguauugugagaucucuagaacuuauuaaucucguguaacugaaaauuuauauuuugugccuguugaucaucaacuaucccuauuccccugcccucccagccccuggcaaacaccauucuacucucugguuucuaugaguuugacuauuuuagauaccauauauaaacagaauuguauaguauuuguccuuuggugucuggcuuauuucauuuagccuaauguccucaggguuuacccauguugucacauuuggcaggauuuucuucuuuauaaagcugaauaauauuccauuuucauaugccacgauuucuuuaucccuuugucuaucgaugggaauuuugguggcuuccacaucuuggcuguuguaacuaaugcugcagacaacaugggagugcagguaucuccucaagauccugauuucaauucuuuuuuuggauauguacccagaagugggauuucuagaucacaugguaguucuauuuuuaaccuuucgagaaggcuuaauacuauccagcauagcagcggcaccauuuugcaguuccuucguauuuuaguugugcucucuuacagcaucugacccagcugaccacuuaccucuucuggaaacucauuccuuucuguccuagacuggagcucuggcuguucuuccucagcuucugaguggagcagauccaguugcucaaugccuauuuccaucuggaugucaccugcuuaccucuauuucugcguguucaaaacugaacugugacauuguccucaagaugccaagugaauucguuugcuagagcugccucacaaaguaccacagacagggugguuucagcaacagagaaguccaagaggaaugugucagcaaaguuuccuccuucugagggcuaugagagaaucuguuucaugccucucuccuggguucuggugauuugcuggcaaucuuuggugucccuuagcuuguagaagaagcaucauccagaucucugccuuuuucuucacauuuccccuuuucagaaggacaccaaucauaugggacugggguccacccugaugacuucauuuuaacuagaugaccuauguaaagauccuaucuccaaauacauucugagguauuggggguuaggagcucaacauauaaauuuaggagggggugacaaaauucaaaccauaacaccaagcaaacuugcuuuuuauauauauauauauauauuucccaucacaaugaauggguccaauguccacuauguugcucaagcagaaacuuggacgucauuuuuauuacaucacuugcccuuacauuaauuuggguucaagaagucacagaaccgggaggcaaaauuuugaaauaggaauccuagcauccaucagaccucacaaagggguuugugacucucaaaugacuaacagccucugcucuacauacuuuuuaaagugucuaccaucuugguacaaaaguaccacauacuaauuuuagaaaguuauagaaaaguauaaagauaaaauuaaauuuauuucauuauuuuaguaccgagaaucacuuagcauuuugguuuuggcuuuauaccuucaugcguuuuuauuuuuuaaaaaaacuaguuggaucauauugcauguaagguuuugaauccagcuuuugaaauucaauauuggaucauaguguuuuccuguaucuucacaaaaaauuucauagaucuuuaaauagugcauauuauuucaucaaaugaaaccaugauuuagauauguuuuuacuaucucauugcaaauaugcagguguugcuauuuuuugacuuuuauaaauaaugcaacaaccuuugcuauuuggacuaaguaacuuguucgugauucagacaugauucagcuaggggugaaggagaagaagggauacaguguuucucagcaaauuauuaguguaaauugaaggaaagcuaaaccuacugaaguuuauaaauguuuuagacauuauguaugaacaguuacuuuguuauuuaaaagcuauuuuucauugaauuguuaagguagaucacaauauauucuccacucugcaucuuucuuguuagcuauucuuuauaaugcacaacagggcuguccaaaaaaacuuucugggaugguggaaauguucauuaucugggccguccaguaugguagcaguuagccacacauggccacugggcacuugagauguggcuaaugcaacugaggaacugaauuuuuaauuuuauuuaaauucauuuggcuuaaauuugaauuuaaauagcuacauguggcuaguggcuaucuuacugaauaaugcaggucuuuuaugauuaugacuaaaauacagugcccaccuuuuuguagacacucuucugaaugcuuuacauauuaauauuguuuaaucuucacagugacaccaugcagcaggcuuccaguuacuauugcuguaugacaaauaaccccaaagcuuagugggugaaaacaacaaucauuucuuuuguuuaaggauuuguuauacaauuugggcaggguucaucagagacagcucugaugccccauggagcaucaguugggacuauaggaucuacuuuuauuauggcuauuacuggcugauaaguugaugccugcuauuuucucuccacagggaagcuuaggcuuccucacagcaugguggcuggguuccaagagcaagugccccaagaaacaggaaguggaaguugucaguuucuuauugccugaggcuggaaagugauaaugcaucauucccaacacauucugugggucagggagaguagaguguaaauguaaggggacgagauacagaccucaccucucaguagaagcaguaucaaauaauuuugaagcuggaaaccaaaaaguaucugagacgggucucagucaauuuagaaguuuauuuugcaaagguuaaggacauguccagagaaaaggaucucaaauccacaggaacaaucugugguucaugccauuuuccuaagaagauuuugaggguuucaauacucaauacuuguauugaguauucaauacuuguauugaauauugagguuucaauacuuguauugaauauugagguuucaauacuuguauugaauauugagguuucaauacuuguauugagguuucaauacuuguauugagguuucaauacaaggggaaagagggagcagauguucacauuacugaaucuaccuguugcaagggaaaaggagcgggcaggguaauagucaauuaugucagucagucagcacuuuaccuaagauaaggugagcauggaguagcuaccugugcagauacuucaccuuuuaucaguagcuaucugccuaagaacaaaaggaaacgcaauuucuugaaugacucagcuuucaguuuaauuuuuuccuuuuggcauaguaaauuggggucugagauuagauuuuuauuucccagggccaucuuguaaaauuaucacagauuagucacacucauuuugauccuuuuaacagagaggaaacagaguacagaacaguuaaaauuacucgccuaaggugacaugucuaguauguggccaauaacaugucuguuauuucugccaggucugagcuuuuaaucugagugcuauauugccucucccuguaauuuauaugcuucacuaauguagauuaauaucuucaguuuuuucauggcacgauaauuaugaaauuaagugaaugacacauguuuguaagucacagagcucuguagauauuuaguguuuguuagggguugccacaugucaaauucacgaugaagacaccuucucaaucaccugauucagagggagguguuugacuccaauucugagccccucuuucaucccucuuucccauugucccccuaaaaaagaauuuauuuucacccccagauugaaacagacagugauucugaguaaagcuccuugaucucagcaugcugccuacuucaccuauucuuguugcguggaauauguguuauauaaaggaauuaauaaagaaaacauuguuuuaggaccauaaaagggauuaaauaaauguuucugguuuuuccugaaaauaaggcaugagguuaaacccuaacuuagacgguauauugcauauauuuagggauguauuuauuauauugauucuucagggagaaaucagaaaacacuggcuauuucaaauucuggagguugucugauaaaguaaugaaugcaaccucuuacaaaccuaagaaaccaauuauuuccuuucauguucaaagacaauggauauuuccaugcgaaagagagguagucuuuguucuauggccucugguuugcaaauaaagcuucuguuugauauuguuuguuugcugcugugaugaaccgugcucauuucauaccaggcauauuguccccauuauaaucauuaugaugcaggaguuuucuucucggucacuuuguaaacuggggaccuccuggcuggcgacgcucugccccagccucgacgcccugcuuggccacgcuggcgugcuucagcuccccugugguauagcuuguacccacuuucagcaguucccaagcucuuguagcgcacccaagaagaaugaggauacacgacacacugaagggugaggagggcggagaagaauuuuauugagcuaugaaaauggcuuucagcagagaggcaauguggggcucgggggaaugguucuacuugaaguuccuccuguguggcugggucuggggccuuuuauggacucagaauggggagugagugcugauugguuugugaggaaagcgcaccaaacaggaagacaaguccuccaucugguccgaggauuuaacuuguagcuuggcuuucaagcuuuaaaauucuucagcauggaggugggguuucaccagggacccaacccugucugccugggcauuugacugccuccugccacucucaauuacaauacggauucuuuucucaccaaaauucucuugagaaagcuuauauuuaaaugucucuagcuuuccaauuucuggguuucuugagcagugugugugaaccucccuugauguagaaaaccucacuuuauccuuucagagucaggauauuccaaauacugaagcuuuguuucagucaaaccccacaguuuucuuugguccucaucuaccugacuccccucuucauuuuguauuucucuccucauuuuuccauggcauggugcucugcugauucuuuugcuacacgguauguucuuccugaacuccuggccucaagugauccgccugccuuggccucccaaaguguugggauuauaggcaugugccacugugcccagccuaaauauuaauagugguagcuaacacauuuauagugcuuacugugugacaggaacauauauaaggcuaacuuuuuaauacuuuuuaauuuaauuuaauuuuuuuuuuuuuuuuuuugagacagucuugcucugucacccaggcugaagugcaguggugcacuucuuggcucacugcaaccucugccucgcaggcucaagcaauccucucaccucugccucuccaguagcuggcaccacaguuguguaccacaaugcccagcuaauuuuuguauuuuuaguggagacgggguuucaccauguugcccaggcuggucuugaacuccugaccucaagugauucgcccccuccccccacccccuucagccucccaaaguauguucuuccugcgaucucaguuggccacauuguauaauugugugcuccaggcucacugcuuucuggagucccuguggcaccccugcaggcuaagauaucaaacugucucucauauauauauucaugugauacuuugacaugucuaaaggcaaaaacuucccuuuucuccaaaagaugcccacuucaaagcuucccuauucuugaagucauaaaguagauccccacuguucuuuucucuucuagugccccguguuuuccuuccacagcauuucucacaaucugucacgaucugcccguguauacuuguuuaauggcuguuucugaugccaucauauacgagccucaagauggcaggggcuacguuacguuguucaucacucuauccaguucccacccaguguggugcuugucacauaacuggcaugcauucaauguuuauugggauuagugaacaaauaaacaagugcacucacuuccauuuuuauguuugcaccccaggccaagaucuugaugcuaucccugacuuuucccucuucuucauacucuagaucugcuaguuuacuaaauccuccuagaauguaagcugcaugaggacaacaaaucuccgccuguuuugcucagugugaugaaccugcaucacaagugccuagaauggugccuggcaugugggugaauauuugcuauguugcuugcuaguuuacacguaauaauuuauuucaucuuuauaacaauccuagaagggugaguagguaguauuuguaugcccauuucauaagaaaccaaggcaucaagauguuaaguucuuguccauugucacacagcugcuaaaugguggagcugggaauugaacuugaguguucugaggccaugcucuuaaucacuaagaacugugcuauaauguaauguaguguuuauguaauauuuguaauguuacauguaguguuuauguguucauucuguguuuguaauguuacauguaauguuuauguguuuacucugugcuggacacuucacgacaacccuguauacucauuccacaaugaagaagaagcugucuucaaaggauguuuuaaaaaaugacccagcaugggaccugguucaugaguagcagaguuaaacucagacuguuugagcucaaaccugggcuaucuuuugccugugcagcuggacccaccagucugcauggccugugguuucgggagcagacccugacuuacugugaacauuaccugagagucauuagguuuuucuugcccuggacagauaucuaaugcagcaugcauguuucuuucuguagacaaugggagcagccgcacauugcacuccagaacagagacgaccccgucgcccagcaacgauacugggaauggacacccagaauauauugcauacgcgcuugucccuguguucuuuaucaugggucucuuuggcguccucauuugccaccugcuuaagaagaaaggcuaucguuguacaacagaagcagagcaagauaucgaagaggaaaagguugaaaagauagguaaauaaccagggcucuuuuuauugggggugaggagacaguuuuuaaauaugaaaccagugauauaugcuuuccaucucucugaggcagaaugauccauuuuaguggcagguggugcaguguaguguaagugcagauugugcaguaaucacaccuaguuugaaaacuugcuuucauuacugaauaccugccagauagggcacccuuucuugcccuguggccuuagacaaguuauugugugcucugaaucucugccauguauaauuucacuuaaauguauuuuuaauuaauuuaaucuuauucauuugacauuuuaauuuaauuucaaugaggaaaauaauccuuaccuuuugggguuucugugaaauuuagaggaaagaugcauuugguauuuggaauauaugacuacucauuaaauauuaauccuuacuauuauuauggaaucagauucgaauaagagugaaggaaaaauuaaaauaggucuccccauguuugugguguuacuuuugcugggggaguucuaucuuaaauauuugugauuggaauuuauguuuauuaaguaaacgaucgugugcacagugcagaaaaaaguaugacaagagcuggugccuuaguacuaacuucaggcugucucaucuguuucuccuaauguggagucauaagguaguguuuagaaaaaccggggagacgaaauccuguuuucgccacugauguuucuuucccaucaucuuuagggauguuuccugacuugggccuugagagguaguaggugacucccccuauuccuuucagcccugcuaagggcaguuucugcagaaaggugacauuggaguaggucgcccuucaggcaaagcagggcuggcugaggggagguuccucguuccuugccagcuugcuggacuguugguuuuucccacccccacugaccuuugaggcugagaaggaacaggauugcaugaugagucauguaugagccugugagcaaaccaaagccaaguguuugucaacagaaaguggagccucccccucuccuccuucccagaugcucuguagguuggcuuagcagccagcuucugagcugucuaaccaaacaugcauguucacguggaggaaagcugaccuuuggauggagaaggcauuguccagguaaaugaguaggacacugcacaccuugaugcauucucugugaacuaggauggagcguuucaacccuuccucguucuuauugaaacaaauuuugcagauugguuucagagugguuugcuuuuuuucccaaagaccgucauguaugcuccugguacagaguccccaaaguaaacugaguuuguggacacauaaccaagcccugaauguagguaauuugaaaguguauuucagaggauacagcagucugaugaacauggaagaauuaugauccaauuuaaaaaggaaauuaauauuguaaauugauauaguaagucugcaauuaaaauaaaauccaaggagaaucuuuuucuuuuuuaaugagcuuucuucccauuucucauaaggcuuuaagaaaaugaugagagagaaauaauaaugaagacugguacaaaugcauuuucaaauuauugucuuggaaagugaguauuugaacuucagaagagauagauggacagcuuugauacuuucucuuuaugcuuguuaugcauuaggaaguuuggggcuggagggagaaagccuagaauuguagcaccaugggugaucuccugaggcuucuggaaacuguucagugaggucuuggguucuaagauugauugacuugaugcuggugaccaauuguaaccuguucuccccuccucuuuucucuuucagaauugaaugacagugugaaugaaaacagugacacuguugggcaaaucguccacuacaucaugaaaaaugaaggugugaacauuuuaguguuccaaaacaauucaguauuccuauccuuuauuaaaaaccugcuucgaagagucaagauuuauauagacucucuuacugacuucaccuaagcuuucuaacaccucagcuuccagcauuauucagcuacgcaaguuucacaugagugaguuuucuaagcgugagucggucuaagcguugcagagacccagcccuggaggcgcugucagcugguguucaaauccuggccucacugcuuacugguugugugcaauuuggggaaacuauauugccuuguuucaugagguagaguuucuuccuguaaaaugaggauaauaauauuuaccucagccuggcacgguggcucacaucuguaaucccagcacuuuggaaggcugaggugggaggauuacuugaggccaggaguucaagaccagccugggcaaaauagugagaccccaucucuucaaaaaaaguaaauagccaggcaugguggcacauuccuauguucccagcuacuugggaggcugacgugggaggaucacuugagcucaggauuucaaagcugcagugagcugugaucacaccacugcacuccagcauggguaacagagcgagacucugucaaaaaaagaaauaauaagaaacaauaauaauaauaauauuuacuucacagcauuguugggacauagcacacauagagugcucaguaugguaaguacucaaauauugucuguuccuuuuucaugcgcuuaaaaaaauugugguaaaauacacauaaaauuuaguacuguuaccauuuuaaagugcacccuucagugggauuaagcacauucacaguguuguacaugcauuuccacugucuaguuccagaacuuuacaucuucccaagcugaagcucuggacacuuuaggcagccacuccccauucccuccucccccguccacuggcagcugcugcugugcuucuguuugucuacucuaugucauccuuucuccaguguuaacacuuuuacaaaguugaacuuuuaugaaauuuaguauuuuuucacccugaaauguauucuaaauuaucaucuuaaauggaagauuaauuuaaucuugaguaaagaaacuuuacgguuauuguucugagcacugguuauucccuccauagcacaccaugcccucagugauauuugaggugugugggauuccuugcccacuuacucaauagcuguggauucucacacugugaauucucauuacaauuuaaaagaaaauguuuccccugggcuuugucugugcuuuagccagcaugggcucguggacugauagagcucagccugauagagcugagccauuugucuaaagguugaaauacaccacacucaucaguaaauaccugcuccucugcccucaggcccugcccugggcaccccacacucccagauccucacuacuccacaagagcaccugccugcccagccuguuugucaguuugacucucuucaacgguuuuugacuuagagaaacagcaguuucguaugguugagcauaauuuucauugcuguuuuuagaaugugcuuuaugcuuuuggcauagaucugggugcuuuauauacguaaucucauuuaaucuucaaaacaucccuauaaaguuaguucaguuacacccauuuuacagauaaagaaagaagguuccaaguaauuaaauucacaugguuagugagcagcccagcucugucugucugguuucaaauucagcauccuuuucaaccacacgauauugucccuccugucuucuaauaugcaguugucaauuucugcagucuauaaagucagacaaccaaacuuacucggaugauguuuaaaauaacaaaaaagaccagaauacuuggauuuugaucucugucuuccagagaccuuccuucagggcacaguaguuggugauacuguucuugaguacucaaucauggauguuucuuuuauaugaaaaaaaagugcuuuugaauuugcccaagcaaugcaugacuauguccuuggccuagaagauguacccauucuggaagugugcaguguaaggcauggaugaccgccucacugccucugugccuuucacauuccagacugccuuucguggcuguggggagcuugcaggccuuugggacccgggcuucuaaaagcuggagcaguugccaaauuugugaugaugcaugaaauggguacuggcaguugaaucagucgaaauaaguaaacugugagaaccuugccagggguuaaaguucucacguaucgacgucauagcacucaugaggguuugcuaugugcugggccuguucugugggcuuuccagggaugcugugaucucgacauuuucuucccauguuauaaagugaagcccaccguacuuaacuaaguugccaguguugcaccgcuggaaaguggcggagcugggauuggagcucagguguucugguuccauagucuguuauuuuaaccacuuacuguaguaccucuguccagguggcaugaaagagggauggaaaacuuauuccuuucaaagagggacaguauauagcugggguaguuuguagaaauccuuaagcauuaacucaauaaauucuucaaaguagcggccgggcgugcuggcucaugccuguaaucccagcacuuugggaggcuaagguaggaggaucacuugaggucaggaguucgagaccagccuggccaacguggugaaaccccgucucuacuaaaaauguaaaaauuagcugggcgugguggugcaugucuguaaucuacuugggaggcugaggcaggagaaucacuugaacccgggaggcagaggcugcagugagccaagauugcacugucacugcacuccagccugggcgacagagugagacucugucucaaaaauaaauaaauaaauaaauaaauaaauaaauaaauaaaaauaaaaauaaaaguaccagaugacguaggcccuguuaccacccuauuuuguagauuaggaaacagcgacccagaggauaagacacuuguucaaagucacacaagcagguauggcaggacggugcuggcaguaagcacuucucuuaauuacagcagagaggguguuugggguccuuggaggaggcguauuauauaauuuccucacuucccacacucaugggcgaauagggcuguuuugguuuuuuuuucuuuuucuuuuuaaaugauguuguuuuccuuuuggaaaguagccuuuguguuuuuacugugcuuagcaccaguagguaccacugagcagucaauaccggaggugccauuuuucuccucucuccucugcuccccaguucucuuugccuucuaucuuauucucaaccccggguccccucuucuccuguccaugccuucaucuguguaccugcgguuucuccaggggcccgugaggacagcuggugacuccaauccuuugcgcagcccuugguucccuuccugggcccucagguaauaccugauguugcugcacaccccuuuccagcuguggccucuucagcuuccagccugcaccaaaaccacagccuggugauaagaugcagccuugaucucuuaccaguuuauaaccuagcauguuugaguucggcuuugagacugaaauccucuauuuuguggacuaaaugcauuuuuaaaaauauuuuugucucaaugauuaacauaacuugaacuuaguaccaauuuggacuucucuguugauauuuucugucuuugauaaauuggaauuaauauaaauuuugcuuucuaguuuuaaaagugauacguguaccaugacuuuuccuuuacguuaaaaaaggaauaaaauuaagcacaaucucucuauuacccuuuucccacguguguuuagguuuucuuuuccuggauucaugcauccguaaacauuugcaaucaugauauaugaaugguuucugcuucgcauuuuaaguuuggcaaauggggugauauuugaacuguacucaugguaacauucuuguuuaugguuuaaacacauuaugucuuuaauguuggaagucaauuuuaauuuagauaaauaucucuugaaggauggauuaucagcugaccugcugggcaaacacacuuuguuuguuugguugucuccauccucacacaacacuucugacaaagauguggguuuuuuccauacuuugcaguucuccaaauccccgaacccugcaauuuaauacaguucugacucugucuaccuagaguuagcgucagaucccaaaagacugccccuacuugggaugccaguuggaagccagggcucugguacuucugaccuauaaucuuaaauggcugggaggagggauccacaauccuagaauggguuacaggacucagggaaacacuuuauuacauguacuggcuuguuauagaggaugcaacucacgaacaacaaaauagaagagaugcauaguauugggguggggcgcagagcuuuccugcccucucugggugcgccacccucccggcaccugcaccuguucagccaccuggaagcuaucaaaucuuguuguucaagaguuguuuuguccaguuuaauuuccagucccagaacccugccccguccuccccugcucugacuuuccugaggucccuggguagggcugaaaguuccaacccucuaaucacuuggucuuaaugaugacuggccccacccugagacuguuuaggggcuccaccccaagucaccgcauuaguguaaacccaggugugaucaaaaggugcucauuaugaauaacaaaagacacuccuaucaggaaauuccaaggccuuuaggaacucugugacaggaacccaggacaaugaccaaaucuguugcauauuaugccacaccugcacucugacuauuuuccuaauccaaaggguuggauguacggcagugcuagcuuuuaauucaucuuucuaaauagagccgaacugaaucgugucuggguagucgcuggaguuuucuugcauuguauggauguuuggaaaguaucugggagucuguagcugaguuccucugcuaggcccuugaacuggcugcuuaguaaaaauugcagggaguacuacagauaguccucaagugcuucugguuagugauuaguacuucugaucccuaggcaagagaugccuuugugaaguuuuugccuucaggcuucguuuauauuuugccagaaaagauuccuuuauaaaugacugugaguaccgaguggguucugaaacuuucucuguugauuaugcaacaugccaugaaccauuauucaaccucugucccuuugggcggggacuuggacauugaaggguaggaaggaagaugucaggguuaaaagcacccacccuggagucagacagaccaggguuuguguccaagccugucacucucuagcugugugacuccggccagucaguuacgaucuuuaggucuuagucuguauacuuguaaaaugggggugauaauucuaccuacuguuaaggucaucagaaaaguccaacacguaagaucgguaaagcuuucaggcagugacuggcacgugccggcgcuuacauuuuggugauggcaauguuaguuuuugcuugggaaauuugccuuaggugugaggaaaacuuugaagagaauagugaugggagagacagaagacauuuuucuugccugauuuuggcuguuucaugcauauuaucaagcagggauucagggagaaaaagaggucuuuucuggaaaaugucacccauuggaacauauucccuuuucuugagggaguuuccuugcccugugccuagcuccucccauuuuggggaagguggggaaaggaaguguaguugacaaaaugccggcaaguguggagaaaaccaccuaaggcuuaguguagcugugaguaauaugcaaggaggagauacaccuucaacagaacucacaguauugcucuuuuaugguaacuucacaaccaaauuaaggcauguguuucaguccuaacggugguguuauauuagaaaaccuucucgucacuggaaaccaaaaauguucccaauagacagauuacugaaguugacucccuggagauuagcucagagacagggacgcauguguguacauguggguauguaccuguacaugcaugcaugugggugugugugugugugucccacaugccacagggugaguccuagagacucacucagcaaaccaaggggauguuuacuaauuauuccugagagauaaagaugaguuacaggaauucaugaauaaccgagaaacacacaucuacaaaaagcaagcuuuaauaaugauuuuaauauaucuuaucuuccuggaauuauuuuguaauuugaccuuucauuuuauagguggucaucauuuuacaggugauugauuuuucucaggcagugauuuaaacguuugauuuuaaaaagcucacuccuguaugugcugauagugcugucccuguuuuaauaccuauugguguuguuuucccucuuuuuuauguuuauaguuuugaaguaugguaaauguuggcagaguaaguuuggguggcaaauuacuuuauauaaucagccauccauauccaucagaucugcaccuauggauuuaaccaaucaaggauaaaauaaaauuagaaaaaaaaaauggaugguugcauccuucuggacaugugcagacuuuuuucuugucauuauuucccauauaaaacagcauaacaacuauuuacauaggauuuccauuguauuagguauuauaaguaaccuaaagaugacuuaaaguguaugggggagggggagauguguuucauaucaggaaccugagcaucuguggauuuuggugucugcacggaucuggggaacauccccgcauggauacugaggacuacuguauuuuguauacaauaaaauacaaaauuguauaugggauuguauauccaaaccuaguaucugaaacgacauuauuuuucugaauccucauuuauuagccaaaagggaaauuaacugacauuacuggauuauacuuaaauguguuuuacagagggaacugucuucuuuauugugcaggagaaauuacuauggauccguuuucauaauguuuuuguaaugacaggaggucuuauuuagaucaaaauuuguguuugaaaaugcauuuggacauccacagauaguugugaaggguaaaguauuucuuuuggcaaaagauuaaguguuguauuaauauuucuucaaagaaaaaagcaaaaacccauauguucucaaggguugcaauggggcaauguguccccuaagaagauaaaaauuggaucggggccaaaaaaaaacucacucucuuauauguaaagcacagauauguguauaguacauaacugaguauauaauauaucugccguauuguacauuaaugggagagucauuaggguaaaauaguugaacaaggcucuuggguggggcaauaaugaaagccagguugagaaacaccacauuguaagcccuuaacuguuaaaacuuacagcagcaguuggaacuagaauuaauauuccuucucuagaaaagucauuugaauguuaaacauuaaauguugguguuggcuuacaugguaaauagugauuuuuauuuguucuuuccucucuagagaauuguugugguuagucaugagaacagugcuucagaaaucaauugaaaagguuacaagccaguaauaacauuuggccuugccaauuaaauagccaagggaaacuugaacauucacuucagucuuucauccuggggagcgugaccacucuacaaggaggcagaaaacacauggcguguggauguggauguggguguggguugggggacucaagaaucuuagauuagguuuuuuuuuuugcuuuuguugacagccuagcuucccaucuacaaauuuggauauuuuuuagaagucuaauuuuuuaaaguuagcguauauuacauaacuuauauguugugaucaauacuugaaauuuuuuuuuuuuuuuuuuuuuuuuugagacagagucucgcuucaucgcccaggcuggagugcaguggcgugaugucugcucacuguaagcuucgccuccuggguucaugccauuuuucugccuuagccucccagguagcugggacuacaggugccugccaccacgcccagcuaauuuuuuguauuuuuaguacagaugggguuucaccguguuagccaggauggucucgaucuccugaccuugugaucuguccaccucggcuucccaaagugcugggauuacaggcgugagccacagcgccuggccaauacuugaaauuuuaagauaucuggccagucaagggcuuauaugauccugaagcucaucuggaaaauuaaccuucucucaucccugaaucgauaugggauagaauugaugcuacaggaggauucagaguuuagggcuaauuauuuuggcacauacaaguuauuagacuauaggucacuuaugaaauacauuucacuaucauauuuuucaaaguauauuuaucaaaauuaguuaacugcaagggagcagcggcauauaaaugguccuuuaguuugguggaguugguguggggugagggggugguuucuucuacuuuauauugcuauugauguguaagaagcaaugccuuauaguagaucugcucuccuugccauagauucuuugucauucuuacuaaguuccugugggguggaaguuacugacagauggugccauguuaugcaguuauguugggggagacccuccuuucucuaggcccccaggacuucaucuaugaacugaaagaauggaauuagauguguuuucaacagcuuuucugaugugauuacucaucuuauucauucuauuuuaauucuuuaauuuuauuuuuauuccuuagcgaaugcugaugucuuaaaggcgaugguagcagauaacagccuguaugauccugaaaggugagugcuccuccccucuuucuuagugcgacaucuuuucaguuacuugcucagauauggcgccaucugaaaugcucuucugcuagagcagguuucccagcuuuaacacuauaguuauuuugggaccagguaguucuuugcugugcggaacuguccuguguauugaggauguuugauagcaucccuggccuucacucacaaggugucagagcauccccugcccccacccucccaaggugugacaacccauaaugucuccacacauugucaaugucccguaguggggacagucacuccugguugagaacugcuguguuagagaauagugaugggaagaaggaaggcauagagguuaagggcaagaacauagccuuggaauugggagaugugguugaguccugccuguaccacaauauuaacugucuguucuugaggaaguuaacugaccacccugaguuccaucaucuauaaaauggagaucaccacaguaccagcuuuauaggguuguuauaaggaauacagaguaccuuaagcauugaaagaccuccaugaacaaugaugauuaaaugaacaagcugguuuggagcuaccugcuauguucuguuuuuguauuacuauuuuagguuaugguuguugagcagcauauuccuucauaauuaauuacagagaacuguauuuccauaaaaguauuauuucuucaacaaggagcauuuauuggaugccuacugugugcugggugcugcucuggagcuggacauccacagacccuugccauggaggaacacaggauuggagaugugugugugaggccucaugguggagagccugugaaugcuguaggauggguggagacugaaggcucugggggaccccggggggccaaugggcauucaggaagguucauggaagaggugccaucugaaccaggcgugcaggagguggagacaagagucagggcuggcuguaggaagaagggccagaagaaaagucaccacaucaugauagccugggacucaccugugaaggguucaguccaggguggccaggccaacugacauggcaaaggggcuggaucuuucuucacuugcuauguggguugugcacucagcacaccuuagauguuuaacagguguuugucaaacuggcuacguuagauguguguuuuagaaagguaacucagaaugcaaggaguugaguuuaggagagacguagagucauagagacagaagagcucugauuucucccacauuccaguccuggccacagacggcugguguucugaccaucuuagcucaaggugucuuugucucagucaucuuugggcauccuguagugcccgucaguggguuuuguacauagcugguacuugagaaaugcuuguugaaugaauguuguuaaacucuugcauucagcuuucuaauauguggugcuaauuuaacauuauuuuacuccaggaagguacugcuuuguguuuuuauuuuaacagguaggaaggcaucccuaaagagcaccagaagacuuuuggcucagucauguuugaggcggucuccucaaccguaggcucuacuucuuuuuuaaguguguagguggccaguuugcaucaccgaaaaggcugguuucugccaucacagccuccugugugucucuggggcucuugccacaguccaggugucaggcugugggugccacgccacccucaguacucccaccugcaccagagggcugauuccugcucaguuuggcucuguuagguuagaauuccuccuuuucugcugggccagagccuucacacaugcuuuuugaaaauagcucuuaucucgacuauguauuucugcuuuuuuuuuuuuuuuuugagacagagucuugcuuugucacccaggcuggagugcaguggcgcgaucuaggcucacugcaagcuccgccuuccggguucacaccauucuccugccucagccucccgauuagcugggacuacaggcgcccgccaccacccccggcuaauuuuuuguauuuuuaguagagaugggguuucauuguguuagccaggauggucucgaucuccugaccucgugaucugcccgcuucggcuucccaaagugcugggauuacaagugugagccaccacgccuggccauauuucugcuuuuuauauuuuggauggucuagccaaauauauuccagauuaucaaaguggucucugcuguuucugaagcacuauacuguauagcaaggugauuaauugcaugguuucuggaauuaaacuuucuagguuuggaucucagauccagcacuuauuugcagugugaucuugggcaaguuaccucacuucucccugccucaauauccucauuguuaaaaggaagaaauuaauaauaccuacaucauaagauuuuauaaggauuaauuccauuaacauauacauauaagaugcuuagaauacuguuagcuauuuaauuaugacuguuaucaacaccaucaacaucuguuuugaacaucacuuuugauaucuuugccuaaaggcuuuccuccuuugauauaauggagauuugaucaaauguuuucucuaaguuaucugauaauuugauggaauuuggguucuucccuuuuccagggcauauauacuuagagaaucucuuugcuuagagugauaggcagacacucugguaugugagaaauuaggauaauugcaugagaaaggagaucaguguuuuagaaagaaacauaauacuuuaaagccaguguaucacuauuagaagcagugguuuauucccagcuaauaaauuccauucuagaagugauaaaucacauuuuuuuuucuucuagagacaggucucacucugucauccaggcuggaguucggugguacaaucauagcuacugcaaccuugaacuccugggcucaagugauccucccaccacugccucccaaguagcugggacuacaggcacgcaccaucaugccugacuaauuuuuucauuuuuuuucagagacgaggucucucuauguugcucaggcuggucucaaacuccuggccacaagcaauccucccacuuuggccucucaaaaugcugggauuauaggcaugagcuguugugccugaccgugaaucauauuauuauugcuuaagauaaacugucaucgcauggucaugagaacugaguaccugcugucugaggucuguucacaaaguccauuuguacaauuggaagacgcuuuuuuuuuucuuucaauuuaaacugcuucugucaucacagggagagagaucaccuucgcugauauuuccuuuaaccaguugcucuuuuuguuuuccuccccacauuagccccgugacccccagcacaccagggagcccgccagugaguccugggccuuugucaccaggggggacgccagggaagcacgucuguggccaucaucugcauacggugggcgguguugucgagagggaugugugucaucgguguaggcacaagcgguggcacuuuauaaagcccacuaacaaguccagagagagcagaccacggcgccaaggcgaggucacgguccuuucuguuggcagguaagaucccuucagaugcuuuugguuugugugugacaugggugcucugguguguggacuucugcuuaccugucagauguagaauauguucucugugccugucucagguuauaucucugggcuuuuuagauguuuucuggugugaguccuagauuuuuccaacaacagaagaauccuaaaagguggcuguugcuagaucagaugguaaauguauuaagauaaauaccuaccugcucuaacagauaaagcccagauuuucaacuguauacagaauagacauuuauauuucacuuauggaauccagggcagguauugagauaucaauggguggcucuucaaguacuuguccaggguuccaggcccccuucguuuguggcucugccagguuugccagccaaaggagcaggucuguggaagguuguucacgagggguuuugaaagagcuaggccugagaguggcucguaucauuuugacucacacuccacuggcuggaacuugaucacccagccaagcuaacuuucagggaacugagaaauagcaucaagccaugugcaagggaagggagaagacguggaucugguccacagcccuccagugucugucuguuaaguuccaugugaauugcuuugacugcuuucuuuuaguggguggugcuuuccacugugucuuggcuuucuugguccuaguaccuuucacuugugacccauaugugagguggagaucuugcaguucaagugaugaauccauuggcccuuaccugaagcaucuuugcagugggaugcuuuugcaguucugcuguuagaugcugagucccaugcaggaacugcauugccgauguugcauuuggaaagacaguggggaguacugguaaggaacacacaugcuggagugagaccgggugagcacugagcgaaagucaacagugcugcuuacaugauccuucucucucaguauacugacaaccccccugggaagaguaaccugaacucgucacuucuaccuccuucaaguccuggcaccacuacuuacaaacuguuacguugcuccaugccucaguuucccccucuguaaagugagaaggacagucacacucaccucauagaguugcuguguguagacuaggugaggugacucacauaaaggucuuaaaccagcuuuggguacuuacgcacucaagaaauguuggcugguauuauuuuuauuuuaauucaguugaguuucaucauguguugcacaagcaucauggagaagacuugcagggcuguuugccacuuacagcaaaacagcacaauucaugaccacacuguuuuauuaagaagcagagucaugggaauuuaugaaugcaaagcagugagaaccuguagcuuguuuggacaaagcauguuuuguuggccuuaaaaaaaaaucugcugaaauuuucaacucagauucaacaugccuuuuuuuuuuuuuuuuuuuuuuuuuuuuuuuuuuuuuugagguggagucucacucugucacccaagcuggagugcaguggugugaacucggcucacugcagccucugccuccugggcucaaacgauugucgugccucagccucccgaguagcugggacugcaggugcccgccaccaugccuggcuaauuuuuguauuuuuaggagagacgggguuucaccaaguuggccaggcuggucucgaacuccugaccucaagugauccaccugucuuggccucccaaaguguugggauuacagguguaagccaccgugccuggccaaacauggcuuuuuaaaaugccccaaauccaacucucuuucuuggauauuggauacuaggagcgcuuaaugauuccaggcuguuuuucagcauguauuacuuaagagagucuuacaguuugacagaauagauuuguguuuacaguuucccuguuauuucuuucacuucuucagagccuucucuucaggguuggugaucuuauuuuggacacagaaggagaauuuauuucagauaauuuuuaagggaaauuaagaccagaacuagaaagaagcuguuaugaaagacucuaggauuuggugaugauauacuagaaaaaacaguuaaacugaauacauuuauuuaacucuuaauucuuaaugaaaaucucuuccuuaacuuccuuuaguuuuuccuuaaucuauaaugaaaauuaacccauuuuuuuuaaaggcuuacucucaaacccuaaugcugauaaaauguguuucuagggcucuucagauuuucugcauaugugugagagcaugugugugcguguguguguugagauaggacugccugacaguugcauauuuucggaaguucgucaucuucugguaaacauucugguuacgucagucuaauuuguaaaccaguugagcauuuaaccagguuucugugguuaaaaaaacugauguaggccagacaugguggcucacgccuauaaucccaaaacuuugggaggcugaggcagguggaucaccugagguuggaguuugagacuggccuggccaacauggugaaacuccaucucuacuaaaaauacaaaauuagccaggcaugguggcacauggcuguaaucccagcuacuugagaggcugaggcaggagagucgcuuaaacccaggagguggagguugcagugagccgagauuguaccacugcacuccagucugggcagcaagagggaaacucugucucgaaaacaaauaaacaaaaaaacugaucauuguuagaaacgacaacucugacgcuguuuaauauucgagucucugagguguuuuuuuuuuuuuuuuuuuuuuuuuccuuauugagacagggucuagcucuguugcccaggcuggagugcaugacgugaucucggcucacugcaaccuccagcuccugggcucaagugauucuccugcuucagccucccgaguagcugggacuacaagugcacaccaccacaccuggcuaauuuuuguaauuucuguagagacagaguuuugccauacacccagucuggucucaaauuccuaggcucaagcaauccacccaccucagccuuccaaagugcugcugggauugcagguauaagccaccaugccuggccaauaccugaguuuuuaaaugccuuuugcaugcucuguaaaauauccggcuuagucugugauguggcugaguagaaaucagcuggaagguugggcaggggccaggggaauguacuggauaggaaugcauguucgaauauguuguuuuucauuuguguccuaacuuuuggcugaguucauuugagauccucuggguggaugauuuuugcuuuauucauaauucuuguuuauuagaaaagcaaaccccaucaccucuccccauuccccccucagauuuagaguuacaaaaguggagcacaagucaaaccagaaggaacggagaagccugaugucuguuaguggggcugaaaccgucaauggggaggugccggcaacaccugugaagagagaacgcaguggcacagaguagcaggugagccgugguuuuggugacauugggggcagaguggugcagggugaggagaagguacuuggagccucccaggugcuguggcagcauaggaaugguauuugacagggaagugggagagcuuuccuugacccaggaagacugagggggacugaacaugauuacuugucugccuagagcuucuuguaaagaagucacaaacuuagugccuccaggggcuuggccugugugauaaugaggauagaggauuacuugugaggcaauguggcaugguggggauuguggcaaacuagaauucacaucacccaccauauagggcuugcauuaccacgaggcagaaagcaccuaguguugcugcaucuucuuacgcaaaaaaagacaaaauccagacuucuaaaauguaaaaucacugauuuucgauauuggcagcuuacuuuuuuuuuuuuaaacaaccaugcaggccaaaugacuuguaaucuugucaccauuuuuagguaaacugugacuugaaaaagucuggagcaaacaaaccaaugcuuuuuccuuuuauucuguuggaaaccaguuuucuuugugucacaguucugaaaccucaauacgaauauuucucuucccaccaaauauuuugaggcaauugaaaagccacagugauuuauuucuugauuuggcaauuuuaauuuugcaagacacugcuuaaaaaaaaaacaacacgcagcugggcacgguggcucacgccuguaaucccauguaaucccagcacuuugggaggccgaggcaggcggaucaugaggucaggagaucgagacaauccuggcuaacauggugaaacccugucucuacuaaaaaauacaaaaaaguagccgggcguaguggugggcaccuguagucccagcuacucaggaggcugaggcaggagaauggcgugaacccgggaggcggagcuugcagugagccgagaucacgccacugcacuccagccugggcgacagagcgagacucggucucaaaaaaaaaaaaaaaaaaaaaaaaaaccacacacacacgcaccagaacccugugauaaauugauaguggcuuaacuuucaucuuaacuccuuuauuucuguuccggcuugagugguauuuauccuuuccauguuucuuaucccuuguaaaagagcaacggugacgauuugggagggaucaugcccuaagugcuccauggaaccaucagagccugaacaugaaggcagaagaguuuacacuuacauagggaagggagggcgggcaaugggggagaggucaggcagggacacagcaaaacugacaugaacccuggagucagacugccagguucaagcuccagugugccacucacuaacccugggaccugggcaagauacuugagcuuucuaugccucacuggaaauuggaaguggugcucuuugccucaggggcgggagugagauuuccaugaaguugcacgugugaaggcagggccuggcacgugggaaaugcuccguccaugcuacugauuauuaccaugugauucauucauuuuuggucgguguggcugaguggaggagagauguggcuuuugggugaagcuucucugauaaucugccgggcucagaggguugaaggugcucuggaagcaaucuggaacaacucugugcaccuaaauuuucugagacauagggacucugaucauuuucuaguguuaguuagcccucgcgguuuugccuguggggagaucuggcgucucuuccugaguuuaggagcagaauaggagccuucuuaaagagagaaacaguacagaaaagucuaccauuggcuucucagccaguuacuggugaccuuagggaagggagucaagaggaauuuaagaagaggaugaugaagauggguaauaacagcagcuaacguuaauucaauauucuagucuucuaggcaugguacugauguguuucucacaugucaucauuauaaaccucuccaaaugggguuaguacuaugaucauaguuuuacagaugaggaaacugaugaaugggaaaggugaguuacauguugaaggucauauagcuggaaagaggagcauucugauuaaggucagugaaggacuuggcuaucugggaagagaagcaucuggcuauucaagucuuaggugaggaaggcccagccagcuuagcugcaaagaaaguaugggucauaaggacaggcugaguaugagucaucaacugggcagugaguugagagauggagccgauugcaccagaagaccuggcuugcccucgauuaggaacugcaagaugauccucuugucagacucaccucugauuagagcuuggcuaacuagugccauggcugauuuuggccaccacugcccagagagcgguacucuagaucugggaagguuagaaggaauuaggauugcucagcugguuuuuuuggcccgaaucugucugauucugauuauagaaauuugguccaagcaucugaaguccugaccacauuuaacugauuuacaaugagauauucucugcacagcacacuguuauucaacaggauuauauaaacgaggauuggauuugaucagaagacaugggugcaaaucugagcuucacaauuuggacauuguacuuaacugcccuaccccugguuuccuugaacgugaaauaagguauuaaauucauuguuuuaauccaagagccaagagaaagucuggaauguaguugguucucaguagaagguagucauauuguguugugcugcucaaaucacaaugagcacgaguggccuucaaagggugacguguuuuccgagccuccaacuuguuguaauugauuuucaaauuaaaaauuaauucuucguuaugaaaaauuuuaaacucaaaaguagaauaguaucauggauguccaugauccauggaguaaauuaauuauaauaccuacaguuuuuuggguauucuguacuugggcaugcuuugaaaggcacauuccguguauuagcuaauuucuguaauccucgccacggcagucuauaggugcuaguaccccauuuugcagaugaaggucuuaagcacagagaguuuaaacaacuuguuuagagauaccagcaagaaugugauagaguuagacuugaaccugggcagccuugcuucaggugucacagacuucauucaacuggguccaagacgagcaggucccaugaguagagccugcucagauugagaccugcuggguggcccuaucugauuaccccaaugaaguauaggcccugaaaaaggaaggaagggaauauucauugguguuuuaaaaauuauguauucauuaaaauuuuucuugcaguuuuuuuucuuuucaaaucucauccccccaaaaaaaguauguuugggacauuuaacaugacuugauuuuccaacuagaaaaauucugaaaauuuuacuucugggccagacucucugguucuagacgaagccagaagaucugcacuggaaugcagcuagugaagcaggagaggagugcuaugugucucuucuacaaucugauacagucuuuagaguuguauuuuuuccugaaagagguuuuugcucaaauuuggauuuuuagccaaacaauuuuacugcaauguuuuguuuuauuguagaacagacucaaauauucaaauacaaaugcauauccacuuauugguuagguuucuuuuuuuauuucuuuuguuuaagguguuuguuaccagaaacuaaacuuauauucuaaauagaauguuaucaagacuguggcaggauuucucucucucccuucugguuccuucucccuuuaaaaccccaaaucugauguugggcauggccuccccauucgucuaacccugcuuuguuggucugaguucuuguuuguggcuacaucuaacuugcccucuugcccucugccugauuuauuuuggcaaugcgguuaaaauggucuuuuuucugcagaaaauguguuuugguuucuccugagaagaauaagcuuuuguucuucaaaguuaaauaaauugaauugcuuucagccuccaaaugccacugccuugucuucauugucacuggucuuuggcuuuuuaaaaaugauccuguccuaagcauucugugucgcauguuucugaagucugcccucuuuuguuccauucgcugauaguguccuguuggaaacauugauuuaguaaguuuacauaaccauacuuuaaaauuuuuuauugaaaauuaaucagauuuuaauggacacaugaaaguugcauauauuuaucaugugcaauguaauguuuucaaauguguguacacugcgauggcuaaauugagcuaaugaacguaugcauugccacacauacuuauaauuuuuuugcguggugagaacacuccaaaucuacucucuuagcaauuuuuaagaauaugauacauuguuauuaacugcagucaccauguuguacaauagaucucuugaaauuauuuauccccucuaacuaaaauuuugugucuuuugaccaaccccucccccgccccuaccucuaaccaccuuucuucucucugcuucuaugaguucaacuuuuuuuagauuccacauguaagugagaugacgugguauuugucguucugugccuggcuuauuucacucaauguaaugugcuccagguuuauccauuuuaucuucaaugacaggauuuccuucuuuuuuucuggccgaacaguguuucauuauguaucuauacuacauuuuauucauucauauguucagggacucuuaggaagauuccauaucuuggcuauugggauaaugcagcaguggacauggcaguacagauaucucuuugacauacugauuucaguaccucuggauauguacugagaagugggauuguuggaucauaugguaguucuauuuuuaauuuguuuguuuguuuucugagacagagucucacucucgcccagguugcaaugcagugggacaaucucggcucacugcagccucugccucccggguucagacgauucuccugccacagccuccugaguagcugggauugcagaugcaagccaccacaccuggcuaacuuuuguauuuuuaggagagacaggguuucaucauguuggccaggcugaucuugaacuccugaucucaagugauccaccugccucggccucccaaagugcuuggauuacaggugcaagccacugugcccggucuauuuuuaauuuuuguuagugaccugcguacuguuuuccaugaugacuguaauaauguauauucccacuaacaguaugcaagaauuucuuuuucuccacauccccaucagcacuuuuuuuauaauugucauucuaacaggugugagguauuaucucauuauaguuuuaauuuauauuuccaugaugauuaguaauguugagccuuuuuuucauauauuuguuggccauuuguaggucuucuuuugagaaauuucuauuuagaaucuuugcccauuacaauuuuuuuaacauuuuauuuauuuuuauugacaaaaauuaucuauauuuauuauguacgacauguuguuuugaaacaugcauacauuauggaauggcuaaauugagcugauugacauauguauuacaucauauauuuaucauuuuuuuguggugaggauauuuaaaaucucucuuagcauuuuucaagaauacaauacauuguuauuaacuguagccaccauauugugcaauagauuucugauacagucuuuagaguuguaauuuuuccugaaagagguuuuugcucaaauuuggauuugauggccuauuccuccuaauugaaauuuuauguccuuugaccaucaucuccccaacccucccuucccauuuugccccauuuuuaaauuggguuauuuguuuucuugcuuuugaguuguuuguguuucuuauauauuuuggauaguaaccauuuauaagauguaugguuugcaaauauuuucucccauuuuauaaguuaucucuucacucuguugauugcuuugcucugcagaagcuuuuuaguuugaugaaaucccauuuguccauuuuuguugccugcgcuuuugggaucuuaucaaaaaaucauuguccagaucagugucauggaacuuuccuccuauguguuuuucuaguaguauugcaguauuacaguagcauuucuuuuaucaaaacaaaaauucauaauauuagacaucuguuuuuauuuuuguuuuauucagacuauuguauugauuuuuauuuuaguaauuuauuucagugauuaaaagcuggguuuuaaacuccuuacuuuuaauugugccacuuaacuaccaaugguuuugggcaaguuacuuaauguuuucaagccccgguuauuucaucuuuaaaaugagaucguugcuggacauacaugauacgauauauguguaguucauaagucaauccuuggcacagaguaucugcuaaacauucacugcuguuaacaauugucauggcugguggucuuaauuauuuauuaggucauuucugaagcaucagcuuuugguacugugaauuccuuuuuacaucuuaagaacauuacagcuuuggacucucaggacaucucagaaauagauaguauuugucaagucccuuaggaauuugggccauuuucuuguuugcauuaaggaggccuuagaaauaaccauucccggcugggcgcgguggcucacgccuguaaucccagcacugugggaggccgaggugggcggaucacgaggucaggagaucgagaccauccuggcuaacacagugaaaccccgucucuacuaaaaaauacaaaaaaaaaaauuagccgggcgugguggcgggugccuguagucccagcuacucuggaggcugaggcaggagaauggcgugaaccugggagguggagguugcagugagccgagauugcacacugcacugcacuccagccugggcgacagagggagacucugccucaaaaaaaaaaaaaaaaaaagaaagaaagaaagaaccauuuccuucuuccaagagguggaauuaaaauuacuaacaaggagauggaaaaguuuugcugacaaguucuuuuuauuauaaaaaucagagggugggauaaauugaaaugcuggacagagacguuuucggccuaagcgugacugcugugccgguguucugcuuuggaauaaaagucuccucuuugucaagacucuuucauggcucaaacucccuccugagcaucuguggcuggucacaagguggcucuucugaccuucggccgccuucauguucuccucuaacagugaggaaaggcuccuuggcuccuuuuuuuggacucuguggcaggaauuauaguagaagcuccuuggggacccccucggaagucguacugcuugauuugcaguccucucaauugcuuuucuuuuauuaacucuccaggaagcaguuaaugaugagaaacugcagguacuacuaguuaguuuauuuuuuucucucuagcuguaauuuuuucaggaaaaaaugcaucuuuuuuaaaaagcaaaaggaucucagauuugaugggaacccuuuaacuugauucacuggucuuacggggcaacagaauauaaaaagaaacugcaccuaaaguaggcauggauuaggccaccuggcuugguuuucaguugcuaaacacauuucucaaagguaaaaguagugccgugaugccugccguacuccugugugggagacugagcccacugaguccaucugaaauguggagguggagggaggugagcaucugcccaggcccugcucugugaagccuagguagguagaaccggccagaugaagagaaaagcugagugaaggaugggacuuuagaagcaauuuuaggaguuguagguaauaauauccuauuuuacagaugaagagccaggcuuagagggauuaauguuccccauaucucagggcuagguagugagagggcuuggaugggaagaaauuuauacuugggagcuuacaugcucaguggccguggagugugagggagcuuugcuuuucuuggcaagaaagcaaaucaaccgccguuucuucacauagcucaauagcucacagaacugaucauuccagccuuuggauggccuccuuggcauccgaugggaucaucugaugagcagcugauggauuuuaaggcucugucuggaucagguccaggugugugagccauucaguuuucuuccagguagaugaaggucauagacuugcagacuccagagcagcugugauugcuaguucagaucaauggagguacaauuauaucuuuaaaaaguauuucuuggccgggugcgguggcucacaccuguaaucucagcacuuugggaggccaaggugggcagaucaugaggucaggaguucgagaccagccuggacaacacggugaaaccccaucucuacuaaaaauacaaaaauuagguaggcaugguggcgggcaccuguagucccagcuacucgggaggcugaggcaggagagucaguugaacccgggaggcagagguugccgugagccgagaucaugccacugcacuucagccggggugacaacagcaagacucugucucagaaaaaaaaaaaaaaaaaaaagcauuacuugagacccuacuaugugccaggcaguuugcuguguuuagggauguggcagugugucagacagacaaugaagaccauacucuuacagagcuucuauccuagugcuuauaccagacuuuucuccccugcaccucccaguccccuuguuuaguguguguuguuacauguguuguucaagaucaugccgagaguucauuacggagccaggaccugggcuuccuuauagcucauuccuuuacugucuccaguguauuggauauuacaaguguuugaaauggaauuuuuaaaaaagaacugaaauauaagaaaugcauaggauaaaauauuuaaacagccuaaaagucugcagggugaaaaauaaaucccaaaaauaaaucuuugcuccauuuuuauccugcuaaucccuuugcguguaucaccucuuaaaccuuuucucaagaggacaccagugugaucaguguucacuauguccuuucaggauuaugcugugcauauacaugcuuaugcaauauaucuguguauauaaagccccuccuuuugcccuucuacaaaugagaguauagauacuacacuuguucauaccuuguuuuuuauugaaguuagugauuuuuagguucugugguucccugacuguugagauuuugucuuacucacaaaugacugaggaagaaccagcuuuuacucucccacauugacugagccauaaggagugaaaaugguagacacaguuaaaaagcuauaugcccuauuuguccucaguuguugggaguggcuccaguacauuuauggccaugaucugggaguuuuugaguggaccuaaaaacaugcuuuacugucaucaacuaugauguuuuuucuaaguuauucuuccauggccuuguucugugcacaggagauacuaaaacauauuuauuaguauucccagaguuuagacaacaugggugaccaggaauuuuugauuuguuuugcuuugaguugccaccaaagcaagccaucuccuccuaacacauaucucccugggcaggggccugccccagggccccuuccuauuguugaccaggaguugacccacugaaggagagcuuaucuguucuuccucuuuaucccuaucaccuguuugacaucugcucuuuucacugcagaaauugagcaguguuggaggcuagagacuuuggagggccuaaagacagacccaagggggcuugagggaagcggaaaaugaaaggcuuucggagacauuuuuaccuauaauuagaaagaaaauggaauuaaugguuauaaucaggauuuuuauuuuucuuuauuuuuuuccuuauuuuauuauuauuauuauuuuuugagauggagucuugcucugucccccaggcuggagugcaguggcgcgaucuuggcucacugcaagcucugccucccagguucacgccauucuccugucucagccucccgaguagcuaggacugcaggugcccaccaccacgccuggcugauuuuuuguauuuuuaguagagaagagguuuugcuauacuagccaggauggucuugaucuccugaucuugugaucugccugccucggccuccgaaagugcugggauuacaggcguaagccaccgcgccuggccgauuuuucuuaauuugugccuugagaccuugaguucuacuaacauuaaauagcuuaaguuaaaacaguaccuauuuucuguaaguaacaggacauaggauacuguagugguuccaccauagagguucuggaaucagacuucuugcgcucaagaucuuggcugucacuuuuuagcuaucuagcuuugggcaaauuacuuagccucugaugccccagcuucuccaucuguuaaguggggauaauaauacuacuacuacuucguagggauacuguuccuuugcccuaaguaaguacaaaauagguuagguguuaaauuacuauaucggaucagcccuauuuaaacauguagccaauaaaaguguuaaaauuaauguuuuugauauuucuugauucucuugaagcucauagaggccagguuagacauaaccuauaagguaauagcaguauuguccauuugauauucaaguggaggcuuacugaaggccaguuagcugaacucugucuagcucacaagccaguagagaggcaauaucuaacuuguuccauuuuccuuauuagaaagagaugguacuauucagaguaauaaguuauucugccuguagcuuaguguagacauuaaaucagaaguguguugagacuaguagggaacugcugaauugcauuuaaauaauuuccaguugaauccuuguuuuuccagguacagaauaacuuuugaugucaguuacauuuuacuuggaauaaggugcucugauucuaccaucucaaaggcugguaaaucacaaguguucaguugcugucacuugggaaacccauuguugcuaaauauauaaguauguugaaauugcugugagaauauaacccaguaaagaacaaccuucagacuucagaucuaaaucuaaugucagaagauucaaaacuguaaggaaugcaaaauuucucacugguauuauucaacaaagaagauaauauaauuugcaggaauauacauuucugucuaugcuaguuaaaaaaagugauuucuauuuugaauggagaaacacaccuagaaacauuauuuuuccugaauugacccacauacauagaaagcuucucacuauugauauuaaaaaauuaagguuuuaguuauuaagcccccuucucaaauuggggguuauaauaugcaacucauggaagauguaguagucaauaaacauaaaaaaugcccaacuuuacuaauaaugaaauaaauccaaacugagaucacuuuuugcuucucuggugacaaagaugaauguuaacacuagcaugaccauauaacucacauccaaaaugaggagguagcucacaccuguaaucccagugcuuugggaggcugaggugggaggauggcucgaggccaggaguuugagaccagccugggcaacauagugagauccugucucugcaaauuaaaaauuaaaaaauuagcugggcauguggcauacaccuguagucccagcuacuugggaggcugagguggaaggauuucuugagcucaguaguuggaggcuguagugagucaggaucaugccacugcauuccagccugggugacagagagagacucugcagagaauaaaagggaacacugugaauaauuauucuggguaaacauauauaaaccaagaccucccaggcaaacugguucauguggucaccuugguuaaaagggugcaggggcugggugcgguggcucacgccuguaaucccagcacuuugggaggcugacgcagguggaucacgaggucaggaguucaagaccacccuggccaauauggugaaaccccgacucuacuaaaaauacaaaaauuagccaggugugaugccgcacgccuguagucccagcuacucgggaggcuaaggcaggagaaucgcucgaacuugggaggcggagguugcagugagccgagauugcgccacugcacuccagcccgggugacagagcgaggcuccuucuaaaaaaaaaaauguggugcagggaggugggugcaguggcucacgccugugaucccagcacuuugggaggcugaggcagguagaucaccugagguugggaauucaagaccagccugacuaacauggagaaaccccaucucuauuaaaaauacaaaaauagcugggggugguggcgcaugccuguaaucccaccuacucgggaugcugaggcaggagaaucacuugaacccgggaggcggagguugcagugagacgagaucacaccauugcacuccagccugggcaacgagagcgaaacuccgucucaaaagaaaagaaaagaaaagaaaagaaaaacgaccaaccaaccaaacaaaaaucaagagggugcagggagauggacauuaucccacaccaaagcaggaggcuacaauggucuagaccuuugugguggcaaucuggaacuguaaaaacuuaaauauguacucuuugaccaaauuauuccaauuaauaaauaucaugcauaaaugcaaagauaauguccaaaguuguucacuuuagcauuauuuacauaguagcaaguaccuggaagcaucuuuaaauacaucuaucaaugggagauuaaguaaaugaauugugccuuaugcauuucauaauggccugcaaaugccaaagauugaaguagaugcugggugugauagcucauaccuguaaucccagcaguucgggaggcugaggcuggaggacugcuugaagccagaaguuugagaucagccugggcaacauagugacccugucucuacuuaaaaaaauaaauaaauaaaaaaaaauaaaaaauuagcugaguaggguggcaugcaccuguagucccagcuacaugggaggauaaagugguagcuugaacuccaugacuuaagcccaggaguucgagguuccagcaagccaugauugugccacuguacuccagccugggcaacagagugagacccugucucuuaaaaaaaaagaaaaaaagauugauguagaguuauauguacagacacagagcaucuacuguauauuauuagaugaaaaaaacaaguuauaaaauauuccaguuguguuuaaaaaugauaugcagcauggcucaguuuuucuugcgucgaagcugauuguuuaagcuuccucccugcauacacuaagcuccuucaggacuugggcagugccuuuggauggugucuucucauccuuugcugagacuuuagguggcaucuuggcaucuuguacauaguuggcccucagugauuccuuaacaggugugauaauauggcauucaucucaucauuacaagagcccucugcaaauuagucgaauucuaguucccaacuacuuugaaauacauuuaaaaacagauucuguaauuuuaaaauugaguuacugauuuuuuguuuuguuuuguuuugagacggagucucacucugucacacaggcuggaguacaguggugcaaucucggcucacugcagccucugcuucccagguucaagcgauucuauugccucagccucccaaguagcugggacuacaggcaugcgucaucaugcccagcuaauuuuuguauuuuuaguagagacgugguuucaccauguuggccaggcuggucucgaacuccugaccucaagugaucugcccaccuuggccucccaaagugcugggauuauaggcaugagcuaccaugccuggccaaguuacugaaguuuuuaauuaauauuucagucuuuaagugauuuugucauacuuguuuucgcccccauuucugagauguauuuuuugaccuccgcugacuuuauaguguuguguuugcaggguuuacccuuuggaagcggauuuaauucuugcuguuuuuaaucaguugaaaaacauuaguacugggucuuaccuaaaagcuuaaaccuucauacgugcauuagaaucaaugaagcaccuuauaggaaagcagaguccuggacugcaaccccguagacucugauuuaguaggucucagggagaggcccaaggaaucugaaguuuuugguaauauuuaagccgauucuaaagcagguucugcugaucauucugggaaacacugauuuuaaaagauugcauggauuagccuagauuagcaugaaucuauuggguuuguuaaacaagagccuuuauuaaaauaagaagguauccguguuaauuuauaaaauuuaacacacaauuuagaccagagcaagauuuaaaggacuauaagcacugaauacucugugaugugauuccauuaaucgauaucugccaagaugccgaucuacgcaggcaguaccauugcaggaccauggugucacaugcacagccaucauaaccugcaagcguguaacugcagaauggucaguagagccuggaacaagauaaaucucuaacuaagaagugugagccuuaaaggagcacagauuauuagugauugaucacuuaaauguagcuccgggacuucaguguuaauauugcugucauguagcucuauaaacaacguucucuauuuauuuuauuuaaaaguggucaagagaauuauuaauccgacugugugguuccauagccuugucuuagaaugagaucagaauucaguguuguguagguguauacuuuugaucuucccagggacugggccccuuuaaaguauagguuuuuagcaucauuuaacuguucaugcaaccacagugauuuccccugagagagacccuggcagcauuucuaguuucugcauuuccuuucuguugccugccacacagguggggagcagagaagcgaggguaccagaggauuccagugaugcuguggguguguccggggugacuggauagcagugcagcauggagguagcuuuguggucuuccaggucuuacugccugggauggauuuccuacuuucccguuacuaauuguguggccuuugguaaauuauugaaccuggaagccucaguuuccuccuaugaaaauaggaaucauugacuuauggagucaucgggaagauugaguuaaugacccuagagugcuuagcaugacaguaccuggcacagagaaagugcucugcaaaugccagugcuguuauuauuaaucagauagacuuuuucuuccuuaacauccuacacuuagagauuuuagcauuuacuguucauuaauccgcuuaggcuccuaguuucuuauaacauguuucuaauuuuuaaagggaucaauuucuuuuuuuuuucuagagaauccuuuuuaacaaggcauagauauuuguauguauauccuaaucagagacauauggcagcuuccguggacccauaguauaaugagaggauuauggcuuuaucuuuauaagauuaugucauaagcaauaaacucuaaagaaaaagacaaccucuuccuuuguuccagauaaaucuucugggcgguucuuaauuuuuauccaucagucuuguuuuauaagcaaaaugguuacacuuugggauuucugaauucuguuuuccauguaauggaacuucgcuuaauuuuuuccagcuugaguacucacuuguguaaacugucaucacaaaauuucucccgaagagagauaggccaggcuugcucagugugguguggucccaugugauggcaacugggaacagugaguggguggguguuuccucucucacccacuccuguuagccuuucuggugucucugugcccacccacacaugauuucugacugcugcaggacaauauggaaggcaccuuguaacacuuuuauuauuguucuggguuaaagaaauaccuggaaggucauaguguugugccaguaaugugcuaccuucuaauaaauguguguuuguaauuagagaccagaacugcaaggguuuuaauaagauuagcuuucccuuuucugcuuaguuucugguauuagcagugaggacuuuaagcagugauuuguauuuuuuacuuccucucucaaagauauuacagauagugcaguuuuuaucagcugcagaaggcagcuguugaagaaagcuaaugugauuguugagagcagagaauuggaugaugguaaugaccagaauaguuaaccuuucggagcauacugauugcuuuuccucguauuaagcguugugcauaggaucaucucaugucaaauccccaguaacccuaggagagaaugcuacagaaacagccacgguuccacggcugggaguaggggucuggauuugaauccaggccccuccuuuuuagcuuagccuguauucuugcaugcccaguucuuaaagccggucaaaucugugcaaaacacucaaaaugaggaguguuucuagguugcagugaaaacuguuacugugaugaaacauuaguuucuaggccugacaucccccaccuuugacguuguuauuuuccuugaugcaaaaaugucuaguucuaagggagcacauaaagaggagacauaaaaacaguggaauaccauaccuguuuucuagauaauggccuaguuuaagguuuugccuggaaaauucccucucauuuuuuccuuuuuuuuuuuuuagggccauuuuuauaugucucuaccucuggccuuucuaccuuuuuucccccucugcuagaauguuuauaugaauugacaccuaccugaaaguaguuccagacuugacuuuguucaguuuuacaguaaaaaucugcaguucuuguacaguuuuggcaauucagugcaggguauuacguauuucauuagaauuaaaaacuugauccaugcuguuuuauuggacaguguuuccuuuuuagcuaaggggauaaagguccuuuacucaucaucucauuugggaaauaaaucucuuucuuucugucugucucccucauucuuccucuugugcucugucucuauucucuuugaauauuauauugaauauaauauugaauauuaugguugaccaaaugaauauuauauugaauauaccauugaauauuauggaugaccaaaugacagaagaggauaacauagauaauaauaagguacauaucuugaaggacaagcuguaaaauaaguaaaaaguauguucuucaaaacacuucuagcaacuucaugcuauuucuucauauuucugcaagcugggucuaucucugguuuuguuuaguguuuauaggguacacaugauuuuggcaggugggagaacguuucguuccuuaaccuuguguggguucaccugcaugguauguguauuucagcauacacggggagcucuauaauuuuaguccuguccuggguuaugccagucuguaaaacaggaaaguaaaaagucacagagcuguucauuaaaugagauaguuauagaaagucauuugaaaagcagggagcuauuuuacaaguaugggccuuuguuugugauguaaacguagacauugacaagggccaguuguuagaaugacuuaaaaauacaauccagaacccugaagguacaauaaagaccuaagauggaauauuuaaucauuguguucuuacuugaaaucccaaccgugcugucuuggauggucaguagagacuuccagugaacuggcuuugguggggcuuuagaaagacaccuauugaaggcacaucacaugggaaaagcaggagcaagagagagaaagggggaggggcacauacauuuaaacagccagaucucgagagaacucuuggaauuaauuauauuuuacuuaaauuucuuuagccugaauucuagaaaaaaauguacagugguagaaggaauggggugggaugggaugggacaggguaagaauagauuauaauucuucuguguuuuuaaauauucaggcagauuaauaugugauaugaugcuuacccuugguuaaagaucuacauuuuuuguuuucucuugcagcaaugacuugacuugaagagcucuaagagacugaaaacuuauaugaaguugccuugggaauauuuuuauauauuuuauacaguuucuaucauggagucagcaggcacguggauaaaaccuaaaagggaauauuauugcugugccauauacagaauucaguuugcuuugaaacaaguuuugguugaaagagucuguugaaaauuuuauuauacuuccagggaaggaaagagcuguuuuuaucuucuuaaccacucccagccucuacucuucccagccccuaaucccaggccuugguguacacacuguaguuuuuccauuaugaugaguaugugcagugauacuauucauguacagucugagcuuaugcucagggguguguguguauauguguaugcaugugugcacgugaguguguguuucuuuuuccaguuccugcauccuauuuugacacugguuguaagaagaucuugauacauacagguuagcuguuacaaaagauaaaagaugaaucuucagugguaaaagcucaguggaaauaaucuaguuagcccugaggaguugauuccccaagggaccauggagucagaugggaccagaugcuagacuuuggauuccuugaccacaaauucagcauuaacuccugccaccaccaugucacuccuacagcacuuacacauuuugagaagguuuuuuuuuuuuuuuuuuugaggcagagucucgcuguguccccuaggcuggagugcaguggcacaaucuccacucaccucaaucuccaccuccccagguucaagcgauucuccugccucagccucccaaguagcugggauuacaggcaugcaccaccacgcucgacuaauuuuuguauuuuuaguagagacgggguaucacuauauuggucaggcuggucuugaacuccugaccucaggcgaucuacccgccucggccucccaaagugcugggaauauaggcgugggccacugcacccgguuuuuuguuuuuuuuuguuuuuuuuuuuuuuuuaaccuuuagcugagcgauucuugguuaauccauugaauaaaggagaaaaugguugaaagucacacacacacaaauuuguuuggacaacccaaggccaaaacaaaagaacccugcuucucucuuuuuuuuuuuuuuuuuuuuuuuuugaggcggagucucgcucugucgcccaggcuggagugcaguggcacgaucucagcucacugcaagcuccaccuucugaguucacgccauucuccugccucagccuccugaguagcugggacuacaggugcccaccaccacgcuuggcuuauuuuuuuuguauuuuuaggagagacgggguuucaccgcauuagcgaagauggucucgaucuccugaccucgugauccacccgccucggccucccaaaguucugggauuacaggcuugagccacugcgcccggccuagaacccugcuucucauauaagaugggccugcaccuaccucuggcauguuuuucuuuguguauuuccuguuuuucauccuguaacuaaugcucauuauuuaaaacacuccaguuacuuuucccuuuaggccuggcaaacuuuucuuuuucuuuuuuuuuuuuauaacuguacauuuuacaaaacaccugaaaggacccagaggcauaaauaguauuacaugauuuaugguagcucuggggugagcugugggggaggccaguuacaaggucuccaagacccgccuccaugucaguguuggggggugccuugagcacuucuuuuauuucauauaggaaaaugcacaucuuucauuugucucccaaaagaugauuuccauaaaaauauacuucaaaguauuuacuguacauagacuucaaugauuuuauuuccagcaucaaacuaaacauuucuaaccuuuuaaauaaauggggaauuuaguuucaugagaauuuuuacugacaacuaauaaacacuguauguguacauauucauauacacuguggacuggagaaagucaguauggaaauaaauuucacugagauccagaaaguagcaauauaggacuuuuagggguauguauuaguguaaauaauauaugugcagucuaggcuaaucauuuuaauuaaaaacaaauaagcauacuuuuuugcuuuaaaaauaugcccucaaaauggugggggauaaaauguaagauauucuuuagcuuuaauuauuuuuccaucuuauucaagucagagcacuuuuuuuuaaauagcaauacaacaggcaagagaauacucaaaaauauuuaaaacuguauugauaccaagaguauguuuuaaauauuuucuaauaaauacuugagcgguuuuugucuggcaggcuuccaaauuugccaaaauuaagcguucaguauuuucaacacauacgcuuuuuacugguuuauacugaacuaucugaugagaauuccuguguucccaaagcaacugauguuuacaggucuuguguuacuccuccuccuuucuaaggaugagggaauccacaacagacuuucucuagaaaacacuaaugauggacaacuuuuuggugucaucaaugaguuggcuacuaccuugauguaaaaauuuguaaggaaaauuuucaccauuucgagugucaaguguauuuuuaacugucugguuuguacuuuuaugacuuuuguacuaccaaagcggaguuaaaaauaaaaauguuaaacgcaguguguugucuugugggugauccaauuauuggcgccuuguacacuggaaauacagucguggcaguauaauuauugagcuuaauuuuuuacagugcugaauuucuugugucuugaaauaucaagugaucacuuggcugacuuuccucaugagauuuccccuccugcaguaccccuuccccuaacacaggcauacuuuggagauacuguggguucagccccggccuacugcaguaaagcaaauauugcaaucaagccagccacaugagcuuuuugguuucccacugcauauaaaaaaguuauauuuauacuauacuauagucuauuaaguauaugcaauaauauucugucaaaaaacauacauaccuuaauuuaaaauacuuuuuauugcuaaaaaaaaauacgauaaucugagccuucagcaagucauaaucuuuuugcugcugcaggaucuugccucaauguugaaggcuacugaccaggguggugguuacugaagguugggguggcuguggcaauuucuuaaaauaacacagugauaaaguuugcugcacugauugaccucaccuuucaugaaaguuuucucuauagcaugcaguacuguuugauagcauuuuaucacaguagaacaucuuucaaaauuggagucaaucaucucaaaaucugaugcugcuuuaucaacuaaguuuauguauuauuauauucuaaauccuuugcugucauuucaacaguguucacagcaucuucaccaggaguagaugccaucucaggaaaccacuuucuuucaucaucuguuaagcaauuccucaucuauucaaguuuuaucaugagauggcagcaauucaguucaaucuucaugcucacuucugauucuaguucugcugcuguuuccaccacaucugcagugacuuccuccacugaagucuugaaccccuccaagucaucugugaggguuggaaucaacuuccagacuccuguuaaugucucuauuuuuaccuccugugaaucaaaaauguucuuaauggcaucuagaauggugaauuccuuccagaagauuucaauugacuuuacugagguccacuagaggaaucacugucuacggcggcuguagccuuaugaaaugccuuucuuaaauaauuagacuugaaagugggaauuaaucuaugggcugcagaauggauguuguguuagcaggcaugaaagcauuucucccuuuguacaucuccauaagagcucuuggguaacugaccagguccuugucaaugaguuauuauuuugaauggaaucuuuuuuucugagcaguaggucucaacagugggcuuuaaauguucaguaaaccaugcugucaacagaugugcuguuaucuaggcuguuuacaggcagagucgauuuagcauaauucuuaagggccuuaugauuuucaagaugguaaaugagcauuggcuucaaccuaaaguugacagcuauguuagccccuaaaaugagagccugugcuuuugagguuuugaagccaggcauugacuucucaacuaugaaaauccuagaugucaucuccuuccaaaucuguuuuuucauuuagccaccuucauccaugaucuuaccuagauuuucuggauuauuuacugcaguuucuaaauuagcacuugcugcuucacuuuguacuucuguauaauggcaaugguuucuuuaguuaauccuuaugaacuggcugggugcaguggcucaugccuguaaucccagcacuuugggaggcugaggcgggcugauugcuugaggucaggaguuugagaccaaccuggccaacacggcgaaacccugucuccacuaaaaauacaaaaacuagcugggcauaauggugcacaccuguaaucucagcuacucaggaggcugcaguagaaggaucacuugaauccgggagauagagauugcagucacugcacaccagccugggugacagagcuagacucugucucaaaaaaaaaaaaaaaaauuaaauuuaaaaaucuuaugaaccaacgucugcuggcuuccaaccuuuuuucugcagcuuccuaccuuuuuucugcagcuuccucacuucuuucagucauuauagaacugaagaguuaggaccuugcucuguauuaggcuugggcuuaagggaauguuguggcugguuugauuuuuuuauccaggccacugaaucugucuccguaucagcaauaaggcuguugcacuuucuuaucauucguguauuugcuagaguagcauuuuaaauuuucuucaaaacuuuugcuuugcuuugcauucacaacuuaacuauuugguacaggaggccuaauuuucugccugucucggcuuuugacacgccuuaaucauuucuagcuuuuuauuuaaggugagaugcaugugacccuuccuuucacuugagcagugagaagccauuguaggguuacuaacuggccuaauuuuaauauuuugucucagggaauagggaggccugaggagagggagagagacgggaacggcugguuggucgggcaguuggaacacacaugcacagcauuuacagauuaaguuugucauuuuaugugggcacaguucaugucaucccaaaacaauuacaauaguaacaucagaaaucgcugaucacggaucacuauaauagauauaauaauaauuaauugaaaaguuugaaauauuucaagaauuacccauaugugacacagggacaugagugagcacaugcuguuggaaaaguggugcugauggcugggcgcaguggcucacgccuguaaucccugcacuuugggaggccgaggcaggcggaucacgaggucaggagaccgagaccauccuggccaccauggugaaaccuugucuuuacuaacauacaaaaaaaagaaaaaaauuagccaggugugguggugcgugucuauauccccagcuacuugggaggcugaggcaggggaauugcuugaaccugggaagaggagguugcagugagcugagauugugccgcugcacuccugccugggcgacagagcaagacuccaccucaaaaaaaaaaaaaaaaaagaaaagaaagaaaagugcugauggaccuucucgacuugcaggguugccacacacguacgguucauuaaaaaacaaaacaaaaacaaacaagaaaacccuacaauaucugcaaagcacacuacagcaaagugcaauaaaaugagguaugccuguuacugcuuuuuaaauuugaagauaauuuuggacuuguagaagaguugcaaaagcaguacagaguucauguaa

SEQ ID NO: 14353 - RNA, 1316 nt, Homo sapiens
aagaugaaaguuaagccacuaucaauuuaucacaggguucuggugcgugugugugugguuuuuuuuuuuuuuuuuuuuuuuuuugagaccgagucucgcucugucgcccaggcuggagugcaguggcgugaucucggcucacugcaagcuccgccucccggguucacgccauucuccugccucagccuccugaguagcugggacuacaggugcccaccacuacgcccggcuacuuuuuuguauuuuuuaguagagacaggguuucaccauguuagccaggauugucucgaucuccugaccucaugauccgccugccucggccucccaaagugcugggauuacaugggauuacaggcgugagccaccgugcccagcugcguguuguuuuuuuuuuaagcagugucuugcaaaauuaaaauugccaaaucaagaaauaaaucacuguggcuuuucaauugccucaaaauauuuggugggaagagaaauauucguauugagguuucagaacugugacacaaagaaaacugguuuccaacagaauaaaaggaaaaagcauugguuuguuugcuccagacuuuuucaagucacaguuuaccuaaaaauggugacaagauuacaagucauuuggccugcaugguuguuuaaaaaaaaaaaaguaagcugccaauaucgaaaaucagugauuuuacauuuuagaagucuggauuuugucuuuuuuugcguaagaagaugcagcaacacuaggugcuuucugccucgugguaaugcaagcccuauauggugggugaugugaauucuaguuugccacaauccccaccaugccacauugccucacaaguaauccucuauccucauuaucacacaggccaagccccuggaggcacuaaguuugugacuucuuuacaagaagcucuaggcagacaaguaaucauguucagucccccucagucuuccugggucaaggaaagcucucccacuucccugucaaauaccauuccuaugcugccacagcaccugggaggcuccaaguaccuucuccucacccugcaccacucugcccccaaugucaccaaaaccacggcucaccugcuacucugugccacugcguucucucuucacagguguugccggcaccuccccauugacgguuucagccccacuaacagacaucaggcuucuccguuccuucugguuugacuugugcuccacuuuuguaacucuaaaucugaggggggaauggggagaggugaugggguuugcuuuucuaauaaacaagaauuaugaauaaagcaaaaaucauccacccagaggaucuc

SEQ ID NO: 14354 - RNA, 1316 nt, Homo sapiens
gagauccucuggguggaugauuuuugcuuuauucauaauucuuguuuauuagaaaagcaaaccccaucaccucuccccauuccccccucagauuuagaguuacaaaaguggagcacaagucaaaccagaaggaacggagaagccugaugucuguuaguggggcugaaaccgucaauggggaggugccggcaacaccugugaagagagaacgcaguggcacagaguagcaggugagccgugguuuuggugacauugggggcagaguggugcagggugaggagaagguacuuggagccucccaggugcuguggcagcauaggaaugguauuugacagggaagugggagagcuuuccuugacccaggaagacugagggggacugaacaugauuacuugucugccuagagcuucuuguaaagaagucacaaacuuagugccuccaggggcuuggccugugugauaaugaggauagaggauuacuugugaggcaauguggcaugguggggauuguggcaaacuagaauucacaucacccaccauauagggcuugcauuaccacgaggcagaaagcaccuaguguugcugcaucuucuuacgcaaaaaaagacaaaauccagacuucuaaaauguaaaaucacugauuuucgauauuggcagcuuacuuuuuuuuuuuuaaacaaccaugcaggccaaaugacuuguaaucuugucaccauuuuuagguaaacugugacuugaaaaagucuggagcaaacaaaccaaugcuuuuuccuuuuauucuguuggaaaccaguuuucuuugugucacaguucugaaaccucaauacgaauauuucucuucccaccaaauauuuugaggcaauugaaaagccacagugauuuauuucuugauuuggcaauuuuaauuuugcaagacacugcuuaaaaaaaaaacaacacgcagcugggcacgguggcucacgccuguaaucccauguaaucccagcacuuugggaggccgaggcaggcggaucaugaggucaggagaucgagacaauccuggcuaacauggugaaacccugucucuacuaaaaaauacaaaaaaguagccgggcguaguggugggcaccuguagucccagcuacucaggaggcugaggcaggagaauggcgugaacccgggaggcggagcuugcagugagccgagaucacgccacugcacuccagccugggcgacagagcgagacucggucucaaaaaaaaaaaaaaaaaaaaaaaaaaccacacacacacgcaccagaacccugugauaaauugauaguggcuuaacuuucaucuu

SEQ ID NO: 14355 - RNA, 774 nt, Homo sapiens
uuuuuuuuuguuuguuauuuaguuuuuauuucauaaucauaaacuuaacucugcaauccagcuaggcaugggagggaacaaggaaaacauggaacccaaagggaacugcagcgagagcacaaagauucuaggauacugcgagcaaaugggguggaggggugcucuccugagcuacagaaggaaugaccuggugguuaagauaaaacacaagucaaacuuauucgaguuguccacagucagcaauggugaucuucuugcuggucuugccauuccuggacccaaagcgcuccauggccuccacaauauucaugccuucuuucacuuugccaaacaccacaugcuugccauccaaccacucagucuuggcagugcagaugaaaaacugggauccauuuguguuggguccagcauuugccauggacaagaugccaggaccuguaugcuuuaggaugaaguucucaucuucaaauuucuccccauagauggacuugccaccagugccauuauggcgugugaagucaccacccugacacauaaacccuggaauaauucugugaaagcaggaacccuuauaaccaaauccuuucucuccagugcucagagcacgaaaauuuucugcugucuuugggaccuugucugcaaacagcucaaaggagacgcggcccaagggcucgccgucgacggcaaugucgaagaacacggugggguugaccauggcuaauaguacacgguuuuccucggcggcggcgucugcaaagccaaguaauugcuucu

SEQ ID NO: 14356 - RNA, 4406 nt, Homo sapiens
cgcgauacaaguacguaaugacgacagacguucuuucuuugcugcgucuacugcgagguaaggauguuucugugcucguggggguacugggaaucugaaaccaucugcucugggaaaggcugcggcgcggcucccacucucggaaccuuguccuguuugucccccagcucggcaagcgccauaugagccuggcggcgccagaugcgaauccuguugugggcuuuuuggccuauucccgccccucagucuugccgggauggcaccgcccgcauaggacuuccaggguugggcugagugggaguucgacugcugggccucguaauucucgcuuuggggcugcuccuuccaggcugggacacacuggggcccgcugucggucucccguccuccgacaucuugucuggaacuuccgccuggcagucuccaguaggaguggagcucugugcggcguaguuugguggaaaaacgggccuugcgucggccucacccccaguguuuguguuucagaaugaagacuauucucagcaaucagacugucgacauuccagaaaaugguaugagacuugaugucuuuuacuuacaucuuuacugcacguuccaagcguuguguggccugacgaguguguucucucuucuagucgacauuacucugaagggacgcacaguuaucgugaagggccccagaggaacccugcggagggacuucaaucacaucaauguagaacucagccuucuuggaaagaaaaaaaagagggugaggguuuuucuucugauaauucaguugcucguuggaaggugguuuauaacagcaucacauuugguugcuuuaacaauuuucgaauuaagguucagugcuucagcuuuaaauguugcuguccagaauaccagccuguucagugaaauugaaaaaccagauucugaacacagccaauuauauaaagcucaaauguaauaguggucaucagugacacgucuuaaugguguuagaaguuugguuuauuuuccuagugauugcuuuguaaaaaucacaggaaccggcaguaggucauuuaaaccugaugauuuaauuuuccagaagggaaguuuguugcaacuucuacaaagcuuaacuguugggagguuuuauaggugguuggauuuuuccaguugaaaaccaugugcuuugauaaggguuaauucuagaaucuuaaaguaauucgguaaguggucuguugucuuuuaagccugcauauuucuggaaagaauacauuuuuuguucuguuacagcuccggguugacaaauggugggguaacagaaaggaacuggcuaccguucggacuauuuguagucauguacagaacaugaucaaggguguuacacugguaagcagauguaucagacuuccuuguuuuggaaagggagguuucucaaaccugugcuuuauacagcguaagugucucuuucagagaaugggucauguauuuuauuugguguaauacgcaagaacuuggcaaaaauaggcaucugugggucuuuaagcgauagagcugagagcaaagaccagauggguacaacauguuuguuuuuuucuguuguuggguuuuuuuuuuuuuuaaucaaggcuggggucucgcuauuuuguccaggcugagcucaagugauccucccaccuuggccucccauaguacugggauugcaggcaugagccaccaugcauggcuagauggguacaacuuuuaaaaaguaggcuaaugaugaauuuucauaccuuccgaauucuuuaagauaggaaaucuacaguugcaguacuaguugguagucacaucucaccaucaggaccccuuguugggauagaaaaagauguaguuucugaguuuucugucugcugccauaauguaugucauuauucuuuccaacccaccgucucuccccucaagauaaaaaguucaugcugaaaugguuuucuuugcauuauaccuucuagaaugcaccugauaauggcacccuguacaucuauuauaaaucuguuaagauucccccaucuacccuugcucuuagccuuaaguuccuugaaggcagggggccugccuuuggcuugguggucucaauuccugccaugugcuguaccuuaguaacucaguaaauguuagucuaaugucuaagaucagggcuuugggguucucauuaaaagaaggcagcauuguucauugagggcauaagagcuagugaaauaaagccuccgcaaggagcuuuacaguccacugaauagacagaacaauguuuauaaggcuugguucaggugacaguuauuagaaaaucuuggcagugaguguuacguuuuaaaauaaguauaagcaucuuagaaaauuuuaaaacuauuaaaaauauuccucagcauugcuaauagcuugcuuauuuauuuaacauagggcuuccguuacaagaugaggucuguguaugcucacuuccccaucaacguuguuauccaggagaaugggucucuuguugaaauccgaaauuucuugggugaaaaauauauccgcaggguucggaugagaccagguaugugcauacccucagacagaauuaagaaauuuuuccuucauauuuuuuuccuccuuuuccacucccaacuuccauacuuuaguuggcuguuguuuuguguuugugcugaguaaaaccagauuuguuuuagaauuaucucuugauuacacuuaaacuguuggugcuacuuaaggguuuauaucauuaugucgauuacaauuucagaaaguugauacauuggaguagcuugcaguggugguuguauuuaacuuggcaaaugaaaucuuuuaaaaagacuuuaaauuuacaaaagguguauauaaugguguguauuuauggagcacaaugugauguuucaacacaugcauauucuguggaaugacuaaaucaggcuaauuaacacauccaucacuccauuuauuucuucgugguaagaaccuuuaaaaucuaaagagaaaacuacaugaguagugguuaauagccuagcguaaauuucagcucucacuguccaccuugggcaugucaucucucugcagcuuaaaauugcaaacaucuuugauuaaaugaguuaaaguugaaaaacaacaaugcaugcguaauacauaguaaacacaguagcuuuaaaaaaaauuuaaagcuuagugcuuuuuauuugaggcagggucuugcucuguugcccaggcuggaguacgguggcgugaucucagcucauugcauccuccaccuucgugcucagguguuucucccaccucagccuccccacuagcuggcacugcaggugccugccaccacauccagcugauuuuugauuuuuuguagagacuguuucgccacguugcccaggcugauuucaaggaaugcuauggugccuggccccagcuaauuuuuaaguuuuuuguagaggcagggucuugcuauguuguccaggcuggucuugaacuugcaggcucaagcaguucuucccccuuggccucuuaaaacauaccuggcucggccucuugaugcauuuugauuccauugggguggggaggggugggaagaagggagauucuuaguaucaaaauaauggcuguccagaaauacucugauacuagcuauggucagcaacauuuaaugaaaacccuuauguuaaaaauaaaccccugccuccuggcuucaagcgauucuccugccucagccuccugaguagcugggaguauaggcacguaccaccacacccagcuaauuuuuuguauuuuuacuagagauggguuucacaguguuagccaggaugguuucgaucuccugaccucaugauccgcccgccucggccucccaaagugcugagauuacaggcgugagccacugugcccggccucaaaaucuuaagaaaagguucuuuuggugcauggaguuuuacauggaauaaauuagugccucugcaauuuaaauauuuuuuacacagauuugaugcugugcaaaugcccucuccccuuuuagguguugcuuguucaguaucucaagcccagaaagaugaauuaauccuugaaggaaaugacauugagcuuguuucaaauucagguuuguauguuuacuaugucuaacuaugccuacaagauuuugucuaaaucuuguuuaaaauacaguauuuugcuaauuuuuauuugauuagcuuuuuaaauugugaaaauaaaaaggucacauucugaaauuuuaaguacagcacauaaugaaauacuuucuuuuuaagauggguuaggcugauguauuaauugcuuuaucuucacuccuauagcggcuuugauucagcaagccacaacaguuaaaaacaaggauaucaggaaauuuuuggaugguaucuaugucucugaaaaaggaacuguucagcaggcugaugaauaag

SEQ ID NO: 14357 - RNA, 3186 nt, Homo sapiens
uauugcagugaauucugcucuguuucauguuuggaaaaccuguugcuugugacccauugaauugauuuuaugugucguuuaucaguaagacacgauucuguggcuuuacuucauagacuguaccuggcuugcuucaucaucuucuuccugccccaaauauagccaagaaaauuguuucuuaauaugggacccaguuauagccuauaaaacaagucacugggcgcccucuugguugcuguuguacauuauuaaaggacuuuccccugggcagacacauguuccccaggggagcagaugcccuuuaaggacagagcuugcauugccucuuuuaagcugcuggcuugucuuuuggguucccuuuccauugcccuucccaaguaggagaaaucaaaaaauaguugcagaccaaccuguuccacucuaugaccuugggcuaguugcuuaaacucuuugacccucagucccuugaucuauaaaaugaaaaaaauaauucuaccucacacggcuguugugaaagauaagugauauauuacaugugaaacugccuucucuacauuaaagucaauguuaaguauaauuauaaucuuaccuauaucacuauaggccaugacacuggagaauuaaauguacaaauaacaaagggaccugcucugaacaccucauuaguuucugauacuucaacucccugguguuuaauaaacuaacaaaaacauuaauacauucuaaaagcugaucauuaaauaaaccuauuaacaucuauguaaaguuauauguugcuaccuaacaagcuaccuuaaaacuuauugacuuaaauuuauagagacagaaaguagaacagugguuaccagcggcugggaggaggagggaaaggggaacuauuggugaguggguacagagugucagugugagaucaugaaaaaguucuggagauggaugguggugaugguugcacaacaaugugaauguacuucaugccauugaaccacacacuuaaaaaugguuaaaaugguuaauuuuacguuguguacauuuugccacaauaaaaaagaaucaugggccaggcaugguggcucaugccuguaaucucaacacuuugggaggccgaggugggugaaucaccugagcucaggaauucgagaccagccugggcaacagcuggucugaaauuagccaagaugguggcuaauuucaacauuuugaaauacaaaaauuagccgggcgugguggcaggcaccuguaauuccagcuacuagggaggcugaggcaggagaaucgcuugaaccccagaggcagacguugcggugagccgagaucgcgccauugcacuccagccugggcaacaagagugaaacuccgucucaaaaaaaaagaaaaaagaaaagaaaaaguucuggagauggaugguggugaugguugcacaacaaugugaauguacuucaugccauugaaccacacacuuaaaaaugguuaaaaugguuaauuuuauguuguguacauuuugccacaauaaaaaagaaacacgggccaggcacaguggcucaugccugccaucucaacacuuugggaggcugaggugggcagaucaccugagcucaggauuuugagaccagccugggcaacagcuggucugaaauuauccaggcugguggcuaauuucaacauuuugaaauacaaaaauuagccgggcaugcuggcaggcgccuguaauucuagcuacuagggaggcugaggcaggagaaucacuugaacccaagaggcaaaguugcaguaagccaagauugugucaccacacucuagccugggcgacagaaccagacucugccuaaaaaaaaaaaaaaaaaaaaggaagaaaacacuuggggaccuaaaaccacaacgcuuuucgaguuagaauuuuggccagcucaucucugcccuauauggugucugcugggacaguucaacugggaccgaagcauccaagauggccuccuuugccacgcuggugcuggcucuuagcugggaugccucucuuuuccuccauguggacucaaccuucaaggcuucuuucuccacguugcugcugucuacagcuggacagccugaacuucuuuacaaggcaguuggguucucagagagaaagcaaaagcucuagaucucuuaagaucugggcuugaagucccaucaccucucagugguucaggcgagucauuuugcugguacggauccugcgugggaggggaggacacacgggugaauucagaggggcaugguuccuuuagggccauuuuguaacaaucuacuacagccuccaugccaauuuauuagcauuucuccaugcucugccuuaucuugaauucuguucuaguacaauaucuccagauuagcacauagggucauuguuaagacgauggacuuuggccuaaggcuucaaaucuuggcucugccauuuguugacugugagaccuuuggccaguucuuuacucucucucuguuucaguuuucuuaccuauaaaauggggaugacaauagucuuuaugucaucguguugcugugaguauugaaugaauaugaauaaaaagcuuaguaacagugccaggcacaaaguaagaacuauauaagcguuugccauuauuguuauugucauugucguuguuauaauaaacauaagaagcagcaugguggagaagggaauauuuagagcuaaauaagacagaaagguuggaaacgcuuggauacacaggaccucccugccucacagaguucucacuuacaucuaaauccuuugcugacauuuaagcuucuuuccuuuuguucucuacacaggagacauggagaacagcugaucaacaucucuccauaauaauccucugaacaccugaagacagcugugagagcuuaaagauuugcugaggcuaaucuggguacagguaauuguguugaugauauguucaaaugcaucuaagucuaugccugaguauaguugcuggguuauaaacaggcacgucacacuucucuuauacacuucaggaagcuggagcgcugggucuuguuuucccugaaggcauuagggaaugugccugcucuuuuucagagcguaaaccuggaauagguuuccaacgaggacaaugcaagccagggcugagaggugccauguguauggcacacugcuggccccaaagaccaguuaggccaggaaccaauccu

SEQ ID NO: 14358 - RNA, 4755 nt, Homo sapiens
aguucaauugcuagacuugcuuuuuguuuuuauuaucaacaaucaaguuaaugguacacucuuggaaaacuauaugcacauguagaaauauuucccuuuuaaauagaagcauucauuauaacacauauaaauaaauucaaaaaucugaaacauaacuuaugacaauuauguucacaaacauaguccaacaggaaaaaaaaagaaaucagacagacaugcaccugauaacaaaaauauauaccauugucugaaccguggccucucuaaacacaaaagauugaacccgugagaaccuuauuacaccauaaagacacgccauagagacuacaagaagagaaaaacauuauacggucacguagaggagacagucugcacugauauuaacacgauacaauugagucacagaacacaguuguagaaagacaccgaaaaaguuaaagccucaacauucaacuaauaucuagaguuugugccuuuuaaaauaaaaacaacaacaaagaaucaaaacagagaugucuaaacugcgcgaagaauggaacccucaauauacaguccauccaccauacaggaugugaguccaguucggaucauuccaacagaaaugcaaaccgagacaccccugcaaacgugugugugugccuuuuccuugcucgguagauuucucugcagccaguuacguggacugcaauugaccccaauccaaagcagugccaaaaaguucaguaaaagcugguggaagaagaaaaugccgacgggguaggcgggagcgagggggaaaaaaagaguugcgaaacaugagacacauuuugcagaguuugcagaugaaaaggcaucucauggauagggcaucuuucagggccgaacggcugcaaagauucgggguugggaguugcaacugugugggguuccgaugcgcuaauggcgggaugguguucagcgaggugggacaggcaagggggugcgagaaagucacuccggccgccgggacagucugagcaagucgucgccgcagugacccgaacccaaggacacgauaggaaggggggcuggaacggcgucccuacucuucccugaagaagagccccaagagaauccgugcuguuaggagggagcggauuuagggguucacaagaucgagccuucagcuccagcugcagcuucuccccuagccccuccuuuaauuugucuuuuuuuuccuuauguuuuuuaaaccuuucuggguuguuggcuuuuuguuuuuuaaugguuucugccuuccaacuuuuuuguuuuuauuuuuacuuuuuugucuuuuuuuucuaaacaagucacuaaguugguugaggccccccaucucuuccugucaccugcuugggccacagacacacauuccccgagacagacacaaacugacacgcagacacagcccccugagagugccccgcguccaggccgcgcugcucacaacccccgaucagcaggcggagcccuggccccgcugcgaggccccaggcaggugcgaagccagggaaguuuguuuguuuuguuuggggguugaggaaggggguaggagugggguugaaaugagggcgacgccguuuucccuuuauucuuagcgcgauuacuuuaggcccucaaugaaaaagccauggcagcagcgacgacaauagccuugggccuacccgcucgcccacucgcccgcccgggcccuggcucgcccgcugucgccgccgccgccgccgccgcaggauuccagaucagaacauacugcucuucacuaaggcggcuuuggcaccguugggucuuuggagcgaagauaggacgcuggcgaagggacccccaagcgaauccgggauggaggugauggggccggggccgggagcccagccuuguccagggcccccagccgcagccaggccuccagcugccgccgcugccgcugccgccgccgccgcugccgcggccgccgccgcugcugcugcgccgcccuugccggguucgccucccgggcccccgggccccgccgcccccggagcuccagccgggcugggcccgccgccgccgccuccauucgccccgcagcugggggugggguugggauugggaccugggcccccagugcuguccgggucagugcucuuggccucuuugcucucgucgucccuggaagagucagacuuuuugcccgaggagccguucuuggccgcggccgcugcggcugccgcugcgcgcuccugcuugcgaaacuuggcgcggcgguucuggaaccacaccuggcccaagacggaaggagagacggugaagcagggggagaaagaagaaaaugggaaagaaaagcaccgguuaggguggcccaaguucuacuucggcuuguuuuaacacccuccuccccaugcgcugugaucacccccgcgcgcacauccaccaagucuaccgcuucuuauugcugugcauuuucggagaaacuuucuuagggggagugagcacgccagggacaugaaggcuugcggcagaguuuaaaaagccgcaggucccagaaagacccgaaaagggaaggccuuauuuuggugggccucuguucagucggcuucuugagcaagccccgagcucgccauucaccccuaagccuaaguucuaaaguuaaacucuaauugguagaaggaaaagggauccucucuggguuugcuccgcugcccauccccggccuuugagccuggaagagcgugcgauggugcgcaccgcuucucggucgggggcucacccagagaggcgcuguggccaacucgugagcgcaccuguguuuaacagguuggaguaagucaugguucuugaccuucaugaagucacagacccuuugcaaaucugaugcaagucacaguuuccgggaaaaugaaccuauaugccauggggccagguuaaaagcacuugaguuaggaggcauuuuuuuggggggcgggaggggagaaggaaaaacuuauaauacgggagcaaagucugcacaccuuccaccacaggcacuuccuguccccgaaauugcaucgcucauccacgucccaaggccccccaugucucugcucgggugggaaacacuucgcaacuguaaauaaaaugccaagagcgugcgcucuaagccucucucgaacgcacagccacaccaaauccaguauuucugaucggccauggggcccuagguccuucucacucgaggcuccaggacuucgaauuucaccagccgccccucaccccacaccuccccggaccagugcggcggagcggggucgguuuccaggcgcgcguaccuggacucgcgccucugugaggucgaucuucagggccagcuccucccgaguguagaugucgggguagugagucuccgcgaagacccuuuccagcucuuugagcugggcacuggugaaaguggugcggaugcgccgcugcuugcgcuucucguugaggccgccgugguccgugaagaguuuguaaggaacuagaguaugacagaggagacagaaagugagcaaaucagccggcagcucgccggccguggagcuagaaugugaggacuccaaggucaggucauacggcagccgcuaccuacacccgcgcgagagaguugccgagagaagcugcgggaagaaaccgaggaaauuuguuaucugcggaaaccugggcucaaacuucgggcuuggcggaguccuuucuggcacaagcgccuuuggguggauugaaacagcgcgaugugacggacuugagauagugcuuucagcaggaaaaaaccagagaggaaaaaaauccaaaaacaucagucggaauaucagggagccaggaaagaaguuaccaaacagucccacuuugggaacuuuucaauucucagaaaguugacccggcucaaaaguugggggaaagagcugcaaaaaaauaauaauaaauuaaagaaauaaucauaaaaaugaccagccaaagaggugugagccgcugucgguucuuaaaaaaagagacacugccaguaaugagcuuuacucuuuguuauuuaauuauuuucuaagcuuuacgucucaucgcaaaguaaauaaauuaugccuaucauuuuggcagcuuaagauaauuuuguuggcgguucgggugugacuaggauaguguaacccuguaagugaauuaccccucccugcaaucgcuucuaacgugauaaauucuuucauuuguguaagcaaauuucguuugguaaauacuaaacacauuuccauuuucaaaugcaaucaaggcuuccuauauacgggcggaaaggcggcuuccuccgcugagaaagcugaagguccuuaccugcggcguacggacugcucugguggucccugagggugcccaggcugcaggaucccggcgugagggaagggcagccggacguggccccaaaagugguccuuaucggguuauacuggaagccacuggccuggcugcaggaacugaagucagcauaggcugaagccaggcucgagguguccaucccagccauacaggacucguaggcagaggaauugagguaagaauauuccauuuuauacauugaaaagguucuggauggcucagccaaguggaaaaaugaaauaaaagauggauauggagaagguggcuggaguggggagaugugcacagcucaacgccugccuccaaacuggccuccuuacuaccagcagagccuaguuuuaugaaaaagccuccuaugagaugccuugucugaggucucuagagcauauaguccucauaauaaacuuggcucuu

SEQ ID NO: 14359 - RNA, 1215 nt, Homo sapiens
ucaagaucaaggcccggacuuaccuuuuccaggaaaccuccccagaucccuucugauuuagguaccguccucugugcucccugugauuaaaucagccucuacacauauuacacaaucacuaugcucugauuuccguuuacuuguuucucuuuugcaaucugugucauauuccucuuuuuauccgccgugccaaguauggagccugucacauagcaggccucauaaauacuuauugaaagaauuaauaauagacguagaaccaacgggcuuaguaagccccuggagaaaggaaucaaagauguuucugaggccucuauaucaggaagugcggaaauuucaugguuugagaaugggcaggaaagaucauuugugagcuguauuuaaugcaaaaguugcucccccauccugauuucuuagcucacugggccaaucggcggaaggacagguggggcucaaauuaggagaaaaaaaccacacuucccgucaugccucugggcaccgcucccguuucccccucuuugucaccgccucuuccccacggaaaugaaaggagcacuuccggguucggcaauaaccuggagccggcggcguagguuggcucuuuagggcuucaccccgaagcuccaccuucgcucccgucuuucuggaaacaccgcuuugaucucggcggugcgggacagguaccucccggcugcugcgggugcccuggauccagucggcugcaccaggcgagcgagacccuucccugguggaggcucagaguuccggcagggugcauccggccuguguguggcgcgaggcagggaagccgguacccggguccuggccccagcgcugacguuuucucuccccuuucuucucucuucgcgguugcggcgucgcagacgcuagugugagcccccauggcagauacgaccccgaacggcccccaaggggcgggcgcugugguaagugcgagggcaggguagucuggcuugauuugcaagaguuaggaagaagcaggaagcguugcgagucccgaggcguuccagaagcucagugcauucaggaaugggauuaaugaguugggguggggaaguuggagcggggagaggggagguccugagcgaagauauggagggaacuacaaguuuguuucugaagcgacaauaggcugaccuggagcugguggcccccaccuguaugccauggaaauugggccuucuuuccucuucu

SEQ ID NO: 14360 - RNA, 16074 nt, Homo sapiens
uguaacacuaccaucggguucuugguagccccugauaaucacacacagucauauguaugcagugaaaugcacuaggagagccaaggaaacaccauaaacaaccucauagggguucaggucagguuuugcuaccaaaugaguuagggagaaacuugguuuugagagcuuucuggauuuuggaguuguagauaagggauugcagacuugcaucaugcgguuaugcuuucaagacaccugaaaacaaguuagcuugcugggugagccuaguuaacauuucacacuucaacacuggagcaugucuaucauaaaaauaauuuuuguuuaggccuaauugauaaagagcuauuuuuuagacucaauuaggcgacgacaucaguugcuuuggagacuucccuggguuuuugagacuaaagccaugacaucaggguggagagaauucuugcugugcugcuuaucacagcagggagugugcccccacaucacacuaaauccuacuuguuccuuacacaagcugcuaguaugagagacccagacugacaaugugcuggaaggaagccaggggccauagacucuuggugaaauggggggaaugaucauauucuuauauccauucaacauauuuuuugagcacuuacucuuugcuaaguauuauaaacuuucuguauagcauuuuauuguuuaggcaguguuucaugugcauugccucuuuuaauaacccuacgaggaagguagaacauauuguuauccauguuuuacuggggaagaagcaaagucuuacagaguuuaagugucccuuuaagguacagaaguagcugaccugggacaaaaacccacuucuuuacuuucuucugcgccucgaguaauagagguuugcaccuuaugaaaauaggggugaauauacuuuuuaauaaaagccauaggaauaaacuguuuaguagugauugguaucaaccaucagauagcauuuaaauagcucuggcagaagaucuccucaaggaacguguugcagcuuaaggcaguuaaucagauauuucccauugcaaagaguuuccaugugucuggggugcugugaggcaucacucagauuccccuuuuaggacugagggacuuaauucccuuaacugccaggaagguuguuggcugacgucuuucucuggaaauuaccaucagguggagagagagcauucuuguucaaggucauccccgucuccccaccccccgcccccgcccccgcccccgccccugcccccgucuuggggcagcccacgcccaaugauuggccacuacugagguauaaaagcccagccccuuuguccagacccgggacaacucugaagagccaugccugcuccagaccucccugugggguuggcugagaccguguugugguggcacugcaguccagccucucucacugccacuuccuuuccucugcuccacugguguugaaucaagaacacuccccagcacaccucugcacagaaaucaucugaguccaacuugcaaaacuaggucucagugugagguagaaaggagguuguucucaggucuuuauuuugugagaaaauacucaccuuugagaucuucuuucuuugauccuuaaaaaggaaaucccaaaaaauugaccuccuuugaaauucacuacauucuuuugcugaacgagacagucugccauuuguuauuucccuuuauuuacuaacguucacucuaguuuuaauuugucucaaaaugugaauagccaagccuacuugaaccaauuuugcaauugaaauuuguugcagaacagaaaauuacgugaggaacuugaaggacgaggcauuuguuggaacaggaaaugcagaacauuauagcagaguggaguacuuuugguaaugaugcaugggacugaaaugaugugaaagggaaaucauuuaaccauguaaauugaacaaaggagaauuccgugauaaugaccccaggcccuaguauucaggaaaagaaaauggugggcauuggaaugaggucacccugacgcauguggcauugcaucuaucaguuugcuuugguuuggcaaccugguuugauucucugccagagcauaaguugguuuucaucucaacaguccuuuugcuccuugaagggugagaaaauaggcccauuuuucaauauaccacaaaauauuuuagggugaacuauuuuagggaaggaggauuuuaacaaacaaguuggugacucaauuugauccagaguuuccagguugaagcaguugcauuugcuagagagaaggaagaggaggaagggcuguuauuguugucauuguuuuuucuaauauuuccuaccaagcaacugcuuugggauaauaacaaaaugauuuugcuauggaaaaaaugcagagaaaagaaacgggggcucuuugauuggcuaauaaugaacauaaaggacuucaugcuugcugaauggcagauugaaauucaguguguauucaugcagaucuuaugggggugguauuggauuggaccacaaauuagugcuggcauuaaugagauggaagcuguaaaaugcagaguuccaauaaccaugaucucugauaaggcccaauugaaagcacccagaccguucagacaaguucuaugugaaagcagagcaauaaacaacaaagagauauucaaaaugcgggaaaaaaauugaggauuauauaacugacuaaacugguaucagagugcuugguuaaaacauuaaugcacagcugagugacaaacauagacuugcauagaauaaugauuuuuagaaacagacacuguucggcugguugugguggcucaugccuguaaucccagcacuuugggaggccaagguggguggaucaugaggucaggaguuugagaccagccuggccaacguggugaaaccccaucucuacuaaaaaauacaaaaaguagccaggcgugguagcacgugccuguagucccagcuacucagaggcugaggcaggagaacggcuggaacccgggagacagagguugcagugagcccagaucacgccacugcacuccagccugggcgacagagcgagacuuggaaaaaagaaagaaagaaagaaacagacacuguuuagaugcuacucaaaugaucagagagaaggauuauaccucuucguuauagggaaguuagucuaaaucuggaacugcacugugacaauaccacuacuucuagcgcuaacaccaauaugccuucugugugguggguaucaugauuuaugguuuacagcaccuuuucauauguguuauccauuugauccugaugguuuuuucacauugauaguugcauacauguuugugcacccaguuagcuucugaauuccaugacugcaggaacugaagucuuauuccuuuuaugaaacacccccucuuuccauuuaauuguucaugaauucucuuaggcaauuuguuucaaacaacauugccagauggcagacauccuuuuuucagcauuucuaggauuaccuggcauauagaacaagcaccauuauggcaaaauuacauaauuauauuaaguugauaaaugaaugaauaaaauauaccacauaacauauuaacauggguggauaguauuuggauggcauuggaauucuuggauggccauagucugcaaaacucaccuucaaccacugucccuguauuccauuauccaaguaggcuaacaaggucuuggcaaguaugugugugucuuuaucaaaccacuuggcuuccuggaacuccauugguaagcuuucaggaauuccuucuucaguuuucugugaaggugaaccgaaugguuccucuccucuuagugccaccauucuuauuuuuugcucaaucuccaaccucuucuuuucuguaccucuagggaagcccugggucaugaagcagcuauugccuguccagccugcuuuuuguucaagguacacacagugaucuaaauauccuguugcuguggugcuaugggggacaagauuggugggagacuuuauuucauuuuucugauugucaccaucuugcuuuuauucuucuacacccucauuuuccauauaaccugagaguuacuucagugcccuuugggucuucaagggccuuucugggaauccuguccuuucuccuuuccuuuuuguagucuguccuugcuauuacaguuugauacauuuguguccagcacagagccuggcauacaguaagugcuuagacaauguugaaaugaaggaaacuacccugcaagagagaggcccuucuguauucauuguauaucugaggagcaguacaaccaagaaaaguuacauccacaauuuuagguugauaaaagugugcagcugagaagaugcuuagagaucaacuaagccucccccgcauucccauuguuuguauucagaagaaaauuaaguaagaggugaaucaacuuuuccaguaucuaguaguuaguggguaguuuacuaaacacuggaacucugaguuguggucagugucugucucuucacauguuuuucuuuuuuaaaaauauuuauuggccggccgcaguggcucacaccuguaaucccagcacuuugggaggccgaggcagucagaucacaagaucagaagaucgagaccauccuggcuaacacggugaaacccugucuccacuaaaaaauacaaaaaauuagccaggugugguggcgggugccuauagucccagcuacuugggaggcugaggcaggagaauggugugaacccagaagacggagcuugcagugagccaagauugcacuacuguacuccagccugggcaacagagugagacucugucucaaaaaaaaauuuauuaaauuuagagacagucuugcugugucacucaggcuggaaugcauuagcacaauuguagcucacuguaaccucaaacucuuggcucaagugauccuucugccucagucuucugaguagcuggaauuacagguaugugcuaccaugcccagcuaauuauuuaaaaaauuucuuguagagagggugucuugccauguugcccagguugguccugaaccccugacauaaaaaauucuccugccucagccucccaaagugcugggauuacaggcgugagccaccaugccaacccucauauguuuuucuuacagguaaagacaguagagaugcugcuguguacauaaucuugaucugauguccuagucuuucugccaggcauggcauguguaucuucuuauuuacauugcuugaugaugacuucugucucuccaugcugagaauuuaagagauaucauugcgggagaggcuggaagucuuccugaacugguugggacagaaucauagaaucuaaaggccagggagaguuuacagcuuccugaggccagucaugcucugaaguuuaaaucuucaccuacaaaaaauggucagccagacucuguuagaaccuucauggccucugucguuggguaguguugacacuuggguuuugacuggaacccauuugagguuccaaguccaccaccguggagauacucagaacaacugaauuccuggccuccaugccaguuccaauuuagguuuucaugauguuucuccuucuccguuaacaagucuuuuaacccguguuucucagucuuuugaacaccaaggcagacauugaaaaugaugauauuugcauggcgcccugggguaaaccagaggggaguuaaggaugucugucuggggcuuggcgaaaauuauuacacuucucuuuauaguguauaauuauaagaaaauaaaauacaaaauauuaugaaagauguuaaauauugaauuuguauuaaacuuccaaauaaaaucuuuucaaauguuugaaagcaaaauuuagcuugcuuccaugaacauaacuuuuaauaccagguuuuaugcuugaaauggcugcaugaaauuccugauccagacuuguuaaugaagauuuauucaaauucuugauagccaugauggucaaggaacuaugauuaaaaauaacauuaccauuuuuacaacuuuucaaaaauguguaguaguugaaguuauaguuaaagacucuaaucacucuuucuuuacuuucauugacaaauguaauguugaaauuucuaguguuuauaagaaaggauuucuaacccaacugaacuuuuuaauauuaaguaguccaaggccaagcacgguagcucaugucuauaaucccagcacuuuggaaggcugaggugggcggaucauuugagcucaagauuugagaccagcuuaggcaacauggcaaaaccucaucuguacaaaaaaaccaaaaaaacaaaaauuaguugggcauggugaugcggcgccuguagucccaagguacucagaaggcugagguggaaagauugcuggaguccagaaggcgaaguguguuaguccauuuucacacuacugauaaagacauacccaagacuuggaagaaaaauagguuuaauggacucacaguucuacguggcuggggaggacucacaaucauggcugaaggugaaaggugcuucuuacauggcagcagcaagagagaaugaggcagaagcgaaagcagaaaccccuuauaaacccaucagaucuugugagacuuauucacuaccacaaggacaguauggaagaaacugcccccgugauucaauuaugucccaccuggucacucccacaagaugugagaauuaugggaguacaauucaagaugagauuugaguggggacacagagccaaaccauuucacagagguugcugugagcugagauggcaccacuguacuccagucugggugacagaaugagacccuuucugaaaagaaaagagaagagaagagcagagcaagggaggggaggggagaggaggggaggggaguucccaaauauguugaagcucuguuuugcagaaugcgugcauguuguuaaagcagccguauggaugccuucuguauggcugcaucagccacauaugucagaagcagauuuacugugcauugguuaccucuuuagcccguugcaucuugggcagcaacuucuacuacuugcacaagucuagugagacagaacacuuacacaaguuaagcaaagcaacuucauuuauuuauuuauuuuagagagagugucuugcucuguagcccagauuggagugcaguagcacaauuguagcucacuguggccuugaacuacuaggcccaagcaauccuccugccucagcuugcugaguagcugggauuacaggcaugagcuacugggcccacuaugcaaagcaacuuuaucacuuacaguuaggcagcaagauccuaagccuagcauucacggugaaccagucccccaaggcuuaggaaaucugcagaggauggauggaaucuugucugcauggucucuacaugacauuacagcugagggacuccaaaagcagucgauucuggguuuuauaccuggagacaauagaucuugcucagcuaaaauuuugcaggaaacccuauuuuaguggggacaugaacagaacccaggcuguucuggacaguuacaccuuaucucaagauguuguguuccccgcauauuuugcaguuauucugaaaaccaaaggccagaaaguggggaaagagcuggguuucuaaggggacuuguccugcaacauggagagagauauuugauauaugugaagaaagaggcucugggcagcaccagaaucacauuucugcccaguuuccuuuccccaccugcacccuccaaccagcaacaccuaaggugacacacugugcucuuugggccccuggaauaugaacuauuucaguaacagcuccuugaccccacuuucaagaugggcaggagugucccaugcugcuguuugugaagguuuguguuucagaugguagagcaucuucuuguccauguucaguacaugcaaguggagcagguguuuuccccuuggagaaccaugaagggcauccucagaccucacuaugcuuggauaauguuuuguagaaccccuacuaaggcuaccugggccaaagcuggccggcauggggucuuugguugucccagguccuacugaagggcugagguauccugcagcuccaggcaaagcucuuaacaauucagagcacaccaggaugccaaggcacacggaagaucugcucuuagccauugcuuccaugaugcagauucaaguuuuuucaucaucacugucuuccucugauggucaugucugauuaauauauaccccuuccaaugcauaauguucauaccugaaccccaggugcagccuaaucagcaaaggagacucccaggaauacucaccucucuugacauagauauuauauauauauauauauauuuuuuauauaucuauauauauauauauauuuuuauauaucuauauauauauauuuuuuuuuugaggcgcaguuuugcucuuuuugcccaggcuggagugcaauggcgugaccucagcucaccacaaccucugcuuccuggguucaagugauucuccugccucagccucccuaguagcugggauugcaggcaugcacuaccacgccuggcuaauuuuuuauuuuuaguagaggugggguuucuccauguuggucaggcuggucucaaacucccaaucucaggugaucugcccaccucagccucccaaagugcugggauuacaguagugagccacugcacccagccgacauagauauuguacuucuaaggugaauuucuggcaucuacacaauguugcugacuuguauuacacuucuugaauuuuauagacuuuaaguggauaaacuugucugcaaacaaagcuucauccggcuuguugccauauucugaugggcaagaacgcuuucaguaaggaccccccauguugaaugaauaaaugacacuuuuauucccagaauaaacuuaaugaauauacuuugagcagcacuggacaacgcugaccauuccauucuuuauuaaucuuucauuuccuuuggcuguccugacaccaaccucuucugguucucauccuaccuuucuaagauuccuucuaaaccuuuuuccuuauucuuugccuaccuguugaauauugacguuuucuaucucugcuuuugugauuuuuucaucugcacccucuuccccccaugccugccauuucuacuuccauuuguauauggcgaauuccugaaacugucucuugccaaaaacucuguucugaguuccagacucauuuauccagcuguucauuuuucccuggaggucucacaagccccucaacucacccuaucuaaaauugaacucaugauauuccaccaacccaaaaauauuucaccucaaaucauuucuaaauugauaaaagacacugccaucuacaagucacaagacagggaaaucauccuccauuccuuucucucccucgccucuccacauccagucagccacuagggauauugacccugccuccuuuaugucuuucaaaccccuucuccucucuugcccuuggucucugaguucaguaagguaaugcuugcaagguguuggcccugugccuggcacaugguaccuacagcauacaugacagcuguuccugcuauuagcaguugcuccaaacccuuguuaccauucaccuauacugucaggaauugucuccuguucucaugcuuccagucguaucccccauuaaacccauaccuuaaauuccuucaaucacuauuaauuuuucucauagcauauaucuuaugaucucuguucccugcuuacaaacccuucaguggcucccuauggcccauugauugaguuucuaugacuucuguuacccaucaccuuuccugaccucagauuuuccaggauggcugaccagcugcucauuugugcuacugcuacguguacauuaucauaguuaauccaggucuccaaucaauaagguagaaacugcugacagcauuuuaaauggaaguuuuuccagcauugaaaacaaaauaaaauuguaagguccagccuccagaaauccugucauaguaucauuuuuuuuuuccagauugcuucauaauuauuucuuuaaaugucugccuucccauuaauaugauguguggggaaaggccugggucagagucuuugucuccacagugccuggcauggugccugauacuaaguguugauugagcaccauuugugugccaaggacugcucuaggguauguggaaacuauaagggacaaaauuccugcucuuccugagggaagccugugcacuacccaucccuuuccagucucuuuccuacccagaggcugauguuauucacugcauuuucugugauuaguaacauaaagggggaaaaaucauucagagagaaaauaugaacugucagaugagaaugaaauuauaagugguaagaggagaauuaaauuaagagcaguaagcaucauggauuuauaaaaacaagucaugucagacaaacuuaauugcuuuuccugauagaauuaccaaauuaagggauggcgggauacaauauccugagagcaguuuccuucaacgaccagguaaugaauauuauuuuugaaguuagcagagccuuuugaaauagaaucaguugaaauuguaccaaaugaauucagauugacuuugaugugagucugguucacugacuugacaacagauuggagaggagaaaaacuaaggcaacuacaaacaauauggugcugagcuucaagacacugccuagcagaagcguggggauccuuauucagauggauuuaucacaaucauuauuggagucaaagaaugacuuuuguggcauuuaaaagacaucaagagaaaaucacaguacuugggggaagucacugcauggagcacagaaaugagaugcuucuacacuaucauuacaacaguguggcccuuggagugauaauaaccaauaucuugcauagugcuuuaaaccucugcuacccaggguauaagucugcagacagcaggagcaugggggagcaucuaggagcuucuuagaaaugcagagucucaggccucaccccagugaaucugaguccgcauuguaacaaaaucccagaugauuuggaugcacguuaaaguuugagaugcauugcuggguuuauuuuauauuauccuauacaauuugauuuuuagaucuuucucagaggggcgagacuuuguguuuaccuaaaaaaucagggauucagccccagucuuagcaauuccauuguuuacucuuuccaccuuccuuaaaaucaagcauaugaagcugaugaaguuggucccuuggggaaguuacuuaaccucagugggccacacuguguuuauuuguaaacaggagcuaacaaccugggcaccauuacaguguuuuuacacgccacauguguauauaauacuuucgcaucuucuaacaucacugaguauauuauuauucccauugcacacauauggacacugacauuuggaguguuuauguaauuggccuaaauucauauuuuauuaaacagcagauccaggauuuaaaccuaggucuguccgauucccaaagccauguuauuucauauacaguaugaaaagggcuguaucauagcuaugagugacagagauuucagaagcuggggccaagagagggguuuaguuaggaaauauuuguugaggaccuaugacguuguaagaaccccugagaauaugcauuagggaauaaaacagaacugggcccugcuuuguuaaguuuauaaucuaauggagauggaaaauuuauguguguguguauguguguauuuugaggcaggagauauugcuugcaagcuuuuuuguugggauaaugcagacauuaaggaugauggaaaauugcuguuaacucuaagcaacuggauaauuuuuagaagugagggcauggaaacagauacaaauauauaacaugcuauugaacuguuaaugacaaacuuuuagccaaccacuuugccucuuuaaaauuucuuccaaccuuauuuuaaaaaaaaacuuauagggcccuuagagaauucuauuauucccuguaugccaauaagagcuuuggaaagaaaagguaaagcaagagauuaaaaugccaucucuuuuaucacugaccuuggccuaguaucuaggucccacucucuuagguauucagauugaauuaaaagaaagauacuugucuucugugugagguuggucuccagaaaacuucuuggugacaaguauuacagaaauucaagagcccagagaguucuuaguggagagaugguacauugaaaaaucugaaacugaccaggcacaguggcucacuccuguaaucccagcacuuuaggaggccagguggguggaucacuugaggccaggaguucaagaccgaccugagcaacauggcaaaacccccaucucuacaaaaaauacaaaaaacuagcugaacaugguggugcaugccuguagucccagcuacucagaaggcggagguggcaggaucaccugagcccugggaggucaaggcuaccauaagcugucauugcaccauuacacuucagccuggguggacagagcaagacccugucucaaaagaaaaagaaaagaaaaauccgaaacgaagcaucgccccaaagcgucucuucuaguaaacucuccauugucccuccaguuuuagccuaaaugucccuuccucaaagaaggcuuuucugauccagaucugguuaggagaaucagaaucggugucugcuaaauguuccugcgcagcguucguuuuuccuucaaagcccucauccaauuguaauggguuuuuuauaucccucugucucuccuaacucucggcucugugaggguagagccugugucucuuguaauaaaugcuguauccccaggaucuagcagagugcgaggcauauaguaggugcuuagaguguuacgucaaugauucaauagucaugcuauucacauauaaacaucagauuuuuuuuuuuuuuuuuuuuuuuuuuuuuuuuuuuuuugagacagagucuuacucugucgcucaggcuggagagcaauggugcagucucggcucacuuccaccucccggauucaagagauucuccugccucagccucccgaguagcugggauuacaggcaccugccaccacgccugguuaauuuuuuuuugaaacggagucuuguucugucgccaaggcuggagggcaguggcgcaaucucugcucacugcaagcuccaccuccuggguucacaccauucuccugccucagccuccugaguagcugggacuacaggcaaccgcaaccacgcccagcuaauuuuuuguauuuuuaguagagacgggguuucaccauguuagccaggaugguuucgaucuccugacuucgugauccacucgccucagccucccagagugcugggauuacaggugugagccacugcgcccagccaauuuuuaaaauuuuuaguagagaugggguuucaccauguuggccaggcuggucucgaacuccugaccucaagugauccacccaccucagucucccaaagugcugggauuaaaggcgugagccacgugcccggcccaacaucugauauuuuuuaaaguacauuuuuacccauuuuaaauguggugcgauaaaucucuuuuauuauuauuauuuuuuguaugugguaaaacauacauaacauaaaauuuaccaucuucacuauuuuaaagcauacaguuuggugauacugaguacacucacauuguugugcaaccaucacuaccauucacccauagaacuuuuuucauuuuccaaaacugacacucuguacguauuacaaaauaacuccccauuuccuucuccucccagccccuggcaaccaucauucuacuuucuuucugucucuaugaauuugaauacucuagguaccgcauguaaguggaaucauacaguauuuuuaauuuucuuuuccuuuuuuuuuuuuuuuugagauggagucuugcucugucacccaggcuggaguccaguggcgccaucucaguucacugcaaccucugccuccuggguucaagcgauucucgugccucagccuccuccugaguugcugggauuacaggcacccaccaccacgcccagcuaauuuuuuguauuuuuuaguagagacgggguuuccucaaguuggccaggcuggucuugaacucuugaccucaagugauccacucaccucggccucgcaaaguucugggauuacagguaccuggccacaguguuuuuucuuuaaaggccuuuuaucuuucugaauugguaagggacacaaacuuauguggucuuguuugguagagugagguucuuaagacucugauucaaagagaacucugguuauucuuggccuauuuguauuuacagaaucagagauuaauagaugaggaagagauguaacagaucaucuacuucagacuuuuaagucccaaguauaagauuuauugcuagacugaaauucaaauggugcaggaauggugaacccaguauuucccccugucugucaacacacagaaugugguaauccaaggcaaugcgauuaagacagugguucaccuaaacauuacuuauuuucacaucuuaucaaggcugccaguguaguauuggagggaaagcgcagaaucaacccaagacacacaaauaagaaauaaaaacaggaugaauguggcagacauccucggguggccauuuaauaccugaaucugggucacagugaagggacuggcucuagucucugaccuaacaagccuggucaauuuacaugauuucugucucugcuuuagcuggaagauacucaccaaacaaacaaacaaugaaucuugaugguuuggaggcaacagagagggagaggccuugcaaaaauucagauccgcacaugcaacaucucuuggcaggucagugaauuggcaacuaacagcuguacaguaagauuucugagacaaauauucagauuacuaucaauacgacucaaaugauccuccuguguguugcagggaggaggagggggagagguagaaguguucaugguggcuuagcaacauggccaggggcuaaaaugggagucuccuuugaggcuuuaagcaucaccagauucugaggagcaugcagagcaaagaacuaagaccccaagucuugcaaccuaguuugggacaugggaaggggugcaaaauuuaaggagggaugcagaucauuauuggaaccaguaauuugaaaaguaagggauuagcaagcagcaguucaagcauaagcaggcagaggucugggacaagagccaggccugggguguuugugaccauggccuagguaugggccauaccaacaggcuuaaaggacuaggcauaggaagacauacuuugugcaaauggcuaaacugauugcauuuauuugacuauauagauuuguucauguagacuauguagauuuaacuguguagauuugucacgaucuucuuucccuaaaaccugcuuccuccauaucuuagauguuggccaaaacuuuguggccaggcugguauccugauuacagaucaaccaccuggaugccaaacaguguaccugugggaacuuuugcaagaugugcucucuacucccaaugauuuggccuggaauuagaaaugugaacuccacuuugagaauuuugcaggugucugggaagcguugggucccguacaaaaccauucucauaucuucaacacagauuuaucuuuuacuuaugcagagaugauaaugggcugccauucgcuccuucaacuuccuuugacuauugaaagaaauagaucuacuauagaguuuguugagaaucuuuguaguccaaguucaaguaaaaacacauuauaucacggauaaaaugguuucagaaaucaguggacaaguuuauguuaguuuuugcaaccucaggucccacugccaggccagguaaugcuuuccuucuuggauuccauguugugugcuucagucugaauaacauuaaaaauauuucucuuagcaggaugcggugggguuguuuucuuuuuuaauuucaaauaacaccacuccuugaacugggaacaaacaauucacuugcagcucggcucugcuuuuauuuguaauuuucacauaaaucaacuuauaugaaaauguauucauaauuuga

SEQ ID NO: 14361 - RNA, 4701 nt, Homo sapiens
aaaagaacuucugggcagagacaaaggcagcuaaggacagcugaagauggaaauaguauaugcacaucaugacuggucaguucaucaaccagauggaacuaaguacuucgauggguggcacugaugcuagaagggcauuaaauuaaaguugauaagucugggagaaaagccacagggaaggggaaagaaaagaugagagaagaaauggaaaaggaacagacaggagugugcacggugcaucaggggacagaaucaggcuggguucacacuguaguucagauacucuggagcuguuugaccuucagaaagugugucuucacuuugugucugugaaaugucuaaaaggauuuaccuuacaguguggcugugaacauuaaaugagugacuacaugaaaagugccucuaacagugacuggcccuucaucaauggggcccuauuauagcugaguggcaaccauucguuuucugaugauguaggaugacuggguuuucuauuuaauaguuuuuuuaaauuuuuuuuaacaaaauggguauuauuuaugcuaauauugcuguuaagaagaggcaagaggcuaggauaugaagugagauggaauuucucuaaauaggguugagggagucagguggguguugagaagggggaauuauaacucugggcacuuuuuuaaagagaugggagcacuuucauaucuggcuagcuuauagaaauuguucagggcccugggaaaagcggggaaauggcagauggacugaaugcaaggaggauggcuacaagacaaaaagaguuaucaccugagaguacggaacagcaaugggccccaaaaagaagguacugaauuccucaggaugcuagcagaaaccaaugggauugaaaagaaugaccuggguuaaauucucugggucacuggcuauuucuuugcuuacuacacagauuuggaacaugaguuuagcgaaaacaaggaguaucuggcauuaaacauagcgccuggagaacucaguagguacacaauaaauguugguucccuucccuccccaacuuagggagcaaggauuuucuuucaacacauugagagaaauggcucugucuuugcugcaaagaugacccaagaauguaaguuggaaaugacuauaaaguccugauugugugaaucugcaugaagcugaauauagaagcaugagaccuguaccuguaaguugcugaauuuguauaauuugcaccccgagauccuguuaacuagagcaaaauaucugugcccuuuuaagauaguucucugaaguggacgcaguaaagagaggcauacaagagaaacucuuaggaauuggaagacaaacucagaggcauagaauguagugcugcuuaaguaucacaguggcugggagcucaucugccuggccugggaaggauuaguuaaaugagaccagcauccuguucugcugcugaaaaucuucauguguuggaaaucacaagauguuggaaagauguacuuaugugagcugaaagcugcuucucuauaaccucuauuucacuguuucucauuuguuugucuaaaacacggaagcaagcaaaaaauguuauuugccaaucacuuaacacucauuuauggggcacuaggggccccgcaccauuaggucugagugaaugaggaaagaaaugaagauacagucaucgcucgagaagcaguuuaagcauucugaaaugguuacuguggcacugauguggaagaaggacugaggaagaacaagaccgcugcaaugucuauagagaggaaauggcagagagaagaacauggaggagguagugcugccaguaaaacagaauacagagauuuccuuuccuuuacaaaucccugaaauaccugcgaggacugagggucccuuuagacuucuaauuuccagaucaaauaccaugcauuccucuuagcaacuauuaucagagaaggagcacagggcaacguuuaagguagcagaccuggggaucagacaucgaaguugaaaccuuaucucugccacuaugagucagauagugaugucagauaagguuccuaacuucucugugccucaauuuccacaucuguaaaguggugaucauggcaacccauuuggugugaggaucaugugaguuaccgacaagcacucucuccugauguucauggcaaacacaacggagucugcccugacuucuccucugucuccucacauccaaccuguccaucaauccuauuggcucugcccucaaacuguauucagaauccaaccacuucuuaccacugcugcccuccgggccccacacaccaugaucucucaccuguuuuacuggaauagccuccuaagcggcuugcaauacaacagucagaguccuacagcgaaaauauaaaucaggucaugacacuucccucucaagcuccuccaguuuuuuuuuuuuuuuuuuuuuaaucugacuaugaguaaaugccacaaggcuuuaugggaaacacaacugaaaauauggcucuugguuccccuuaccugcuguacuuuucucuaggcacuuaaacauuuccauauuucauuacucauuguauuuauggucugcccccuugcacuagaaaagugagcuaugggagggcauggguuucugucuguuucauucaggacugaauccacagugccuagaauagcgucagacacacagaagaaucucaauagcuguuggauugauugauugaaaaaaaauauauauauaguccuuacagaacuaccugggauaaaguaagcguucaauauucaugagguauuauugguguuauucuucccagaucuugguugccuuuuuauagagcuccucuauucagucaacgucccuuuagaaccacacagugucucacucuccaaaauaccuccugaaccagcacagagcagaacagggcugcuauucucugucugcuccaccucuacaagguaccauccuggagacccuuauuaagcuuuugggcaaccaaaacacacuuacguacauaauuaauuauuuaguguggaaggaauugcugccaaaucaacacaggaaaggacugggauccuggggauaugaucuuuggauuagauacuuaugacccuguuagugguggugacagaaauuaccuacacccugcaucaggaauccugcagaacggccucaaguucucggggcugcucugggccguguuucauuacguggauaucauaaacaugucaaggcagcagaugcuaacauuuaacuuaugcuggcauuacuuacaauauauuacuauaugcaauagauaauauauguaauguacaauauauuacaauaauauauugcuaugaaaguuaacaguugaauaagcuuuaagacaguuggccaauuauguauaugccuacagauauaaauauuggcacauacaugaaucuuucacauuuauauauguauguauauauauguauauauuuggcuauauucuugauugagauaagaauuuuaagauuagaaaaauauagaccuaagaguagucacuacuuguugaaauuaacugaguuguaauguaacauaacuagugacccuauaucuauaauaaaaauguuagaaauugaauacagcuacaacauuuuuugggacuuauuagccuaaugcccaagaaacaguaaauggagaugauuuaccucggagaaucugaguggcauucucacuauauccuuauauuggcauuauugugaggcucauuuacacgcacacacacccacaucccaccacacccacauccauacccacaccaaaaugcuuugggagcacuaaagugcuacauaaacuuaaaguauucuucuuuuguuugaauaaacagacauuuuggacgugcuagucaagccuacccuacagcugaauuaauccauuuucauauuuucaguggagcaccagcuauuuaaacacuauauucagaguagcaguaguaauaaaacaacaagaaaagaaccucuguuagcauucccacuguaucugaagugaacagaaaugugauggaguacugacauucauuucacuuugaauuaaacacagcaucaccaugagucucaagagacgauauuaaguuuuguguuuggguaauacugggaauucuacaggcaaggguagaauuauauuuggugggcaaaaagccagucaaacuucacacuuguccuagaaguagguggucaaaaccucaguucuugucaucaaaccuauuggccacacuugcuuaaaccaucugggucucaaaucuuuuguguuauucauuuugaaaauaaaauaaacauuaagaaaugagauaaaggaaggcaaagacuuaugucuaaugaaaaagauaucaaguuaaaaucgaccuaagggaaaggcagguccaaugagacagagcacaucagauaaaaacaaagaauagaauuaaauuuuccaaaugucauaaucagauacauacacaugcacauacuuuuuuuccuucaguuguauuccuuuauuucaggaaaaggacucagaaaccaagguaaagaggagacccacucacggcauucucccuguucugcuuagaauacaugcuguuaaaauuucuaguuuucacaauauauguuucaaaagaagccuucacuuuuuguagaaggaaguauauacuccuugauaugucugguuuugcuguaauaguauauaaugccucucucuaauaaauuuaaccacaaauuuuu

SEQ ID NO: 14362 - RNA, 1899 nt, Homo sapiens
uccgaggugcggugcaggcugagccacugccugagccgcugcuccacguccugggccuuagcuucccgcugcagaccugccggccgauucuucgcugcccucccggucucaugaagccgcuggucguguuuguccacggcggucccggcgcgcuggcauccuugagaaagauggcuacacacaccuuucugcaggagaguuacuucaugaugaaaggaagagcccagauucacaguauggugaacucacugaaaauuacauuaaagaaggaaacaugggaccaguggagauaaccaucaguuuauuaaagagggaaauggaucagacaauggcugucagugcucaaaagaguacaucuuugaucgauggauggguuuccaagaaaucaagacaaccuucaagguuggaacaacggaccggacgcaguggcucacgccuguaaucccagcacuuugggaggccaagggggguggaucaccucaggucaggaguucaccaccagccuagccaacauggugaaaccccgucucuacuaaaaauacaaaaaauuagccaggcgugguggggcgcgccuguaaucccaacuacucgggaggcugaggcaggagaaucucuugaacccgggagguggucguugcagcaagccaagaucaugccacugcacuccagccuggguaacaagagcgaggcuccgucucaaaaaaaaaaaaaaaaaaagaaaaaagaaaagaaaagaaaagaaaaaaaagaaaaaaaaagguugaaugggaaggcagauagauguaucuuucauucugugugugugugguuuuuuaacuguaauaauaagaucuguauugaaugauguccugagagaggaaagaguagcgguaggagugaugacaacagagagagcuugagaaagagaauugagacccaucuucagucaacaaagccaauuauugacuuauauaaagaaaugggggaaagucaagaaaauaaauguuucccaaucuguugauuaaguuuuugaaguugugaagauuuuugacaggaaaacuaauucgaaaccugaaagcauccuugaaaucuugcuugaauacugcuuugauagcugcuaucgcgaccccuuuuuaaggcaauuuuaaucuuucaaacuacaucucaccuaguggcuggaaaguauagguaagacaaauuaaguuuuuuauguacuuuuuuuucgucacagaagagaguuaauuaagagacauaacuucaucuuaguuauggugcucacuaaacaaagaagcguaucaagcuauuuuuuuuuauucaaaaagacuauuccuuucauaguuugugccuucuaugagcaaaacuuuuucguauguguguaugucccuuuaguaauuacaacauguuaggauuuagggauacccacuuccuccuuuucuugcaaguuuuaaauuuccaaccuuaagugaauuuguggaccagauuucaaaggaacuuuuuguggagucaguucuugcacaauguguuuaguaaacaaacucaaaguggauucuuagcaguguuuuaauauauaucaaauaacuaacaauuuccuauagaaaaguaagaaaacauaggcuuuguuuuacuacaacuugaacaauguuguaugacagggcauauucuuugcuuccaagguuuggguuggaagcacuagagguucagagccuggcagaacugucagcuuuauucugacauaaucuaaggguauggggcaaggaucacaucuaauacuuguguuccucauccucuauuauaugguguuauucaugauucaacugaucuuaacaaaauuccuagcaguggaaccuugaaaugcaugugacuagauuuaugcuaaaaugauucaguuagcauuuuaguaacacuucaaaugauuuuuug

SEQ ID NO: 14363 - RNA, 26549 nt, Homo sapiens
cuuccugcgccuuuaucugcauccggguccgugggauucgcgcuccacuggucagcuggggucgcucucgggugguuggguguugcuuguucccgcuguuccagcaucgaagaaccauugggucugccgguaaguuuagcggggggugcggcgggggcgccaagaaggggacucgggucgggggacccgacggcaacuucgcccugugcggccuuugugcugagacugggacgccgggccggggcggaaugggugcucaggaaccucgaggcugggggcgcguggggucucccguauugccacucgcggaccugguuguccucuccggauuugugccuacgggagaaggcgucccugcccucuccucucucgcggcuucuucuugacaccucucucuacacucguuaaaaauuccuaacagucauccucauuugcauucgcuguccuuugccaagugagggccaggcaaacgcgcagcugaggggaaucugcagcccccgccucccgggcaggaaccacagccuucuuugcugucucucgucccuccucgggucggucccacacgcgcggccaggccacccuuacgcuuucaggacaggucagguugaguagggaaaagcucagagcagagguucugcaaguguagauucuggucuuggccccgccauuaacuagcuguguaacuucacggguguagaaguugucauccaccauugaaguuuugcgauuuauauucagcagcccuuuuuccuagcgaugcacauccaaaaugaaucagcaccugaaggaagacgagggaaaggguggugcucuguuguuuuuugaugcugucuugugaugccagagaauugcauaaggcgacaauaguuuggaucucugaggauuggcaaaaacuggaaaagucaaaucuuaaaaacuuaaauguggugaagaaauucuucuuugcucugggugaagggauucauuugggacuuuuggaggugacucugcgcccuccagagaguuuaagaaaacaaaaaguugccuguaccuuggucugagagacuugcuuaaacuucguuucagugagaugugugguguucuuaacaaauuucaccugauuaugaauauccccugugauaauuugcaaaagcagagauuccuuggacuucauuucagaucuuuugaaacacugugucuagggagagggaccugagaaucuguauuuuuaacuagcaucguaagugauucucaaccgguaagacaucuuuggcuaaugucucuuugagucagaaacacuuaguuuuaaagccagcuccccgggccacuuuuuaacgucagcaauaaacuucucguaguugcaguuuucuguauaugaagagugagaauaaugcuuucaaccucagagacaagugauucuaagcccuuugacaauagaguuaaucauuuuugugucuacagaaccuagcauagugcuuagaauauaauaggucuucaaacguguguugaacugagaaaaauaacaugcccaggaugcagaagacauuggaaagcucuaaugcuucucguccuccuuaccuuauuuuuuuuccguuuuauuaacaaucagcuggccauauauucuuguuagaaguaaauauaucuuuugauguucauuacagccaauaauucuuucugauucuuugguuuaacucuaaaauuguuuuugacauuagauuauggauuauauuuaaguggaggcugaguccaguuguuggacugaauuuaugacuuacuauguaauuuauuuucuguaaauaaauaauuguuaucgggccagaauucuagaucauggugaccaugauuuuuuguuguugugucagaauucgaaacuguuaccuucuuaaagacauuuagauuccauacauuuauuuuaauaagaccuuuuaaucucauuaauuuagaaaauuugacuuauuacucuauguaaaguguguggguacaaaacucaggaaugcugaaaccauguuauaaaaagcuugguauuggugacugauccauuuaauauaaaaauaagaauuaaaaaucuaagaauuaugggaauuauuacagaauguucaguaaauguuauaaggggacguuuauaaacuauugaugguaaugucaguucaacuucuguagaaaaaaguaugaagauuucucaaagaacugaaaauagaacuaccauuugaucaggcaaucucacuacuggguaucuacccgaaggaaaauaauucauuauaucaaaaagauacccgcauucauuuuuaucucagcacuauucacagugaggcaguagaauagggucuggaggcagaggacuuaaggccaauucgugcugacuuccuaaagcuaaaucaaaggaaaacaccaaggucugggggcaggaaaucuaaggccaauuugugcugacuuccuaaaagagaaaacaccugcgucugggggcagguaaccuaaagccaguuaaccaauuaacgcaaacuuccuaaagcuagaccaaaaggaaaaaacccaucuccccaugcccaaguagcaaaggaccaaaggcuacucucccuacgaucgacugccuuccaccaccucucagauggaaggggaaagugccuuggauuguccguggacuaagcaugggccaucccuucaucugcauagggagccaauucaccucagccuuuaauuagccacggaccaaauccuucaugcagauaagggguaaccgauaagggaccucaaaaggaguauuaaaacccagaaaacuuuguaaccggacccuugagccgcuugcuugggcccacucccaccccauggggugcuuucuugcuucaguaucccugcuuucgcugcuucauuccuguguuucguuccuuuugugcaguucuuuguucaaaaugccaaggaacuggacaccucacacucaugaccuuccuuccaauaacaacaguagcaaagauaagaaaucaaccugaguguccaucagugaaugauuggauaaagaaaaugugguauauauauacaccgcgaaauucagccauugaaaaugaaaucauguccuuugcaguaacuggaggccaucaucuuaagugaaacaacucccaaauagaaagaaaaauaccacauguucucacuuacaagugggaguuaaauaauguguacacguggugauggaaaguagacugauauuagaggcuuagaaggguuggggaguaggaguggguagaugaugagaaauugcuaggaucauuguacauuauucaggugauagauacaccaaaaccccagaccuagucacuaaauaauauauccauguaacaaaauugcauuuguaccccuuaaauuuauaccauuuuuuuaaaaaaaaggaaaacaauaugucuuacagauaacagaagcugugaguuacuguaagaaugcugauuuccacaucuuucaugguauaagucaaccuacauuguguaaaauggaauuauguagcuuuuaagugacuccgaucucuuaauauacguauaauaauuuuucuuaauuuuagaauaauuuuugaggaacuaaaauugcuuuuugucaagaaauuucuccuccagagaugagcaguuuauuuaguucacuuuguuuucuuuuucuucuguugaauucucuuauuaaaaauaacaugucuagugugauccuauuguuauaauuugaauucugaccuuguugcuuacuaccugugugaccuuagucaaauuaugugaguccauuuccucaucuauaacugggcauuuuauuuacuucacaagaugguuguaaggauuaaaauauguacacuugucccuaguaucuguuggggauugauucuaggaucccccuucagauaccaaaauccacagaugcuuaagucccucauauuguaugacauaguacuugcauaucaccugcacccauacucccauauacuuuaucucuagauuacuuauaauaccuaauacaauguaaauacuguguaaauaguuguuauacuguauuguuuagggaauaaugacaaaaaaaagucuguaccuguuuaauacagaugcaaacaucuuuuuccccuaaauauuuucaguucuugguuggcugaauccucgaauauggaauccacagaaggcuaacuauacuuaaaugaccuagcccacugccuuaaacucagugucugcucaaaagagaacagcuauuacuauuuuuuaaauucagauuguauaugugcauguccuucuucaguaauguacuuuuaaaaaucaucaguauauucuguuucagugcucuauuuauuauuuacaucuuuuaaaaaguuacugaauuuaaauuaucuguuuauuauguaaaguguucuacaauggacuuuucucagguuugaacuuguucuggaagcugugcgucaccguaaugaggcuuguaauucuugauaacuaugacuuggcuagugaaugggcagccaaauacaucuguaaucgcaucauucaguucaaaccuggacaggacagauauuuuacacuggguuuaccaacagguaauuaacuacuuuuuccauuuuauauucugauauuaucuaaauuuaauucugauggaauugaaggguuucuuuuaagauacuuuccccauucauuuauuggcaugucacuaauugaacaucauaguauaaaaggccagaaaaaugcauauauauaaaaucuacuaucuacaauguguuacuaguucuugugccaaaauuuagucucaccugucacuccaaaaugcaauaggaaauauuguaacuuaaguguuguucauauuuuuuguacauuuuucuaguaguccuuuguuuuggggaacauugcuuuuaccauucauaccaguuuuuaguugauuggcuuucuuauuaaucauuaagagguaccuaagguauguacuguugccucuuaauuuaacuucaccugccuuauaaauccuuauuaauauagaaguuauaaauuauauauuauauaauguuuauuagccuuuuacuauuugcuucuucuauuauagauguauuacaagugaaaaauauaucuucaucacaguaauuacauauuuuauugaauucaguuuuccauuaagcauucucuuaaaaaacgacuagguggugucauuugaucuuauggcacuuuauuugacccaugauuuucacagaguguuagaccuggaacuaaaguugcuccuuauugacuacaaggcauuuguucuauaccccugagccuugguuuccuuaccuauaagaaagauaaggauaauaacuuaagaugcuguuuugagauucagcuaagauaguguauguguaagucccuuguauacuguagucuauaaauuuauaguucccguguguuuuauuuaaacagacuguuuucuccagcuccuccccucauacaugguaauuacauaaaaacuacaauuguaauuuuuucccacuugaguaauuuccgugaaugguacucuucaaguugauuguuuuguuuugcuuuuucucuuuugguccagggcaguagaucuuggugagaauggcaaaaggguuuuuuuuuuuucacuggacacaccaguacuacacccccagcacccucaguucugauaugugaccccuugggguugaacgugguuucuguauaguuucuauacuguuacccuucauuacacucagccuaccucuguuaauaacauuguguuaauuaugaugcagaaaaaaacaguaauuugaguggggacagaaagacuuagucuuaaaugucagcagugcuaaacaucuuuuuguguauuuagaucuacaacguuugcuuuauuuuggguaguauaacugcuaguaauauaccugccaagugaggaucucuggaaaaccuuguugaaauuuuccauuacucuccuucauugaccaucgacaaguuaauuauguccucuucccccacugcuucugagacuugaacauacaugucgguaauugcuuguaccaggcugcauuguaauuaucucccuaucaagcgcaauuucugggcaauaucuguucaauuuuauauuuacucacgugaccuuaaugagcuugacauuuaaaggccugcaugcugugaaccugaucugcuucccaaaacuuauucccaccaucuccuuacacagaacugggcuaggcauauuugacugcuugcaguucaagaauaggcuugaaguugcuggcugcuuugcuuugcuuugcuuucacucauauuccuagcauguuauuuaauggaaucuauaugaacucuggcaccagaccuaucuagauuggaaucccugguuucacagccauaugacauuuggcaaauuccuuaaucuuuuugacccaguuauuuugucuucaaaaugggaaagauaaugccaguuucucaagauugugagcuuuaugugagguaauauauaaaaacauuagcgcagcaucuagccacaugguagacagaugucaucguugaaccucccgcuccaucuuuucucugcucugaguuaguuuccucuuuguugaaaguguaucccuuaaucaagacugaauugaaaugccauuuucuuuuauuguucuuccaacucgcaagauuguagucuuuuuuauuugauguucugcaauacucagacuucuuuuagauuauuuauaauguuuuuccuguguuaugguuauuuuguacuugcuuaucccuauauugugaguucuuaaagaaaaugucuuaaucuuuguuuuauauaaaucauaguagguacuugcuaaauuguguuaguaaugacuauuacaaagcaaauauaaaaauuaaguuucuuuaaccaguucuuuuuuuuucuucagucuuuuuuuuuggccacauugauuacaaaauagaaaaugaauuugucaccuccauugugacagcucaccuuuuuauucauauauccuuaaauugagagacuccuauaacucaucucuugacacuaaaagagagaagagauucacuuauccuucgagaaaggaagagggaaagcauauuuauccaucuuuuagacagguuucauguuagugggcuauaguuguugagaaacguaaaauuuuacuacauaauuuuuaaauuaauaauuguaauugaaaacaacauaugugcuuagcuuuuagaaaaucuuuuuuucuucugcugugugguauuuauuuauagccuugucuauucugacaucucaaacaagaggcagucuuuuuacuauucuugaauuuccuuuguauuuguuuuugucagagacuguuuaguuuuaucagauuucuguauaauacuuggguuggaauuuuuugugcagccuuuuguuuuacacuguucuguuuugugaugguggguuagcuaggaaucaguacuccaacuaggauugggacggccagauaacuuguuagaagaaugcagucaaucuagccuuucaguuugaaguuaaaaugaaaaaaaaaguaacaaauuuagaaaacaaagaugaaggccauccucgaguggcuaaauauauuuauuuuuauuuugucauaucaugaagcgccaucuuuucacauaucaaacuaugauuuuauaaaacaauagaaucaagaacucagaugaaauauccucuuuccuauaaguucuaucuuaagcaaaaauaacuucuuuuucucaccuuacacauuuuagcugaugcaugcugaaguuaucaaaagaugagaaacaggggcuccauuuagaaagcuguaaggcuaaagucccuacucaguguuugccaguuggagauucuauuuugaaaguaggggcaauauuuaaauuuagcccuguuuucccuuuuaauuucaguaaauggucaacacuugaccuauuuacauaucauuugugcaagaacucaagauuuuuuuuucagaaagggagauuuuuaaaaagucaguuauauauucuagaagcuucuaaucuuagaauuuguuauaguauaucccaguacccaacaacucaaggauaauuuuccaaacuuuaauuuuuauugacagauuuccagcuuuauucagcaaauucugguuuaccaaaauuucaaaguacuuguuaguugauuauguauuuaaguuaauaauugccuaauaaaucagaacuacagaauauuauuaaguaagaaaaacacagguaaaguuaauaaaaaguuuauuuaauagauuauuaagucauuuuagaaaauggaauuuuuaugucuuuuagggaguacaccuuuaggaugcuauaaaaaacuaauagaauaucauaagaauggacaccuuucuuuuaaauaugugaagaccuuuaauauggaugaauauguagguaagcuauacuuaaauauauugaccauuauuuggguauguuauauuuggaauaaaaugaauguaguuuuagaauacaaguauauuugaauuuauguuuugaauauaauauuaauguaugaauauauuucuaaaauguacugcuuucagaugagauugggaguuuauuuaaaaaccuguauuuuugugauaguagcacagaauaguggaaggaaugaaggacuagaaaucagaagcucugcauucauccugggcucugccacucaacagugauguaacuuuaagccagucuacucacauuucuuauucucuuuuuuucuuaaggcagaguuaaaaccaguguugucaggauaaacuaacguacauguaaaaguaauuaguuaaguauuuuuucaaaucaaaagcuauauugguagcccuggagcuuuuauaauuuauuguuaacuugccuaccugaaaucugugaugcauagaaacucuguguuaaaauuuaaauauagaaauguguauuuaaugguagcauaaaugauagccaaagaaguguugugaucccacauaaucugcacacauacaggaugaauagaggaggaacauggcuaucauuucacuugaauggcuacuuaauuuauuuugagcuuaacauguaagucaauuucauugguuaaaauuuuguguuugagaagaguauaguuacuaagugcacaugagcuagacuuucuguguuugaauccuaacuccuuugcgaacuaugggaccuuugggaaagauucuuguguuucaauuguucaccuacaaaaugagauaauaguguuccauagauguuuuaucaauuaaugcauacauuuagggugauuaauacuaggcauauaaucauauauuccacauaagaaugcuuuuaaauugaauaugguauagagaaguuagauuuauuaaauagcacuuaugacuuaaaaagaaaaauaaacuuuagauuuauuucaggaauacuuauauuuuuauuaacuucaucuuuaggacuuccaagaaaucauccugaaagcuaccauucuuauauguggaauaauuuuuuuaagcauaucgauauagauccuaauaaugcacauauccuugacgggaaugcugcagauuuacaagcagaaugugaugcuuuugaaaacaaaauaaaagaagcuggaggaauagaucuuuuuguuggagguauguaaaaaccuuuugucauuaacuguuuguuaguguuugaauuagggauuuuuaaauuuaaaaaauaaaucuucccauuguguaauguaaagagcaccuguggcuguccguaauacgcguuuauucugcuacugauuccuguuuucauuuucuucagaaaauaaucuuaaaauucccgucuuaaucuucaaauugacagcuggaauuguuuaccuuaugccuugagagguagaucccaauccccguuaaacucuguuaauuaccucuuuaaaguugacaguuuaccacaucuuucaaaaugaguaauauguuucuuuaccuaaaugauagcuucuuuuuacuauuucuuuaaaacucuagccagccuacuuaucaaauuacagaguuuaaacguuugcaugaggaacagguggauuuuaguagauuacuuuaauuguuucaucuuacugaguaaucaguuaagaaugauguaaaacuuuuuacuuaccagccuuaaguuaauaugaguuaagcuguauaauugucauaauaaauuccaaaauuaauguuuaauuuaccaaauuccacuuguaauuuauauauguguguguauauauaaucuacaguuaaaaauaaguuuuuuccuuuguaaugacaacgugguuuucuauuaucaguguaaacuaucgcagacagcuagcuaauugcuauaagaauaguucaacaucaacuaaacuaaaaucaaaauuuuuugccagauucuuuaauauucaacuaaaaauacuaaugcuguaaauuaucuguauauaacuuauuauuaacuuaauagaacacugaucaaaauuacaugaauuugaucuucaauagagcuguccugagguuaauuuauacuugaaguggccaaguaugguugagauaguugauuaucauugggggaaauuugguuuuaaagucagacguaaaauuguauccuguuuuagccacuuaguaucuguaugaccugggaaaguuuauugaaguucaguauagguacaucauuuguaaaagaggauuaauauuaaacauuccaaaauuugugagaauuaaucauguuguaacauguauaaaaugccuuacacagugcuugguauauaguugguacuccauaagugcuacuucagucuucucuuucucucucaacuguaaaugcggaaauaauugucccuuagaauuacugaauuccuugggauuuuuaccgaauucccucuagggacauccaggaagacugaaaucuucucuuuaagauaguuuuuacuucuaccuagcagagucaauaacauuuacuuucuugauagaaugguuguuuauuggagcaagaaaccaaguuagacuauugcuuuucaaauuagaagguuaucuguuuuaaauaaaauuuacuaauauuacuucaguaauccuagagaacauuugcauacuccugcuuuguacguaugacucaauuuugagauaauuaaccauuuguaccuuccaauauucaggcuagacaguagauauuugagagugucugaggggugcauagaccaucuaaucuuuagauuuucuaagcuccacaccaaaaucugguagaauuacuggaguaccacauacuucaacugcuuauaucaaaaaauguuuucacucauuuacuauaaugcaaaaaaaggcucuuaguuguuugagguucauuauuaaaaguggcugcuugaaaauaucuucauuuguagacuuucuuucccccuuguuaauuuauugaccuuacauaaguaugcaugugacaaaucucuuguagacccaaagguaggaaauagauuuuacuauggggaauaacacugauaagaacacuugauuuuauuccuuugccugccuuccagaaagcauucauagcauaaaauaauguuuaagccuguaauucuuauccaagaugucugguagaacuuuccucuuuccuuauaacuuuaaaucauuucguacuucuuuucagcuaauuuuuuuugggaggggguuauguuucuucaguauaaaccaccucaguucuccuuuugaaauagauguugcauaaguuauaauuauauauguuuaucacugacaccacuaaaaagaauuugacuugguuuuuuaaccaguuugucuuaagcuuccuguaguuguuuccccgcuccuccccgcucccaaauauauuuuaagagaguuccugugccucuuacauuaacaucuucacuguagucauggaugauccaaugccugacauuuuauauguaccaucuaaaggacauaauugugcagagagagagaaggauuauugcauuuucuuugaacuuuuccuuauuugggaugcccuauuauuggauauguauucaugaaagaaucucauuuguugaucuagguuuaucaucauuggauuuuuagaugaggauuggcaucugggucuuacaacuacccuucuuuuguuccaggguuugguuaauaaaaacucuaagaacugugccaaaugggaucaaaauaucagcuuuauuaaagguaaaguugaaauagagauugcaguuugggcuugaagccagaaugggguuuuucacuccugcccuuugaauuggaaacaguagaaugagaagagcucaaaaauguuaaucugcuauugcucauuccagggaauuagagcagaggucccuuuccucugagggaagagggaaagaaaaaggaggaaauacauacucaaauguucuaauuccuccucugauggcaaacguguucagagaaaggguaaaagguguaucaugcaauuccugacuuaaccccagcaauaagauauacaaacauggauuuuuaaaaauaaaaucuagggcugggauccgguggcucacaccuauaaucccagcacuuugggaggcugaggugcgcagaucaccugagguugggaguucgacaccagccugaccaacauggagaaaccccgucucuacuaaaaaaaaauacaaaauuagcugggcgugguggugcaugccuguaaucccagcuacucgggaggcugaggcaggagaaucacuugaaccugggaggccgagguuguggugagcugauaucgugccauugcacuccagccugggcaacaagagugaaacuccgucucaaaaugaauaaauaaauaauuuuaaaaaucuaguuuuacaauaaaaucuaaauauauaaacuuuuaaaauaucuuaacgcaguagugucuuggguuuuuuguuguuguugagacagagucucgcucuguugcccaggcuggaguacaguggcuugaucuuggcuuacugcaaccuccaccucccagguucaagcgauccuccugccucagccuccugaguagcugugacuacaggcacuugccgccaugcccggcuaauuuuuguaucuuuaguggagaugggguuuugccacauuggccaggcuggucucgaacuccugaccucuggugauccaccugccuuggccucccaaagugcuaggauuacaggugugagccacugcacccggccuaauaguguuuuuaaaaaguaaaaauaaaagaagacaguggagaaaauguuaaccuucugauuugguugcaugcuuggauucuuugcuuugguagaaaaaggaaauaacuaaugggaucaaaaguaaauuaacuggaaugauucuaggguaacucacaaacugaaggaaaaguuaaaacaaccaagucuuuggaaaaacagagaaccucagaucucagaaguagaaacucaucaaucuucucccugcagugcugucauccagugcuucaguucaccaugcugucuucguuaacuguaucccuggucaagauucagauccagacagauauuuugauuggcucagccugagacaagugcuuaucucuagaccacagucacuuuaccuaagagggauauaggaaauuaaaauuguuccagccccucuggugaggggagcaaggcagaagagaacaaggugggagguggaauaaacuauaccgagcugaccaaagaauagcaaccauacauucauuuauccagccauuauuuaauaagugcguccuaugugucacuuguuauucuaaaugguaauauaguaaugaagauaaagcccuuacuuucaugaagagugcauguacauucuacccuuagaacuguaggaacacaggaaugacauuuacuccagacagugaguuuuagagauguuucauagaggugcugauaucuuaauuuagacuuaaaggcugaauaagaauuagccacauuuaaaaaaauaauuuuauaucaggaaccucaguuauucauagccaacaagcaaauaccuugacccagcucuguuauuaaccuuugcucauaauuucagcuuagcuguacacuucuauaaggcccaaaucaucagugaggucaguaguaguagaucuuaguagacuucauauuuuuuuccugaagcuuguauuuuccugaucccauccuucccucuacacauauauagagaaauauaaauguuagggauauguauaccuaagaggagaaacagaacacuuuuacaaaucuagauaauuuaaugucuauaauuaauauauauuuauaagcagauacauacuuaauaguagaaacagucaaugcauauuaaccauauguaggucuggccuuaugucuccauauuaaaaauucauaaauuguuguacuuuggcauucuguacuugcuucaauagaguauucauuucuucauuuuucaaaacuggguuacucuuugucauauuuuaucuucuuguggccugggaaaauuuuguuaaacuugugugcuaagugucaguaaaauacagauaucauuaaaguaaauaugcagaauauaaauguaaaagauauuuuaaugacucaaggaauuggcagauuuauuuuuuggcugagguuaccagaaaugugacuagcuacuaggguacuuauaaauaaaacucgauuuauuuaugucauggaaagauucuuaaguuugugaaaagaauuaccuuccauuuccuucaaauaagaaugucauauuccugucuauauuuuagagguaauccuagaauauuagaguuggcacuaggucucuuuaaagcaguguuuuaaaacugguugucacccauuauuauaucauaaaaucaauauagccagucacgugcaacauuuuccuuuuguuaaugaaaugcaaugucauagaaaacagcuuguaugguuccuaguaaggguaaguaugauuucauggaauucuugucuuaauuauauuuuauauguuuguguuguauauguguauauauauauauauauauacuagauugcaauaucaaauguuauuucuuacaaggguuacagucagaaguuugaaaaaaaaaaacuguugcccuagacauuaucuuauccaauccacacauuuuuauaagugaggaaacucuccuacagaaaggucuacuaguuaauugcccuaucuggacuacaaccaaguaaauuaaagugugacuauaaagauguccaaguuaggagucagaagacagauccaaguccugucucaguauuuacccaguugugacauugaacaagucacuuauuuuucuugagcaucaaaauuuccuuuuguguguuaaaaaagguggaggaaaugagggaaauagauuuggcuaaucuggccaucucauaagauuauuaaauaauauuugauaaucuguugugaugaugcaugugaaagggcuuuauaaauuaucaaauguuauauuaauauaaggugauacuuaauuuuacuauuagaaucaugccagcucauugcuaaacauguagaaaacauggaaacauuuguugaaucaauacagaaacaaauauuuuaaugcaguaauaggaauucaaguauaaaauaaaacaaggugauuuuuuuuuuguucuuuaacgcacauugaacuuugugaaaccuauuuacuucauguguauauguauguauauuucuuuugaaaggaauugguccagauggucauaucgcuuucaaugagccuggauccaguuuagugucaaggacaagauuaaagacucuagcaauggauaccaucuuggcaaaugccaaauauuuugauggagauuuaucaaaagugccaacuauggcucuaacuguugguguggggacagugauggaugcuagagaaguaagcauuaaauauucuuugcugucuuucuuuucauguuaauauauuaauauuuuggaggaguuaugaugcugaauaagugauauuuugauugcauucuauuugcaguauaaauuguuuucuaguuuucaguaaccaacuuuugucagucucauugacauguuuagggaucaauuaagucuuuuggagcuguaaacuaagaauuaagcaccaccacuuuugagguacuauuucacuugccuauuccugcuccaguuugagguccuaaaaucuuacugaucacaucguuuguuuuuuauugaaagugucucaugacaggacuguugggacaaugaugcaaugcuaguuacacuacaucuuuuuuggagcucacaggaugauuuaaaugcuuuuugacuguauguuauguaggaugauagagcccuguugguuuccagcagaaaaggaacucagcuagggcugcaacuguucuacauuuggcauauuuaagcauggaagagcucugaacagaagacccuguguaauuuuuaaguuuuuuuaaauugggcugucauuuucuuccuugagaauacagaacacauuguagucaguucgugguuauauguaguuaaauuauauggaaacccagaacucuguuccuuucugguagccagauuggacagguucagaggaaaaaacuauagacaagguaugaugaaaaaguaacuuaucuugauauaauuauauuuaaacuugaacauacuaauagaacugucaaucaaaauauaugagaaaccuagaaaucauagguauaugaauaaaagaccuuucaaggacugaaacuucauagucaauaaguugaaaaaaggauuuuagagcaaucuuauuucuaaaaugugaaacugaguuauguaauagauuacauuuaacaagauguaaguuuuaauacaguuuuuaugcugauuuuuagaacaaacaauuacucaaauauugaguuuuuuucuuugggucaguuuuugcccagacaggagugcagugugugauuacagcuuacugcagccucaaccuccagggcucaagagaucuucccaccccagccuccuaaguagcugggacuucaggugcacaccaccaugccuggcugauuuuucaauuuuucauuuuuuuuuuuuuggaagugacaaggucucacuguguugcccaggcuaauuuccucauuuauuaaaaauuacauuugacuuaaaaauuccaaccaagaagggaugguggaggauuuaauaugagcuuauagauuuuuguaaaucacuuauaucaguuuaugggaugauuaaauguugauuauucuuuaaaauuagcuuauuucauaaccuuuuaaaauaguguuauugcuacacuuaaguagcaaaaagcuguaucaaugcaacaucugccugagcacugguugucaaacauuaguguacauaagaaucaccugguauccacaccuagcuugcuucuuuaaauuuagggauucugcaguuugaacaaacauaacaaauuauuccauauaguuuguccuuucccaugauaugagaaauaaucuccuugagaguagaacagguaugauauaacuaaucacauaucagaucaagucuauuuaaagaccaauuuguuuuaucuaugccuuagccauagauaaacaccaauaaugaauucuucauccuauacuaagcuucccuuccagcagccuccuuucccuccacucccuucauaaugguaaugccagguauguacuuaccuuuucucaccaauaaaaguuuaguugucuuuuuuuuccucaguauauauacuucauguugagauuucuugccaccugucccauuaccuuuuuagagugugcauccauaaugaaaagacucuuagcucauauugucuaauuguuagaacuuuuacaagaggcaauguaauguaauuguuaaucgcuaagaauaugcacuguagaaaaaaacuacuuguuuguaucuuaccaaaaccuugggccaguuacagaauaugccucaguuuccuuaucuuuaaaauaugaguaagaauaguauuucucucauggugguguuuugaggaguugagguaauucaaggagagugcagaguauuuccucccauuuuaggucuaguuauaaaauauguaauacaaaauuuguuauauuuuagaacuacagcaauuuuaacauuguuuuuuaaaacaauuguaaugaggaaaaaaaguuuaaagauuauauuacaaaaauauguguguagaugagguguuaaaugggaucaauuuccagcuuaaacaugauaaagaaaagauuccgacacauacacauucacauuugcaacaugucauugcauuauuucauuggcauuuagggccuggggaccaagagcuuggauuuucuguagcuuauaaggguaauaucagucauaugugauuauaagacaguuccuaugugcuuauaagacaguuccuauguuuaaguagaucccuaauccuuuuuuaaauccaguuuuuauucugagucaacuuugaauagcacauguucagugaaaugcucuucaggcuuuucuugauaacucuucaaauuaccuguuguuuuagagucuuugcuuuucugacauaguaucuuuugcuuaucuagacuacagcaacuugguguaucauucuagauuguauaaauuauuuauagauuuguaacucugcuuuugcaacacaguccuuuuguuucuuuuucuucauugucccagguuucuuuuauacaucaucauucacuauguuaaaaguuacagguauuauaguguuugcauuaauaacccauaacaagauauuguuuugcuuuguuaaacuagaagcaacauuuugugcuuguuaaucuuaaaaaguagaaaugaauaccuugaacuauuauguggagcuauguauuuuucuuucucucagaaaaaaauauuggugcuuaaguucucguuuaaaaaaaauagagcuucuuacucauuuggaacaaguuuuaacaauugauguucauaauuuuucagguaaugauccuuauaacaggggcacacaaggcauuugcccuguacaaagcaauagaagaaggagucaaucacauguggacuguuuccgcuuuccagcagcauccccggacuauuuuuguaugcgaugaagaugcuacuuuagaauuaagaguuaaaacugugaaauacuuuaaaggugagcacugaauuucaaaagccgacugagauaaucuguugugagugacaauuaaaacuuacugugacugugggguuaaaucucacacugugaccuauugaaaaguggcaacacauagcuaguucuuucaaguaauggaaaguucucaccucagauaauaguaucuucaaaguaguaccuuuuuuuuuuuuucaugaagagaaucucuucagucucuauuuucaguaaacaauuuuucuugaaauccaagguuuaauaauuuacuuucauauugaauauacaagaccaaauaacccaaaagaaaauguaucuuuguccauucuggauuucuuuucauguuuacuagucccaccucaaucccucuuccucacuccccucuaaccuuaauuuagaaccuaaucaguggauaagagaucucccacuaucuaauuuaaucuuuacaauuuuaagccaauuuauucccauauauuaaaguuauaaugucuaaauguuaaaauaguauggaauaaacucugcaaguaagcaggaguuugauugcccagacuucauguugauuuuccuuuuuccuguagucuaguucaguaauucagaaaccuuacucuaccaggcuguguauuacaaaacacauaugcuugauauaaugguuuuaagagauuuucaagggacauuuugccuauacccaauguagaaccuauucucugauuuaagagucagcuccacauauuacacauauguaagcaaacuguacaaacagguaauuuucauaaagcaccuguauuuacauagcugauauuaaaaguuacauaguugaucauauagauaggucagugauucacuauguaguauguaugcuacuuuugcuacaugauuauaccuuuuaaucuuuuuuacucuaguaacuagguauuuauuuuaaugccuauuggaaaauacacugaauaaaucaaagcuauauuuuuuggauauuauugcuuaagacaagguccaaaaaagcuaccauauuugauuggcucuaauacacguugaucuugcugauguuggacugugucuuaaaacuggugucagaucauagcuuacuggguagcauuuuuuucucagugguacauaaaauggugugucuuacaauuuauagcaucucauacucagaaauaaaguauauaaucuuaaauuuuuaauucaaugcaaagaaaaccaacucauauuucauguauaugugugaauauggcaaauaucuugaagguguuauacaaauaacugacauuuggcaagcacugaaaauagucuauuuuuaaacaaaaugcugaucaugcuuuguauauaguuuuguauuuguacuuauguuucaugagcauuuuccuguuuuacuaaauauuuggaagcauuuuaauggauaguuaaguacauaaaucauaauuuauuuaaacauuuccuuauuaacacuuagauuauuucuagucauuuauauuuuuaccauuuaaauuacuaauuuaccaagccacaaauauaucaaacugaaaaacugaaaaacugaaaaauuucugauuugugaauaaaagagcauuugauggaguuuuaacucuauuuucccauguaacccuucagauuucaucccaaauaauagauuccuugacuacaaggaauccucacuauccacaaauuuuaauuccaguuuuaaggagauucauuuaacauggccauuuucuaguccucauuaagucccagauaaaucccuguacuaaucuaauuuugucacaauuagguuuuuaucagauuuuuauaucuuggugaauauuuaauaagauauuuaauaacagccaguaucucuaugaccaggcacuauucuaaaugcauuuuacuuauugauuuacuuaucacaaaaauguuaugaaauggguauucauagucccauuuuuaaauuaauaggcuuaacagacagagacguuaagcuacuuacccaaagucauacagcacauauuugggcagagcuggguaauagaaaucaaaaucaggcugaucucuggaguaugcaggcuuuugucuauucuauuauacugccucccagaauaaacucuagguaugauaccaucuacaucaaaaccauauuuccaucugcuuuuuucccauaugauaaucacugcuuccaaaaaagguauaucgacauauguuagauaauuuaaaauagaagggugguagauguuuauauguauuuaguucuuuuaguucaucuaauuguaagcucuucugaaaaauuuugaaacagaccauucgugagaggauagcugcacugcaucaagaggacacaguauuuuccacuuuggagcugucuguauuucugaagagguuucaggguaucagccuguuaggauaccuccuucaauaugaagacagaauuuagacauucugggcuacauaugggccucauuuuacagcauuuuaguaaaggguagagaaauugaauauucuuaaauaaacacauuucaaauguaguuuguauacuuuucauaccuccauugaguuacuaguauaucaaaauacuggaggauguaaauuccuauaauugucauccauaacucuucaaauuccauucacaucacuacccuuucuucugucaucacuaaaaagugcugaccagaaucuuaaaggguuuuauuuagugccuagauaagaucuagguuaacuagauccaaaacaauaaaaauugucaguaaaugcaaguuuauuucaauauauaccuauauaacgguauauaccuuuugaaagauacaaguuaaucacaagacaacaaguuuaguacguggggauuuguuuuauucauucucgcuuuucauuuuugcuuuuuaaauagaacagcuuugauuuuuaguauaugacaucaucaucaugaauuuuuuucucuuacuuuguauuuaggcuccaccucaguaguuugacaaagguagaaugaguucauuuugagucaaaaccauaaaaguuacuuuguauagacauugguuagaaucugugacauuuaaccuuucuucugguaacguuucaggaagucuggugcauuuuuaucagaagaauuauuucuguuugacuuaaguagcaauuauuuauuuauauaaaauucguauguagaaaguugucaguuuuuaccuaaagucacaguaaauauuugacuuaauaucuaaaaagcaauuaauagaauuuucaaaauaauuauuucuaguuuggaagcaguccuauuugauguauaaaagauauauccaauguaaagaaaaaaauuuuauaaaggaguugaauuuuuaauauuuacugauauuuuaauuugcauguauuuuaaagcucuguguauucuuuccguaaucaaaguuguuagcaaaugacagaugaauacuauuuaaguagaaaaacgauccucuacaaagugauacucuggaaaauguugcaucuucuaaaucauacagcugauauuacccuuaucuuuguuguccccucuccuacuggacaugaaguuucaggugaccuucaaguaggcuguugagcaguugcaggacuagugaauggaaugcuucccccuucccuccuuuagagucccauucuuaugguuagaauuucuccuacuacacaaacacuucccaguacucuuugcuugucccuuaaaagugggucuuucucaaagcugggauuuuagaguccuuuuugcagccuuucugacaaggaacaucuguuuacuaacaagcaaccuaucucuccaauccaguaaucccauuuccugcaaaaccgcauuaagugccuuuccccacccucccauguucuuaauaccuggaaaacuuaacucauuucuuuacccuccaaaauauaaaaucucugguucauuaacugggucagucuuuuuagaacuuuuuucuccccaaagaaauauaguacugaggcauuaaaacaggaguaacuggaagaucagcuauuucccaagcagcuuccauagcuaagagcagucugcaaguauauguaccaauuacaaaaugaaaguuauaaucuaccggauuuaaaaucguaauuucuauucugaauuaaaugauuuaauacagguuguuuucugucuuguuuuaguaacccucccucaguguagaauuuguaaucaaccuuugucauaaauacacaugccaaacuauuggaaaguaauuuaccagacgaauggauaggguaauguauuaagagugagacagcaguucugagccccuggcuggagucuaguagaggaacugccagaggaucaauaucaacauagacuuuuagauauaauuaaaaccuauuaucuaagucaguauucaaauuugucaugcuuaaucucuuugaagacaagaaaugcucuucugguuacucccaaaguaccuguacacauucuagaucugcacuguuacauaauuauaaauugguauuugcuagguagauaaaacuuaagacauucugaaacauuucuauuuguacuuuuucaauaaacuugacuauaucaagaugggaacuaaacaggcuuacugugucuuauaaaaaauacuuuguugucuaaaguaaaugagauaguucaaaauuaauaaaaacaacuagaacugugcuuuuuuucuuuaaggucuaaugcaugugcacaauaaacuuguggauccacuauucaguaugaaagauggaaacugaaggagacuggagcaaaauucagcuugaaugaacagagcacuuuuuacuaaguaguagaugaauuuucagcuaugcaauaugacaaaacauggggaauuuugaagauugucauuuuuucauucgagucucuauguuaaacauuccauauuuugaauauuuauaucuuguacuuggguuuaagagaaguagcuggcucucaagauugacuggcuauuuauuauaaaguacugaagucacauagccaccuauaaaacagcauagaaaugucugccuguuuaaaaagucauuuuaaagguagaguguccacaucaggcaccauuugugauaugacuccaguggcguauauuucauuuuuuaaugacaagacacuccaaaccuuucagauaacaaacuaucauugcagaccuucacuuuuggaaugcaaucuuuauauuuucugugcaucacacacaugcuuuucugcacgugguugccuuagucaucuuccuacagcaccaucuagacaucaaaaauugugcuauauaucauugguaaaggaaauuugaagagaugacagugccuaaaaguacaguuuacauccuuuuggaaaguauguguaagugcauguuuuuugugcaccuucuucuauagcacuuuuuuacaaauaucuuauuuuuauuuaacgacuuggguucaugucccuaauauaaguaucuugacaauuaugagcuuuauaccuagcaagccacuucaggaaauucuuuuggagaauauuuucugauuauuguuaaacuuaauauacaauuagcuuuauuccuuauaaaaugucuaaaagaauaauacgaaguauauauaaaaggaauuacuguaaacuacauugccauagcaauuuacauaaaaguauauuguuuuuuaucuuuaacucaaauaaagcguguaauaaauaaguuaucuaaauuuccagaagugaaccugaagaauacaugcauucgacucccaacaauuauaguacaugugaaccugcauucauuuuggguuuguuaccaucaugcauuaggagaguuagguuaaaagaugucuuugccucuguggggagcaaaaaaaugcuccuuuugcuuauuuugcauuucauaagcccaccugguagaagaagccuuacuuaucugcuugucuaugugauuaaaauguaguuucuuaaaauauuaaaauagcaaauaaauuaaugaaauaaaauugguaauaggguuuuaugguuaaaagugggggaugggguaaauuaugcugcuuuaauuccagaugauguuuuaauagccuuauaaauguuuuuuaaauaacuagugaguaacacuccacuuacacuuccaguaauaagaaucauuuacuacaaacuaugcugacuaccuuagaaagucauacagcaucacagugaaaaagcuaaagguaccuguugugcuacaugauucaccaguaauuucucugcuuuaaaggucuaaaaauucuccuuuccauuuuccuucccuugauguuaggggcuuaguugagguucauguacucaagcuccuccacaagcugaggagcgaaaacucuggccauuuucauuccugcuuucauucccuaaauugaggagcuaagcugcuguuaggcaaagaaccuagcuuuuucaagaaaccaaccacugaaucccagcucugucagggaaauaaaaaagucucagcuacuuccccaaaauuuuuacauagauugaauaagggaagcauacauagcucagcacagugguugucacauauuaaagucaauaaacggugcuauuuuaauauugauaacaguguuuaaacauauuucaguguuugcuaaaaucuuaguaauauuaaguccucugaggaaugcacuuauaaagcacacaacuccaaaucacuaaagucaucugacugggaaagcgggaaggggaaagaaauuaagcuuacagaaaaugcuuuuuuguacuacaacuaaaacuauaacuaaaacuacuuuuuuguacuacuauaacuaaagagucauagguuaaaaaaagguaaaauuagucugaauaaaaaagacuaagacugguaaauuauuaaauagcaagcacauaguacauauuacguuccaagaaccaauuuguaacuuauccuuuggcagugauagaacagaacacuuuuacaauuuuuuaauuucaaauacugucauuuucaaaauacuacugucauggucuuucagauuucaucuguuuuuaucagaaccuggaagagggagggaagauacauaagaugauaauguauguaucuaggacuauaucacaggcuacuucuacacaugauuuuaaguaaaucuccacuuaauuuauaauuaaaaugauuucacaauaacuguaagcucaaaauaucugagacagcucucaagucaguuuagaaaguuuauuuucccaggguuaaggugugcccaugacacagccucaggagguccucaccacaugugcccaaggugguuggggcacagcuugguuuuacacauuuuagagagacaugagacaucaaucaguauguguaagguguacauuggucuugaaaggcaggacaacuugaagaggggcgggggcuucaagcauaggcagguaagagagaaaggguugcauuuuuuugaguuucugauuagccuuucacugaauauacaauuuacaugugagaggagaguagaggaauagucaguuauaccuuaaucuggcuuagugaaacaugaaacagagaaagcaaucauuuaugcauuuguuucaugugaagacuuugaguucuuuguccauaaggaauucccuugugagcaaauuuuaucuuuguggcugucuuauuuaggaauaaaaugggaggcagguuugccucaaucaguucccagcuugacuucccuuuggcuuagugguuuugagauuuuucuuucauauaaccuuaguauaaaauucauccuugauaguguuuaucccuaaaagacauuuucuucauucaauucauucaagguagaagauaaaaaucaauggcu

SEQ ID NO: 14364 - RNA, 15400 nt, Homo sapiens
caagcggccagccuugacacgugacccaagccccagcuucgcgcagggauggagccggaagaggggacgcccuuguggcggcugcagaagcugccggccgagcugggcccgcaggugagggcggguaccgggggaagcggcgcggggccugggauucgcgacagcccggcgugcggaucaggccgggugcgacccggacgccuucgcaagcucccuagggaagggaggaggaaggggcgugauuucgggugguugguccccgccuucccuggggagccuaggaggacagcuuggggcgccacccccagccuagaggugcagcuccaggggcuuugcgcgcagaagcgcccacaccagacugggcuuugaaagcuuaagucgguguuugcugccucuuaguauacguuuucuuaauucauucaacacauaaccucccaaaggcucccuaccuaccggacagcagguacagagcuaggugcuggaauacaaugugacaaagaccgaagcggacccugccuccccccuugagggugguugguaggaagagaaauaacugggcgaguuacuuuaguuaggaucgucccaagaggugauguacccauugacuuccagucuguaaaagaaccuggcuuguaagaaucuggaaaaagcaaccacauucauuuguucagccaguuuuucauugaagucuaccauagauugagcgccccgaugggaugagguaaauggugagugagacacagccugugcccugguggagcaucuuuuuuauaagucucaauuuuggcuuccuguuuccucuauuccauuuauacuggagaaaguguggaggagacagaaaggaaugaacuuaccuccugccagggucaagaaaaaaaaacaccuaauucuuuucuuuguuuuugcaagugaggaaccugaaaugucagcagaaauuuuggcuaacuugcccaggauugcccauccaguuaguggcagagcuggaacuuaugcucagaucuguugauucugaguguuuuauuggcuuuuggcucuccuugucuucacucuacccauuuagauaaggcccauaaccuuuauuaccauauaugucgaugacuucuaaaucuuuagguccagccaaaaauuucuuccucuaugguucaagaaugccagguaaaaaacaaaacaaaaccccaaaaaccccaaaccaaaaucucuucccugagugucaggcuucugccacagguaccucaaauucaguaugcccuugccucagcucuucuuucccccuggaccuacuccucccguagccucauuuucgguuuguggcaccaccacuuucacccagccccucucaaccugacguucuagguuucauccauggcccccccuuuucacaucucuucuaccucuuuacugccuccauuuugaguguccucaacaauuuaagccccuuaaucuuuaacuccuuaacugaaaauugaggcaucugggcucacccucucucuuacaucuuccaaccuguuagcaaauauauggaaaaauaaugcaaaugugugaauagguugcuucccgguugagcacagauugaagucuaggcucuuuuacuuuguacacaaggcccuuuuugauuuggcuccacccaccucuccagccuugucuccugucacccccuaggcaccccccaaaauaacuugcuugugucuagaaaugcacuucuucucuccuguuuugcuuggccaacuacucauccuuuuaagauggacuuuuccuugcuuccucucugugcuccuucguaccuuguauauauuuuuauuauggccccaucauucuaaauuacauguauuuguauguuugccuuuuucgaauggacuaaagcucuguuaugguagggccuuauuuauucucaguuuccucauuuguaaaauagaaauaauaacaaugguuacuucagaguuguagugaggaucaguccagagugugguaccuaguuagggauccauaacgguagcuauuauaguuucuuugccauuaaauaaagucauuuccaugaccuuugucauuaaauaaggucauuuccaugacuuuauuuaauaacugggaugaaguguucauuacauauuugugaaugaauaacaaacauauuccaaaaaagauaaugcuuuuauuuuucaguuugaguucuggguuuuuuuuuuagcauggggacaguauaggauaagguguagagaauuuugaauggauucaaaauugaguauguugauuuaugguaaauaaaaauucaguuuguauaguauauuagccaccauuuggaagcaguugcuuguguucuggcaugugugguguuagagggaaggaguuauuaguuaaaaugggguggaauaugauuauuuccaaguuauuugguucaaauacuccucuuguaagauacaaauaacuucaagaaagauaaccuuauuaaauguuaagugcuuagaauaguacuggcauuguguuaucucaguuaauagaugcugaaggcaugaauuggaggaggaggacuagugauaauaauuagaaugguaacgagggcuagcaaugucuacaugucuuuguacaugccaggaagaugccaagugauuugcacguauucuuauuccauccuuacagcaagauuaagagaauagaugauauccucauuuaacacuugaggaagcagacucagaacauuuaaauaaaacuugaaaauacugaaacugggauuggaacuggauaguuuuauuccaaaauccguagucuuaaucacuaugcucaguuauacauguguuaggcuuucuguugcugauauuaagauacuaauaggauagaaaggaaaguaaaaaaaggaaaaaaguacuggagacuuucugggaauacagcaaaaguaacugcugagcugggugcgguggugcucgucugcaguccuaacuacuugggaggcugagaugggaaaauugcuugaguucaggaguucaaggccagccugggcaacauagugagacccucaaaagaaaaaaaaguauguugugaaaauggaggcaaagcaaaaugaagcuuauaggccuacaguaagagacuuugauauaaguccuauccuuuuguuuggucguugcuauaaauauggaaucuuuuauauguaucuuccuuuuaguuuuuucauuauguaauuuuuauaacaaaauuauuuuagcuucugaaggucaacauaauaauagaaagucuaggauuuuuaugaguucuaauuuuuaauuagaauaaucuuaaaagugguuuauacauuuuaacuuaagcuggucuugcagauaacaugaacaucucccaacauuuguuuguuaagaggaagauaaauuuguuucaucauuuuacuuauaaguacauuuauuuccuuuuuucuugcuagcuucuucacaaaauaauugauggcauuuguggucgagcuuauccuguguaccaagauuaucacacuguuugggaaucagaagaauggaugcacguuuuagaagauauugccaaauuuuucaaagccauaguugguaaaaacuuaccugaugaagagguaacuucucugcacauuucuauaacuuacaauaaauaaugcucagguuucucucugaguuuuuuagagcaauguauaauacaagggcuaucaucaguaacaacaaauaccuuauaauugugaauggaaaaaucuguggaaguccuagguuuuugcaguuuuguuuuugguuguuuuuacucuuuugugaaacauuuaaaacauacagaagaaaacaagaaauuauauaacugacaccuacauucacauuaccaguuaaacagguguuaacauuuugcaauguguguguuuguuucagaaauaaagcauuacaaagauaaccuaaauucccuuaucccccuccuggauaucccacucuuaccuagagaucaccacucuugaaggugguguucauguuuuguauuauauauuguguguauguuugaaucuuuuaguguauugaaauuauuuggggugugucaguguauaacuuguaauaaaauguaacauuugucugcacuuguaaauuguuuuaaaugcagcauuguguuuuacauugauaaacauggaucuaguuaguguauuuuaacuccuuguaguauuugaugauaggaauuaaauaggauuuauuuaucucccuacugacuaaugaauagucauugcuucuuucauuauuacaaguagugcugcuauaaauguucuuuacaugucuccuuguucacacucacaccagcuuuucugggguagauaucuugaagugaaauugcauggucauaggauauccuucuuccacugaauugcuuuugcaucuuugucaaaaaucauuugagcuuguguagguugcucacuuuucuaaaaaucaaguuauguauguuugucauugauuugguugauauucuggauauaagcucauuguuagaaauauguauuuuaaauaucuucuauuaugugcuugccuuuuuacucucuuaaugguaucuuuuggugaaacaaguuaugaaauuuaacagaucuacuuugucaauauuucuuuugcuggcuaauacuauuaauguuuuguuucagaaauauuugugcugaagacaugaagauucuuggauguauucuuguagaagcuugauuguuuuagcuuucacauuauguuacugaugcauuuugaauuaauauuuguguauggaguggaggucaaguucacaauuuucuacauuaauaucuaguugaccauuuauugaaaugaccauccuugccccacaauauugcugugcugccuuuauuguaaaucaaguggcccuauauuugugccucuguaucucaacucuucaauguauuccauuagucuacuuuuguauauuugccaaugcuauacugcuuuaauuacuguagaauuaaagcuaaauuaaauuaugucuucauaucugguaauagaagaccuucauucucaugcuucuucaggagugccuuggcuauuauauuuucggauaacccucuagaaucaacuuuucaguuuuaaccuacaaaccugcuggaauuuugauagagaucauuuauggggagaauugacaucuuaacaacauuuagcuuuccaaaguuaagaacaugggauagcccucuauuuauuuagauuagcuuuaguuugucucucucguauuuuguaguuuucaguguugagcucuugcaaauauuuuuauuucugaguaaaugauguuuuugaucuuuaauuuuucaguaguuuuuugcuaguauguacaguugauuuuuauauaccuugugucccacagccuuucuaaauuuguuuacugugucuaauuguauacagauuuuuuggggggagauuguauauaauaauuuucuuuuucaacuuuaacaucuuucauuuauuuuucuuaccuuagcgcauuggcuaacaccaguagucaguguuucuuuuaaaaaagcagucauaguagauauauaucuauuccuaaccuuagggagaaaguguuuacuauuucaccauuuaguauguuagcucuguaauuuuauagauauccauuaucagacuaaagaagcauccuacaauucuaacuuugcugagaauuuuuaccaugaauggauauugaauuuuaugaaaugcuuuucccugaauuuauuauuguuucuucucuauuuuguucaugugauuuuugaauguuaaacuaaggcugcacugccaaaauaaaccccacuugaucgugauguauuaucuuuuuuuuuauauaucucuugauuuggauugccaauauuuuguuuaggauuuuuacaucuauauuugagugaucuuggccuagguguuuuuuuuuuuucuuuuccucccuauaauacuauugucaagguguuaaguuuuauucuggccucauggaaugaauugggaaggauuuuuuuccuguucucaggaagaauaagugagauugacuuuauuuauuuaguguugugcuacuuaauuuucacacauucagaaauuuuuugguuaccuuuucucauuagucauaacuucauuacccaguaauaaaaauauaaacaguauuauuuaguucuuugagaucugucgugguuugccaaauggcucagaauaugguacguuauggugaauguuccauauacauuugaaaauaauguguacaguugucagguguaguauucuauauauugcuaagguuagguagaaugcauuuuuucaauucuucuauauccucauugauuuuuuuucguuucuuugugucagcuauugagaguuguauuaauaccucuaacugugaauguggauuuauucauuucuuuuaguauugccaaauuuugcugcuuuauauauuuugaagcuaugguguuaggugcagagggauuuaugauuguugugucuuucuguugaauugcccuuuuacugucguucucuauuucuuguaaugcuucuugccuaagggcuacauugucugauauauuaauacaaguugaguaucccuuauuugaaaugcauggaaccagaaguguuuuggauuucggauuuuuuugacuuugcaauguuugcauuauacucaccagugcagcaucccuacucaaaaaaucugaaaucucaacuauucaaaugagcacuuccuuugagcauccuaucagugagcagaacuuuuccuguuuugggauuugagauacucacccugcguggugguaucagcuuugguguuuuccagguguauucauuuccaugcugcugcuuccaucaguccuuuuucuuuacuguauauuuugcagaaauuuguuaaaaccuauuuucugguuauucauucucaucuuacucuuuuuuauaguuacagaaguauuucucuuuuucuuuuacuguugcuuuaaaagugugcaaaaggagaguggaauuguguuuuuacauuuuaaacagaaagccccuuuugccuguuuuuauuuuuauagauauuucagcaguugaaucaguugaauucacuucaucaagaaacuaucaugaaaugcgugaaaaguaggaaagaugaaaucaaacaggcucugucaagagaaauaguugcuauuuccucugcacagcuacaggauuuugauuggcagguaaagguaagagucuaugaguauguguauuuuuuauuucauuuuuuggauauagagaaauaucuuuauaauaucauauauauaaaauuuguuauuuugggaauguauuaucccaaagaaauaucaaagauaguuuaaauuacaucuugaauuaacuugggcauaaguacacuacaaacaucuaagccauguauaauaacauuacauugauaauaaauauaauuagaucuguaaauuauuaaaugacauaagugauggggcagcauauagucaacauauacauauauauauauauauauauauauauauauauauguauaauuuauuuauuuuuugagacaagagucgugcucugucaucuaggcuggagugcaauggugcgaucucagcuuacugcaacuucugccucccggguucaagcaauucuucugccucagcccccugaguagcugggacuacaggcaugugcccccaugcccggcuaauuuuuguaucuuugguggagauuugggguuuugccauuuuggcuaggcuggucucaaauccuggccucaagugaucugccugccuccacccaccagagugcugggauuacaggcgugagccaucccacuuggucaauauauauuuuugaccacaacuuucuagacuuuauagcuuucuuaagacugguaaaugugauucuaccucuaggaggaaaaucuauaagauauuauuaaaacauuaguuuuuaauacauuuugagagucacuaucaguagaguucauaaagaagaauuucagaccaacuuuuuguccuuauaagauaccuagaccaguagaugaagaggaaauaaauacauuguguuucuugauguuagcaugacccuggauaaagugccuuacauuguguauguggauuaaguagagaaaaaugugggaagauaacagguggguucauaauuggauaaauaaccaagcaaagacagaugaauuuauauuaguuaaaaagucucuguggcucuggucuuggcccagucauuuucaacauuuuuaugaauauuaugcuuaucagaucugaaggugauacaaaacuagagcuauaacaaguguauaaugugacacaaaguucaaaauuaugucacagccaauuacaaucagugaccaaaugaagcaaaauaaauuaaucaggcaaccuaaacagaggauuuuuaauuuaaauauuuaaauuuuauaaauuuaauuucaauuucagaguuuauauuuuuauaaauauaaaagauaaaggagaccaggcacgguggcucacaccuguaaucccagcacuuugggaagccaaggcggguggaucacuugaggccaggaguuugagacuggccuggccaacauggcaaaacugcaacucuacugaaaaaauaugaauauuagcuggguguuguggugugugccuguagucccagcuacuugggaggcugaggcacgagaauugcuugaacccaggagguggagcuugcagugaaccaagaucaucgugccacuucacuccagccugggcaccagagcacaacucugucucagaaaaaaauaaauaaauaaaggauaagagagauguuaauaguagcauauaugagaaauguuuaguuauuuugguuuaucaaaguauagcuucauucguguugauucaggcccguauuuuguugguagaaacguaguucuguuuuuuuuuuuuuuuuuuuuuuugagauggaguuucgcucuuggugcccaggcuggagugcaauggcacgaucucugcucaccgcaaccccaccucccggguucaagugauucuccugccucagccuccugaguagcugggauuacaggcaugugccaccacgccuggcuaauuuuguauuuuuaauagagaugggguuuugccaugucggucaugcuggucuagaacucccgaccucaggugaucugcccaccucagccucccaaagugcugggauuacaggcgugagccacugugccugacagaauugcaguucuucaagcaagagauggugcuaguacauucuguuuccagugauaauaucuucuuaguguauuaucuguuuaguuuuggcugccaaacuuaagagauauuuaagcaaauuggacuccaacuagaaaagaaugaccaggaacuuaaaaucguggugugugaaauugcuuugaaacacugagaccauguaccuggaaaagauuaaaccuaguagaaacaugacacuuaccuuuaaaaggcuaaaauucauagauggggaaauauauaaaugcuuuguggcuccagagacuaggugaaggacuaacguauauuauuugcaauaagauacguuucaauucaaccuggggaagaacuuuuuaacaaguaugaguaucuggaaaugauuguaaccgcuucucaagguagcacaugcaucaucauuggugguauucaagcauagggugaaaaacuauuuauuggaaauauugaggaggagaauuaugcauaagauaguuaaccugaagcugauacuuccagaucugagauauuauggguccuguuuuugggugagagaauagaggagcuaugucaagauuugauucuauaguguauguaccacaagggagauccuuugaggucauuagggaagaugucccuuaucauugcauaaguaauuuuuuugcaaguggcagcauucuaaacaaagauucaguuuuuguggauuuuucuggcucagauucuagaaaaauugaguuucccuaugcugucugccaaggaagcuacagugcucauuucaagaaguauuaguauuauaaauauuugguucuuccaauuccccuaggauauauuccagagaaagaaauuaagaagugagguaaauguacagaguguuucuguugaguggcucuaauugaagaugguaucuugauaacauauuuaucaauauugugauagauagcugaccaugaauuaagcaucuuaauuucugagaguuuaccacuauuuuuggucucacuuaucuuuguacaugaacuuucaucuucuuggugccuucagucuucuuuaagaauucucuguuucuuguacauuagacccauucaguacuucccaggcaugacucugaucuagacaccugcuucugccacaagauugcugacugguugucuuacuuuccuaccgauuuccucuccuuuauucacucuccuuucucuuucuguucuucaaauaugcuuuagcauggacuuaauuuauuucuuucaccuuucucuauacucaacagcaaacaguacuuuuaaaaaauguacugcuaacuaaccucugauguauacucaauauaguucuuuuuacuauuuauuaauugcuauuuuucugauuuuaaacagcuugcacuuuccagugacaagauugcugcauuacgaaugccacuuuuaagccugcaucuagauguaaaagaaaauggugaaguaaaaccuuauucuauugaaaugaguagagaggagcugcagaaucuaauacaguccuuggaagcagcgaauaagguauuugcuauaauuuugucauaugauuugaauguuuaagguuuugggguuuuuuuuuguuugcguuggagucucacucugucacccaggcuggaggggcaacggcgcgaacucggcucacugcaaccuccgccucccgaguucaagcgauucucgugccugagccuccagacuagcugagauuacagaugccugccaccaggccuggcuaauuuuuguauuuuuaguagagaugggguuuuaccauguuggccaggcuggucucaaacucuugaccucaagugaucuacucgccuuggccucccaaagugcugggauuacaggcaugggccacugcacccagccaaauguuuuaaguuuugauugauacuccuagacucauaguucacuuuuaguguuuuuucuccagauguuuuauguuaauuaagcacagaaaauacuuuguuaauauguucugagcucuaguuuuagauauuaauuauaacuuguaauguucaauuaguuuugaacauaauguacuaaguaauuuuugaaagaauaauagugcuauucuaacagcugaauuucuuuugcugcaaugcucguuaaugauaaaaauaacauuuuuaccuuagaauaauaaaauugauucugaagaguuuuuaugauuaaaaaaauuacgauccuaaaaaaaguggcuuuauuaacuggacuaauaauagaaaauugcuuuuaugauccucuaacuauggaagacagaaucugacuuguaguuauuaugacaaaaucagguugaggcaagacagaacuaaugaauguccaaaaacuucacauuuacaauggaguggcuaaauaacaauaacugcuccuaauguuuaauaaaugagaaaaauaauacuuaaacaguggaaacuguugugaggaggaauaaaaauaauugucuuuguauauguauguuucuucguuauugcucagcauuuucucuagugaucucaucucagugauuaagucucagugauucuuacaaccucuauugcccuacuauuuaaucuucuugauccuccuuuuuaaaaacucugauaaacuucagcuucucuccacacucugcauuugcucaaacauuguagugcuuugauuaccgguccacaugccuauuaaccaaacgagcagcucaggcuuggcuggauggcuggggcuacaugugugaagggugcaugugauagagcccgauauaaaugguaacagauucugaaccguagauuccagcaggcauaugucaucaguuacugugcauuguacuugcuuguuaugaguucuccaugcccuuuuucagagacuucaaagcauuuaauauggaauauaucagcaucagucuuguauaaccugauauuuucucuucaauuuguguuuuaaggugguccugcaguugaaauaacuggaaaugaugaauaccaguccuaucagauuuuauugcuccaacuuauauggcagagugaauacugcguguucagaaaccuugugaugucuugacuguugcaccaggcugagaaagcagcaauauugauauuauaaagauaaaaauuuaucaacauuccuuaacaggaaauuacaugguugagaggaaaugcauaaaaugaaagaugaaaaaucuauaguagcaguuuauauuuucaugauuguuuugccucauuuauuaaauauuugagaaaucuuuggagauacauaguuuuauugaaagcuaaaaauagguucuaaaguaauguaaaaauauaaagcacaaauauacuugaauauugcuuaaagaauugugugaauagcaacauauauuauggauauauacuuugugauauuuuuaaaaaauaauuuuuucaaagaauguauaagcugcauauauaacucaggagauuccaugucuuucucauauuucagaggaaagauuauaaaauauaaaauuucuuagagaacaccucuuugucagagauaaacaagaacaaauacucuaaacuuaugugaacaguuuugaguuuaugaauucuagaaacuaaaaucaagaauacagaaaaaugaaaauaacauuuuacuucugcgcuucuauguuugggaaacauugcucugauaaaaaauagcugucauuaugcaguguguauauucaaauaugagauaagacuauguacacauccacuuuuguuaauaaacucaauauugaauacuuugggauguuaaauucauuggaaaaacaaaccauuuguaaccucaguuaacuuuaacaacaagcauucugagcaaaugaaaagugucuuguuuuauuuuuauauauugcuuuauuuuaaaugacuccaaauaacucaguaguuauacguaauuauacguaacucaauaauacauaauuaauaggugcuugcuauuugcaagccauauggcuuauuagagcaucagacuauucuuugaggcauccggagcaauuauuacuauucucaucauacagaugaggauaggcuuagaguguuuucugagugugaucuaaacagugcuacucaaaaugugucugcagagaagugcuugucugugaacuguuuguuacaggucagugauucaauaaggagcuugggccagaaaguguaucaguauacugcugucuucaucgagaaauuuugguuuuaaaaaaauuaucagcugaaggaaauagugugcuuagugugguaguuaauuuaucuucuugugcaaguuauuuguuaugaugggccagugaugguuuguagaacagcacuucgaguagcacucauugugaagucucuucuaaauuucagcuuuccaugcaguaucuccuuuacaagaaaaacgucuugcuauaguuagucucucucucaccacuugguaacacuccauuagcacauucagcagcuuuaucgaaauugaaucaguauacuaaauacugugcauacuaaagugugcaaugugauauuuugacauauacauauuuacauccaugaaagcaucaccacaaauuaggauaaugaacauuugaucacuccugaagcuuuccucuugguccucuauagucccugucccuuccauuucccacaaguaaccacugaucugcuuccugucacuauagaugguugcauuuuuggaaguuuaguauaaaggaaucauauaguguguaauuuuuuuuuaaucuggcuucuuucagcauuauuuugcguuucauccauguugcauguauccguaguucauuucuuuuuauuguucagaaguauuauguuguagaguucugccacaauuuauucaccuauugauggauauuuugguugguucaaguuuuaggcauuagaauacacagaaugcugcgaacuuucuugcauacaucuuugaacgaacauaugcuuuuuuuugagcaaguacuuuagaaugaaauggcuggaugauaugguagguuuauuuuuucaagauacuaccgaaauuaaaaaaaaauuuuauuugaauaauuuuugaggguacaggugguuuuugguugcacggagaaguuauuuagcggugauuucugagauuuuagugcacccaucacccgagcaguauacuguacccuaaauguaaucuuuuauccuucaugccccucccagccuuccuccccaaguccaccauguccauuauauuacucuuacgccuuuguauccucauagcuuagguuuuccauucccgaguuacuucgcuuagaauaaugacugucaagcuuuuucaaagugauuuuaacauuuugcauuuccauugcagucuaugagaguuccagcuccaucuugccaacacuuggcauugccagucuuuuuaauuucaguuauuuuaauauguauugucucacagugguuuuagcaauauuuaacaaauuucccuaaugaccaaugauguuaagcaucuuuucaugugcauauuugccauguauacaucuucagugaagugucugcucagaucuguugcccauuuuucaauuggauuuuuuguuuuccuaguauugagguuugagagcucuuuugacuuauucugaauacaaauccuuuauuagauagauacuuugcagauacuuucuucuaaucuguggcuuaucuuuuuucccccauguaaauugacccuauauuguuuuagaacaguuuuagauaaaccaaacuuuaagagauaguacagaguuucuauauuauuaacauuuuacauuaguacagugcauuuguuauaauuagugaacuaauauugacacaauguuaaguaaauucuagagucuauucaaacagaaaauuucuaaguuuuucccuaguguccuuuuccugccccaggauucuauccuagaugccguauuacauuuaguuggcauguuuuugaugaccuugacaguguugaagagugugggcgaaauacuuugugggaugucucucucuguuggaauuugucugauguuuucuucaugauuagacuuggguuauggguguugggaaggaagaucacagagauaaaaugccauuuucaucacaucaaaucaaggguacauacuacuaacgugauuuauggcuugauauuaaucuugauaccuggcugagguacagguuucuucacugugaacugacucuucauuuucuccuuuucuuacuguacuuaaggaaaucaccauaguucagcccauacuuaaggagugggaaggugugcucuccuuuuugaggcuggaauaucuacauaagucguggaauuuuguacccauuuguuucuuuuccacuauugagauuucuacuuauuauca

SEQ ID NO: 14365 - RNA, 26933 nt, Homo sapiens
uagcagagaccugaauauagacacagagguagccaugcccacuuccaagggaagaguuugcccagcaagaaaacaacaugugcaaagacagaacuguguugguguguuuaaugaaaagcagagaagccacuguggcuaaguuagaggaagcaaggggaagagggauuuaaagaguuaaggucuuagaagauagaucagguggagaacagucaggaggcaacuguaguaauucauucagugagaggugagcaugguucagaccagguugguacagguggaagcggugagaacgggucagauucuugauauauuuuuaagacagaggcaauaagauuuggugauugauuguuuguggggugugugugaaacagugaagucaaggaugacuguagauuuucuuacuuaaagcuacuaaaaaagagguugcaauuugaugagacaggaaggacauaaggaaaagcaagcuugggguagaggggaauuaggaguucuauuugaaaaauaaggcauuguaggcuuuuuucucucacaaaaaacaggaaaauaaagaaaaaggaaaauaaggcauuguacacgucagugccucaguaauauucauuggaaugaaugaauuaaacacuucuguauuuuuuuuacuuaggauuccaaacaagaggaaauggaggcuauacagcucucagaguagcaacauuaauaaugagauaaacuccaccuuaaauggguugaggaaaaaauaauaauaaugaaauaaacaacacugccuuccacagcucuuugagugcaaaaguucucauacagauuucacuggcaaagucuggggguccaggacucaaugauauuauauuuaguauaauauuguaauuuaguauaauaucauaauuuaguaaauauauacaaguguguucuuuucugagacaauucaucaaauugccuccucaaaauagcuaaugugagucaauauauucauucauucaguguacauuuauuuaguaccuauuaacucuuccucauuaaaagaccucaauuugaguccacaguacagucaucccuagguauacguggugaucgguuugguugaaaaaaauccacauauaagcggacccauguaguucaagcccaaguuguucaagggucaacuuuaaauagaauguacaggauuaagaaaaugcuauuguucuuaguuuuaaaaaaaaaaaggauauuacaugcuagacacugggcaagggaguguucauuagauccccuacugugaaaagcaauuugccuagucaagaguaucaccuugggacauuagacaaacuuugguuaaaauuucaaauuuucuacuugcuuagcuguguuacuuaggucaaguuacguccuucaugauuucuuaauuaaaugaucaaucuaauguguaaacugccaaaaaugaggugcuccaucuaugguuagauuccugcuaaugagcaaacuaucuuugguuauaauuuaacuucucagguagauuuguuuacagggaaacucauuaguuacagaacaugagcauccaaucuguaaaaccagacccuugaaaguuaauuuuauaugaaaucuguccagaaucccuuaaucacugaacaaguaaauaaaauaaaauuuugaucacacacaauucuaccucugggaguuguacacuuaccaggguaccaucauucuacgguaacugaaauuucaagcccccucauaaauuacuaaccauuauaaaauaaguaaauuauuuauuauugugucugaauuuaaaugaccuugaaaacugauaaaauuuuggucagucuuaaagaucuaagaaaaguuaaauaaucaaaauuuagcaccugauuuaaaaaaaaauuuuuuuuguuuccguagguuauuggggaagcuggugguguuugguuacaugaguaaguucuuuuguggugauuugugagauuucauugcacccauugcccaagcaguauacacugaacccuauuuguagucuuugcucccucacccccuucccacccuuucccccugauuccccaaguccauugugucauucuuauugcgggaagucaagaaccccaaacggagggaccagcugaagcugcagcagaagaacauaaauugugaagauuucauggacauuuauuaguucccagaauuaauacuuuuauaauuucuuaugccugucuuacuuuaaucucuuaaucccaucaucuucauaagcugaggauguguguugccucaggacccugugaugauugcauuaacgguacaaauuguguguaaaacauauguguuugaacaauaugaaacugauuguaaaacauggguguuugaacaauaugaaaucagugcacccugaaaaagaacagaauaacagugauuuucagggaacgagggaggauaaaggucugacugccuguggggucaggcagaauacagccauauuuuucuuucugcagaaagcgaguaggagaaauaucacugaauucuuuucucagcaaggaauaaaccuggggaaggaaugcauucuuggggggaggucuauagauggccacucugggagugucugucuuaugcgguugagauaagggcugaaauacgcccuggucucuugcaguacccucaggcuuacugggauuggaaaauuccagccugguaaauucuagucagaccaguucucugcuuucgaacccuguuuccuguuaagauguuuaucaagacaaugcaugcacagugggacauagaccuccaucaguauuucuaauuuugccuugccuugugaucuuuauugcccguugaagcauguaauccuugugaccuacucccuguuuguacacccccucccuuucuaaaaucccuaauaaaaacuugcugauuuugcggcucggcgucaccaucaugguccuacuaauaugugauggcacucccggaggcccagcuguaaaauuucucucuuuguacucuuuuucuuuauuucucagaccagccaacacuuagggaaaauagaaagaaccuacguugaaauaugggggcugguucccccaaaacauucuuaugcuuuugcauccucauagcuuagcucccacuuacgagcgagaauauacaauauuugguuucccauuccugaguuacuucacuuagaauaauagucacuaaucucaucuagguagccaugaaugucauuaauucauuccuuuuuaugguugaguaguauuccauuauauauauauacauguauauacaccaugaucucuuuauccacucauugauucaugggcauuuggacugauucuauguuuuuugcaauugcaaauugugcugcuauaagcaugagugugcaaguauccuuuuuguauaacaacuucuuuuccccuggguagauaccgaguacugggauugcuggaucaaauggcaguucuacuuuuauuucuuuaaggaaucuccacacugucuuccauagugauugcacuaauuuacauucccaccagcaguguagaaauguucccucuucaccgcauccaugcaaacaucuacuauuuucugauauuuugauuauggccauucuugcaggaguaagaugguauugcauuucgcauugugguuuugauuugcauuucccugaucauucgugauguugagcauuuuuucauauguuuguuugccauuuguauaucuucuuuugagaauugucuauucauguucuuagcccacuuuuugauggaauuguuuguuuuuuucuugcugauuuguuugacuucauuguagauucuggauauuaguccuuugucagauguauagauugugaagauuuccucccacucuguggguugucuguuuacucugcugacuguuccuuuugccagguaaaagcacuuuaguuuaauuaagucccaacuauuuaucuuuguuuuuauugcauuugcuuuuaaguucuuggucaugaaaacucugccuaagccaaugucuagaaggauuuuuucaauguuaucuucuagaauuuguauaguuucaggucuuagguuuaagucuuuaauccaucuugaguugauuuuuauauaaggugggagaugaggaugaacuuuuauucuccuacauguggcuagccaauuauccaagcaccauuuguugaaaaggaugcccuuuccccacuuuauguuuuuguuugcuuuguugaagaucaguuggcugcaaguauuuaggcuuauuucuggguuuucuauucuguuccauuggucuaugugccuauuuuuaugccaguaucaugcuguuuuggugacuauggccuuauaguauaguuugaaaucagguaaugugaugccucuagacuugcucuuuuugcuuagucuugcuuuggcuauaagggcucuuuuuugguuccauaugaauuuuagaauuuuuuuauaguucuaugaagaaugauggugguauuuugaugggaauugcauuaaauuuguagcuugcuuuugauaguguggucauuuucacaauauugauucuacccauccaugagcaugggauguguuuccauuuguuugugucaucuaugauuucuuucaacaguguuuuguaguuuuccuuguagaguucuuucaacucuuugguuagguauauuccuaaguauuuugguuuuuuugcagcuauuguaaaaaaaaguuugaguucuugauuugauucucagcuugguugcuguuggugcauagcagagcuacugauuuguguacauuaauuuuguauccggcaauuuugcugaauucuuuuaucaguucuaugaguuuucuggaggagucuuuaggauuuucuagguaaacaaucauaccaucagcaaacagugacaguuugacuucaucuuuacugauuuggaugccauuuauuauuuauuuauuuauuuauuuauuuauuuauuuagucugauugcucuggcuaggaguuccagugcuauguugaagaggaguggugagagugggcauccuugucuuguuccaguucucagagggaauacuuucaacuuuuccccauucaguauuauguuggcuguggguuugucauagauggcuuuuauuacauugagguauuucccuuguaugcugauuuugcugagaguuuuaaucauaaaaggauguuggauuuuguugaaugcuuuuucugcaucuauuaagaugaucaugugauuuuuguucuuaauucucuuuaugugguguaucacauuuauugacuugcauauguuaaaccaucccuacaucccugguaugaaaccaacuugaucaggguggauuaucuuuuucauauguuguuggauucgguuagcuaguauuuuguuaauuuuagcaucuacguucaucagggauauuggucuguaguuuucuuuuuugguuauauccuuuccugguuuugguauuagguugaugcuggcuacauagaaugauuuagggaggguucccucauucucuaucuuguggaauagugucaguagaauugguaccaauucuuugaauguuugguaggaaucuucugugaaucugucugguucuggacuuuuuuguuguugguaauuuuuaaguuaccauuucaaucucacugcuuguuauuggucuguucagguuaucuaauucuuccugauuuaagcuagcaggguucugucuuuccaggaauuuauccaucucuucuagguauccugguuuauguguguaaaggcguucauaguagccucgaauaaucuuuuguauuucugugaugucaguuguaauaucucucauuucauuucuuauugagcuuuuuuggauuuucucucuucuuuucuugguuaaucuugcucauggucuaucaauuuuauuuauuuuuucaaagaaucaguuuuuuguuucauuuaucuuuuguauuggggguucaauuucauuuauuuaugcucugaucuugcuuauuuccuuacuucugcugguuuuggguuugguuuuuuucuuguuucucuaguuccuugaggugugaccuuagauugucuguuugugcucuuucagacuuucugauguguuuggggcuuugaauuuccuguuagcaccaccuuugcuguaucccagauguuuugauagauugugucacuauugucguucaguucaaagaauuuucaaauuuccaucuugauuucacuuuugacccagugaucauucaggagcagguuauuuaauuuccaugauuugcaugguuuugaagguuucuuuuggaguugauuuccgguuuuguuucacuguggucugagagugccugauauaauuucaauuuucuuaaauuuauugaggcucauuuuguggccuaucauauugucuaucuuggagaaaguuccaugcacugucaaauagaauguauauucugcaguuguuggaaggaauguucuguauauaucuguuaaguccauuugugccaggguauaguuuaaauccauuguuucuuuguugacuuucugucuugaugaccugucuagugcugucaguggaguacugaagucucccacuacuaugguguugcugucuaucucauuucuuaagucuauuaguaauugcuuuauaaauuugggagcuccaguguuaggcgcauauauguuuaggauugugauaguuuccuguuggacaaggccuuuuaucauuauauaauguuccucuuugucuuuuuaacugcuguugcuuuaaaguuuguuuuaucugauguaagaauccugccugcuuuuggugucauuuugcaugaaacgucuuuuuccaccccuuuaucuuaaguuuaugugaguccuuauguguuaggugagucuccugaaggcaacagacaguugguuggugaauucuuauccauucuguaauucuuuaucuuuuaaguggagcauuuuggccauuuacauucaauguuaguauugagaugugaggugccauuccauucauuguacuacuuguugcccauauacuuugguuuuuuguuuuuuaaauuguauuuuuguuuuauagguucugugagauauaugcuuuaaagagguucuguuugauguguucccaggauuuguuucaauauuuagagcucuuuuuagcaguucuuguaguggugacuugguaguggugaauucuuucagcuuuuguuuaucugaaaaagacuguaucuuuccuucauauaugaagcuuggcuucacuggauacacaauuguuggcugauaauuguuuuguuugaggaggcugaagauagauagaaucccuucuagcuuguacaguuucugcugagaaaucugcuauuaaucugauaggcuuuccuuuauaggcuaccuggugcuuuugucucacagcucuuaagauucuuuccuuugucuuaauuuuagauaaccugaugacaaugugccuaggugaugaucuuuuugugaugaauuuccuagguguucuuugugcuucuuguauuuggaugucuaggucucuagcaaggccauggaaauuuuccuagauucuucucccaaauauguuuuccaaacuuuuagaauucuuagauuugguugguuaacauaaugccagacuuguuggaggcuuuguucauauuuucuuauucuuuuuugucuuuguuggauuggauuaaugcaaagacccugucuucaagcucuaaauuucuuucuucuacuuguuuaauuauguugcugagauuuuccagagcauuuugcauugcucuaaguguguccauuguuuccugaaguuuugauugcuuuuuauucuugcuaucuauuucauuauuucucccuucacuucuuguaucauuuuuuuuuauuuccuuaaauugggcuucaucuuucuguggugucucccugauuagcuuaauaacuaacccccugaauucauuuucagguaaaucagggguucuucucagcuuggauccauugcuggugagcuagugugauuuuugggggguguuaaagaacauuguuuuuuuauauuaccagaguugguuuucugguuccuucucauuuggguuggcucuaucaaaggaaaggucuagggcugaaggcuguuguucagauucuuuugccccacaggguguucccuugauguaguacucucacccuuuuccuauggauguagcuuccugagagccaagcuguagugauuauuaucucucuucuggaucuagccacccagcaagucuaccaggcucugggcugguacuagggguugucugcacagaguccuguuacauaaaccaucugugggucucucaucuggggauaccaguacaguauuuggaguguuuccuggguccugaaggagcaauccacuuccuucagagaggucucuggguacucccagguuuccugauuuauuccuacagucauucuggugcaaaaauucaugacacgagccuccacacacugcucugucuaucugagucagagcugcaaucuaguccugccucccauccaccaugaucccuccucuuagggaguaaguccuccagcccucagcaugauugggguggccucagagacuugcaacugauguugauagcuccuuggaauauuggaaauuuaguggacuugagauuugcauccugguuuagauuuugcauccugguuugcuaauuuagauuugcauccugguuugcuaauuucugacagcacuguagccuugggaaaauuauuuaacugcccugaaccuuguuguugccauuuuuuauuagcauaaugggaauagauucuucuaaucaagguaugguaaauagaaaugauugacauaaaacucuucacaccaggccuggcacaaauugaguccuuaauuacaguaaauauuaagauuauuauuauuuuccugugagauaguuccuggagcuuauuauuaaauaauucauuguaauuguauuaaguuucugguuaaauaacauaaucaaauacaaagggcucaaagaaauccagaguaaggaaaaaaaauuauuggggaagagaguaugguuguaccugaaaauuuuaagauuuuaagucuuuuaggggcugggcacagugacucaugccuguaauccuagcacuuugggaggccgaggugaguggaucaccugaggucaggaguuugagaucagccuggccaacauggugaaaccugcaucccuacgaaaauuuaaaaaauuagcugggcuuggcacacaucuguagucccccagcuacucaggaggcugaggcaggagaaucacuugaacccaggagguggagguugcagugagccaagauugugccacuugacuccagccugggcaacagagugagauucugucugaaaaaaaacaaaaacuuagguaaauaugaaaucacgcuaaccuauauaauguugugccuuaaauauaccugaagacuuuugcagaguccauaguggaaauauuguugcuuauuacccuuccccaaaacuggcuuucaauuuagcuuucucagacaugacaaauuaucuaugugauauaagccuccuaacuuuuguugcugcugccacuucuuccacaggccuaccccuaacauuaacagaacuggggcaagaaaacaaauggauaucuauguacuacauuacuaaauauuuaaaaucaaacuaaugagcuguuaaaaugaguuuuuguccucaccuugaaaaacaaaccuucauaaccaaaauauuaaaaaucuauaaagcaaugauuuuaauaugauuaaaaccuagcaaaaugucaaagacaacuggauuuaauuauuauuguacaugucugguuaggucuguugaugggucagggguacucauauuaguaauaaaauagagauauacauaaauguaaguuauuauguauuauauauaauuuacuuuucugccuucucagaaaaauacuaaauauauugugauaaucaagauuuuacauuauuuggugguagugcuguuucacaacgcuuugagucauuacagauuguaguaauuuuuauaaauuccuacuuguacaaacuuugcauugucucaacacaauuuauaaaaugagacagcuucacaaauaaaucaugaauuuuaaauauuauauucaaacauugcagugggcucccacaaaucaacaauagaugcuucuugacuuaaaaugugauuaugucccaauaaaccuaucauaaauugaaauaaucauaaguugaaaaggcauuuaauaccccaauacacccaccauaaaguagaaaaaucauaagaugaaccaucauaaguaaaggaacaucuguauacuguagucuaaguuuuugcucaugaaaaaguagcuugacuucaaacuggacaaaaugcacaaaacaacaacagaaguauggcauuagagaaaugggggaaaaaugaguugaacccuguccaaagaccauuuuuaaucugugacaugagaaaaauaaaccaagcacagcccagcagucuuguuuagcuaaggagucagaaauaugaccuuggagauugaaguagccagaauuuucagagcaaaguacuagagaagaggaagcaauguagagaaagaaccagaaaucugcagagaggucuuuuccagucuuuguggaaugcuaaucuggacaugcauaaaugaaaauuccacagacuggacaaagaauaacuuccaagguauuaacaguuaaauaaucccaaaacucacacagaccuuggagauauucaaguuacuaccuguagacuggagagauucagugaagaccucaggcauuaauaaugcuuacauggacuuggcacaguggcucaugccuuuaaucccagcacuuugguaggcugagaugggcagaucauuugaggucaagaguucgagaccagccugaccaacauggugaaaacccgucucuacuaaaaauacaaaaaaaauuagcugggcaagguggcacaugccugcagucccagcuacucaggaggcugaggcaagagaaucgcuugaaccucagagguggaaguugcagugagcagagaucacacugcugcacuccaguugggcaacagagcgagacuccaucucaaaaauaaauaaauaaauaaaaaauuuaaaugcuuacaugaaaagccacacuucaauagcagggcuaaccuaacucuagguuaaaggauacaguacccccuuauuugugguuuuacuuucaacaacuuuauuuacuugugguugagcauggucuuaaaauauuuaaugcaaaauuccaaaaauaaacaauucauaaguuugacauauuaucagaaggucaauaguagccugaugcuauuucacaaugccaagucauucaccuccuucgucucaucacauaggcauuguaucaucucauaucaucacaaaaaaggugaauauaguauaagauguuuugagagaaagagagagagaccacauucacauaacuuuucuuaaaguauauuguuauaauuguucaauuuuauuaucagguguuaaucucuuuccaugccuaauuuauaaauugaauuuuaucauaggcaaaaauacauaguguauauaaaauuugguacuguccaugguuucaggcacccccugggggucuuggaacauauucccugcagauaaaagagagcuaugauacuuucaaucugccauauaagucuuaaaagaagcucauaaaggaucaaacuaauuugcaaauaauucaaauuccuuccccucuuuuaaggaggcaauaaaauccaaacacuucacaauauggacuaauaaugucuggcauucaaucagaaauuacuagacacauaaagaagcaggaaaaugugacccauaaucaggaaaaaaaucagucaauagcugcauacccagaagugacagaaaucauggcauaugucugggaacaguagcucacaccuguaaucacagcacuuugggaggccgaggcagguggaucaccugaggucaggaguuugaaaccagccuggccaaaauggugaaaucccgucucuacuaaaacuucaaaaauuagccaggugugguggcacucgccuguagucccggcuacccaggaggcugagguaggagaaucacuugaacccaggaggcagagguuguagugagccaagaucaugcuccugcacucuccagccuggugacagagagagauuucauuucaaaacuaauaauaauaauaauggauuagcaaacaaggacauuaaaauauguauuauaaauaugcucaagaauucaaaauaaaucauuuauauaaucaacaaacaaauuuaaaacacaggaaaaaauaacagaacuucuagaaauuaaaauaucugaaauuaaaaauuuauuagaugucuguucaguagaauagaaaauguagaugauaaaaucagugaaugugaagacauagcaauugaagcugccaaaauaaagcaaaaagagauaaaacauuggaaucuuaguaacucauggaaccauauuaauuggaucaacauguguaauugguacccuagaagcaaggagguaaaaacaaauauuugaagaaauaauguccaauaauuuuccaaauuugaugaaaaguauaaaauuacauauucaagaauuucaaugaaccccaagcagaauaaaaacaaauaaaaucacuucaaagcaaauaaaagcccaauuacuaacaauaaguguuuuuuuuuuuugagacagaguuucgcucuuguugcccaggcuggagugcaauggcaugaucucggcucaccgcaaccuccgccucccaguuucaagcgauucucaugccucagccucccaaguaggugggauuacaggcaugugccaccaccccagcuaauuuuguauuuuuaguagauacggggcuucuccagauugguuaggcuggucuugaacucccgaccucaggugaucugcccaccucagccucccaaagugcugugaacacaggugugagccaccgugcccagcaacaauaagugauuuuuuaaaaaaauuaaacagccagagggagaaaguaggcacauuacauacagugggggaagcgggggggugggaaggauaaucacagacuuguaaaugagaaacaauguaagcuuagaauauaacaaaguaguauuuuuaaugugcugaaaguaaagaaauacuguuaauuuauacuuuuguaccuagggaaaauagcuuuugaaaauaaaggcaaaauacaucuuuuucaaacaaacaaaaacugggagaacuuauugccagcaaaucuacauuauaggaaauaucaaagguaccaaucuuuagccuugaaucuaaccacaucaauuuuuauaaaauauguacucagacuaaaaggcuaauuaaaagcaaagauuuucagauugguuacaaaaguaaaaugcaacuaaaugucauuuaugagaaauaagcuuuaaauaaaaagacacagauagguuagauguaaagggaaaaaaaaggcaugucauaauaauaaauguuaauaggcugggcacgguggcucaggccuguaaucccagcacuuugaaaggccaaagcagguggaucucuugaggucaggaguucgagaccagccuguucaccaacauguugaaaccccaucucuacuaaacauacaaaaauuagccaggugugguggcaugcaccuguaaucccagcuacuugggaggcugagguaagagaaucacuugaaucugggagguggagguugcagugagccaaaauugcaccacugcacuccagccugggugacagagcaagacucuguuuaaaaaaaugcuaauaacacagcugauuuagcuauauuaauaucagacaaaguaaauuccaaaucagaaaguauuaccagaauaaacagggacauuuaauaaugauaaaauugucuauuaauuaaggagacauaauaauccuacuuguguuuguaucuaaugaccaaguuaaacaaauuuaaaaauuggcaauaaacuacauuuagagcaagcaacuuaacccaauugacauuucuaaaacacuacacccagcaacugcagaauacacauucuuuucuauuuaacuuggaacauccaccaagacagaucauaugcugggccauaaaccaaaucucaacacauuucaaagaacuauuauuguucagaauaugcucuguguccaaaagaggauuaaacugauaaccaauaacagaaggauaucuggaaaagcugcaguuaucuggaaaucaaggaacacauuccuucauaacccaugggucaaagaagaaauugcaaagaaaacuuuaaaauauuuugaacuaaaugauaauaaacauuauuaauaaacacaauauaucaaaauuugugggauggagcuaaagcaguauuuggaggcaaauguuagcuuuaaacauuuguagugaaagagaauaaagguuuaaaaucaaagucuaaacuuucaccuuagaaacuggaaaaaggauagcaaauuaaacuccaaguagaaggaaggagguaauaaaaauaagaguagauaucaauuaaaauuuaaaaauagguaaggaaaaucaauaaagguaagagcuaguucuuauaaagauucauaaaauugaaaaccuccuaacuagacugauugagaaaaagauuaccaaguauaagcuagguacaguacuaggcuggacagcaacauuuuugcaaaaagccucaagccccacucuguaaagacagaccacaacacuguaguagagaaaguuuaauagauacaagacuagucaugccacaugggaaauggaguuuguacucaaaugaucuccuccaaaggucuuaggucagggguuuuucaaaggcaguuugggggaagggaggggguggccagguaauaggugcuugcuguugauugacugggguggagaugaaauaggcgucaaagcugcccuucugugggcugaauugcuucugggugggaccauaggagcuggguuggcugguccagguggagccgugggugucagacaugcaaaaaaaaaaaaaaaacaaaaacaaaaaacccugaaaagauaucucaaaaggccaguguuagguucuacaauauugauguuauuugcaggaguaauuggggaagcucauaucuuauaaccuccggaauaauggcuggcaaugguuuaugucugcaccuuagcaggacucaggcuccccuccuccccacagccugauggccucccauuagcuuuauaaaagugaaugaguuuuaggauaagacuuauuaucauuuaaaccauagccuaaauaucuuucaaaguuagcuugguccugugaacccugaaaaucugagacaugucucaguuaauuuacaaaauuuauuuugccaagguugagaacacaaccccaugacacagccucaggagguccugaugacaugugcccaagguggucagagcaucacuggguuuuauacauucuagggacacaugagacaucaaucaacauauguaaggugaacacugguucugucuggaaaggcaggauaacucaaagcaaaagcaggaagauuggaagcagggagggggcuuucaggucauagguagauaagagacaaauaguugcauuauuuugaguuucugauuaaccucuccaaaggaggcaaucagauaugcauuuaucccagugagcagagggcugacuuugaauagaaugggaggcaguuuggcccuaagcaguuaccaacuuaacuuuuuucuuuagcuuagugacuuaggagccccaagauauauuuuccuuucacauuuuccccccuuuucugugggcagcaagucacccaggugccgaggcaagagaccaaggacacgagcuguuccaguauaauaaaauauaaaauaagaauaguuauaccagauauagaucuuagauaugauuauauaugaauauuauuaaucauuaguuuguagcaauuacucuuuauuccaauauuauaacaacccucgcucuauaaucauaaccuaggaaaaaccaggccauacagagauaggagcugaggagacauugggagaagugaccagaagacaagagugugaaccuucuguuaugcccagacagggccaccagagggcuccuuggucuagcaguaaugccagcaucugggaagaugcccuuugccaaguggaccguggucuagugguagcauuagugucaaggaaaaacaccugcuacuuagcagaccaggaaagggagucucccuuuccccaggggaguuuagaaaagacucuauccuccaccucuuguggaaggccugacauuagucaggcccgcccgcaguuauccagaggccuaaccaucucucugugaugcugugcuucaguggucaugcuucuaguccgccuucauguuccaucuuguacaccuggcucugccguuuaguuagcaguagcaaauuagugaaaguacuaagucucugagaagcagaaauaauaauguaagcuguuucucucuuucuccucucucucucugccucagcugccaggcaggaaagggcccccuguccaguggacacgugacccauguggccuuaccuaucauuggagauggcucacacuccuuacccugccccuuugucuuguauccaauaaauaucagcgcagccuggcauucagggccacuaccggucuccgcgucuuugugguaguggucccccaggcccagcugucuuuuuuuaaucucuuugucuugugccuuuauuucuacacucucucaucucugcacacgaggagaaaacccaccgacccuguggggcuggacccuacacuuuucuuuuaaaaaauccuuuggagaaagcauuuuagaagaaaaugcgucucuagucugagguuuuguccgaucucucauggcuaggaugguuuauuccuagauggguaggucccaaguuauuuaggaaggcucacuuuuagcaggcuguaaagucucauguccuauaaagagaaaauaggaggaggaagggagaaaaacaagaacaaacaaaggaacaauccuggaaaaugcauauaggccacacuacucugaaguccacauaucaauagacaggcaguaaguggcuuauguauguaaauagguuguuguuauuuucuucugaaguuuaaguugucuagcuucuguucacagggcuuuaugaaugcacagcuuaguuuucagugacuccaaauuaggauaaaugggggaguggggguggggguaaagaaggaaaagaaacugaaagcaauauuuugaaggcuuguagccaagaaaaauuagaacucaguccaaacuguagaaaauaauaaaaguugaaaaacauuaggcaagacuggaaucuaagaacagguguacuauaguuuuugaaacauaauuuuuccucuccaguuucccauuuuuacuaaagacaaaucgugguuggacugauuugcuuuuuuauuauuuauuuauuuauuuauuuauuuauuugagauggagucuugcucuuguugccaggauggagugcagaggugugaucucagcucacugcaaccuccgccuccgagguucaagcaauuauccugccucggccuccugaguagcugggauuacaggcaugugccaccacgccuggcuaauuuuuguauuuuuaguagagaugggguuucuccaucuuggccaggcuggucucgaacuccugaacucaugauccauccaccuuggacuuccaaagugcugggauuacaggugugagccaccacgcccggcccugacuugcuuuauuauacuuggccugauuauuuguuuacagugcaacaaaaauaauuuuuuuacauaggcuuuuaaauuggcuuugaugguacuuuauuccauagaagaaaucucacauaagacuuuuuuaaagucaaacccagccauggauuuguaccaucaaauaccuaugaguuggguaaauuccuuuccuguugagguuccaagauaaaccuggggcuccuggaccugucagaaagugacauucuuuacuuaccacaggucaggaacccuguacagggacuguauagacaaaaguaugaggccaguuuucccaaggggcuuguauugauuccauaagccaaguuugauuccuuaaagcaaagcacaccaucccaguaaagagccucgguaaaguaacuaguuucuccaauuguguccuguuacaaaugaaaacagauucuuauugcauuuaugcaaauaacuguauugucguaaguuaagaauacucacaaauaguuuccaaauucuguagaaaucagguacagagaaagaaauaugcuccaaauuuuauucauaggaguauacuuacucaauuguuagaaucuguaaauagcuuaaacauuuucuugacuuugaaaaacaaaagaaucagcaccauuuuaggcaaaaaguuaaacagauuacuucagacuucuauuaguuuaauccaugaaguuaauuccuauucugcuugauauucaugaauauuuuaucucuccaugaguccugaaaguuuuucaucuauucugaugucacaaucuccaauguuaucagaaaccuguguucaagagcaccuguuagaguuuuauaaaacuaccuucuaaagagaaccaaaaaaagacaauaauugucuguggaugacaaaaaguuuuagggcagccauagucaaagacacaauugaugaggaaauuuguuaccucuguugcacacaauaauuuaacauaacaauuauaauuauuacugauaauguacacuaagucguaucagaauuauagaaguuucccauaauuuuagaauacauaccaauaacauuuuuauacaaauacagcccaaagaaaaccaaacaccauuucuuauuugaugguguuuccuguauaauuuuuauaccaaauaaccaaauaugucauuuuuugacauuagggaaccuauuaauaauaucuuaaaggauuaauuaguucaaaaaaagacauaauuuuuuuuugagacagagucucgcucugucacccaggcuggagugcaguggcaugaucucagcucacugcaaccuccaucuccuggguucaagugauucuccugccucagccuccccaguaguugugauuacaggugugugccaccaugcccagcuaauuuuuguauuuuuugguagagacagaguuucaccauguuggccaggcuggucucaaacucuugaccucaaacgauccucccuccuuggccucccaaaaugcuugaauuacagguaugugcccagccaaaaaaaagacauaauuuauaauuuugauuuuggaaaguuugucaaauaucaaagguuuacacuugauaucacaaaauaggauuacagguuauuguaaaauaagucauucauuuaaccagagugauaacucaaggguuugaaaaaaaaaaagugaaaaccuuaauucuuuaagagaggacacuuaacuuucuaaacaauuagcucuaauaaaaacagcaugaagccaaauaaauuuguuuuucaaaauuuuauaaauaaucuauaaaaucuuaauauuggucauaaaauuuaacuuccauaagccuuuuauaaccuuuauaaccuuuauuaaggaguugguuaaugcuucaagaaaaucuuguuaaucugacacagcgguccauaugcuggucuugaauaagagugucuuugacauuacugguuaauuuauagagaaauugaacuuauuuuaucucuuaaaaucagcccuuacaaucccacaugcccaccgcuuccacaauagucccuggaauuugaggcguugaauggcuuuaacuucugaccuugugucucaggaaugcaguuuauuuugauuggcauauucugaugccaaucaagagggccugaagaugagguuuuaauugcugucgguguuuuaagacuuagcaggacuugguguccuuuuuagacccaggagucaaagcccuguaacuuaaugucacaaguacuuuaaaaucacauacagaaagauacauggauguaauaaccuuaacuuaaaaaaaaaaauuuaaucucaguuuuuuuccuaagcaaaucaaaacuuaauaauaauggcauaggaauuauuuuuauaaaaccuaaaaucuguuaggccaguuaccaaaaggcaaaagaaaaacccuucugcaguguacagaacauuauguuggaagaaaacauuuccuucagaucuuuaagaauauuguuagcaucaggccacaacaaacagaaguugaggaaacaaaaacuuauaugaguugaaggaaaccauuauuauuucacuccuuuuaaaaggggagagaaaaccaaaaacagcaagaugcaauagaaguuuaacuuuggguuaagauauaaauaaaaucucuuauaauuuauuaagaguaaaucaauacccuaaggaacuuuuauuguucuaaucaauucuuuacuauauaaauguuuuuggguuuuuuuacaucaaaccaagucucuggaaagaccauuguaauuucccuuuaacuacagacaacuugaucauauaaguuuugggguuuuuuuuaaauaaauucuuucauugugacuuacccagaccauucaugacaugcuuggacuuucugguuuguccugaacaucccuuucuuaaacaaccagucauuuuauucuaggucuaaauuuaccauguaauauucuuucucauauaaaauuauuucucuuuaagcuuucuuaccaaaauauaccucuuuauuucuauaaguuucuuuacaucucucuuauuuccuggcuccucuuaccuuguuuuguacacaaccuuuaagcuuugaauuagaaaaaaauuguccaccuuuuuuaaaaggacacuuuuuucuagaaagaauguuuuccuacaauauauuuuuauuggaaaauaccuaaauaaugaaauauuuuaguauaacuuuagauucuaaauuaugacaaguuugccuacaaguauuuaucccauuacaucugucuauuuuauuuuauucauuuaccuacauuauuuaugaaaacugugauagucaucaauuaaaguuaugaaacucaccuuugcaaaauucugagacagugaaaaagacaggaccuaacugacuccaucuugcuucuaaccuccaagcuguccuugcuuauucccaaacuuuagaaggaauuuaauuuauauuuuagcuuugaaacaaagacaguaauaguccuuucccccaaacaaacuuccuugcugccuguggauuacacugccuaaugccacaauaucagaaguuaugguaauuuuacuaaauaauucaaaauauagcuguuuucauuaaaccaauagcaaugucuuauuuauuaaagauuaugaaagcaaucuugggcuggguuuauagguuuguaaccccuaugccaaauuuugacaccuuauaguauuuggcagggauaaguaugaaauugcuugauuaauaaaugcaaacaaaaauguaugcuggcaaugcuuaagacauuucuaauauuacuuuaucaguaauuuuaaagcuagcuuauuuaguaaagauuuuacagcugggcacaguggcucacaccuguaaucccagcacuuugggaggccuagguggguggaucaugaggucaggagaucgagaccagccuggcuaacauggugaaaccccaucucuaccagaaauacgaaaaauuagccgaggguggugcugugcaccuguaaucccagcuacuccgaagcugaggcaggagaaucacuugaacccgggaagcagagguugcagugagcugauaucaugccacugcacuccagccugggcaacagagccagagucugucucaaaaaaaaaaaaaaaaaggacuuuacuuaaaucauguaaacuugaaaaagcauuggacagccacgcacaguggcucaugcuauagucucagcacuuugggaggccaaggugggcagaucaccugaggucaggaauucaagaccacccugaccaacauggcaaaaccccaucucuacuaaaaauacaaaaauuagccaugugugguggugcuugccuguaaugccaacuacaugggaggcugaggcaggagaauugcuuaaacccaagagacagagguuguauucagccaagaucaugccauugcacuccagccugggcgacaggagcgaagcuccaucucaaaaaaagaaaaagaaaaagcauucgacuagucuucccuuuuuuuuaagaagguauuugauuuaagugcuucuauuuuucuuuaagccaauuaauuagagcucuuuuauauauuuucaguagugaaacauuauguacucaacacacaaauacauagacauauuaggcaugccgauagaaguacaucuuauagauucauaaagaccuuuuuuuuucuaucuuagacuuucagauauuugauaaccuguuucacaacacuaggcaguugucagcuaaauagccauaaauuuagauauuaaaugaaacaacacaggugaaaaucaaauagcaaaauuuacaucauaagguauauaaagaaaaagucugguacugcuagagggagauugaugauggaugccaaaucaaacauaaaauuauagaaaucuaucauaggauuguauaaggagaccaauuuuauuuagauagggacuauuuauuuuuuaacuggaucucuaagcucugggcagagcccacacugaauccugggucuucaaaaagagaauuauuuuaagguuagaccacaugaugcuuuuacagugcacuuuaaaaacaaagacauuucuaagugccuaaacuauacucuuccuuaaaaaccccagagaagccucgguuguguuaccagggguccuugcucacagagcucccaagaugguggcgagccacuuccaagaugguggugggucgcuuccaagaugguggcaagccucguguucucugaccugggguucuuggccucacggauuccaaggaauggaaucuuaggccauguggugaguguuauagcucuauuagaagccgugggucauggaagagaaccguagaacccagugacuaguguucagcucgauuaggaugaacccaggcacuuagccgugcaggaacaauggcaagccuuuagcccaaucgggacuggcaaugggcaccuugcuggaucaggagcacagcacacaccuugccggauccagagggauggaagucagcagcaggucugcgauggcagcaaacgacaguggugggcagugguggacggcaagcgaaagcucagcucgagcuguaacaaacauggaccagaagagugcaguugcaagauuuaauagagugaaacacagugaaaacagagcucccguacaaagggaggggacccaaaggggguugccauugcuggcucgaaugccuggguuuauauccugaucauugucccuccugcugugcucucaggcagcagauggcuauuucuuuaccuccuguuuuugccuaauuagcauuuuagugagcucuccuuacuaucugauuggucgggugugagcuaaguugcaagucccauguuuaaagguggaagcggucacuuucccagcuaggcuuggggauuccuuagucggccuaggaaauccagcuagucgugucucucaguugcaauagauauuaaugaagaacacagaauucagucaacuaagaagaaaaaaaauuacuaaaaaaaaaaaagacaagguccugggagagaaaaaaaacaaaacaaaacaugaaggucuuuuaaauacacacaugcacacaugcacacacaugcacacauacacacacacacacacacaucuuggauguuagcuuuuaauuaagcugacuuuuaaccauugaguuccuuuuuuaaaaaaaucuuuuaaaaucucauuacuauugucagugaaaagaguugaacucuaaaauauuugaagagcuuuauucugagccaaauaugacugaucauggcgcaugacacagcccucaggagguccugagaacgugugcccaagguggucagggugaggcuugguuuuacacguuuuagagaggcacaagacaucaauuaaauacauuuaagaaauauauugguuugguccagaaaggugggacaauuuaaaaccagguggguguggggggcuuccaggcuguaggcaaauuuaaacauuuucugguugacaauugguugaguuugccuaaagacacgggauucauagaaagggaauguucggauuaagauaaagauuguggagaccaaaguucuuuugaagucuuaauaguggcggcccuuaaagacaauagaugaaaauguuuccuauucagaucuuaguuaaucgcuuuaggauugggaggaucuggaagaaaaagaucuagcuauguuaacagagauucuuuaaagaugcaaauucuccccuacaaagaacagcuuugcagggccacuucaagauauggcaaagaaacauguuuuaggguaaaauaauuuugcuuuucuuccuugucucauaaugcuaugucagagucaaguuggaaaauaacucaugauauauuggcuuaaauaaaacccuucugaugagaauuuaugauuuguagggcaugacuccccagacaccuuagauaggaauuugggcaagauaaaaaaaucaguuuaguccuuacuauauuucagcuaggacaaauugcugcuauuucagaaguaccaaguaucaaaccagaaagggcuugauuuaggaaccaaacccagggcuguuuugguaggaaaaaaaacaaaggcacaaccuuagcuaucgggugggaccuuagcagugugggaggacagccauugcuuucaguuuggccuaacaaaaagggugguguuauguaaacaaagccccuuuaguagucaaaaucaaaaauccuuccucuuuuuccuuuugcuggccauuuuccuccccaccacaccaucuuuuuuuuuuuuuuuuuuuuuuuuuuuuuuuuuagaauuuagccacuucucaggccuucuuccccauaauuuggaacuuuccuuuggauuugaucaaguuggauagaguugaucaaacccugaucaaguuggauagaguugaucaaacccaaugggaaaaagaccaaaacaacaauaaaaaacagacaacaacaacaaaaaacaguuaggcaaaacaaacaauggcacaauuuauaugauaacugagugcucuaaugguaaggagaaauuaagaccaguuggucguuaaucuuaacuuuaaccaagacaaaccccaauucaguuacuuaccuagggacgagucucuggcuauagacugcucucuaccauucaagaagcaggaaaaacaaaacaaaacaaaaaaaaaaacacuccuuuucccuguuggaagugagccaaacuccaacgucauggaaacagaaaauuugucuuucuugauagaagcaaguaaaacuccaaaaaagagaaguuguacagcaaaauaaacuuuagaucuugaccaaauuuggggaaaucagggauucucuggagggggugcucucagaccucagcaaauuguccuauugguuugagcuguaaaauuagcucaugcugguaccaagcacugauaagagguuugccaaaggucaggggcaucuccacucagaaucccucugugguuaccaaaaugugaaccccaaaaauuugagacaggucucagugaauuuacaguuuauuuugccaagguugauaacacaaccccaugacacagccucaggagguccugaugacaugugcccaagguggucagagcacaguuggguuuuauacauucuagggacacaugagacaucaaucaacauaugcaagaugaacauugguucugucuggaaagacgggacaacucaaagcaaaggcaggaauacuggaaccagggacggggcuuuccaggucauagguagauaagagacaaaugguugcauuauuuugaguuucugacuagccucuccaaaggaggcgaucagauaugucagugagcagaggugugaguuugaauagaaugggaggcagguuggcccuaagcaguuccaagcuucacuuuucccuuuagcuuagugauuugggggcuccacuauugauuuucuuucacaacucaauaacccaggaauaauuaagggaaaggcaagauggaggaugaauuacucagcuuacuguuaaaauuuucucagugauauaauuuuugcaaaggugguuucuacuccccagcuaccaccccucuugucuagucaucuuauuccuugccccagaaaccacagaccucccuacaauguagcaacucagggguuaaccuugacacaccaggaacccucccagaccuccccaagcucgaaagaccuguggccuugucccuugaggcccuaaggcucuacuaaucauuauuuauuuugaccaucaccccugggucuaaguguccuagcacaaagaccaauaaaacagaaguuggcauuuuagagggucucaguuauuaucgcauucuaauuuuugagucagaagaguaauuuuccuagaaucaaagaaugggcuaguuggagauuuuuuuaaugcucuucuuuuaguuaaacaaacaacaugauuuugcgggggaauaaauaucccccaacuuuaugucauuaaagacagugugugguacuauaacgguauuccccaaagucaucuagaaauuaucaaugaaggaaaauacauauuauaaauuucugcuaggcaacauuuaaacuggaaaagcaguggucuuaaaugaguuuaaauauuuuuuuucugaauuuuuucucuuuauuuucagaauugaaaagcaagaacuacaacaaaaugccucuuaccuaaaguagaccuuaauaugcaacugaaauucaauaaagauacauuuuuuaaagucuguuuuguuuuuuaauguccaauuaccaaauggguuaagagcacauacuugaagcccagcuuucuugguuagcaucuugguuccacacuuacugguuaugugugcauaggccaguuacucaaucuuugugugccuccauuuccucagcuguaaaguggggguaguaguaucuaccuuacaggauuuucaugaagauuuauaaagcaaauauuuacaaaga

SEQ ID NO: 14366 - RNA, 23477 nt, Homo sapiens
agaccccgcagccccgcccgccgcgggugcguguggagaggcccaggugaggagcaagcgcccgcguuccggaagcccgcucccggggccaugggggcacaggugaggcugccgcccggagagcccugccgagaagguuugugucugcccugagccgagggaccuggcagcuggguggcgaagagaccgggugggcgguccccggacacuugcggagacuggaaaggggggcuguaccgacucuaaacguagucguucacucauucauucauucagucagucggccguccagccaggcguucaacacuuauuuaugggugccuaggcgauucgggcugugcuggaaaaccugaguggaauaaggcaggugggacucccacucgauucgcgaggccgaccaguguaaauuaccgcgugcugcgugugggacggggaaacucaggaugcuaugggaagaaucccgagucccucugagaaggacguuuccucugacucaggcucccuuccagagucugcggccgacgucacccggugggcagagggcgugucugccuggggggcccgugggaguucugcgcugcgcccugcgcuggcucccggggaucgagcaccgcgagagguugggcgcccggggccgcgggggugggcguugggcaagucugggccgcccacgucucuccucuuccuuggaaaugaaaaggucuccaaacccaugagccugucugacucgcugugcagucacucuggcugcuuaaggcgagagccguacuggagaggaaaccuggaaccgggagcacucguuugcaggcucuucuuacugcuucucaccugagccccgugaaaucucugggcgaggcuccuugcccuucgccaaguguucgcaacacuggcggguuuucugcagucuccauacagaaggccccgauaaaaguagggaaggggguagggggagcgacuggaaggauguagauacauugaaaugaugguuuucgccguaccaaggggaaagcagcuuuuuaauuuaccugauaaugcaguaaaggggaagggaggcagugaaaggcaugguaagaacuacuauauauauacacauauauauauaguucccuuacacauauauauauauauauauguauauacauauacaccuuugcaaaggugcucgcaacuucccuaguuuccucuccucuugacucuuccagcuuauuccuuuuuaacaagugagcucguccaaaccaugcuagcaaggaagagaagggacaccaaaaaaaggagaaaaaugccugaacaauucacaagcuauuaaaaaaaauuuuuuaaggccgcuggaucuagaauuauuuucuagucuuuuuuucugaaaaagagcaauaacgccugaacaacucacaaacuauuaaaaaacaaaaauuuuaaggcagcugaaucuagaauuauuuccuagagagucagguugugugcccuuuuucuaaauaauuucuaacccagcaaaucugacaguuacuaacacacccacacuuguuuacccaaggaucuguaaguaaggaagguauaugaauuacacccacuuguuugagcuucuggauguuuuuccugcuuugcuuaugcauugaguuccaacaagaaacauuuaagcuccaggcuuaauaccugugauuaaccaugguaauuaauugugugaaaagcuggugagaaagacuuagaaaucugaaugcacguuauuaguagugggaagagauuaggcuuuggcaucagacagucugagcuguaacuuagcuuccuugagcauuuuccugucuauaaauugggggucaucccuccaguuuacaguucugaagaguaggugcaggugggauuacauaugaacuacaccacucagagcuugacauggaguaaacaaagacucaauuuuucacuuguucauucaaauaacaagagucccaugugccaagcacuggcauaggugcugggauagagggaucugcaagacagucuggucccagacucuaggacuagguuccugcucucaggcaccuuacuguucagauggcagcuacuaugcaagaaacaaaguaauuuaaaagaucauuauaauagcaguaauguaucaagaguguugggauguuuagauuggguauucaaugaaagccccuuacgaaagugauauucaagcugagacccaaaugacaaggggucagucaugagaucugaagauagaacauuccaguugaacuuccaugaagaaaaaguuaauuucauacuuugguuuugacuuuuuuuuguuuuuuugaggcggagugccacuccgucacccaggauggcaugcaguggugcaauuucagcucacugcaacuuccaccuggguucaagcaauucuccugccucagccucucaaguagcugggaauacaggcacaugccaccaugcccagcuaauuuuuguauuuuuaauacggguuucacuguguugaccaggcuggucuugaacuccugacuucaagugauacuccuaccuuggcaucccaaagugcuggguuuacaggcaugagccaucccccaccccacauugguuuugacuuuuaaagcuauagaugcuucaaaagagucucuaauccaaaauuaucuuuaaaagaaacaaaugcaaauauguaugaagguuguuauaaagcuguaauuaagccauaugaggaagucuauuugauugggaacauaugauggaaagugacugagagguuccuuuagauugggaaggcaggaaaggccucucugaguugcuuaguccucucacucagaagaagcuagcuaugccagccagcacucuguaacaggcucaggaacagcugcuuuuuaaaaagcuuaaggugagaaggaacuuauucuaugaaaggaacagaagaaaaggcaauaguagggaaugagguuaggcagcuggagacaggauuccacagggccuuauaggcuauagugggaauuuuggauuuuuuucggaaugagaagggaagcccuuguggaguuuuggaaggaggaaugacaagaucagaccuacuugucuaaagguucauuucaccugauccuucucccaccuacucuuuagccacaucucauaccaucucccuuucugucaccccaggcaaccuggcugacugcaguuucuucaaccccucaggguuucugcuuuuagacuuagcagagaggcucuuuuguuuaauccuguuuuaaaaaauauauuccuugaugcugcuuuuacuacuugcuauggcacucuuaacauacguauaguuauuuguuuguuaauccuaucugcccccacuggaauauaagagagcgggaccauuguuguauucauuuuucuaucuccagauucuagaaaaugcccaacagguaguacaccauacauauuuguugaaugaaggaaaagaagauuaguguuucagagaggggugagagggagaguaaugcaauaugaugucagagacgagccaguuucagagcaugagaagcuuuaaaguucaaaguuagugaggaguugagauuuuguuguaaguugagaugaaaaaccaugacaggggacagggaguauuaagccagggagugauauaaccuacuucccacugguuagcguuuggagaauaaauuguaacagauauaaagagauuucauucagucauucccaugcuaauaugaauaggcagguauaucacauauucuugcuuagguuucuaggucagcugaagguugacugaucuagauggggcucaccuauaugucucugcuucaggcuaauguccaccuggguuuggcuccuucaugugggaugagcucagaucugcuccaugugucuucauuugggugcagaggcugaagggacagcagcuccucagggaauuacagagaugcaaaugaguaaacccaaccacauaagcaucuuugaaaucuagcuucauaucacuucugcugacuucccauuggccaccaacuuacuuccagcccaacaucaggugaagcaccuuugcccacauugggaaagguaaggggcugaauacugaaugaauaauaauccaaacuaucacaguagaauagauggugagacccccaacuggaaauaucuugcggugauuaaaaagguaguuuuauacaauuauugacuuucuuaaaaccagauuucuauuccauguaauaaacuggauaauuuaaauuauuauuuaaauuuauauuauuauucucuauaggcaaauauuugacaaauuauuuaaagcauuucauccuuauauaaacaugaauaauaaauuucaacuggcuuuuucuuguacuuuauguuuuuauuuuucugaaauagaaugcuggcugggaauuggguuacuuggcccugguuuuagcaguuacauaacuuuggccagugucacuuaauauauuggcaucaguuucuuuaaaauaucucuccucuaucagugccuaugaguuuagaacugguccaucagcaacauuuaugaggcaccaguauuguaaguaauucugagaacaaacauagguuaugaucaaacuuuagaaucauugagucaaagucccucauuuuacagaugcggaaacugaaaccaagagccauuacucaacuugcccaugauuauagauaguagaucuucauuuuuaaauguuaaagguguguguauguaaacuauuacaccuguacauagaagauaaauauuagguugaaacauaugaaacuacuugucauaggguucaaauuguucaguuaucaucaauuucauauaguucaacauaauauaagaacauuagaaguacuguuugugggaccuguaaauuacuuaaauaucaaucaacuauaaaacagaaaaauuaguugugugauaguuauacaguggaauucucuagaacaguggggaaaaaacaaauccugcagccucaugcaucauguuuugaugaaucucaaaaacaagucaccuaagaacaaauucuuuaucauuacacuuucauaggugcaaaaagaggcaaaagcauuuucaagauauauggagaaaaucuuuuuuauaagcaaaagaauguuaaagagaaaaucaggauaguuacuaacucugaggggugaugcuuuauuucuuaaacuggcugguugauacauugguguguauauauauauauauuuauaauauauauuuccuaaauauucauuauucucuauuuagaaaaauaacaucaaagaagaaguacauguucguggcuagcaagaguguacuuugguacagucacuuuagaggacuauugauagugucuguuaaaaaugaagcauaaugaauggaguagauguucucuuucuguggaauaaagucuggauuaaacucccuggaaaauuacugugcuuacuuaaaucuugauaagccaauugugacuugagaugucuuugauuccuuuaaaacacuccaaauucccugcccacacaccauccauuacccaucucuucccuucucccguaggccacuccacauccacuaacccauccuuucuuuccucuuucagucauaucugcuguaggcucucucccuaacauguucccaaagcauaaaacaauuuaaguccuaaggucaguaaccagacaagauuuuuauuauuuuuccugccauaaaacuuggagcauucaugccugccaguugcaaugagaacuugcaaaaugcaacagugaucauuugaucucccuuaugacccucugcucccacacccccuacaaugucagaaacauuuugcuguaucaacagcuuagaaggaauauuguuucacuggaaugagaucuacccacacugauuucagagacaaaguuuuggagugguuauguuaacugcauaguaaaugacaugaaugcagccauggaauucacugguaagucagguccgauguuuucuuaggaaugaauguaaucaaaauucuuacaaaaauauacuuaaucacuuucccuucuuggggcuuagaugagauaaacaucguguggaacaagauugcuaagggcuagcuugcuugaaaauuugcagcaucagccuggccaacguagugagagcccaucucuacaaaaaaaaacuaaaaaaauuaguugggcaugguggugcaugccugugguuccagcuacuugggaggcugagaugggaggaucauuuaaacccaggaggucaagguugcagugagccgugaugacaccacugcacuacaaccugggugacagagugagacccugucucagaaaaaaaagaaaugaaaauuugcagcaguuaggauauuuaguuuugacuuugaguuuauucuggauuucuauuucuuuguuuuguuuuguuuuuguuuuuguuuuuguggagaucucgcuauauugcccaggcuggucuugaacuccggggcucaagcaaaccucuagccucugccucccuaagugcugggauuacaagggugagccaccauguccaacuauucuggauuucugaaacaaaguuggaucauuuucaaauuacagagauaaaugaaauaauagucaugaaaaccuugaauuccauuauuuuauuauuuuccagaccugaacuucauggguguuucuuaacuuugcaugugguaaaauucagguggcuucaugaagcuuugccagggguacauagguccacuuauggaagucuuguugcuaagacaucauuugaucaaacugccucuuguugcuuauaugccuucuuaagauuuuugaaauguaaaacuuuucuaaaaauugaauuacaaaauuguuucugauuaauuuuccuuuacccucuuuuguuuaggguaauucauaaugggagaauuugccauuuuuaaaggaaagaugggaagacagaacaucuugucacaaugucaccuuguuggugucuuuucaaguggagaacagauuauaaaaaguuucuuacauaguguaaaacguuuucauuuuguauuuuaguguuuagccucaaaauuccaagacauuuauaauaguggacuugguucaggggauuuacaugcuucuuugaaucucauuuuuuaaaaagccuaaugauauuuaaauucuuuuuauuagauuccauuuucuuuaggacaaaguggauuaacagaccugaaaaaucaacuaaacuagaaaacuaaacccacuuuuaaaacguuuuuugaaauauauaacucuucauacccaccaaaugacucauaccccaccaaaugaguuagacagauuucuucuuuuuuuuuuuuuuuuuuuggagauagucucguucugucacccaggcuggagugcaguggcgcgaucucagcucacugcagccgccuccuggguucaagugauucuccugccuccaccuccagaguagcugggacuauaggcaugcaccaccaugcccaugccccgcuaauuuuuguauuuuuaguagagaugggguuucaccauguuggccaggcuggucucgaacuccugaucucaagugauccacccgccuuggccacccaaagugcugggauuacagccauaaugcucagccaauuucuuuuuucuuuuuuucuuuuucgagacagggucuugcuguuaccuaggcuggagugcaguggugugaucgcagcucgcugcagcuucauccuccugggcucaagcgauccucccuccucagccucccgaguagcuuggaccacagacgugcaccaccacgcccgguuaauuuuucaauuuuuuuuauguagaugggguuucacuauguugcccaggcuggucucaaacuccugggaucaagcaaucaucccaccuuggccucccaaaaugcugggauuacaggugugaguuaccaugcccagcgaacagauuucuugcaaugugauuucuagacugagguugcuaugcuuucucccuacauucaggccccacaagcccugcuuuccaguagccaggcugauaaugcagagugaaguggaugugaugggcuguguugaacuguugagcacaagccggucugaacagcuauucgcugcuccaucaaguugcugauucaccagaacaaagacauaaguguucccagaucgaauuuauagggggaauccaggcuuucaugugaaauagcucauuuuuaaaugaugacagcuaaacacuuaaaaaucauuuuuaaaaaucugugcaagccaaauugacagugucuauaggucugugggccaccuguuagcgacuucccuacauguaguaaaauguuucaguaccauccacucaaggcucuguuuccugcagaaagccgguaagcauuaauaccucucccuuucauuccugacauucucuucuuuccuuuuuuccaggauaugugcugucucuggucuguccaaacuccucccaggcuuggugugagaucacaaaugugucacagcugcuggcuucuccugugcucuacacggaccugaauuacagcauaaacaacuugagcauuucagcaaauguagaaaacaaauacagucuuuaugugggcuugguacuggcaguaagcucaaguauuuuuauuggcuccagcuucauacugaaaaagaagggccucuugcaacuggccagcaagggcuuuacuagagcugguaagaaacacaugcaacuaaugaauuuaaguuucuaacugcagaaaugaugugaggccacaucucagcaauacucuuauaaacuugcuuguguaauuauaguuauugauuuuuuuuccauauggauguuagaaaaauacuuaggucuuugauuaaaaugaauagaaaacucaugguuaaugaagggauagucaggcagaccuacucagcaucuuaagugucacuauaaauagcagccuaauuccauugcuauccauuuauugauuuaguaaauaucuauuaggugccaaacacugcuagggaagguuccuguucuugagaaucugcuauaaaugagcaaguaaaccugucagcaauaaaaaagaacacauguacaacuaagaauuauccuaggcuacaguaauaauaacucacuggcucgguuuaucuuagucucuaucuucuugauggagucagcugugucucccagucucugaucucugccaccucuccaacuuccucuugcuuuucuccccaucaccuacuuuucucuuguuccuggaauaugucugguucugucccacccccaggucucuucccauugcguggaacccuucucccugcccuucauucagcucacucauccuucagacuucagugugaguagcaucaccucagaaaggccuuccuugaccauccucucacagcaggucuccccaccccacccccguuauucucugucauugcacuaauaguuucccucaccguaccuaggauaauuuuuaguuguacauguauuguuuauuguugcugacagguuuacuugcuuauugauaguagauucucaagaacaggaaccuucccuagcaguguuuggcaccuaauagauauuuauuaaauuaauaaauggacaacaauagaauuaggcugcuauuuauagugacacuuaagaugcuaaguaggucuaccugacuaucccuucauuaaccaugaguuuucuauucauuuucaucaaguguacuauaagaucuaagcuuuuuucuaacauccauauggaaaaaaaucaaugauuauaaauuacacaagcaaguuuauaaaagaguacuauugagaggagauuuguacuaucagaaaagaaaacauaugcuguauuaaaacaauuugauacuggcauuaaagcgacaaaaucauaacagauaauuuaaaacuuauaaguggacccaaguauauauaacaauugaauuuguuauuuuaaaaagugacauuucgaaacuguggagaaaggacaaaucauucaaaguauugagauaauuggaaaaaauuagaggagaaaaacaugaaaguucugcuucacaccauucagcaaaauacauucuagauagguuagaauuuaauuuaaaaauaaaauuuuuuuuuuuuuuuucagacggggcuuugcccugucggccaggcuggaguacaguggcaugaucucggcucacugcaaccuccaccucccagguucaagcgauucuccugccucagcuucccaaguagcugggauuacaggcaugcaccaucacgcccagcuaauuuuguauuuuuaguagagacgggguuucaccauguuggccaggcuggucucaaacuccugaccucagaugauccgcccgccucggccucccaaagugcugggauuacaggugugagccacugcgccuggccaaaaaaugaaauaauuuaaaaaaaaaagaaggcuuuucuaagcauaaagauaaauaauuuauuuuauauaaaggaagagauuaucuagauugacaaaaaaaauccuauauggaaacacuuuaacugaaacuaaaaagcaaaugauauauugggggaaauaugaugaaauaugugacaaaguauaguuucauaauauauaaaaagugacugcagucaauaaguaaaaagguuaguacccuaacagaaaauagacauggcauauaaacaagaaacaaacaaaauaagaaaugcaaaugaccaauaaacauacguaaguaaauauuguuucacuaguacccaaagagauaccaacuagacaauagucagguucagugugguaacauaauuccaacuuaguuauuuguaaauguaaugaccaauaaacauacauaaauaaauauuguuucacuaguacccaaagauaccaacuagacaauagucagguccaggguuguaauauaauuccaaguuaguaauuugccaauuucuuaagaagaaaguccuaaauaagcacaguuaacuacuuugcaaaauagucuucauagcuuauauauccuguuuaauuauaacaaaaucaauuaggucaaaugcagagggcuaaguauauuaaaauugauaagaaaacuccauuuucuauaguaaauauaaugacaaagucacagauuagaguaguaggaagauaaccuuuugaauaccuuaaaaacauuuuguccuuuucaguagacaaaacagaaacuugauuucagcaugacaagguagagguuaagcagagugcaucugcccaaugcuuguuauucucucauugacuaauccaaacucucaaaagcucuuaugucaaccaucuucuucccuuuacaguccucauuacuaccaauguaauuuacuauuuauguuuucuguuuuuaauuuuaaccauagcugaaaugaaguauuuauguccacaccucugacugacauaaauauggugaaccuggugauuaaauaaaauuuccuacaaauuaagaaaaacuuaugauuuguggaaaaacaaagggaugacauggaaacaucauacagaaaguuuuaagcaauccuaagcaaaaagaacaaagcuggagguaucacaguaccuucaaauuauacuauaaggcuaucauaaccaaaacagcaugguacugguauaaaaauacacacauagaucaguggaacagaauagagaacccagaaauaaagccagauaccuacaaccaacugaucuuugacaaaguugaaaauaauauacgcuagggaacggcuacccuauucaacaaauggugcaaggaaaauuguagaaccauauauagaagaacgaaacuggaccuuauaucugaccauauacaaaaaccuacucaagauggauuaaaaacuuaaauguaaaaccugaaacuauaaaagcccuagaagaaaaacuaggaaaaacuuuucuggacauuggccuaggcaaagaauuugugacuaaguccucaaaaggaaaugcaacaaaaacaaaaauagacaaaugugaccuaaaguaaaaagcuucugcagagcaagaaaaauaaucaacagggugaaaagacagccugcagaauaggagaaaaaacuugcaaacuaagcaucugacaaaggucuaauacccagaaucuacaaggaacucagacaacucaacaagaaaaaaacaaacccaugaaaaaguggguaaaggauaugaacauacauuuuucaaaagacaugcaagcgaccaacauauauaugaaaaaauccucaguguaacuaaucaccagagaaaugcaaauuaaaaccacaaugagauaaccaucuuacacuagucagaauggcuauuauuaacaagucaaaaaacaacagauguugacaagaaugcagagaaaagggaaugcuuauacucuguugguggggauguaaauuaguacaaccacuacggaaaacaauauggagaucucucagagaacuaaaaauagaacugcccuuuaaugcagcagucccacuacuggguaucuacuuuaaggaaaagaaaucauuuuaugaaaagacacuugcauucaaauguugaucacaccacuauucacaacaccaaagucaugaaaucaaccuaagugcccaucgacagaggacuggauaaagaaaaugugguauaauuauauacacacaccauagaauacuacuuagcuguuagagaaaugaaaucauaucuuuugcagcaacauggacggaacuggaggccauuauccuaagugcagugacucagaaacagaaaaucaaaagcugcauguucuuacuuauaagugggagcuaaaccauggguacacaugcacauucaaaguggaauaauggacauuagagauuccaaaaggugggaggguaaaaggguagaagcaggugagggaugaaauacuaccuguuggguucaguguucacuauucaggugauagauacacuaaaggccagacuuuacaguagauuuauguaacacaacuacacuuguaccccugaaucuauuuuaaaaaucaggaaaaauaaaacaaaaaugaacuccugauucaugaaagaauaaaaugggugacaaacagaaaaaugcagauugaaaugacauaccauuuuaagacucaaauuugcaaaguuuuuaaaaaaauugacauaacuuuucuggagggcaauuugguaauacauguaaaguucuuuaaaaaaugcauuuccuccuacccaacaauuacacuucuaggaauuuaucgugaagaaauaaucauuccaguguugcaaagguaaaugcguagggagguucgugagagcauuauauuuauaacagaaacacggaaaaaaaucuaaaugcaauuaauccauuaggggauuuguuaaaucauuguaaauugggggaaaaaaagcuuuagaagagcuuuggaaaugaccaaguaaauaagcuaagagacuuuagauuuacugacuuaacuuuucuaaccauaauccaguacgcuuccuagaaguuaauucuucaaaccuuccuccaguguagaacccauuuuuuguuaauuuuuacuuuuuguauuuuaggacaagguggacauucuuaccugaaggaauggcucugguggguaggauugcugucaaguaaguuuuuaauacugagaauacuguuuauuuguaagauaguaaauagauuacaugaaauuuuucauaauugguuaaucuuccugucaagaauggaacaaggauggaauuuaagucuaaacauuuuuguguuagucaauauauuguccuauauauacuauuauauauaaauaaauuaauuuuuacucuuauuucccacccccugugcucucaguacuguccuggaaugcaagggaaaaaguugaccuuugaaauauuacauuuuaaccacagacuucuuguauuuucuucaccauaacaauagagaaaaguacuuuucuuucauauuuucccaccuccuaauuagaacaacuauuguagcugcauauuuucucaagaaagaguacaguuuccuugccaggacaacacggauaagugaaaggcuucuguggcugcuugguacugaacaaauggagaagaaaugaagggugucagcacucuccuuccucccagaccugcugugaggauuaaacgagacuuuacaggaucugaaagcacuuucuaaaugcuaaugugauguccaaauagaaggcaguguucaucucccucagccacuuuugcugacuucagucuccccacuaagugaaauuucuuaaaucccaaagcggaggcuccccucaaaaagggcaucauaaauucccucuguagccaggagucuuaaagcuucccugaauuuccccaaaccaagcaacacauuucaguauuuguaagauccuguuaugagaaggaacuggguaccuuuucuuuaauaaaugguggaaucuaaaaggaugauuaauaaagagaauuuaaauauguauagccccuucaguucuuguuuauuguggauuuuuuugggguuuuuuuguuuuuuguuuuguuuuuuuugagauggaguccugcucuguggcccaggcuggagugcacuggcaggaucucggcccacugcagccucugcaucccaguuucaagcgauucuccugccucagccucccgaguaccugggauuacaggcacacaccaccacacccagcuaauuuuuguauuuuuaguagagacaaguucucaccauguuggccaggcuggucucgaacuccugaccucaggucacccaccucggccuucagaagugcugugauuacaggcgugagccaccacgcccggccaccccuucaguuuuuagggugcuuuuacauccauuuucuuuauuugaauaaaaauugacaagggcugucugggaagauuccagauagguauuuggaucuuucucuuuuucugucuuacuugcaucuccccacccucuacccauacuuuauaaugaaaauaugaggagaguauuaugugacuacauuugcaauuuuguuuucaccguguaaaaaaguuuaugucaguauugaagagagaaaagcauacauuagagauuaaguaagugauauauauacaguacuuuaaucaugaagucguuguuuuccuggaaagcuaucuauaaagauaaaaauauaaauaauauaaaguauccaaggaaaccuuaauauuccaagaaaacugccacgguuuuuuuuagacagagucucgcucuugucguccaggcuggagugcaguggcgugaucucgguucacugcaaccuccgccucccagauucaaacgauucuccugccucagccuccagaguagcugggauuaaaaacgcuugccaccacacccgguuaguuuuuguauuuuuaguagagauaggguuucaccauguuggccaggcugaucucgaacgccugaccucaagugaucuucuccccucugccucccaaagugcugggauuacagucaugagucaccaugcccggccuugccgugauucuuucgaugauagcaaugucuuaauuauucuguucuguaaauuuagauuuguuuaaugauguuuuccuaauggugaauacuccuauagauuuggggggauguagcguagcagccagacaaagggaaaaagaaaaaaaucaugcugguguuccuuucucucucuacaauaagcauuugccugguguaguugccagcaugaaauacuacauucugugggcaaguuucccacuguguucugugagaauaacuuggccccaguaccagagcccagcucuugaagggauuucucucacucuagaaguuauuuauagcacacuauaucaugcaagucuagaguuccucagauaagaaaaagauuacauucaggagcauaucaugacuuuaaaacagcugccuggaucucguuaagcuacugagauacuguuacuugcuuauagaucacuuacaauagagggauaucuaacuucaugggccuauggcagguauuucuggcuauucccuaccuacacaccagauuuaaccauucuaauuuuccaagcugguuuugguuucuguggguaaccuacaaagcuguagguauucuugagcaagugaaauaauucucugcuuacuacaaagcuaccucuacuagauuucauuagagucaccaaauaugucuucaauauugaaguagcuaaaaauuucuauugaaagccauuuaaaaugaguacucaucugucaccauuuuuugcaucuuuugaguuuaucaccugguauuacaguuugucugcaucucuuaauauuaauuaucuccuaccugcuauaaaacauguuacaucauucuuuuuagcuagaucuucccauguauuuggguuaaaaguccacugcuuugcaugagucauuuguuuuucucuucugacaaguaagcccauuuuuuauaucaauaucucugcuugcuuucuagugggagcaggagaggcugcaaauuuugcugcuuaugcuuuugcaccugccaccuuggucaccccucugggugcuuugaguguucucauaagguaugugagcaacagggaacuuggcuucuguagguauuuuaagaccaagauaaacuuaaaccauaauaaacauauggcuauggauaucuaaaagcaaacacacaaaucuagaccaaccugggcucuaaaagucuagaugaacccaaauuauuucugaggcuccugggaagcuuuggucaagucacucaggcucaguuuacucauucauaaagugagaacaauacuuuuucuugccugaaaucacaaaaauaacuugagaagacuauaaaauaacaguagaaauaggaaauagacugucacauuauuauuuuaaaaaccuaagacacagugaguuugauuuccuacuaacauaaauguguuuuacauuuguaacacugcaaugaagcauagaagauuuuuuaaaucucucaucagaacaaauugccagaguccugucaauuauuuuccucaucauagugguuaaugaccauaguuaucagaggacuuuuacaagcaugguguuuugguuaaauuuuaacucucacuacaauucuugcauuguuugcuggauacuucuguuuggagacccuguaguuuugauaguggaaacaggaauaauuuuccuauuucauggaauguggaucuaauuuuucugaguuuauuaugaucccaaaugaauguguuugauaagcauauacauuuuugucuguucuuuucuugucuuuuuguuuucuauucauuaccaaccucuaguauaaaaccuaugauugagccuacuaaauucuuuuuagcuucuguauaggauuguuaugaaaauuaagugaguuaauacacauaaagcacuucaaacacuugucuaugcaaugaauagcuaguaguaguaguaguaauaguaguaucuucacuaaggcugcaguccuaaagguggccacaugagggcaacucuaggaaaguaccugguaauuuaucauaaucuugaggacagauggguacuuaauugccuucauggggaugccagagcauuagaggaaggaggcuggcuugcagaaaccacagcaacugaagcauuagcaguacuggauaggucuaaguaucagagcaguaacaggugguaaggaaguauuuugauauuuugaaagucuguaucaagcuucuccaacccauggcccaugggcugcauguggcccaggacggcuuggaauguggcccaacauaaauuuguaaacugucuuaaaauauuaugaguuuuuuuugugauuuuuuuuucuuuagcucauuagcuaccauuacuguuacuguauauuauguguugcccaagacaauucuuccaguguggccuagggaagccaaaagauuggauaccccugguccguuugauuguaguggugugaacuagcugauuauuagcccugagcagaguaauuuuucuuuaggaauguaucuuucuuggaaacauccaugggcauacauauucuaaauguaucaugccaguaagauauaaaagauuuucuauuuuguuuggcuuuacaggaaaagauggguaaauugaaaaugacuugaguagaaccucuuguaagaucacuggaagauuaugggauauagaauauuauagcucuuuagauauaaaaacagugaagcauauuugauugcccaucaguucugaguuucaaaccaaucuaggguuucagugucauauagcauauuccagucagcucauugggauacaugguggcauguaccacagugugacuucugagcugccaugggaucaaaagguaauugagcuauagugauuuuuaauuuuuucucucccaacagugcaauauuaucuuccuacuuuuuaaacgagcacuugaacauucaugggaaaauaggcugcauauuaaguauauuggggucaacugugaugguuauccaugccccacaagaagaggaagucacaucuuugcaugaaauggaaaugaaauugagagacccaggucugugauucaaccuaaagaaccacucaaauucugcuccacuuucucuccucaccaaauaguaucuguaauaauauuguaauaagcuuucuacauugugggccgcauuguggguugugagacacagugagguuugauuauuauuucuccugaaaagauggcagaacuuauuuuuguguucaugcuuccccuguuacacaaugaaagggagagguggggaugguagaggcaaaagacauauauucaaaaucaaaucuuugccacucucuuccucugaaaauaaaaaguuaaucugauaauauucgcccuagcucauagugguauuggugagauuuaaaugauauguuugugaaaauccuuuguaaaauauugagaacuaugcaauagaauguuguuuuuaauuugaucucacuucuauuucuaaaauaccuaugcucuuaaacucaugacuaacaagauuucagaaagguauaauccugugagcauuuucuaaagucaaauucuuuucuccuucuaacaggguuuauuuccuuugcugugaucauaacugugaucuccuuggugcugauuuugauuguggcucccaagaaaggacagaccaauauauugguuuauauuucaaucuguuccuugauuggagcguuuucaguuucuucugugaaaggccugggaauugccauuaaggagcugauagaauggaagccaguuuacaaacauccgcuggucuuuguuuugcuggcuguacuugugcuuucaguaacuacacagauuaacuaucucaacaaggcacuggacaccuuuaauaccucucuugugacacccauuuauuauguauucuucacauccaugguagugacuugcucugccaucuuauuccaagagugguauggcaugacagcuggagauaucauugggacccugaguggauucuucacuauuaucauuggcaucuuccuucuacaugcuuuuaaaaauacugacauuacuuggagugagcuuacauccacugcuaagaaagaagccgucucucugaaugucaaugaaaacaauuauguuuuacuagagaacuuggaguguucagccccaggauacaaugaugacguuaccuuguuuaguagaacugaugacugaagucucuagaaacacugaguuuuaaccaauaugagacacacgaagaggaaaaugaaugcuugcuucuuggaagaacugcuaggaaaguuagcauuuuugcaguucuaacuaauuuagaugugaggccaaguaaaaaugccauuuuuuuggccauugaauuugaaaaucaaauugauuauccuccagaaucucuacaaacuuugaaauacucucuaaggaucaaagaagucaaagagcuaugugugucucagaauaaucuccuucuucuggucacaguaucuuugucucugccagguggcucuucauuucuuugguagcuauuuuuagacuuacagucauucaccaauauacaguuagcaguguucugauagacacaguaucagucauauucuccguugagucauaauuucaaacucaacaagauuucagaaagguauaaucauguaauuucucauauuaaaacugagaagagaggccaggcauggugguucacaccuguaauccuagcaguuugggaggccaaggcggacagaucacuugagcucaggaguucgagaccaccuugggccacaaggcgagacccugucucuacaaaaaauacaaaaauuagccaggcgugguggcacaugccuguaguuccagccacccgggagccugaggugggaggauugcuugagucugcgagguuggggcugccgugagcccagauugcgccauugugcuccagccugggugacaaagcaaggcccugucucaaaaaagaagaagagaaagggccaggggcuuuugcuuuaaaaaacuuuuuuuaaaacagaagugaaaccacgggugcuuuguucuuccuucugcaccuccuucuuaaacuagauagcuaauuaguuauuuuaagaaaaaagaaauuuaaaaaaaagccugcuuuauuuguuagugggcuagaauacacaagacauacccacccaugaagaguuuaugaauuguaacuuauugacauuaucauaggaauuuacuaccaguuaaagagggagaacggaggaagagaaaaauacuucagauaaaggaaaaaguuuucuucucacaaaaacacagacacgugauuguuuucacagguuccauuaauuaacucaggucuggaagacauaggacaaaauggaguuucugaagaaguccaggugaauucagcuuuggagucacuuauguucauuuuuuuuccuuuucuuuuacuauuauccuaaagguuauuuuucuuguugauauagagauuuuuguaaaagauugcuacauuauuucaggauuauauccuacauuucgauugcucucaaauguuuuaucccuaaagagugaguuuuccacagacuguuuggaagcaacuagaaaaaucuuugugaaaaaucugaacaaauuaucauaauggcucucuugaaauuuugcacuuucacccuuauuaaggaaauuauaauuaguuacuaaccuuuaaaaauagauauauucuaauaggauagaaaguuaacuuccuggcaaacaaaauacuaagaucucaggggcuacugcaggaaaauaccuuuuucgcacauuaaaauguuuauaaaauuuuccccucucauuucaaaugcauggcaggaauaacauuuuugguggucuuuaaugugauggacagauuuacugucacuuauugauuuuauggaaaauaaauuggcuaucuuauuuuuauaacaaucuuauuuuucucaaaacaaaaauccuaaccaaaaaguugucauuaaaaaaaaaaaaauucagguagacugaauguuuuucugcucuaaccuuaaauguuauuagguuugguuuuuguuucuaagcuacuucaagacuaccugagguaauaaugguaaacuuuauuauucagaauucgauuaaacuaacuucagcauuuccacaguucuauuaaacaaugacugauguucacaaugacaaccuaccugagauggcugcaaggcccuaauguuccauuauacauuauagucuuuucagcauaguuuaguguugagugcaauucuaaugcauucuacguuuuugaaaaucgauaauccauggaagguccauggguugauaccucaggucaaaaauguguuuacucuguugauugcuguuucacuuuacuuguauaucagauauauaagcuaugaacacaaguuuguaguaaaaguaucuucugucugggcaauggcucacaccuguaauuccaacacuuuggggggcucaggugggaggauuucuaguccccaggaguuugagaccagccugggcaauaaacuagaccccaugucucuaaaaaauguaaaaaacaucaagaggcugagucaggaggaucauuugagcuuaggaguucaaggcugcaguaaguuaugauugugccacugcauuccagccugggugacaagagugagacccugacccaaaaaaguaucuucugauaaaguggcauuugaaaauugcagaaauuuuaauauuuuuucuuuuaauauuaagaacuuuauugaucucucuaggacaccuuggugaggaaauuaauggcacuuuucuugacauccaaccugggacucuggugauucuguguucuggcgaauuuaaguuucagacauuucuuugugucaccuuuuacaagguguuugcccuugguacguuaugaccaggucaaagguucccaaacacaaggcucauuguguacccuggacaggaaauugaacugauguugacauguaugcaugcccaggaggaagacugggaaagauuuaaugaguugaaguaugcugagaaacaaugaaauauuugaaaacugucuacauaaaaguuacugaugcacaugcauuaaaaaaaaaaauguuguugcaaaucuaacacuaaaaaauuuuugacugggugcaguggcucacaccuguaaucccagcacuuugggaggcugaggcggguagaucacaaggacaggaguucaagaccagccuggccaacauggugaaaccccgucucuacuaaaaauacaaaaauuagccaggcaugguugcgggugccuauaaucccaacuaccccggaggcugaggcagggaauugcuugaagcaaggaggggcagguugcagugagccaagauugugccaccacacuccagccuggguaacagcaagacuccgucucaaaaaaaaaaaaaauucccaaauaggaagauauuuucuaaggaagaauaaaaugcuggaccccuauauucagacuauuagucuuaacugguaguuuauguauauauuuuaauacuuugucaucauguacauaucuuaagauuuauuaugugaauaucugcauguguguuauuaaggauuacaaaguugugcucacacaggacaaauggaaagauuuuccuacuucuguaaagauaaguuucauuauacuuuugucuuacaauuuuauucuuaggucaaugguuauuuauuauaaguucagauugcacaauuuucauaagacccuuuggauuuagcacaugaaauuaacacauauuuuaaaguauuaaauacauggaaagcaucuggcauuaugccugauaauaggcacuuaguaaaauguacuuuucuuugaaucaacauuugaauucuuacagucuugucacuagagacuuaaaaggaccauugagugccuauuuuuauacauucaucuuuucucaauuugucacauuaucucauuuuaaauaaugcaagugaaagugaauucaucauacuaucucaacaccaauacaaaauuauuccaauaaaaauauuuuucuuaauaaaaccagaaaaacugaacuaaaugcuauuuagccccgccaacaaagcuuuguggaaaaauauaugaauauaugaaauguucucaaauauuuugaauaaacuguucaugaagccuuauauuuugcaaguguuuuuacuguugauuuuagaaaguuuauaaaucuuaaauguuuguauauuuuucauuugcaauaaaauguuauuuaauuaugcuuuugaguucaguuuuuaguuuauaaauguuaagcauauguaauggcaaaac

SEQ ID NO: 14367 - RNA, 2715 nt, Homo sapiens
gauauauucaauauuuauugaaugaaaaagguaagacauugaguaaggcaauagaauuuaaaaauccaaguauaucuauccacuaugaacuucucuauauaucuaaguauauucacucucauguuuugcaaccaugaggccucaccagaauccuuuacuuuuucauccuggaagagauacuggagauccuccaacucacgcauucuaaaguaaacuaaggaccagagauuagagagcagcgaucaaggucaagugcauuuaugcuacagcuagaacccgacaucaggcuuucugauucuuaauucauuguuccacacuacaacagcuuuuccugccccacaaacauuagugcuaacuucauaauguccggugaacuguucuuuucaaggaguauauuugaaggguucgccuuauagaaacugacuaguuggaaucuauuuuacaaagcauugaaugcaagugaaaacugcuacacgugaaguagucaugauuuuuaacccuccggcaacaaguucagacuggucagaaagagcaaugauauuuagaugagcauuacacagauaauauauauuacuugacaauuauguuagcaaacaaucacauccuuugacuaggucuguauagcuagaaaaauacucgacuuauaguuagccagcaaacuuuuaacacaaauacguuuuuugcuacgaauaaauagcuacgugguuuuaaguagaacuuauagucuacuuaacuuucaacaaaccaaguauugaguguccacugugucaguguacuagacaugggaagcaaaaaugaaguguccuuaaaucaaguaaacagacaaaaacaaacgaaaaauaauucuuagagaaaaaagcaauuuaaaaaaaagugcaaacaccuauugagaacuauugaucacguagugcuagaauaugcagaauaauuagaucuuuguggaauuguugggaagagguuuccugaaugagagaguaugggauuuaagaaaagaaucagauauggcaggcggagaauauggcacuagaaaagcuaaaggguagaagcaagucagucauggcaugaguccacacucagguguaacaggacuggaucauuguuauuaaacuaaggguggaggcggcaacugaagaaaagcugcaaacacaagccaaagccguucacaauugaccucugaagaccaacgacugugauaaugugaucaaaacaaagcauuuaaguuuuguuuagguuuccugccgcauucuaaaggcagacuucacauucuuacaauuuucuucauucuucaguaucugucagcguguuuaacuacuuuuaacauacaacuuuuaaaaaagucaagacacacuacgaggaacuuuuuccgaaggaagugauccaaagaacagagugugagucaauaaacggagaaagggaguagagaagcgguuuacuaucccccgcuuccgccccagugugcuguaaacuuuaagucgggaaaacuauguuuuaaccgaugagauaaugccuuuaaaagugcuuagcacacugucuggccaguaggaagcacucaagaaauuaugauuauuuugaccuuagaccucucuuaacugucugaaacugggguuucuuauuuucaggggaagaaacaggacacaggcagucuagaggcuccugccagccgagacaaucuccaauuaaaagucggcaucgauuaaauauuugcugaacaaaguaaacugucucuccaccgccgggcugagcgcccacucgagauccggcccggaacaagggcgagacuggcccgcgggucccacacucccuguaagggguggagaacacgcccacacgcccagaccaacaggcgaggcuguucgaggaccuuguuagccaccucagccccgcccgccgcgagccuucugcuggccucccguucugcagggacccucccuagccagcccggccgcgucccacauccgccgacacgccccuuccggccuaauccccgccccucaagcaccggccccgccccauaggccccguccguggccccgccccgccgcgagcuggcgccggguccucucagcgcccgccggcggccgcguccacccccgacgcucugaggucaccgacugggccggcccgcggggggcggagggacggagggaagauggcggcaggggccggauauuggcgccgccucccccaaucccggagccggcgcagaugaggcaguucggcuggggccagcggcgcuuuggaacccgagguggggggacccuggcgguggggccugguccugcuauaugccggcgccucggcuagagugagcggcggcgacgccucuuuccuccgucucuuucccugucgcugcgagagcgagcgggcggcggaggcggcggcggcggcggggccgggauggaggacguuaacuccaacgugaacgcggaccaggaggugcggaagcugcaggagcuggugaagaagcuggagaagcagaacgaacagcugaggagccgcucgggggccgugcagggcgccggcucccuugggcccggcagcccgguucgggccggcgcguccauucccuccuccggcgcggcgucuccucggggcuuccccuugggccucagcgccaagucgggcggcgggcccgggucgggcccgaggcggacgaguagcgaagagcugcgggacgccaccuccuugcuagcggcgggcgagggcggcuugcug

SEQ ID NO: 14368 - RNA, 17686 nt, Homo sapiens
gaggggagggugugagcagcgggugcccccaguccccgccagggcgcaagcgcaggcgcgcagggugcggucgcggaggggcgggcacagucgggcggggagcucggcggcggcgggcgcgggaagauggcggcagcggcggcggcggcugcagaacaggucugugaguaccgccgcggccgcgggcuggaggagcgggggaggccgcguccugccggcugggcccgcgggagcccuggccgggggugcggggggcgcgggccgcagggucuggguucggcggggccgaucggggcggggcggggcgggaggagcugugccccgccgaggaugcuggcacaagcuagggaccaggagccaggggcggccucgggcucggcccggccuggcugauccucggagggggugaggaggggucuccuuccggagagccugggaggcggucgagccagccuggaagccugcgcugggacgugccagggacguaccccguucagccgccagcagagauuuggauaaaaauaaccgcagccccagcgagaaggcuccucuuacaagaaacgggucagcuguugccccggugucagcuugccaucuuuguuuuuuguuucugccaucuccaauaugcagacaucccagauuuccccucacgcuuugguuuuugaagauuuagucaccagucuaaaacuaucuccuguucacuuuuaaaaaugauuuauccaagauuuccugaccugcauuguaaacuuguaacuuagaaugguuuaaaaggcuccucauccccccaaaaucuaguuauacguaugcauacauguacaugcauauguguguguguuaauauauacauacacguaaucgcuagggugauuuauuguaauacagauaauuuucaguaacuuucccccuuaccuaacuuacuuuuccuuugaacaauuauaguaguuucucuuuaaaaagucucauucuaaaacauuguugaaaaaaaugagucaaguuuugaccuuuggaacgauuuucuuagauaauuaacuuuuuagagaccuauuagauauaugucacuggagggcucauucugaagauaaaagacguaaaaucucucuucaaggagcuuaaagucauacagccaaauacaugcagaaaaaaucagcuaaagacaauaggcaggcugcagauuuguaacaguaaaauaaaacauagaggaaugagugaaacugaaaggagacaaaacuucuuggaguugguauuuaaauugugccuuggcuuuccucauuucccgccuaaguuaucagcuucuguuucagaugauuguuuuuccaucugguucuauuuuugcuuuacacauaaguggggcagucugauccguuacucagucuccacuucaaauuuacgcauuacgucuccagcccugaacuuaacugaauuuuccauaggcaccucaaacucaaaaauguucaaaacuggacucugucauacuuacuauuaaaaaggcuacaaccauccauucacuuguuuaaccuagccagaaacuuaggaccaaggccauuuuaagggagcugagaaggaccugcacuugguuuaauguucugcuguccugggcuugagauuuaaacagugagccccacauuuucuuuucccccugggccccacaaauuauauagccaguccuauuugggagucaucuucgaccccuuugugccacacucauauccaaacaaucacgagauccugacaguucuaccucuuaacaccuuuccccagacuucagcuucaaagucaaaccucagucaguaccucauugggacucuuagagaaaccugcuguugauaucuucacuucuaggcucuucaguuccaguucaucucuuuuuggagugauuuuacuacaaugcaaaucugauuguauaggaaaccuauuuuaacucuucaguaguuccccuuugccuucaggauaaaguccauuguucuugucaugguauuuauguugcuuacuggccccuaagcacaucucucauuguauuucuugcuucaucccuacaccuauccuucucaccauccacauaaagugaccaaaauuaguucucccagagaugguugccucucaaagucuccaugcuucuuccucugccuagagugaccuucuuagcucuuuugccugguuaacuccuguccauccuucaagaguuaacucaaccuucagcuuuucuuagaaacuuucccugaugcccuugccugcuagguggagaugcauuccucuucuguacccuuucuguauuguaugcauugcuccacuacagcacuugucaugcuuugugaacuguuagucaccuugucugucuaccugacuggccuguaauuaagcuccuugaggguggacacuauguucauccugguagcuuggagcaccuggcuuauaguaacuauucaauaaauguuaaaugcaucaagaugaagacaguaaugugcaugguuuggcagagaagaguaaagacuacgucucaggagggaugaauuuuguccuuucucucuuuuauguggaccuauauucaaacuuuggcuaacacuuuuaaguugcccaucuguuagggcugucagaagccugagguucuuuuuuggaaccugacuacaaauucuguuaagucuucucuuaaaguaucuacuuaaucucuccuuuuucaucccacuuuaguuuagguccucuuaaccucaauccuccauuacuacaacauccccagcagcuuacuuacugguacuccucuuucuucucucucguacaaaugcccacaccuuuaacacucugaauuugugcucaaaaaccuccagugacucccaauuaaauagaacauaaagacuagaauuuguacccugcuguccaagaaccuucacaaccuggcccuacuuuuccaacuuccucuucccugccuugccauaucugacccaucuacuucuccccauuucccuaacaacuccaggucauccugucucuccucccuuugaacucugcaguguguauugccuagacuauugauuuuggcaccugaacauacagagugcuuuauugcauuguuaaauauuuuauguuaacauguacacaaaucauaucuguuaauacauagaggauaaggacccuuuccuauaguucuuuuguauuccuaucuauggaauuaguguuuaagcguaaagugcuuaauacaugcguauucaacaacugaauuuucucagagcuuuaagaaauaaguaggacaguauccauuucugcccauuucuuuugugcucuugauauucaagauuauuacccaaaaugucauucaaccauagucuaggucagagguucucaaaucauuuuggucucagguucucuuuacacucuuaaaaaauggaggauuccaaagagcuuugguuuauguggguuauauucauugauauuuacuauaggagaaguuaaaauggagaaauuuuuaaaguacagggcuauacaagcauacauucuguugagugaugaugccaucacauuggucauguagccuuuacauucaugggccuaggagaguaaaaacagcaaacaguaucucaguguuauuucaaaaauacagccccccaaaggguuuguggaacccucccaggacuccccacccugcauuugaaaacuacugaucuaggguaaugugagcucuagucagugaaauuauaaguaacaaacuaugucagccuuuccggucuuauuuucauauaaaugaaaauauauaccguugucccucaauaucuaugggggauuggucucaggacccccaaaggauagccaaauccauugaugcucaagucccuuauauaaaguggugcaguuuuugcauguaaccucugcacauccuccuguauacuuuaaauccaucugcagauuacuuacaacacugaacacaauguaaacacuauguaaacaguuguuauacuguauuguuuagggaauaaugacaaggaaaaagucguacauguucuguacaaaugcaaccauucccuuuuuuuuuuuuuuuuuuuuuuuuuuuuuuuuuuuuuuuuuuuuugagacggagucucgcucugucgcccaggcuggagugcaguggcgggaucucggcucacugcaagcuccgccucccggguucacgccauucuccugccucagccuccggaguagcugggauuacaggugcgugccaccaugcccagcuaauuuucuuguguuuuuaguagagacaggguuucaccaucuuggccaggcuggucuugaacuccugaccucgugauccacccgccucagccucccaaagugcugggauuacaggccugagccaccgcgccuggccucaaauauuuuugauccacagugguuaaauccauggauauggaucccauggauauggagggccaguuguauacguaaaaaaauuaauaaauuauuaauaaaagcaguuacucacuauaggauacguaugacaacucugcucagaaacaagcuguauacuuugacagugggacuguugaaagcagagaggaaaaauaucagauagugaccuugaaguuucuucuguacuuuccuucuaagcacaguuaugcccuuauuuggaacugcaacucaaugugauuugcaguuuauucauggaaaaugugucaguaaccaauucagcuugcuauagcuaugaauuugcaccuaauagauaaaugcaccaaaacgagaggguauagcuguuccauuauguuguauuucauuuuuagcaaaguuccaaugguccuguaaagaaguccaugcgugagaaggcuguugagagaaggagugucaauaaagagcacaacaguaacuuuaaagcuggauacauuccgauugaugaagaucgucuccacaaaacaggguugagaggaagaaagggcaauuuagccaucugugugauuauccucuuguuuauccuggcugucaucaauuuaauagugaguauuuguaagaauacucauuuuaauugccauggggaauuuuuuaucugcuuuauagugaaaucauagacuuuauuuucuccuuuucuauacaugucuugucucuuacugaauuuuaaugaauacuuuauuaaaaaaacuagugugcuaauauuuucauauauuaauuucauuuacaaaaaaaugugcauggguuuaucccuuuaauggacuuaauuuuuagcaaggauagaauuaugaggcucccaccuagcucaaucgguagagcaugagacuuuuaauaaggauaggaucaacucaauagaagagaacuuugccaagaugauuuuauugcuuucacaucuccuuaaaaauauaauccuuucuguuuucauuuaacuuuuccuacauuuaauguugccuccucagcuggauuuuaaaauuuuaaacccuuugauggcaguaaaagguuauauuuuauaguccuaaguccccguugucaaaggaugcaagaaucugguaggcugauucacacuaaaguacugaggaccugauaggaugccuuuuccaaagauauuugcuuuuuuaaugaagaaauccuuuuaaucugaaguugugacugucugggguuaaaucugaaacucuggcaugugcauguacagauauuuucagaaggaaugauuauugauauacuuaagacugaucaugaacauagucugcagcaguuuugaagugauucuuuuuguguuauuuucuacuucuaaugcaugcaaggcagucuuuuuguauuuauguauguccaaagcacuucugucuaauucuucacucaaaucagaaagaccucuuccuauauauuucauauuagauauauaaauuuuuacuaggagcacaaaucugaaugcauuuuauuuuauaaauguauuuuaucggagacuucuggucaagauggcagcauaaagacauuuuuaucuucuucucuaaaaagcucguuccaaaguaacaaugucacgaaacagaaauaucuuugaagaaagucggaagcaacugaaauccuaaaucauaauaaaugaagacacaaaguaggaggaacaauggcagauaacuuaucagagaggagaaucugcuuguuggggaggggauguugguggaaguaccuuguagaacccuaaaaagccuugggaauuagaaguuccaguaccuugaaaagcagaagugaggcaagaacugaaaacagagaagucauuugaaaaucuguauaagaagcagugagaucccuaggccuccucucccuuccagccagcaguuagacagcuaccccuccuaaugucauacaaaacuagugugucucuggacacacuggaccagagaggauucuaucugccugcggauacuggaggguagggguuggguuuccauacugaaacaggaaagucuggguccugagacucccuuucccacgcucucuuuuccucauucuccaccuccagcucccuggcagccaggcaagagacagaagagccuucucugggauuccugaugcauauagaaaaaagaucugaagauacugucauuuggcaagucccggugaaaaagccauguaauuucccucuugugacaccugucagucacaagcccuaccccucaaauaauuuucuaugaauucaucacuaaguaugaauacugagccagggaucaauagacuuuugaggaaagugccaagaauugaaaaaugauagagaugaaaacuccuaaaccauggaaaaaauagaaacucauggaauagagaaaaugccacaaaaacuaccaaaaaaacaaaagcccuaaauucaguauuuucagagaaauaagaauauacugcaucaaugaaacaagaauaacaugccauuuaaaaggcacaagccaggcacaguggcucaugccugauaaagugagacccugucucuaccaaaaaaaaaaaaaauuaaaaggaacaauuaagaacucauagauaugcgcgugcacacacacacacacacacacacacacacacacacacacacacauacacacacacacagagaugaauggguggguggguagauggauauagguagguagguagguagguagguagauagacagaagacauuagaagauaaaaaaacucuuccagaaauuucaacaaaauuaaucaacucaggagcucuaacaugcuguuaauaggaguuucagaaagagcacagaaaacacugggggggaaaugaucaaauacauaagucaagaaaauuuccuagaacagauugaaaacuaccauacuggguccagcguaaugcauaaaaagacacaacaaggccauuauuaugaaauuuaagaaaaccaguaauaaaagauccuaauaucuuccagagggggcaaaaaagcagguuauguauaaagaauacaaaaucagaauggaauaggaccucccaaaagcagcauugggaccuggaaggcaauaaagcaauggcuuucaaaauucagaaagaaaauaauuuuccaucuagaauuguauacuuagccaguccagcaaucaaauaugaagcauuauaaagacguauuuuugccaugcacacuuuccaaaaaauuuuacuucucauacauugcuuagaagccacuggaggaugugcucuaccaaaagaaagaugaggauacaggaaacugggugucuaucagaagagaaagacaaaaggaaguucagcaugaacguaagggaaaguuuaugauuacagcugugcagggggcccauacagaccaguccagcccacgcagaccaaaccagaaagauacagguuccagaaagauuuccugagagagaaaaauagaacuaauauauuaucugagaggcucagaccuacagaaaauuguauugagagauuuuacagaaauaguggaggauuugagauuaauuagauuuuuaaagaaacuaaggaaaaugaaguauuaaauucugagagacaagguacaggaaagaaacugccauuauaggacauauuugguuugguaaugaacaauauuuauaugguuguaauacugaaaauaaugaccuuggauuuaauuaaaacuugagauuggagcuggaaaagaaaagagauauaaaugagcuaaauuuaucaucugcuaaaauagaaaauuaauaauaaaaccuaaauuaugauaaaugaagaaauaacauauuuagaagaaauauuuguuagauauuuuagaaauauauguuuagaagaaauacauauauuuagaaauaaggagauaaauucuagaugaaauagcuaaauuuguugaaagugauuguuccugggaaugagauguggagaggguagaaaaaauaagaaacuauucauuuuaaauuauagaccuuuagcacauuuugacuuuuagcuauuugcauguaauaccuuaauaaaaauaaaauucguuuuguuuauaaguggaaaauuaauugauauauuuaccucacugauaaaacauuuuaggaggucuuuaacauuuuggugauaauauuuucuauuuguuuuccaauuacauuaaauguaugcggccuaccaacaguggacuuguguucuuuuucagauaacacuuguuauuugggccgugauucgcauuggaccaaauggcugugauaguauggaguuucaugaaaguggccugcuucgauuuaagcaaguaucugacaugggagugauccacccucuuuauaaaagcacaguaggaggaaggcgaaaugaaaauuuggucaucacuggcaacaaccagccuguaaguugccacauuaacugaaagaaaugcaaacaggagaggggcauuagagaaaaauacuuugcaaaaaccuaguugauuauuggaaagagauauuuucccuuagaaaaauuaguauauuuauaauauaucuauaaauguaugaauauagugaauacaguuuaaaacauccauaaauauuaauauuuaauaauacuauugcuuuuaucaucuguuaaaauuagaugauuucuuaauauuugagauuuuguucaaugguagcauuuucuaugacagauguaauuuguaugagaauacauagguuacucuuuucuccuccauaugaggaagccauuaagaaagcacuuucccaggugagaauacucuguaguuuugggggcucuugaagagaauaugccaaucuagucaguggcaucccaugccaagagcugaaaacauaguuuucaacugaauaaaaccucaaggagguauucuuaccaccaccccugccuaucuuaggccuugggccauguuccuccaugacucaugcauuuuugcagagcuaaugagcaaauaaauguauaaaccuucauucuaaagaacucuucuuccaaguggauggagggagaacagacagaguuaaacguauuugaaguuagucuguuauugggguuuuuaaauuucuguaauuuuuguaauuuuuaaaauauauuguucaggaauuuuguuugcagucuucuuugaaaauauauucacaauaaacuguuuuuuuugaagauuguuuuucagcaagggacaacaaagcucaguguagaaaacaacaaaacuucuauuacaagugacaucggcaugcaguuuuuugacccgaggacucaaaauaucuuauucagcacagacuaugaaacucaugaguuucauuugccaaguggagugaaaaguuugaauguucaaaaggcaucuacugaaaggguaugauuuauuggcuuuguuuuacuaaugggagagaauuauucucuagaguuauaaagugggaagagaguuauacuguuguuguuuuuuuuuugagacggaguuucgcucugucgcccaggcuggagugcaguggcgcgaucucgacucacugcaagcuccgccucccggauucacgccauucuccugccucagccucccguguagcugggacuacaggcgcgcgccaccaugcccggcuaaguuuuguauuuuuaguagagacgggguuucaccguguuagucaggauggucucgaucuccugaccucgugauccgcccgucucggccucccaaagugcugggauuacaggcgugagccaccgcucccggcugagaguuauacuguuuuaaaguaguauaaaagaauauauuccagaacaccggaaaggauuaauucuagauuuguaauuaacuagcuugugugaucauuaucaagucaucuuuaucucaauuuccacaucucuaaaacauuaauagaaacauuugacuuucaucucucaugacugaagcuucuauuucucuaucucugauaacaauucucacauuaauuuagaaacucuuuuuaguacuuguuuuuuaaauuuucagauuaccagcaaugcuaccagugauuuaaauauaaaaguugaugggcgugcuauugugcguggaaaugaagguguauucauuaugggcaaaaccauugaauuucacaugggugguaauauggaguuaaaggcggugaguauucuuuuaagagcuuaagagaauuauuagguucuuggguacauaaauccauauguggaauaguauacaauuauugaaaaugauauaauugucuauuuuuugacauggaaagauguucaaaguggguugugaaguaaaagaaaguuacaaaacaauuugugaaauucauuauuuuuauuuuucagaacauauguauguuuauaaaaaccuagcagggugugccagaaugucaacaauguuuagcuguggauagcaagauaacagauuauuuguuuuauuuuuauuucuacuagccuguauuuucuguuucuuucucucuuuuuuuuuuuguauaaugaucacuuguauuguuuuagaaggcaaaaaaaaaaaccuucuaaaagagaauucuggaagaucaaaguaaauauucaugccuuguaguuguuguuuuuaauuaaagauuuuucacaucccucccugaguuucauauccaaugaugugaaaaaaaacaauuagcaaauuuauaaaauuauuuuauuuagauauuuuuauuaaaaauguauuuuuaaucuauuauuaauuguaaaggaaagagguuuuugucuuuaucguggcuguugaaagugaauuuucuuugugcuuaacagauuaaaucugaacuuuaacagguaugguauuucaugugccauaaguccaaaaacuuuuuaaugucucacaauucuggucaaaguauacuuauucaaaaugccuuuggguaccugcaauaugcuauuuaauuaaagcgaauuaaauuugucuuaccaaguauuacaugacaaaagugaacuuaaacguagggacuuaucauucuuucuuauuaaaaaaaauuucaauuucauaguuccugggaaaaauacuuuuuaaaaguaguuguuuuacuuuuauaagcaguuuuucccccagaacacauaaucccaucucuaaauaauaaagauggacauaaaauguaauucuugccagaaacucaguugccuacagaguuaauuuguauguauauugugguguaagaagccauucuucuaagaacacuguugaagaauagccacaguacaacugcuguucucagcaguagaaagucacagaagcaagagauuuguuuagagaccauuagcaacuuaccaaaccuuuuauuuuuuucuaccugccacuucuugucccauucuaccuuguaguuaauaugacaaauauuuaaauacuuugaaauauacauauacacauaucaguuucucuacuguuaaaggaaaauaaccuaguauuaaaaagauaauuagcuuuauaacuucguuaauaucagugguuaguucuaaaguguauaagccaaucauuagaaauaauuuuaucaauuaaacugcuuuuuugaaaaagcuguuuaagaagcaauuuaggccgggcgcgaugacuuacgccuguaaucucagcacuuuaggaagccaaggcggguggaucacaaggucaggaauucgagaccagccuggccaacauggcgaaaccccgucucuacuaaaaauacaaaaauuaccugggcgugguggcgggcgccuguaaucccagcuacccgggaggcugaggcaggagaaucgcuugaaaccaggaggcagagauugcagugaacccagaucgcgccacugcacuccagccugggagacagagcaaaacuccgucucaaaaaaaaaaaaaaaaaaaaaaaaaaccaacaacaaaaaacaauuuaaagaaaguaaaauuaaaugaccacaagauggcagcauuggaacaaauuggaaaacuagucacuuaagaauuacugucuauuccauauacuaccacugcauaaucaguuaaccaucuccauuauuuauaaccaauuuucucucuuugcuuuaaauacccucuguaagccgaugccucccaaauuuggaauugugcuuuaaccucuccucugaacuaagaguuacauaucuagcugccugcuuaacauuauccauuuugauaucugauaggcaucucacauuuaacaauugaaaaguuagauucuccauccccacaagcaugcauuucuuucaguauucuuguaccauuaaaugacacccaucaguccauagcaaagccuucuggcucuaccuucagaagauacagagucuugcuguuucucaccaccucggccaucaccacccugauguaaacugccaucauucccugccuggaugguuggaacagccuccuggcugaucuucuuacuuccaaguauucacucccauagucuguuuucuacccaacagccagaguggccauuuuaaaaagaucaagucauuucuguauucagaauccuccaaaugcuucccguauaauuuggaauaaaaucuaaagucuauucccugccuacaugucugauccucaguuauuucuuugacucaucuccuacugguuguucccuucacccuccgugcuucuuccacacuggccucauagcugucccuggaauccaggcacaucuucaccucggggccuuugcagacacuguuaccucugcuuugaguacccuuccccaguuaccuagacagcuuccucccucacuuccucuaguuucuguuggaaugugugaccuuaucaaaccacaggugguccuuccugagcacccuguguaaaacucaguccccaucugcucacucucuacuuauccugcuuuauuucuccucauagcauuuaucccaccugaugucuuauguguuuuacuguucauuuuuuuuauugucucccccuaccccauuaaaacaucaacucaauaagaacuugggcuuugccuguuuuacuuacugcuguauuccccagcaccuagaauagugucuggcauacagcaggcacucaguaauuauuuguugagugaaugaaaagaagaaaggaggaaagggagaaagcaagagaguccuaagagucacuaaaaagaaggauuuuaaggaacuacaauaagagaauguuucuggaacagugggcgugaagaaccuccagacuagagugccuggucuucaaauuauaugguuugaaucuucauuugcaguguugcaaaaacauuggaaauuaaaauuaauucccucuaggaggaaaagucuuuuuuuuuuuuuuuuuuuuuuuuuuuugagacagugucucgcucagucacccaggcuggagugcagcggugugaucucugcucacugcaagcuccgccucccggguucacgccauucuccuuccucagccucccaaguagcugggacuacaggugcccaccaccacgucccgcuaaguuuuuguauuuuuaguagagacgagguuucaccguguuagccaggauggucucgaucuccugaacuugugauccgcccaccucggccucccaaagugcugggauuacaggcaugagccaccgcgcuuggccaggaaaagucuuuuuguacucaugaucacaaacuuaccaaucaguaccuuuguuauaguucucuuaggacuuacaaaugaaaaugaucugaaacuuuaucaacaucaauuuuauuaugaacuuaggaauucugauguaauuuuaacuaacaauagaggaauuauguugcagauuuauuuacauauguuauggauauaugaagugaagaagucacucauugaauccugauauuuuguuuuuuauuguugcuguuguuguuuuguuugugacuuuacucuuucuuacugcuugcuuuucucauugauauuucaggaaguuuuguuuacugacuuuguucuguacccccucauggagguaaauaaaucauauuacuauucuccuaauaggaaaacaguaucauccuaaauggaucugugauggucagcaccacccgccuacccaguuccuccaguggagaccaguuggguaguggugacuggguacgcuacaagcucugcaugugugcugaugggacgcucuucaaggugcaaguaaccagccagaacaugggcugccaaaucucagacaaccccuguggaaacacucauuaaaagaaccccagaggucaccaacauguuuauaucuugacuugacuuuuuuaugcaugcaaaucauuguuuuuacagaguuugugauaacucauaauuauuuuaauggcagagcacugcuguaucuguuuuauggucuacauaguuaaaaucuucucagagagccuaaauucuaauacauuuuauuaauuuauacuaaucuucauauuuacuguucucuaaaauaauuaugagaagcaaauaaaaucaaaagucauguuuaaagacguguuuuuaaaauuccacuaucccuuuucuaaagguuaaaggucugaagcagcuguuuagauucacuguaaguaaacuuugguaacucuaauggggauagacccacuuaagauauuuaaaaagguauggcaucagcguuucaugcucugccuuuuagcuucuaaaaggaaagaugcagauuucuagugcauuaagccugagccauauucucacaugcaagugaagucauuaaagaacuuuacauaugugagauagaaacaaugguuccuuaguuuugcacugggaagaaaauauuuuguaaaagaauguuuauuugaaauaaugauaacuaucaauuguucacaaugugguggaaauuaaaacaccaucucagcuuuaacuuuuaaauaauaaugauaacuaucuuuauugagcaucuucuacauccuaggcauuguccuaggcauugcauguuuauauccccaauucucaccacaacccugcaaguaggugguauuauccaaguuuuacccauuaagaaacugaagaucagagaaguuaagaaacuugcucaacaucauauaguaaguagcagaguugggauuggaauucaggcaugacucaaaccuggauguacuugauuccaaaugccauguuguuuucacucucugcacugacuuuuuaauuauuuaaaacucuagaaagaugaacaaagguuaauuuaaacuuaccuaagaagaugagaaucaaacaaaacagauaugcuuacucuaguuaaaaagaaaauaaaucucaugucagacccagaaaggaccaaucacuguccgauuguaagcuauguugggccaauuccaaaauauuauacgauggagaggucaaauuuaccuacuucugaguuaccucaguuucccaacaauggaccuuggcacacuggaguaacaauacauaacagaguugccaagauauuuauacccucagcacucggggcaacacaguggaaaguggggaggccauagacccaaacaaguucuuugggccaggcauggccuaguaaguacaccaugccucgaaaauaaguccagaagcacuggacuaaagagugcuaaugcaggaaauaauacacauaauuuuuagguaaggauaauaauuuaucucugcuccuaauauuacuaucccauuguaauuauuuauaacccucaagccaguugauuuuuaauauauuugauuggaaaagaacucucugguauuauuaagacucacacagaaucagggacagggcccccaaaggaguuugcuguaaaauaggcaguagaguuguggcaugggcccaacccugcauucaaguguaacagcauucugucagggucacuuugaauugugcacauaagaaaaccaauacaaaaaacaauuuguauucaauauugucacauuucucucugguagaaaaaucaaauaccuuagagauuaugaagucauuaauuuauacugaaauuggauugacuuacuaccuaacacugagcgcuguuuuuaaaugaaaagaaugagauuuauaaccacuugaguguuauugcagugauauuugaacucauuugaauauauucaguaucauuuaaugucugaauucagaaaaaaaugccgaaauuuuuauucagaugguccauaaauuaaauugcauauucauuacuuaucugcucuauuuagauuuauuuuaaaaguuuauuuaaguaaauauuuuuauaaaaaccagaaaacacuguauuacaaaauauuauuuauuaaauguaguucaggaaauaaucuauuuuuacucuuuuuugggaaauacuuguguuuuugauacaucuccaugaaguucuuuugagaggagaggcuauuuugauguuuuuauacaacugaagguuaacagccauagcauuuuaugauacuuuacagguaguccuggcuuuuucccugaaacauaagcuuggaaaaucuauuagaaagcagaacagggcaaacucuccauuuuacuuauggcuuuucuaauuuuuaauuaauuaauuuauuuuuuugagacagagucuuguucugucgccaggcuggagugcaguggcacaaucucggcucucggcucacugcaaccucugccucccagguucaagcgauucuccugccucagccucccgaguaccugggacuacaggcaugugccacaguucccggcuaauuuuuguauuuuuaguagagacgggguuucaccauguuggccaggauggucucaaucucuugaccucgugaucugccugccuuggccucccaaagugcugggauuacaggugugagccaccacgccuggccggcuuauuuuuauccacaguaaaucuucagcaacucauugucuccaccagauaguauuuuucuguaaaugaaaugcugacuucgccucuuccugcuguaugcucaucccugcacugagcacagauaugacaagcaguagccaugggggaggugggugacaaagauaggaccccgggagggggcgcagguacaugcuaguuucaauuaccacaguauucuagagacggguugcaaugacaaggggggcaaaugaaaucaaugcaagauuucuuaauaaugggcagacagaaaaauguaaaaccacacaaaacggacugcugauaauauuuuaaaauauacuuauuugucuucuuuuugcauugugaaaaaaacaaaauaaauuuugugugauaauuuugaugaugaaagguggaaguucuaccuagauuugaaugaguguuuuuuuaagggaaugagaaugucauggugcuaaaccugacaaauaagagaucauugaaaugcugaaaauuuuaacagucuucuuaaaaguauugagggggcaaaaauuaccaauuaugguauacaaaaauaagccuauaaauguguuucacauugcuaacuugaguuucaguugauucaguuuguaauaacuaguaaugagcuucuguuuacaauaaaaauucuguaaauuguuugcu

SEQ ID NO: 14369 - RNA, 84969 nt, Homo sapiens
ccaccuauacgcgccgcgccgcuugggucuccugcgcaugcgcagacggaccugcgcuggaggcuucaucuuugccgccgcugccgucgccuuccugggauuggagucucgagcuuucuucguucguucgucggcggguucgcgcccuucucgcgccucggggcugcgaggcuggggaagggguuggagggggcuguugaucgccgcguuuaaguugcgcucggggcggccaugucggccggcgaggucgagcgccuagugucggagcugagcggcgggaccggaggggaugaggaggaagaguggcucuauggcgguacgaaacuuccugucucugucucucggguucucucaggccuccccucuuggcccucaaacggccggcgucccuggccucucgcgccgccgcuucgggccucugguugggaguccuguccggccugacuuaggccgagcgcggcgugcgcgugcccccaguccccgcggcggucucccgccuggcccacgcccaccaugcgcauccaccccuguggcggccgggccgggcuggggggcugugaccgguccuggcccccggcuucgcugugcuuuccccgaggcgucucgaucgccuagcugcugcgcucuuuacccuuguuuuuuucugucgauucugagguggugguuuuuggugucuguuuuugcccuguggccuuagggugcccuuccugucccuucuuucagaaacagucauucuguaauaauagcuaaauaaaguuaaugcuguacaacuaacgucuuguuucuugauggucaguuuguauggaaugcaccugcaaggguaccuccuugucugaaagucgugcuuuaaaaauaauuaauuaagagagagagagagaaagauggcccauaaagaaaacucugaaugucuccuguauuaaggugaaguuauucuuuuuuaagagacuaccguuuaaccuacaucauggagguaucucaugacccuucggcuuauaguuuucagugucaucucauguauuuguuuuucucaaaauaaauuuaaugcaucauguacuucucucuagaaggguacuuguuugacaucugguuuuuaacuuuaagucacaaucccuucuugcuuguuaacaccagauuugaaaguuaauguuuguuccuugccuaaaacauauauucuugauugucuuuagaauagaauaguaaaagugcacuuugggcaccaugcagguccuugaugaugugacuuugauaaacuuguaaaaaaaaaucguuugguggcaagauuuagcauuaguuacuacucuuugaaaugugaauguguaggauuucuuuuacaaagaucuggaaaucuucauuaccucuuaaauuuaagcuuauuuuuauagcaguaaagucugauuuuuuuuuccauaaaauaaguaucuuguuaaguaauuauaaggugaucuaacuuuggaugugcuuauaggcccaugggacgugcaugugcacagugauuuggcaaaggaccuagguuagugcuugugaugaucacuucagauuuucauaauacuaguuucuuuaagagugguuucuuuauuuuguuugcuuauuuauuuauuuguuuauuuuacuugguagaugaaaaugaaguugaaaggccagaagaagaaaaugccagguuagugaaauuuucuguugaugccuauuacacagguugugugaaacaaugguucugucaguugucaaaauuauuuucuuacaaucauuggcuucauuacaacacugacuuacaacauuuuggaggacauugaauccuuuaaggauuauuccaguuucaggaccuaaucuuacgccaauucuauuuguugguaguuuaaaggacaaaguuuuugaacuuaggauuggacugauuuuacacuguuaaguaacuuguuacucuuaagugaauucaguagugaaguauacaguauaaucguuaagcuacugauaaaaauauuuuaacuuaauugaaaauguuuuuaaguaaaucaggaacacuccaaacuacugcuuuuccaguuuauuaacauuuuugaugauauaauggcaguuugguuguaauuucaaugcuauguauuguuugcauucaaaauguaauuagcugauuuguuauaagguugauuucuuuguuagauuguaagaaagauguaaguguucauuuauagaacauauacagggagucagaauuuuaccccagauuucaaaaagcaagccauguaaagaaguacauggagaugucggcuuuacccugaccacaugcauuagugucuguaauggagggagagguaguuagaagauuuuaaggaauauuuggguuuaaaaaguggaagauauacaacuucauaccgaguaagcugcaaucgaaaagauaaaacagguguuagugaggauauggggaaauaaaacccucauacacuucuggugggauuguaaaauggugcagcugcuuugaagaacagccuggccauuuucucaaauggugaaacauggaguuaccaugugaguccuccaccuuagaggaaugaaaacauauucagacaaaaacuuguacgugaauauucauagcagcauuauucuuaauagaaaguggaaaaagaaaaccucgcagcugcaucaacugaugaauggauagauuaaauguguuauauccauacagcggaauauuauuuggcaaggacaauaaaaugaaguacugguagauguuacaacacggaugaaccuuacaaauguggaagcuaaagaugucaguccguagagacagauuagugguuacuaagaguugggugagugauugcuaauguauacaaaguuccuuuugggagugaugcauacauucuggaauuagauaguugugaugguuggacuaugugaccauauuaaaacucaguuguccuguuugaauggguagauuguauaauaugugaauugcaucucaaagcuguuacaacaaaaaauggauagagggaaaaagugagaaauggaaguagaaauagcuuaggaggagcugaaacuacaguucagcuuccuuacccaaaaaauccccuauagucuuuucacucauugguauauuaucugaaauguuauuucauuuuaaaauuuauauauucaacucaguuccuaauucugaucucaaccacaaaguugagauuaguuuuaguuuauguuaugaaagugauugaauauuucuuuguacccauuccuucaguuggucaagaaauuaauuacagguauaguuuuacaaucaaauauacuuuucuauaugauaaucuuuaucccauuaauuuuuauuuuuauugguuacaauuuuaaaagcuuacuuucuaaucaaacauucuuuaauuuuaauuccgcaauacacaacuugcuaaaauuuauuggagggaaccuucuaccuucccugagugucacugucaacauagcuuuauauuccuuucugcaacuucauuuggggagccguugaguugauuucauccuaugggggaaaaaacaauuuccuuuacaguguuauuuuucuagaaaaagcuuaaaauuuuaucauguuucuaacauuuuaauggugauagaaaauuaaaacuuccaaaagaguaggccuauugaagaaagguacucugccagaccuacugcuaucuggcuugguacaucauugcauugcucuaccaaaguuccugcuauuagaauuugcccguuuccuacugacuggcucauugcugaagccucuguuuuucuuaaacauugcauugcagucuccaauuguguuauaucuauccaaguuuugacuaaagaagggauacuguuuugugacguagaaagcaaaugggacuugcuucuggcuaccuagaagcuuauuucagcaggagguaaauguacugaacaauuauagcugcauauuuguuuucuugaagcaagcaguagaacaaugaaaauauaacaguuauguuuugacuuuuuaucuuucauuuugcuuuauuuggugauugugcuauaaaaugccacuguaaagaucaaauugauuuaggauaauuaaaauugauuaaguuugucauauauuuuuaaaauguguaaaaagcuugaauuauagcccaccaucaaauuauaaaucauuaauaaacugugaaggcauuugcauucuuuuuuuuuuuuuuuuuuuuuuuugagacagcaucucacgcugucgcccaggcuagagugcaguggcaugaucacugcagccucacugcaaccucuaucuccuggguucaagcaauugucugcuucagccuuccgaguagcugggauuacaggugcccgccaccaugccuggcuaauuuuuuuuuuuuuguauuuuuaguagagacgggguuuuaccaucuuggccaggcuggucuugaauuccugaccucgugauccacccaccucagccucucaaagugcugggauuacaggcaugagccuccacgcccagccuggcauuugcauucuacuuacaauguugaguacuugucuucugcaaguuacuagaaauaacggaauaagacagucagauuuuaccauuacugucuccaguggagacaauaauuuuaggagcuuuauuaaagcuuagaaauacuaauauaaucuaucuguacuuccgaaaaguaaugccugacauguauacuuacuuuuguuguuuguagugcuaauccuccaucuggaauugaagaugaaacugcugaaaaugguguaccaaaaccgguaacauaaggcuuugaaauccaguuacugauacaaaucuuuaucaauagcuucacaguuuacauagaaagcaagcuggcauuuuacauuaccuucaguaucagguguuaucuggcccuuucuuacaucuccuacuucaucuggugccaucaaaaacauauauaggaauuaaaaugaggaaaagaaauaguagaaagacugcagaggaaaauaguaugugcaaaggcuugauguuuauugcuuucaaggaauugaaugguuauaaaucuacugaauauagugagccugguuuucagagcaaguuuugagcccacaaccuuucacuguuacgauuuuuuaacguugcuuuuuaauguaugugacagucccugacugcaugccugcaugccauugauacuuugugaggugaacauaucauugguccuaugaauauuugugcauuuuaauccuauaaaaggaaggaaguuauuguuccggaaguuugaaguuguauacaaaaaaguauuuugccuaugugaucuacuuauuuacuaugaugugauuaagcacaaaauagccuuuaagagccaaaguaaaaucuucacaaauauagaauuugcauguagggccucuucuagguauacaagaauaccaagaauaacugagcuucuacuuaacuauuugguacuucuuaugcuuugggguuuuuuuuuuuaauucuuuaauugauuugguacauuguauuugugacacugugaaucuuaaaauuguuuuccucuuagauucuuuuuugccaagacuucucaaauacuuauuuuuuauaauuuuaucuuguagguaucuuaguaaguugcuuuagaucuuuuugcaagaggggcagauaugauaguuaaaaaaaaaaugagguguuguuuaccacaaggagaugaugccaaaaagauuucauuucuuuauucauagucuuauccuuuuuauccuguagaacaucaaaauuaugaguugaaauagguggcagcauuauaagcuuguaacuuuuaaauuguaucucaaaaaaauacagaguggggccgggcaugguggcucacgccuguaauuccagcacuuugggaggccaagguggguggaucaccugaggucaggaguucgaggccagccuggccaacauggugaaacccugucucugcuaaaaauacaaaaauuaguugggcaugguggcgggcaccuguaauccuagcuacucuagaggcugaggccggagaauugcuugaaccugggagguggagguugcagugagcugagaucaugccacugcacucaagccggggcgacaaagugagagucugucucaagacagaagaaagaaaaaaaaaaacagggugguuacuuuuuuuaguuauuaguauuagauguugaaauggauuacugaauguauuuuauaauuuguuuauguucauguagaaagugacugagaccgaagaugauagugauagugacagcgaugaugaugaagaugauguucaugucacuauaggagacauuaaaacgggagcaccacaguauggguaaguuauuuuuuaguaaguaacaauuguguaaaugcuauauaguaaggagagugugccuauaucaaacucucagugguugaguccauuguuuuuacauuuuucuauuuuaacauaaaagaacuuguuaaaguuucaucaugaauauacuucuuugcuaaaauacaguuaauugauuaggcgaagguacauagaagcagcaguuuuugaugcugaauuuaaaguguuuuuauaaaagaauugagugcuaggccaggcauagagguucaugccuguaaucccaggacuuugggaggccgaggcgggugaaucaccugaggucaggaguucaagaccagccugaccagcauggugaaaccuuaucucuacuaaaaauacaauaauuagccaggcaugguggugggcaccuguaaucccagcuacuccagagacuaaggcaggagaaucacuugaaccugggagguggagguugcggugaacccagaucgagccacuguacuccagccuggguaacagagugagacucugucucgagaaaaagaaaaaaaaaaaguacuauaaauucuuugauuagaauuagaaauccuuaaauuguaauuuguaucuguacuuauuauuauuucacuuuauuauccagaccugaguuuagguuuuuaauuuuuuugccuaauaaaaacaauaucaaaaguauuucuuuuuguucuuaauaguguuuucagguuucuaauucucccuuaggccuuuuaggccaauguuugucuccaauuuuguauucuauaaacuggaccaaguaaauggacugucauugacucauugagcgcauaaagaaucuuacagaaagauuggaagggaaauacauugaaguacgaauugugauuuaguuacgauaggagaauaagagucaauguguuuuguuuuucaaauuggcuguauaaugugguuauuauagcuuaugcauuggaaacauaaaauacauuaauuucacuauaguucauuaagcaaccucaucuggaaucaaccaguauauacaaaaauauuguuaaauauuuuauuaguagagucauuuguuuucagaagucauuucaggaagcuuaaagccaauucaguuauugucauagucaguuuuguauuauaauaaugacuacccauguaauuuuaaaauccuagcaccuuuuuagggaacagaguaaagaggcugauuuuucauguuagggguggauauucuaaaugugcuccucauucucauuugggaaaguaaauaauuacuuaaugagaaaguugggcuuauacuguaguacuaguaggccuuuacuaucugcaugaugcaaaaggaacacauaaaauuguaauaauugcauguucauuaaauguuauguaaaauuauuuguauuugcaaguuauagaacaacuugaagcaaaugacaauuuuuuuggauuauggaugggaccuuuuuuugguagaaauugcacucaaauauuaaauauacguggacuuccauaguaccuuacuaaacuuuauuucuuauagcaauuuucaguuuuaugcauuguaauuauguuuauacauauuuauuaccuuuacacacuucagauuucuauagaguagaaaccauugaauucaaaacucuucaaaaaaacaagaaacugugauuuauggaguuuucuauuccucacauugccuuaaauacaguuaagugugcaguaaaugguuauugacuaaauaaacugaauguuauuuaguuacaguugucucugaggguuuuuccccuuagacauuugauuaugaaaauuuucaaaugcucacaaaaguugaaggaauugacaugugaaugcucauuuacccaucaccuagauuauacaaucuacauuuugcuuuguuugcuugaacucauaucccucuaugcguuuacccauuuaucaguugauuuauuuuuuauucauuuuaugcauuucgaaaguaaaguacaggcauuugugaagaguguaaaguuguuuaaccucuauauuucaagguauaucccuugaaaacaaagucagugagaaaaugaaauuugauaaacauuuacuuaugcacagcguuuucagaagcaaauuuaaagaacaaacuguguccaaggacugaauugauuuauuguaaauuguuaggaaauacaaaauagcauuuuuuuuuuuuuuuugcguaacauaccuuuguuacaaguucauuuuauauguaaguaagguaugaagaaaagcaacucuuaaaguagaaauaauuuaucuuggaaaguaguuuguuaccuaucucugugagauugauccauuuauguacucaauaaauaauuuuuaaagacauaauuuaucuggcacuguguuaaguagcaaagauaaugugccuuuaucaaaccaucugugaucauuccauuauuauuauuguuuuuacauuuaccaugcuacaaaagaacccuugguaaaaucaccaugaaauuucauggaguuaacaaauuagauaaaguuacaugaaagcagcaauuuuuuaucugugaauguauuaauugaugagaauacaggaaguuauuauuuuccagagguagugaggaugccagacaugugaguaaauauuuucagugcaacauaagugcuagaauagaaacauguacaaagugauucgaaagguuugagaggagaguugcuaaaagccuacagguguugaagagaagaucccagagguaacauuugaacuuguuugaauaauuuuugagaugggagacagugguuuuuagguggaggacacugccuaacaauaaauauauuagaugcgugccuuggaggaaguacauggcuggaggauaagguagaugaaaagagaugguugaaaucacuuauggaaggaguuaggaugcuuuugcuaugucuuuguagaccuugcaagcuuguccaaugcaccuuauuuuguugcuguuguuguucuguuuugcuuuguuuuagucuuuuagcugcccaaagccaugguuuuuaguuucugucuccagugauaaguggaaaagaggggugauaaaggggcuuuacuggccuaaccagaaacagaaacuaaggacucaugacuguauucucucccuuagacaccccuaauuagguuuuuagacaggucauaucauuugaaaagauaacucuagcaucaguaguugagauggguuagauagagagacauugacuaauagaugugaaguaguuguccaggugagaugauaaucuagacuaaggcagcaguaguagagagaugaaugggaaaauaguacauuugaguauuagagaaacagaaauauagucaggcaugugguauacaccuguagucccauggacuugggaggcugagguaggaggauugcuugagccuuggaguuucaggccagccugggcaauauaguaagauccugucucaaagaauaaauagaaacaaauaacauggguaacugguugguuguggauggaggaggagauaaagggcucagugacuuaaagauuucuagagcaguuaauuggguacaggugggugcuacugcucccaccucccacaaaacagauucauuugacauguuuauuuuggaguuccuauagaaaguccaaguauaggaucuagcauuuagaguggucugagacuucauagggaucuauuggacauuauaucaaauuugccucugcaauuuuucauaccacuaagcuucucuacacaggcuucucuacaaaggcuuguggcuuaaaaaagaaaaaugauguuuuaaaaggcagaauggggaauagaaaguagcuagguggaaagcgaagaagcucauuuauugaacacuuguggcuaagccuuuuauaaaaauacuguuuuauucuauacgguccuguaagagaacaguuuagagaaaauccuugauuuuuguacauuuguagaaaaaucauguacaucauauguagauaccgcuaagucacuuuuucugaauuuggauuguuaaaauguaaacaucgugaaggcaggaaccguaauuguccagcuccucauacuuuuuccucagccuagaaccauacuugacaugguuuggugcucaguaagcauuacaugaauuaaucagccuaugaaaugauuauuucaaguuggugacgauaguacugcuugacaguaguaauauuugguccacuuuguaauuuuugcauuucuagcuguggagcuacaguuauuugauacaauuaaacauuuuauugaauuuacauuuuucuuuuuuaaguagaaaagaaaagugacagugcaaauguaacuaaaccuaagucuuaaauguaguacaucagagacaaaagauggaaguaauuauuauuagacccaaagcagugaaucugaaguccagauggcugaaguucugagagaaaagaaccaaauauauaacaugaauauaaugugagaaauauaucauuauaaacaucugugacuugaggucuuacugauaucuuuuuuuuuuuuugagauagagucucgcucuuuugcccaggcuggagugcaguggcgcgaucucacugcaagcuccgccuccuggguucacgccauucucaugccucagccuccugaguagcugggauuacaggcgcccacccccaugccuggcuaguuuuuucuauuuuuuaguggagacgggguuucaugguguuagccaggauggucuugaucuccugaccucgugauccacccgccucggccucccaaagugcugggauuacaggcgugagccgccgugcccggccgucuuacugauauguuuuuguucagugggaguugguccuucuuugcccauucccguuuucuucuaacuucccuaguaacagaaaagucucuuuuaauuaguauauuugauaauacuacucauauauaagaauccauuauauaaagaaguaaagaacugucuguaaccccguauuacagaaaauguauacaaggcucauuuauacaaguaaaaaugcaaugaauuauucaaauaauuguauacaagucuuagguguuuuggccaagauuacacaacuagcaauugacaaaacauuugaauguggguugguccaacuucagauauuuuuuucuuuaucacuguguauuauauuacaucuaaaaaggugcagcuuaauauuuuuucaaauauauacauucauguaacuacagccagaucaagauaugaaacauaauuggcauccuagaaguuucucucauuuugccucuuggucauuaaccacccaccaccggcaaacacuguucugcuuucaugcuagacuuauuuuugaauuucuugucaauaaauuucuguuauggacugaguacuccaugaauaguugaaaaaggauuuauuaacaauaucaaaugcaagaagaacugaaaggccacuagauuugacaacaaguuggaggaauuuuacuuaugcuuaagagugcuguauauuuaauaacugggaggcaaggaaaugaagacaagggguguaaacuauuuuucccuucuuagccuuauuucuugugaaguuuguuacaguagaauguugaguuauuggcaaaaagguuuuugaaauggaaacaagucaggcuuuuuuuuuuuacuguuuuugccuuuuauugagcaagugacuuuaaaaaucaguuuaaaauguuuuuuaaaauauguguuagcugggcacgguggcucacucuuguaaucucagcauuuugggaagccaaggugggaggauugcuugagcucuggaguucgagaccagccuggacaacaugguaugagaucucaucuauacaaaauuuaaaaaauaaagauagaaauaaaaugugugucacacuauccauuuacuaugugauuguauaauuuguuuguacaaauggaauauauuacuguuuuguuuaagcuuuucaggauaauuucuguuuuuuuuuguuuguuuguuuuuaggaguuaugguacagcaccuguaaaucuuaacaucaagacagggggaagaguuuauggaacuacagguaaaauuuguauuuucuguugcaucaauagggaaauaaggcacauaucuuaaauaggucuuaauagcuuuuuuuuuuagucggggacagagucuggcucugucacucaggcuggaguacaguggcgcaaucuuaguucacugcaaccuccgucuccugggcucaaaccauccucccacuucaccuucucaaguagcugggacugcgggcgugcaccaccaugcuuggccaauuuuuguauuuuuauguagagaccaggucucaccauguuguucaggcugcucuugaacuuucgagcuuaagugaucuaccugccuuggccucccagaguguugggauuccaugugugagccacugcgcccggccaaggugauaauagcucuuuuuaaagaguaauuuuugaccguacaucacagagacugguaaaguuuuucuggcaagaguccaguagcacguauuuuaggcucugcuuuguuuggaacccuugccagguuuuuugccaggaauaguaaaaagauguuuguuuucuguuuguguguguauaugugccaggaauaguaaaaagguguuuauauuuucuguuugucuaugguaucgccuggcuucuugcaaguauagcuccuucauuuuguaauuuuauaaaacagggacaaaagucaaaggaguagaccuugaugcaccuggaagcauuaauggaguuccacucuuagagguagauuuggauucuuuugaagauaaaccauggcguaaaccugguaagauuauuguggauuauauuaauuucaauauuuucagugugaagucaucagaaaauuuuuuugaacaucaauuuagaauuuuauuuuuucauuauaauuuuaauugucuuaagcaaaugaugaguaauaaugacuugggauuauuaaaucuuacugguggccuuguauuacuuaaaauguagacuuauuguuuauuauaauggcguuuguaaagggaauaauuugaucaaaaaugauauagucuuuuugccaccauaaaugauagagugauaacugauagaacucuaaauuuauauuuuuauaguuuaguauauuuuugaugcugcauaaaaauagagcugaaauauuuguacacuaaaguuguguuuuaucuuuaggugcugaucuuucugauuauuuuaauuauggguuuaaugaagauaccuggaaagcuuacugugaaaaacaaaagaggauacgaaugggacuugaaguuauaccaguaaccucuacuacaaauaaaauuacgguaauuaauaaauacuccggaauacccuuggcuugucuaccgucccacuuuuacuccccaaauaaaucgcuucccuauaaaagugguuaaaugcuauaugauaguuuaaaaauuccauuuuguuuaccauguuuguuuuucccuucccucccuuuuagaguuucguauuuaaugauuaucugauguucuuacuuucaaaucacagacuagccacagcuaguuugucuuuauauggccuauuaauuaaauauuaugugguaucuuaauggggaauauguuauuuaacuuaggccgaagacuguacuauggaaguuacaccaggugcagagauccaagauggcagauucaaucuuuuuaaggugaauuuuaguaaauuauccuugguugcucucauuuuuuguucuugagucugcucccaugccacuacucaagggacaagauuaaaguggaaauagcuaccuuuuuuccaaaccuucagcuuccuggugacuuacaaauuugcugauuguuguuuuaucuccacuuuugcaagcaugugaauuuauagccuauuauacuaacaaaugccgaguaaaacuauuguuugcuauauguugugauuucauuuugagucguaauacauguuuguaggauagaaaaguuaguggcaacagauuaugcucucauuguagauaauacucuaaucuuuaucaacagaauuggaaacuuuuuuguucucuuuaaaaaaaugguaaggaagguggcauacuguuuaucucuaugacacuuauaacacugauaucauugguguaaugcccugauagcucaagauaucuucaaaaaucuuaggcauucucugagaggcuuuaagaacucaacauaaugagauacugccauugauuuuaaaaauuuguucuuaaaaggaguagguuuaugugagagacuuugagguugauacuacaacuuguauaacaagucugauuucuggcuucuccauuccaugguaugaucacagacccaguccaaagaauaauacuauauugucauaguucuuuuauggaaaacugauuguguacucuuuuuucuuuaccuuaauaguugacucuuauauugaaugacacugggaugaagauugggaguggcuuuuagauuggguuguauacucagggaacuuuaguggacuggaaagagaccacugcuccccuuuuggguuugcagcccuguccaccagaauacugccuuaugcagugugugugcuaugucugcagauacaaccacucuacuguacacaguucuauauagauaauuuuauuuuaauuuacauccuacuuugcguaaguauuugguucuucuuuugcaaauauuuugaaaguaugugaugaugucuguuguguuuuaaagggucaucaguuuuuucuggguuauauugucuauauaggcauugaauauauuaaacuugacugcaauggguagaaaaguugucuuaaugaacuaguucauuagcagcagugcauuuuauuuucuuuuaauagaaaugagaacugccaucauaaacuguuagcuucuguauacuucauuuuuuguaguagacuuaaaaagagaauaaaaagaaacuccuaggggucagucucauugaagguagccguuaugaauguguauuuuauauacauacuguguacugaaaaauuuauuuugaaguuucuuuuggcuaugugagaggaggucauagaguauuccauucugauuggauucugaaugaaagauuuuaauucgauggguacagucuucaugguuuucuugccuugauaguguguuuaaauacuaauauguuugguagaaauacugauuugggaauaggguguguauuaagaauauguguggcaaacauuuuuucuuuauguauauugugguccguaggaaaugguggaaauagggccaugaugagcaggacauugauuuuaaacuaaccugcaaacauuuguguagccaauaggaagcuguuugaaaguuccugagcaguagaaugaaguggcagaucugguauuuagaaaaggaacuggcagcaggaugggcuguagaaugaaaggggugugaaacagauagggagcuguugccauacuaugggacuaaaaugaacuagggccugaacucacuuaugaggaugaaugggcaaaggaguggauuuaagaauuaaaauuuauuuucauaucugcugcaaauagaauuuuuucauccuuaagugugagacagcccaucagccucuuuaagauaacuuuauuuacuuuucauuaaacaauuugcaaacccaguaacaaguagaauaguacacaugaacccuuaggugcuuaucauacagcuucaacacuuaacaguguuuugacauucuugagguaacagccuuuuauguacuucaauaugaauaaaguuuuuuuaaaaagcaaaauaaaagaaauuuaauagguauaaaaauaaagccacucaauuggguacaaaaacaauuguguaauuauuuaauuagagugaauggcaagagagaagugacuagugggaauagauaacauguauguaugagaaaacguugacuacaacguuuucuuaaaauauuuuuuauucauuugugcacauaugcauagauuuuccccccggcccccccccccccccccgcccccggcugugaauguaugagcuuugucaccaguuuucugaaauuuuacaguuaugugucuuggucuguuuucauccauuguaccaagcauucucgauuuggaagcacauauccuucacuuauggaacacuuucuucuuuuacuuuuuucucugcuuucuuuucuauucuagauaauauuggauaucuucgaauggucuucuaauuuuuuuuauuguuuuucucuuuuucaucuuuuccauuaucugggagaauuuuuuauucuuauaauguuauuguacuuaguuuucauuucuguuguuaauuuccaagaaaauuuuucuuuauuauuuaguuguagcaucuuauuauucaugccuacaguaaugcaauaucuuuuucccuccucucucaaaggauauuaaugauaggcuguuuuguuucuguuagauuuuucuuuuccugcauagucuguuuucaacuugauuauuuaaguuaguuauuuuuaucuucugacuuagacuuuucugaaauguuuguugauuguuggccauucacucauguaacggugggcugcuaaaauugauuggaagcucuguacaucugaauagaacuugcuugacugcaggcuucacuggagggcuguuuuuucacauucccugaugucaguauuuuuagguguuuuucuuuuugugguaaucagauuuuuucagauaagguauuccaguauucuaucuagaggguauauacuuggcugaugcaaauguucugguagcuggagcuuuuaauuucugaauuuuugaggguccugacaugauaaucauugucuuugcuuucucaucgcugacuuaggauucaguuuucuuuggucugcucagucaguuacuauuuuuuaaucuaauuucaaaguucuaaauuuuguugcuuucucaguuuuuuucuuauagguugaaacaaaauugugauaauuuauuuaugguugucuguuuuuccuuuuuuugacuuuaacauguaauguuuucauaaguucuuaaauuuuuuuauaaauauaauuuaaaauagcuacauaguuuauuauuuggaugcaccuuaguuuacuuaacaaggguuuuuuuuuaagauauuguuuguaaaguuaaacuuuuacaaaugaagcugugauaggcagccaaaggaaauuucaaaaauauuuuucaaacuuuuaguacagugguagcauaauuugggugaguauuuagcuucucaagguuguagacuuaaguuuuguuuggauuugucagaucugacauaaauuuguuuuuagaaaauuagucauaaugucuuauggucauuucuuaagauauuaggucaugugaaauaaucucauuauguuacugguuagacaaauuuugaguguguaaucuugaguguaacaucugaagacaaacaaauggauaaucaaguugacuagaaagguugcuagaauagugaggauuuucagaauuguuuaauagaaugaggauauuaugaagaaauuaaggaaaaaagaaaagcugggaaacacgggcaauuuuuguguguuuaaaaaucuaugccauuuuccuaauaucuucucugaccccaccucucucuuucucuuuuaaugucucucccacgucucuuuccccaauccuucccgguuccuccuucccgguuuuuaauugagcauugacugugccaggaaguaccuuaggcuuuggggggaaggggaggucaccauaauagacauggagccuauagucuaggcauuuauugugcuuaaugggaaaauuuagguauuaauuaaauaaucaugcuaaagaugauauaguuauaaacuacauguucuuuggaguuugaagaagugacauuuaaguugauucccaaagacagucaaguaacaaauacuuauugaguacuuauugcaugccagguacuguuuuaggaugagacauaguaauaaagugauggaauuuugugugugugcguguguguguguauguguauaucuacguuaauuuuucugauuucuuauuuauauaucucagcaucacaggguugaaaagcaccucaacaaauccuauuagaauaaugagcacucaucuuguggauauagauaucacccugaguaggccuuaauuggcauaacuguauuuuaugauuuuuuuuuuuuucuugagacagaauuucacucuuguugcccaugcuggagugcaauggugugaucuuggcucacugcaaccucuaccuccuggguucaagugauucuccugccucagccgcccgaguagcugggauuacagguguauaccaccacaucuguauguuuuuuguauuuuuaguagagacaggguuuugccauguuggccaggcuggucucuaacuucugaccucaggugauccacccgccucggccuccugaaguguugggauuacaggcgugagccacugcaccuggccacaacuguauuuuagauguuaacuuuaaguaggccuuuuaaaggaauuaucuauacaaagcaaucauggauguaacagaacuucaaaggaaauaaaacauuggcuuuuuauaauuacaauuacauggugagaaaaagauucaaaagcaaauguuucuauguugagauaaaaugaacuacaauuagaaucuuuuuuuuucccaagauggagucuugcucugucacccaggcuagauagaguucaguggcgcgaucuuggcucacugaaaccuccaccucccggguucaagcaauucucuugccucagccucccgaguagcugggauuacaggcgccugccaccacaccuggcuaauuuuuuuaguuuuaguagagaugggguuucaccauguuguccaggcuggucucgaacuccugaccucgugauccacccaccucggccucccaaagcgcugggauuacaggcuugagccaccacgcccagccuacaauuagaaucuuaugcuuucuuuuacaaccucaaauggacagugcucauaaaauuaaaaaaucaugcuuucauaaacauuaaaaccugucauaaaauuaguggcaauuaauaggcuuucuuagucucucuauauaaauaaccagugaaccauuuauuuucucccuguugugcaaagccaaguggucaaugcaguugauuucagauugagcauuuuuuaacaaaauuauugaagcauacacagacuuaauacuuuuggagaauuauggaguaugaaaggaaaauuuugaacucugcaguuuuuacugcuagagaguucuaagacauucaaaguuauuuuucuuuuuaaccgaugaaagaauguuuaugugcagaaaaagaugagauauuuuuguugaagcaagugauugugcuucagacuggaauccuuuugaauucauguuguuuucccuguaaagagaaaccaggaagaagaaaauccgaugacacuaauacaucaucccagaugcuuucaaaggauuccuuuuuguaugggaacuuauaagcaaucacacuauugccauaaugagauucuuuugggugguugaguagcuuuccuucauuccucuucugguagacucaguaaaauuggcuagagagaucagugaucaccagagagugagcuguguggcuagagcuugaauccaagugguccaaaaacaccguuuuuauucuuauccccucucaggagaaugguacucaugaauggaguggcaugcaucuucucugaaggcaggaugucugugcuguuuucuucucauggcuaaauuagguagucucugucuguugauaaaaaggcucauaauaaaaauaaaaaaugcaaaaaggaauuguugaaaucucauuucucugccacacauaagugauaaccucucaguguaaaccaaacaaucuguaaauagucuggaauaucugugugacaaaugacaaaccucagaguacugccagcuguguuuuccaggaggguuacugaucgcagauuggaauuuggcauauauuguaaaguugacauauuggguguucauauguauuagauaauuucuaugguucuuuuuuuccuugagcagcucaguagaugauggugccauuuauuuauauggggaagacuuguagaggaucagauuaggggaaauuaguaguuuuguuuuggccaugguaacuuugagaugucuguuagacaugaaagaaguuacauagaaauuacugguggucaggggagcaauucggacaauagugucaacucugaauauuccuugacauccccaggcagaacaaugcguuucuuuuuguguuauuauaacaucuuuuauccuuuagauuuuuuucauaauauuuauuauauugcucugauuguugguguguuuguuuuuuccuaagguccaggauccuguuguguuucuaucagcuucugguacauaauagauauucaauaaaugauguuuacauucucucaccagauccugucaguuuuaccugucagguaucugucaaguccauuucuuucuguucccauugccuuagugccgauucucaucaucucauuagaaucagggcauuuaaaaauuuuuuuaagugguagaacucauuuucaaauaaacuaaauguaagauccucauuauaugagaguaucaauuagagauuggguuggacacuauuaauaagagagcuaucugacuauaauggcucaaguguaaaagaguuucuuuucuucacauaaugauuaguugggagguagaugauuuuggaauugaauuggugguucaaauauaucagucaaaaugucuugagauucucuuggccuuugccucaugggaaaggagagugaugcugaauuuaaauggagcagggaauuuaaauagaauuuaaguagaacauaaaauauggugugauauuauuuaaguguaaggaaacuugaauuuguuuaaauugaauaguuugaugauaauuuuaagauaaaaaggugaguauaaaagcagaagagcauaaagaagucauuucaacagacuagaggaaugugacugggcuacaaucaaaggaucuaauaagagcagaaagguuaggcaaaucuuggagaaauuauggaguaaguagauagaugguuuuaaaauuaauauuaagagggagaaggcugggccugguggcucacaccuguaauuccagcacuuugggaggcugaggugggcagaucacuugggacgggaguuugagaccagccugggcaacauggugaaauccugucuuuacuaaaaauacaaaacuuagccaggcaugguggugcacaccuguaaucccagcuacucggggggcugugaggcaagagaaucacuuuaacccaggagguggaggcuucagugagccgugauugcacgacuguacuccagccugggugacagagugagaagagguauuaagacagaugauuaacuucaagcuuuuaagccuacugaacugucaggaugaugguacuuuuaauggugaugggaaaaugggagaaauuguauggauguacaguagcagauuauucacauuuguguuacaggaaaucacagucugaauagaaaauggucagaauggcuaaaauggucaccuauuguuuucuuagaauaaggguggugaacacagaacgggaaaauucuucaaggucuuucuugaauucgaaacaugaagucauaaccaaguaucugggaccuauuuguagugaucugcaggaauuuaugaaagugccaaagaauuaacaguuuauucggcuucuaaguguuauuaaugugaacuuuuugauaguuggaacauuuugaucccauacucucuuuggugccuuucaccuaauacuguucuaaaauaggcuaauuuuaauaaauauucagcaaaggaacauucuuaguguuuaacuucaaauuaaauguuguaaacuuauuuuaacaucuaaaguccauuauguuugaguguucuguuaaauucaacaagcuaauaaccuuuuuuuuuuaagguacagcagggaagaacuggaaacucagagaaagaaacugcccuuccaucuacaaaagcugaguuuacuucuccuccuucuuuguucaagacugggcuuccaccgagcagguuaguuacauaguuauaacucaauuacuguacgacauugguaucuuuacauuguauuugugcuauauuaaguauaaaagcucugaauguuuuaccaaaaaacuggaacauuuuacuuugguuuaguacaaaaugaauucuucacaagaaacuucuugauguuuuuccaucuaaaaagccuaggguaagcaagaagugaagugcgguauauaguuuuguguaugaauaaagagacaaucuuauauucaagagaggugaauaaagagacagucuuacauucaagagaggugguaacaguaguauuugcuguuuccugugcucccuauucuuacauaaagaauuauuggacuucuaagucuagaucuauuggccugaaggucuuuugcuaauuguagugaaagaggcuauugaaauuucagcuuggaaaaucuuuaaaauuggaaccauuuguuguuguuguuugauuuuauaugauaauaccucauauguucccgaagguaucagauguaagaggcaaauaugcuagaaaaugucuuuuuuacuuaaaugugacaaaugguuacccuauuaugccauuaccaggaaacugguaaaggauaguaggcuaagacuagcgaaguuugaggucaguaguuuaaucuuggacuagauaagaugacuaaagucugggccugaaacaaauuaauaacccaacuauuacuaguucucggccagaucacuuaccuuuuguguuacugguuuaaauuuauuuuauauaguuuucuguuuuuguuauucuacaguuuuguauuguuauaagagacauuuuagaauaaucuaaugcaggaagagacuuuauaguggcaucuagucuagcucuaagauaacgauucuugaagccuucagccaaaauuaaauggcauaaagugauccaggauuuuugugaauugucauagacauaaugaaaugugauuauuuaagcuaaauauaaucucaaaauguuugguuuuaaagaauuuaugacagcuaagcuuuaaauauguaguaauauauaauauuguaauauguaguauucuuuuggcuuauacauuuuuuaagagguuaacuuucauucauugaguuuaugguauucugcaguauagagugaugguaacagcuuggacucuggagucagauuucuggaguucagaugcuggcucugcggcuuacuagcugugcugucguugggcaaauucucuaaucuuaugccuugauuucuuaaucuguaaaauguaguaauaguacuucccucacaguguaguuaucuauauucaguggauucauuuauguaaaguguuuuagaacagugcugguaccuagaaaauacucuagauguuugcuauuauacuuaaacuauuuaaaaaucaauaguuuuucuguacuuugccuuuuguuuuuuuauuguugauuggccuuucaaaauuugggccagauuauguaagggcugugugccauuauaaaggcuuuggcuuuuccuauaaauuaaauaaauggggacucacuggcggauuuugagcagagcaaugaaauaaucugauuuagguuuguaaaguuucgauuuagucgcuuuacuaaaaacagacuacagaguuacuuagggugggugaaaacagggaggccaguuaggagguugcagcaauuaucuaggcaagagauaaugguaacuuggaccaagauaaugguguggagauguugagaaguagucagauaccaguuauauuucagaagguaagccaauagccuaucuugauggauuggauguagauuguagaggaaaaagcaguuaaggaugaauccaagguuuuuguucugaucaacugaaccagaaugaugguuuugucauuuacagagauggaaaagaccauaaggaggagugguuauuggaggaagaagaccaagaguucaguguagaauauaauaaaaaugagaugccuauuggacgugcaagugggaaauuugaguaggaaguuggcuauauggaucuggaguagaagggaagaguaugggcuggagauaaugaauuuaggauaaucaguguuuaauauuacuuaaaugaaacuacaaaauggaauuagaccauaaaagagguaaguauugauagagaagugguaagagacagccuuggggcacucccuuguaugucaggaaaauaaggauuaacuaguaagaggagaccauuaauaaggaggaaugaugaaugaaguaggaaaaaaacccacuguaugucuugaaaaugauguguuucaaggagaaaugucagcuaucaaauacuaaauccaauugauuggucaagaaaaugaagacuaagaaugaccauuggauuuuauugauggucauuggugauccugaccaggaucauuuucauuuguauaaaaugaagauaaaagacuuuggaauggauuaaagaaagagugggaggaaaagaauuagaaagagaaaauaugggcacuuuuuggaagacuauuuucuuucugugggggccagagaaaugugacaguaucuggagggaaauguggggucaggagaaguuuuuuuucaaaacaaagaaaaaaacagcauuuuggcugggcacuguagcucaugccuguaaucugagcacuuugggaggcugagaugggcagaucuguugagggcaggaguuugagaccagccuugccaacauggcaaaaccccaucucaacuaaaaauacaaaaauuagcugggcauugcgaagcaaaccuguaguucaagcuacucgggaggcugaggcgggagagucacuugaacccaggagguagagguugcagugagccaagaucacaccacugcacuccagccuuggcgacagagugagacacugucuaaaaaauaauaauaauuacagcauuuuguauauuuaugggaaugaguuauuaaaggagaaauuggugguguaagacagggaaguuguagaggaaugucguuuaauaaagccaaagggaugagauguaauaugaaguagagaaguugcccuuaaguagaagcauggaccguucauucauaagaacaguaacgaaggcaggauacagggcaccagugcagauggguagguggauaauggaaugggaauaauugaaaguucucuucugauugcuuucauuuuucccggcaaaauaauaugcacacuuaucuggugagagugaggcuguuggaaauaagaggccauuggaagguagcauugaguguuugagaagaaaagaggucugaaauaguuuuuuggaguucugugaauaaacuaggugaaaggaguagcugggcagcuggagugaaguguggggucaagagaaaccuuuuuuuucaagaugagaggaauuacaguauuuuuauaugcugaugggaaugaguuaaaguaaaaaauugaugacacagggagagaaacuguacaguacuacuuucuuaucuagguuuugcuuuccuugguuucaauuaccuguaguauguuacaauaagguauuuugagagagaccacauucauacaacuuuuauuauauuagauuguuuuuagauugguguaaaaguaauugcgguuuuggacugugaaauuuaaaucauaacuaggcucaaacacaucuuuauuaaucaaaauagaaaccauuacaaucacauuuuuugccaaugagaaauaaguuucuuuauuccuguaguguaaaaauccgugcuucggauuugacaaacucuuggaaagcauuuucuguauccugcugauuguggaaguguuuucccugcaaaaaguucuuaagaugcuugaaaaagugguaguugggaggcaggagaucagaugaauauggcggaugaggcaaaacuuuguuguccaauucauucaacuuuugaagcauugguugugcaacaugcgguugggcauuguuguggaggaguauugggcucguucuguugcccaaugccggcugcaggcauugcaguuuuuggugcaucucaucgauuugcugagcauacuucuuagaugaagugguugugcugguauucagaaagccguaguggauuagaccagcagcagaccaccaaacagugaccaugaucuuuuucuggugcaaguuuggcuuugggaagugcuuuggagcugcuucucucuccagccacugagcuggucaucuccagucaucguauaaaaugcacuuuuuuuuuuuuauuauacuuuaaguuuuaggguacaugugcacaaugugcaguuuaguuacauauguauacaugugccaugcuggugugcugcacccacuaacucgucauuuagaauuagguauaucuccuaaugcuaucccuccccccuccccccaccccacaacaguccccagagugugauguuccccuuccuguguccauguguucucauuguucaauucccaccuaugagugagaauaugcgguguuugguuuuuuguucuugugauaguuuacugagaaugaugauuuccaguuucauccaugucccugcaaaggacaugaacucaucauuuuuuuauggcugcauaguauuccaugguguauaugugccacauuuucuuaauccagucugucauuguuggacauuuggguugguuccaagucuuugcuauugugaauaaugcugcaauagacauacgugugcaugugucuuuauagcagcaugauuuagaguccuuugcguauauacccaguaaugggauggcugggucaaaugguauuucuaguuauagaucccugaggaaucgccacacugacuuccacaaugguugaacuacuuuacagucccaccaacaguguaaaaguguuccuauuucuccacauccucuccagcacguguuguuuccugacuuuuuaaugaucgccauucuaacuggugugagaugcuaucucauugugguuuugauuugcauuucucugauggccagugauggugagcauuuuuucauguguuuuuuggcugcauaaaugucuucuuuugagaagugucuguucauguccuucacccacuuuuugaugggguuguuuuuuucuuguaaauuuguuugaguucauuguagauucuggauauuagcccuuugucagaugaguagguugcgaaaauuuucucccauuuuguagguugccuguucacucugaugguaguuucuuuugcugugcagaagcucuuuaguuuaaugagaucccauuugucaguuuuggcuuuuguugccauugcuuuugguguuuuagacaugaaguccuugcccaugccuguguccugaaugguaaugccuagguuuucuucuaggguuuuuaugguuuuaggucuaacauuuaagucuuuaauccaucuugaauuaauuuuuguauaagguguaaggaagggauccaguuucagcucucuacauauggcuagccaguuuucccagcaccauuuauuaaauagggaauccuuuccccauugcuuguuuuucucagguuugucaaagaucagauaguuguagacaugcggcauuauuucugagggcucuguucuguuccaauggucuauaucucuguuuugguaccaguaccaugcuguuuugguuacuguagccuuguaguauaguuugaagucagguagcuugaugccuccaguuuguucuuuuggcuuaggauugccuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuacccaugagcauggaauguucuuccauuuguuuguguccucuuuuauuuccuugagcagugguuuguaguucuccuugaagagguccuucacaucccuuguaaguuggauuccuagguauuuuauucucuuuguagcaauugugaaugggaguucacucaugauuuggcucucuguuugucuguuauugguguauaagaaugcuugugauuuuugcacauugauuuuguauccugagacuuugcugaaguugcuuaucaacuuaaggagauuuugggcugagacaaugggguguucuagauauacaaucacgucaucugcaaacagggacaauuugacuuccucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguuugauauuggcuguggguuuguuauagauagcucuuauuauuuugagauacguccuauuuacauaccuaauuuauugagaguuuuuagcaugaaggguuguugaauuuugucaaaggccuuuucugcaucuauugagauaaucgugguuuuugucuuugguucuguuuauaugcugaauuacauuuauugauuuucguauauugaaccagccuugcaucccagggaugaagcccacuugaucaugguggauaagcuuuuugaugugcugcuggauuuguuuugccaguauguuacugaggauuuuugcgucaauguucaucagggauauuggucuaaaauucucuuuuuugguuguuucucuacccggcuuugguaucaggaugaugcuggccucacaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagagccuauuauuggucuauucagggauucaacuucuuccugguuuagucuugggaggguguaugugucgaggaauuuauccaugucuucuagauuuucuaguuuauuugcguagaaguguuuguaguauucucucaugguaauuuguauuucugugggaucgguggugauauccccuuugucauuuuuuauuguguguauuugauucuuuucucuuuucuucuuuauuagucuugcuagcagucuaucaauuuuguugaucuuuucaaaaaaccagcugcuggauucauugauuuuuugaaggguuuuuugugucucuauuuucuucaguucugcucugaucuuaguuauuucuugccuucugcuaguuuuugaauguguuugcucuugcuucucuaguucuuuuaauugugauguuagggugucaauuuuagaucuuuccuucuuucucuugugggcauucagugcuauaaauuuccgucuacacacugcuuugaaugugucccagagauucugguauguugugucuuuguucucguugguuucaaagaacaucuuuauuucugcuuucauuucauuauuuacccaguagucauucaggagcagguuguucaguuuccauguaguugagcgguucugagugaguuucuuaauccugaguucuaguuugauugcacuguggucugagagacaguuuguuauaauuucuguucuuuuacauuuacugaggagagcuuuacuuccaucuauguggucaguuuuggaauaggugugguguggugcugaaaaaaauguauauucuguugauuugggguggagaguucuguagaugucuauuaggucugcuuggugcagagcugaguucaaguccuggguauccuuguuaacuuucugucucguuggucugucuaauguugacagugggguguuaagucucccauuuuuauuguaugggagucuaagucucuuuguaggucacucaggacuugcuuuaugauucugggugcauauauauuuaggauaguuagcucuucuuguugaauugaucccuuuagcauuauguaauggccuucuuugucucuuuugaucuuuguugguuuaaagucuguuuuaucagagacuaggacugcaaccccugccuuuuuuuguuuugcauuugcuugguagaucuuccuccauccuuuuauuuugagucuaugugugucucugcaugugagauguguuuccugaauacagcacacugaugggucuugacucuuuauccaauuugccagucugugucuuuuaauuggagcauuuaguucauuuacauuuaaagcuaacauuguuauguaugaauuugauccugucauuaugauguuagcugguuauuuugcucguuaguugaugcaguuucuuccuauccucgaugguuuuuacaguuuggcaugauuuugcaguggcugguacugguuguuccuuuccaaguuuagugcuuccuucaggagcucuuuuagggcaggccugguggugacaaaaucucucagcauuugcuugucuguaaaauauuuuauuucuccaucucuuaugaagcuuaauuuggcuggacaugaaauucuggguugaaaauucuuuccuuuaagaauguugaauauuggcccccacucucuucuggcuuguagaguuucugcggagagaucugcuguuagucuaaugggcuucacuuuguggguaacccgaccuuucucucuggcugcccugaacauuuuuuccuucauuucaucuuuggugaaucugacgauuaugugucuuggaguugcucuucucaaggaguaucuuuguggcguucucuguauuuccucaauuugaauguuggccugccuugcuagauuggggaaguucuccuggauaauauccugcagaguauuuugcaacuugguuccauucuccccgucacuuucagguacaccaaucagauguagauuuggucuuuucacauagucccauauuucuuggaggcuuuguucguuucuuuuuauucuuuuuucucuaaacuucccuucucacuucauuucauucauuugaucuugcaucacugauacccuuucuuucaguugaucaccucggcuccugaggcuucugcauucuucacguaguucucaagccuugguuuucagcucugucagcuccuuuaagcacuucucuguauugguuauucuaguuauacauucuucuaaauuuuuuucaaaguuuuuaacuucuuugccuuugguuugaauuuccucccguagcuuggaguaguuugaucgucugaagcuuucuucucucaacucgucaaaggcauucucuguccagcuuuguuccguugcuugugaggaacugcguuccuuuggaggaggagaggcacucugcuuuuuagaguuucgaguuuuucugcucuguuuuuuccccaucuuugugguuuuaucuacuuuuggucuuugaugauggugauguacagauggguuuuugguguggguguccuuucuguuuguuaguuuuccuucuaacagacaggacccucagcugcaggucuguuggaguuugcuggaggucuacuccagauccuguuugccuggauaccagcagcgguggcugcagaacagcggauuuucgugaaccgcgaaugcugcugucugaucguuccucuggacguuuugccucagaggaguaccuggccaugugaggugucagucugccccuacuggggggugucucccacuuagacugcucgggggucaagggucagggacccacuugaggaggcagucugcccguucucagaucuccagcugcgugcugggagaaccacugcucucuucaaagcagacagggacauuuaagucugcagagauuacuucugucuuuuugucugugcccugcccccaguaguggagccuacagaggcaggcaggcuuccuugagcuguggugggcuccacccaguuggaguuuccuggcugcuuuguuuacuuaaggaagccugggcaauggcgggcgccccucccccagccucgcugccaccuggcaguuugaucucagacugcugugcuagcaaucugcgagacuccgugggcguaggacccuccgacccaggugcaggauauaaucuccuggugcgccguuuuuuaagcccauuggaaaagcgcaguauuagggugggagugacccaauuuuccaggugcugucugucaccccuuucuuugacuaggaaagggaacucccugaccccuugcgcuuccugagugaggcaaugccuugcccugcuuuggcucgcccauggugcgcugcacccacuguccugcgcccacugucuggcacucccuagugagaugaacccgguaccucagauggaaaugcagaaaucacccgucuucugcgucgcucacgcugggagcuguagaccggaguuguuccuauuuggccaccuuggcuccauccuuaaaauccacuuuucaucgcacaucacagucagauagaggaaugguucauuguugcauagaguaagagaagacaacacuucaugaggaugauuuuuuugauuuucggucagcuuaugaggcacccacuuaacugagcuuuuucaccuuucugauuugcuucaaaugccuaacaacuguagaauggucguugaguucuucgacagcuucucguguaguuguaagaggaucaacuucgaugauugcucuuaguuggucauugucaacuuccaaugaccagccaagguucucguuuccuuuguaaaacuucuggaacuaccacugcacuguaugcucauuagcaauuccugggccaaauguguuguugauguugcgaguugucucugcugcuuuaugacccauuuugaacuugaauaagaaaauugcucgaauuugcuuuuugucuaacaucauuuccauagucuaaaauaaacauaaaauaaacagcaaguaauaagucauuagcagaaaaaauaaagaaauaaaacgagaaaugcccauuaacaugauguguaacauaacuauuuguuuaagaauguauuccaguaucaaacugcagaucccaaaagugcaaaaaccgcaauuacuuuugcacucaccuaauuguucucuuuuauuauuguuaauuucuuacuguguuuaauuauaaauuaaauuuuauaggcauguauauauagaaaaaaucauuguacauauuggguucaguaccauccucaguuucaggcauccacuggaggccuuaggauauauccuccacugagggucuuagaauguaucccccaagaauaagguggggggggcugcuguauauuuucaacuuuucuugaaauuaauggccauggguuuaaagugugacagucuugucgcugcuuuuuggguguuucucugacucuuguuagguauaugaguguuuaugaagguuagcuagaguuggauuuaacagagguugauguaucagggaauuauaaaaaagggaugaaggggacagguacaugagcauuuacuugagggaguuauuguaaugaugggccauuggcuaagaagagauggagggcaaauauagguaagggacagcugaaaggagguaaagaaaggauggaaaaauuagcagggcuaucacuacuaaaaaacgaaaaaugaauaauuaccacugcuaccuauaaaaguuaccuaaguugucaauacugucacuuucguacguaaaggacaguagccacaacucauuaggaaaguuuguuuucuggauuccauuugauaaaaaggauacuuugcagucauugugaaauauuucccauaaaaguauuuuuuuuguuuuauucguuauauuuauggagauuggauagacaucuuugaaaguaaaauuguauugaccuuagggagaaaacaguaaauguuauucauaaagauauaauacagggugcacaguagauguuuaagacuaaugagcugugcuacugaccuaagcacuguauuuccauuguuuacaaucuuagauugccuuauuaauguauauguaaguguugauaugcuugcacagaacuuuuaaaaauauuuuuucguacuuuaucaauagaaaugcuggguuuccaacguucuguaguacccaucaaauuggcacuguuaaguaaaauuuuauauuuaauauaucagaaugcuuugcuuaaucuuuaaacguuagcaucuuaacuuuuugugaaauacauacauacagaaaaguggcauaucaggaauguacaucuugguuaaauuuuuacaagcuaaacauacuuuuguaaaccaggauauagacugauagaacguuuuuauuacccccaaaaguccccauuaugccuccuucauuuguuguugucauugaaaaaaauaaaguuuuauuuugaaaaaaauuuaaacuuacaaagaauugcaaaaaaaaguacaaauaacuuccauauacuguauccagauuuuccaguuaauaacauuuugucauauuugcguuauaauuucucaaaaacauuuuucuuacugagccauuugaauauuaauuguaggcaucaugccccuuuacccuuaaguacuuaagcauguauuuccucagaacgaggacauucuguuagauaaucauacggcagaguuaucaaagucagaaaaucuaauagugaaucaguacuuucaucuaauugcaggcuguaaauuuugcaaauuaucccaauauccuuuauggcaauguuuucuuucuucauggauuuaggacuuaauccagugucacgcguuaaauuuaacuauuuuaucuuuuuguuuuucuuaaaucuggaucagcuucuuagcuuuucuuuguauuucuuaacauugaauuuuagaagaguacaaucuaguuguugaguuaauuguucuugguuuugccugauauuuucucaugauuagauucagguuuugcuuuuugggcaggaauacuauguaagugaugauguacccuucucaguguauuggcuuggagauacaggaugucaguuugucauguuauuuuauuagaaaugauaauucuaaugccuuaguugugaugguguccuuuggguuucugcacugcaaaguugcuauuuuuuccuuuguauuuaauaaguaauuuguggaaaggcuaaauauccuguuccucuucaaacuuuuuagggauuuuagugccagugauaauuuuuucuuuagucaguuauuacuguaauggcugcaaaauagugauuauguaacucuuauuucucuuaacauuuauuaguuggcauucuacuuuaaaaaugagcuuucccacuccgccacuuaucacuuagacucauaaauucuuauuuuaugugugagaaaguguguaugugugacuuacaaauguagcuuauuuguauacaugguguuuaaaccguauguaugauuuauauauacuguaauucauuuugaugugaacaucagauuguuccucuucaaacuugcucugugaccuuugauaugucuccaucauguuuuuuuuuuuaggguguuuuuauaguuuggcauuaccaggauguuccaggcuuaucuuguaguuucccuguuucuuccuuagaagcagccauuuucaaaggcacucugauuccuuuuaguggggaaugguaauuaaaaaacaagaucagggugcuagcugugcuccuuauacuagggcauccuuauuuccaggccuuuucagcacucagagcuaggaaagaauuagcauuuucaagaugaaauuuccauguguguuuuuuaaaauacauuuuagucaugaaaucaucauguuucuuuuacuuccauuugaacaucacaggauucuuauuccuauuucucuuucccuauuccauauugcaucuccuuuuuuuuccacaaugagaacguggcucccagaaucuugaaauacacauauaacagauucagaacuuuuacuguuauaagaaaaccuauucaguaguuuaggauuuguuuacaguuuuuucuuugucucuuuuuaggcuaaggguauauaauucagauauuggguucagaaguuuccuacagaguuguuauauuaagaauuuaaaauauauaauuugguuuauugugucuguuuguaugcaguuuuagcauuuauuuuuccuuccauguucacugauuuauuuuuugcauauguaaaacaucuaacaguucgaaaggcaagaguauccaaagguauauagaaacuugucacaucuuucucuguuucuuucauuccugucagaacagauuucauuucguuucugguuuguuuuuccuguguuucuuuuuacauaaacaagcagaugcauaaacauguauauauauccuguugcuuugaaagagcaucuuauuaguucuguaaaguauuggcaauauugcaaauaucugaacuuuuuaugaaguaugucaacagggauaaaauuaacuuuuuugggaacuuuacuuugaaagaguuauuuugaaagggauuuuuuauaaaauaguauagguuuuuaugaaacacgucagaguguugcuguuaacugguugcacuaacaauacuuauauccauuguugaagaauauagggaaagaaauaccaaaauuuuuaguaagauuuuguaaaauugcaaaaauuaauauuaagaauucauagaggcacagaaauguauuuuuugauuaauguauuguaaccugauguaaauccuuaguucuuuucucauuucugcauugacaucauacuauguugaagaauauuucuaaaaauauucuagaguuaagaaaguguugauagcacaucuauauuuaaauacuuaguaccacagcaaguaguuuauaugacuugagaaugauacuguaggaacauacuaaaagacuuuagaaaaagcaugucaagaaaaaaaaaaaaacagaacaaggggggucagagacaacaauauguaagaaaaaacauagaaaauuuaucucaccagaaacagcacuucuucucagucucagacaaguacugccuccagaaaagccaauucaagcguugggaaguggcaggaucgauaugggagggccgaaucaccugaucuaagguaaggcuauuuuuaaacauuggauacucccugauguuuagaucaucaauguuguuaugccuuauuaguaagauaauaaauuuugacuguaccauauuuuuacccuccaacuuaugcuuuuucaggguacaguuguagguuuuuuaguuaccuuauaaaucaaaacccagcacuugucuugcuacccaucuuucuggcuguuuauaauauuuaaugaauuauauugaaccgugcuaauggaugcucaguaauuuuuuuuuucguucucuugcugcagguuaauucuuucucauaccacaucgcauuuaaaaaaaauucccaggugcuuuucacuacuuaucgaauaaaaccuaacauucugagccaguauuuaggacccguaaaauuugacucuacugaaucuuuccaaucuuauacccacuacagugcaaaaaccccugauuucauuaagcagacguaguagcugcccuggaauaugcuauuucccuuauuguuguuaugcuuuuguuaaugaucuacccuccagugaauuuugguuuguguucugaaucuuaaauuuacacagcauacaaccucgaauggauauuauaauuucucugagccugaaaauugaaauaauaacuucaucuuuaagggaugcaaugagaaacaacuauguuccaauaugaaacuacauuacuugcagugaucaaucugagagauugugcuuugauaaccugacuucaaaauacagaccaagauacuuuccuaauuuaucauuugagguuuuaaauaauuaugauauacaagggguaauuuuguuuuuuguuuuuuuuuuugcuuuuguuagagaauuuuaagcuauuuaccugguuagcucaaugcuauauaaauauguuugcaauuauuuuaauuuaaaaacuuaaaaaauacaaauguaaauuaugaucagauaccuuugaucauaacaccuaaaagaaaagggaggaaacacuaucaaaauuugauuuucuuauguuucauuuucuauacagucuuaauuauauguuccacaugaguuguaaguauuuccuguuaggaaagaaguuagucauucuuaaaaguggauauacaucucaaaguaagaaugucuaaacuguaagucuagcaacuaauguagauaaaaauauauuagcugcauucuuagaguagugucaguugcauguguugcuuuagaagguuaaggaaaguuuucaucuuauuauuuugaaaguacucauugauuuuuuaaaucuauguauuauauaauauugauuuaucuuuguuuucgaacacuaaaauucuauuugaaaaaccaguagaaauuucaagaguuauuuuaaauaaagaaaaguuagaucugacaaguguagaaugaaguguaugagucuuuucacauacaacauuuccauggaaccuaaaaguucauaauuguacuaauacaacuucuauguaacaacuaacucaauuauugcauagagaaacacuuggguuuauauuuaaccuggcaguauggacagccuauuuacugaaccuaaaagggccagacaacaagaacuuauaaauuuaucaugcuauugguaaagaaacuuaaacuuacaauuguuuuguugcauaaguauuggacuuggauuuuagguuuaguuuugucaguaacuaccugugugaauuaaggaaaguuuccuaacaugccuaugccuccauuaccacaaucguaacauaguggagcuagacuguguaauucggaaagccucuucaaaccugaaacucuuuauuuucugacuagucccugguuuacaauggaaacuaguccuuagagauuugagaaaucagagaauuugcccaaauucacagcuaguuaagaggcaaaaucaggacuagaauaccugcuuuucuggcuuguaguaccaauaguucaggcaagucaacuuucauagacaaaggcauagaaauacuuaaaauaggccaggugugguggcucacacauguaaucccagcacuuugggagaccgaggcagguggauacuugaggucaggaguucaagaccagccuguccaacauggugaaacccugucucuacuaaaaauacaaaaauuagccaggcauugucacagucaccuguaaucccagauacucaggagguugaggugggagaaucacuugaacccgggagguggagguugcaugacccaagaucaugccacugcacgccauccugggugacagagugagacccugucucaaaaaaaaaggaaauacuuaaaauauguuauuuucaauguaauuuuaaacuuuguuucuuuggcuuuguuuuaacaucuggaauuccuuuuauaucagcuauuugacuuagaaguuuuuauuuaaaauuguuuuacuuuagauauaguacuuuacuuuuggacaccagauggcuaauuuauagcgaaaauguuguuucccauaccugaaagagacacaucucagugcuuuauguauagcaacuccaucuauaccuacuucucucuaaaaaagaugcucuggaaacaaaaaaacacccuucacuuuaacuuuguaauuagucucaagaauauauguggaaggaaauuugaagcuguauuuucauuacguguuuugugcuuuagaaaauuccaaaaauagccuggcugugguggcucaugccuguaaucccagcacuuugggaggccgaggcaggcagaucaccugaggucaggaguuggagaccagccugaccaacauggagaaaccccgucucuacuaaaaauacaaaaauuagcugggccugguggugcaugccuguaaucccagcuacucgggaggcugaggcaggagaauggcuugaacccgggaggcggagguugcagugagcugagauugugccauugcacuccagccuaggcaacaacagcaaaacuccuucucaaaaaaaaaaaaaaaaaaaaaaaagaaaagaaaauuccacaacagauacccuggauaaaagcuacuuuuucucuuugcuacuuuuucucuuuuuaaacacacacacacacacacacacacacucucucucucucucucucucucucucucucucucucucucucucucucucucucucaggcuacuuuuucucuuuuaaaacacacacugucucacucucacucucuguuaguguaagaaaaacuagauuccugcucuuguaguuaauguaacugacaaauguggaguuugaggcauugcuuaaauguuuguaaagagcaaguaaauaaugauuaagauguuuuucguaaguuauuauauuugggcugggcgcuguggcacauugccuguaauccuggcacuuugggaagcugagguggguggaucacuugagcucaggaguuugagaccagcauaggcaacauagcaaaaccccaacucuaccaaaaauacaaaaauuaauugggcaugguugugugcaccuguggccccagcuaccugggaggcugagguggguggaucacuggacaggugaggcugcagugagcugugaucgugccacugcauuccagccuggguaauggagcccaaccuggucucuaaauaaauaaauaaauacauaaauaacaguuauuauauuugaaguuguggccuuaucauaugcuaguuacuauuaauuuguauaauacaguguuuucccgauuuuaacaguauucuucaagccaaaucuguaaguguuuuucaaacuuuaacaguauucuucaagcuaaaucuauauguauaacaguggcauuuuauugguguaaguuugcuuuauaaaaucaaauuuuuaacucuugugaaacuaauuagaagagugaagcaguuucagugagugcaggaaauugaaacugguaauauggaugauugcuguaaacauauccuaaugcacaguuuauuuuuuuauuuuguuuccauuuuauguuaccaaguucuguuccucuuaauuuucaagugauaguuuauuuuucuuaagcuuauguuccuauauuacaaugcuuuuuaacugauucauacucuugaaugaauaguaaaaauugcuuuucaauguuaaaucacgaauacauuuaaacaugcauguauuucuucuauuaaacacaauacuuauaauaaaacuggacguuaaaugaauauuauaucuaagaaugaccucuuccucugacuaucuccuuuuaugucuugaugagacacuguacugaaaagaugugcccauaccuuggggcauuugaucaagugcucugaaugcauguugcuauaguguguaguuuguaagauuuuauguuauuggacauaugaaggccuuugggguuuuuuguuuguuuuuuuaagauucuuguagagcugugucuuuuccuaucauugauacauuuaaaagcaugaaauuaagcauaaauauggaagguagagcuuuauuccaagcucuguacaaaagugaguaaacuuguuugcacuuuugaacacacuuauguccuccagugagugaaauuugggcuuauuucaccuuuaaacauucaagguuuuuuuguuuuguuuuaaauagagcuuaaaaauugacauuuaaaaaauucagaccccagaaaauuaguaugauaaacacuguugaagaagaagggaagggguuugaaguugguuaugcuaagccugaauccuagugcugccacuuuacaaugcaaaagagccucuuuccacaucugugaaaaugaaacuaauuggauauguacuuuacuuuuuauuuuuucaagacagagucucacucuguuucccagguugaguguaguggugggaucauagcucccugcaaacucgaacuaccaggcucaagcaguccucccaucucagccucccgaguagcugggacuacaggcaugcccaccaugcucggcuaauuuuuuauuuuuuguagagaugaggucucacuauguugcucaggcugaucuugaucuccugaacucaagugauucuccugccucggccuacucccaaaucacaccugagauuacaggugugagccacuaugccggccccauauaccuuaaaugugauguacuuguaaggauuaaauaaauucuaagcugugaaagcaccuauuucagggcuugaaagauaaaucagccaggcgcaauggcucacgccuauaaucccagaacuuugggaggcugaggugggcggaucaccugaggucgggaguucaagaccagccugaccaggccaggcgcgguggcucacgccuguaaucccagcacuuugggaggccgaggcggguggaucacgaggucaggagaucgagaccacggugcaaccccgucucuacuaaaaauacaauaaaaauuagccgggcgcgguggcgagcgccuguagucccagcuacucaggaggcugaggcaggagaauggcgugaacccgggaggcggagcuugcagugagcugagaucgcgccacugcacuccagccuggacgacagaggaagacuccgucucaaaaaaaaaaaaaaaaaaaaaaaaaaaaccagccugaccaacauggagaaacccugucucuacuaaaaaaaaaauuaaaaaaaaaauagcugggcgugguagcaugcguccguaaucccagcucgggaggcugaggcaggagaauugcuugaauccaggaggcagagguuguggugagcugagaucgugccauugcacuccaaccugggcaacaagagugaaacuccaucucaaaaaaaaaaaaaaaaaaagauaaaucagacacucagugagugucggaucuccucuuucaucaugggcuuuaucagucucuuuaaauguaguacugauagaaaauaaauuguauguccagaaaaguguuuugaauucugugauuuuuauuuuagacuagguucuuuuucugggcgggauuuuucauuaauaaauuguuacucgaacauuagaauauauuuucuuuauaaauuguguauauacuguagagaaaauuauucuugugcuuguggaaguaaaacguacacacagguauagaaacaguaccauuucagaccagucauguugcccgggcugaucucgaauuccugggcucaaguaccacaaaacuaaaagaucuguagaaaaauauguaaucaaugauauucuuauguugauggauaugacuuuaaauuuuucuugaaauaaauauuaauuuuuuaugagcuacuuuaaguucuuucuggagggaacaaaaugucuagcagucucuugaacaugcccuuagauuuguagucuucaacuuugaccauauuggaauuaccuaggaagcuucaaaaaaguauugaugcugggucccagaaauguaauuuuaaauagucugguguacacccugugcaucaggauuuugauaugcaggcaagguugagaaccacugauuuagagccuugauucuggguuggcauaaagauuaaaaucaaaugauagcuaggcaccuacgguuuugaaguaaaaugauagauguaguuacaaugggagcugauauuuguauagcauuuuacagccucacagucuuuuucuuuaugugcuucucauuuaauuuacauuuucugccucuuugaaugucuuuugguugguaaccacuaucaaaggugcaugauacuucuguugcaagcaaauggauagguaauauauuugccacguagaaauugugcacauaucuaccccucuccaucuuuucucuaugcucauaguugucccuccaucugaaauguucuaucuucccauccuacaugucuuuuaaggcucaucucuuuccuaacguagcuuaaaagaugcuacacaauuuccaugcagaacuguuuacagccaucuauuuacauaugugaccugaauuaaaugucauaacaagugcaucucuuuucaaguugggaauaugagauagccacauucuaggcuuuuucuuagcaaauggaccuuugaacuguuugcugcccaguucuuauuagaagcccuucugugagaaaacauucauagaugucuacauugauaugugauucacccauucuuuuagaauaugguuauaaacuuucaagcaauaauucaagcaauauuucaagcaaaauaauuugaaaauuugcuauaaacucuggacuuuugccuggaaauugcaucuauacauaucuauuuauuuagaaaucagggacguccugauucuucuuuagagaaccauguugcuaguuaagaaccugaacuguucucaaaagcacaguuacauuauuagaucaagccuaaccauuaagagggcuagauacacagaccacguuguuuugcuuccccugauuaaauugcucuuauugaauugggcauuguugugcuucacucagcauuaaagggcauuuugagaaauagcucuuuaaaauucaauuuuuuuugguaggaauuuuggagacuuuauuuccauauuuuugaaaacaugagauugcaauccauuaguggguugugaaacaauuugguggucccaaccaguauuucuugguuuuguauuguuucuuuugcuuuuuuccuaugcuauauuuaaauauuaauaaaauuacauuuuaucuuagugucaccauuuuuccuuuuuuaaguauuguuucaugaaucuuuuuuaguuuuuaauguauuguggguacuggauugcuguguaaaguguacuucuuacuguguuuuguagucaauaaaguuuaaaaacuauuguacucauauuuucucuuagacucagaggagaaucuuuuucuguuuauucucauuuguaaaaugacaauaaugagaguugcuaccuuauggguuuaucaugaagacuaaauauauauaaaguauuuagaacagugcuuaccuugcgcauaguaggugcuccauaaauacuagcugucauuaccaggaaaacaaucuuagagcaaaugcuuuguuuuaaucuuaaugcacauuaaagacauuuguuguuaaugauguccuuugcuuuggcuuccaagaaaaagcagcugagauauauauauauguauauauauauauuuuuuuuuugagacaggcucuuguuuuguugcccagucuggagugcaguggcacaaucacaguuuacugcauccuucaucuccuggacucaagcaauccucucaccuaagcccucugaauagcugggaccacaagcaugugcuacuaugccuagcugauauuuuaaauuauuuguagacacaaagucucgccauguugcccaggcuggucuugaauuccugggcuuaaguaauccucccgccucaggcucccaaaguguuggcauuacaugcgugagccugaccuucagagaucaauuuauggccuuuugucuaucuucuauuagcccugauuugucaucuuaaacuuucuguugcaucucugcagggagcccucagauucuuucugggauaucagaaucaucaaaauaugauaauuuaauuccauuguaacuucagagauauuuuuauauucauuuacugugccaggaggggagguagaggcucuugggaacauuuacugccuguuuaaacuguacauuaacucagacacccagagugguuaguuucuuagcuuuuuacuagaugguugaguccaauauggagaagaggauuuugauaauagcauuagcugucuaccuuacugaacaaguuuguuggccuaaucaaaccuacgcuuuggggaacucuuaaguuacaguagauuuccucauagggaaacucuauuaaaucuucuuaagcaaugaaagaaaaagcuguccauuaagaacuuucguggaauaauaugguucaauauuuuuuuccauaauguggcaucagaauaauauuagauuuuuaaauuauuugucaguguuagauauuaugugcuuuuuguugcugugguacauacugugugucuuaucauaaaacauuuuggaacaaaacgguaagcuuaauuuauaugauuaaaguaaaucaguuuaugugguuaaaaaauacgggcacaaggagauguuuugaaaauguggagaauuguaauuuucugaacucccuuuagggauauauacuuguuaaggcugauuucucaguuauauguuuuuagaaacauaguauuugccauuuugaaucuuuagugauuaaaaacaaucaauuuaaaguugaaaaaaacuaauuagacuucugaccauauuuaagguacauuuuaagaggugaauacuuccaugugucccagacuuuuugaaaacuagagauccucagaaauaaaugguaaaagacaggcuauagaaaauuuuccccucaacaggaaaguuauaucuagaucuaauuuuuaccacuuuuaacaauuuggagaauuugcuaucugacuugcaaguccaaacaaauuugguagaauuuguucuugaugggaauaaauuuaaaaaugcaaaggagagaguccagugauuggcaagagaaaauaguagaaaaggaaauagagcgaaaauaaaaauuuugacaauggagggcagcaauuaacagagaggaaauuacagccucagaaugcacaccuguauuuaguaggauguuggaauaugaaauguuuguauaucagagggcugauggcaugugcuuugauaaugcagucaugguaggcauagcuuugcaauuuaaauuauagggaagaaauggaagcaauauuuguuuuauuguagagauauuuggauuuuuguaacaugugaauauuaagaucuuuccccagcuguauuggaggauauguuaauccuccaaugaaaucauucaugaucuuugggaucaugaggaaaucuaggaagucagugacucaggcauaaaauuagaaaggcuugaacauuuuuaaauuguacuaaaguuauagagaagggaagucuuaagugggcaagggaugguaagugggaacugacuauguacuugaaaacauuucagaugucaugaugugcuuuuuauagggcugucuuuguuagcacaaaauaauuuguggaguguuucaaggucuacuugagauaaacucuuacuaacucaugauuuccagaaaagccuuaaauuccucaaaggucuugcuggaaggaaaccuagcucaaggggaggggaggucuauagucuuugggauuagaaagacucagguuugaaaguuaguuuugcuauuuaauucaugcuugugucagugauuucacuuuggaccauggcuugucucuaacaaguauacaguaauuuuucaguuuuugugaaguuuagauauaauggguuuggcauccaaccuaugguagcugcuguuauuugucauuuuaggagccuaaucuagugacuguggaaggaucuaugguauuuuaauuguuuugcuucuauaaaguuuuaaaggcaguauuguucagaacugaaauauagaugaagagaaauucaucuaauuugcauccacuuuucauugccuauuucuccaagugacuucuauaucaucuuaggcaugcauacuuuuguaaaguccuuuaucugcauaauagcuuuuaacauuauuuuauuuaaaauacaacuuacuagguuuuucucuuaaauuuauagcauuguuuuaugauagacuauuuuuccauauccuuauaaacuuuaaaaagauuguagaggugaggcggguauuuaaauauuugaauuuuucuaucuaaaugcaaguuaucagaaauggcaaacugguuccuuuuuuauguuuuuuaacacuuggaauauaucacaaggaaaauaucuuguguauguuaaaaugagcauuauuuucaggccuuuuuggggaauauuuaaaguuucuguaauagagcuguaguauguguuacaauuguaguggucccaaaauuuccauuugucuagcauuugcugucuuauuuaauuucacaaagauaaauuuauuuggagacuacuaaaacuaguaaguguagaagagcucuacagagacuuaaaacuuaacauuaugaucauuguuggguauguugguucuagcuuguuuauuaauaaaaauuuuuaugacaaugcaaaguagugagcuuaaacucagggauauuuuucaauguguauugugaucugguuuuauuuuaaaauuuauugcaaacacauuuuguuuuuauuucucacugcuuuuauuauuuuuuaagcaucuaauuaggugaaacugaauugauucaauuuuuauguuacaggagauuaccuggggcaauugauguuaucggucagacuauaacuaucagccgaguagaaggcaggcgacgggcaaaugagaacagcaacauacagguuuaguauuuuaaaauaaauaauuuucuuuaacugaaggaugauaucaacauuauaauuuaauuuauucaauagauagucauagugcuaugcuguguuuuaggugauacaaagagauuuaaaaugugaagccagucauuuauuauaaaggcauuuccaguuagaauuuauaaucucugaaucuuuuuuuaauaggguuuucuuucuuuuccuugguagaaacauaguacagguugaguaucucuuaucugaaaugcuugggaccagaaguguaucagauuuugaaauguuuggauuuugaaauguucauacguauguaaucuuagagaugagacccaagucuaaacaugaaauuuauguuucauaaauaaguuauuuaauuuguuauaaugauuuguuaauuuaugauaaucuuuuuuccuuuggcaacccugaguaaacuguguagugggccugaguuuugauugugauccgucacaugugagguuggguguggaauuuuccacuugugauaaaauguugaugcucaaaauguuucggauuuuagagcauuucagauuucagauuuuuggauuaggaauacucaacuuguauauagguuuacugaaugaaaaauaaaagaccaccagugauuuuaccaccuaaagauaaccacaucugguacaucucuugauacuaagcaaaauugggauacuauuauaauuauauuucuguguauacuuuuuuccccaucuaaaauuaucauuuguauguuuucauauucuuaaaauaugauuaaaauaucuucaugauagcuucauuggauaaauauaccaugauuuauuuaaugugacauuucuggagguggcguagagcugcuuuguuuuuaggugaaaaauugaggggagauaaauuaucaguaaguuggauaauuaauguuagaacuuuaauaacugagacuuccagcuauucauuuuggccauacuuuuuuucauuauuuauuccuauuuucugaguccuuuuaaaaauguccagagcacuuuauucuuaccuuugauaaguugaucauguaaaauauuccuuuuagcaucuuuaaaggcaaaucauuucuauaguggaagauguuaguccauuuuuccuuuccccuuaccauuaaaaugccacgauuucucaaaauaaauacuuuaagaaauagcuuaucagcauaagcccuacaaaaaacacugcacuuaaauguaggaaguguuaauggaaagagggauuguauguuuaaaagauugcuuuagucagcaaggaucugagaaguauaaauuaaauauacaacauuauguuggcugucuuucccaaauuuauuuacacauccuuggggagcuuaucaaaaauccagauuuugaggugccacuuugcuuguuuuauuucaguagguuuggggugcuucuuauggugccugucccuuaaccuguucacacaaagaagcauuuugcaaacauugcuuuauuuuucaagaauaaacccuggucuuaaaguuacaaggcucacaugauaaaguuacuuacauaucuugcugccuauugcuugcagucuguugacacaugccugacaguuucuuacuuugcaaccuggugaugacaggcccuuguacagugaaugucugaccugcugccauguuaauuucuuaaggccagugucugugauuaaugauuacauugccuuaauugaauacuucaacuuugguugggugacaaagauaauacuuguuaaaugaucuuuaugaaguacuuuuuucuuguguggaguguuuguauuaauuacuuuuuauuaagaaauuuuugguaaugauccaguuguuuuuucuuaagauuugaauaugcacauuuuuaaaacuguauguauguguauacucacacaggcguauguauacacauaucacacauguagaacuauuacucuccccccaaaaauacauauaugugaauuaaacuaccuuuuacuuuguuucuuagauuaaaugaaauuaauuuacuaagauuaaucuuacauaauauuuaugcaucuguuuaauuaacugugcucuaauuuuagguccuuucugaaagaucugcuacugaaguagacaacaauuuuagcaaaccaccuccguuuuucccuccaggagcuccucccacucaccuuccaccuccuccauuucuuccaccuccuccgacugucagcacugcuccaccucugauuccaccaccggguaaauaguaaauaagacauuugacuuugaaagaaaaauagcuugcgaguguuuuuuaaaauuuuugacaauuaaaauaauaucuugaucacauuucauuaaaaguaauagauauaauaucuucaacagauucacacugaaacagauauauauauguuuauugcuauuucaauauaggaaagagacaauguucuaaaauuaagaagaauauacagauaccaaucuugugauucaaaaauaugauaaugauccccaaacuuaaguugcuaauagaauauguauaaauccauacucaguuacaaacuuuaccaguguuaauuuguuuugaaaaaaacauuaaaagauacuuucaggaugggaguagaucaaaaaauuauaucuugcgaagagauugauuaauauuucagucuggucuucuucuguauaccgguuuccuuuuaggagacugcuacugggugccugguauuuauuucuuuuaaacaaaaguaaauguugaucauauuuuuagcuacuuuugauuacaauuaaaaaccagguuaguggugauagagaagaaacucacaaauaauucccaaauuuuauuuuuauuugaauuuuucaucggguugccuuucuuacuuuguuuuuaaccuuuaucugccuuaaccaaguuuuuaugaaacuagcaagauugauugagauaauaauuacuucuucccagggagaaagcuaguaguaaaugaugaaaaaauagcugcuuguccucaucagggcaacaugaaagacguauguuaggcuuuacuuccuauuaaucaaaucaguuuauacuagagagccauguacucucacucacuuuuauuugcaagagagcugucuuuguuuuaaggugccaguugugauccgaguacagaaccaaauccagggucugaauaguccuucccuaacauauucauccuuggccucuaaaugucagccacugcuucugucuuucaucuucagugccuuugauuuccuuccacugucaccucuacucucaaaaaguaugagaaaaauaugaaaaaaugacuuguggcuuuagagggucuguugucucaacaauaguggaaggaagagguuggaauauagguuagagguccuuauuccagacaacauuaguauuucuaauuucagugaauuucuaguuccaacaaauagauugagcagaaacgacucauuaguugggauugacuugugguucuugugucuuuaauaugcugaguauuaaccaaaugaaagaggacuuaggugauucaaaaugaggacuucugugauuucuaugugaauccuuuguccucugaaaaagaauuagauaaauaaaagguagaaauaauuaauguuucaacauauuugauuaaugauacuaaaaaaauuauuaauguuugugguacucuguuggauuccuuuguaauauuacuuaaacuuuacuagguagugauuugaaauaauuuucuuuuuuuaauucuuaaaacuuuuuaaaaauuuuauuuuugacaguaauacuuguauauguuuaugggguacaaugugauguuuugauuaugucuacauuguaguaaaucaaguuaauauauucaucaccucacauacuuaacauuuuuuuguggagagaacauucugaaaucuccuagcaguuuugaaauauacgguuauuaauuauagucaccaugcuguacaguagagcuccaaaacuuguuuuucucauuuuacugaaacuuuuguauccuuugaaaaucaucuccccuaccucacccguggcccccagccucugguaaccaccauuuuacucucugcuucuaugaguuggaucauauaagcgagauugugcaguaauugucuuucugugccuggcuuauuucacuuagcacaguguccuccagguucaugcauguugucacaaaugacagaaugaaaggauuuccuuauuuacaaauauaguauauccccagauggcuaacauuuuguauguucaguacuaauuauuaaaguaaguaggacagaguugguaugaauuaaugacaacaaauacuuagcugguauaagaauauucgaaacuccguagaauauugcuacagagguaauugcuacacauaggcaguagcauuaucuggaaguuuacuuuuuuucaaaaugauaaaauuacuuuuuuuuuuuuuuuuuuuuuuuuggagacagggucucacucuuucgcccaggcuggagugcaguggugcggucucagcucacugcauccuccaccucccaggcucaagcgauccuccugccucagaguagcugguacuacaggcgugugccaccauacccggcauuuuuguauuuuuuguagagaugguguuucgccauguccaggcuggucuugaacuccugaccucaagcaaucugcccuccucggccucccaaaguacuggcauuacaggcaugaaccacuaccccugaccauuucuuuuucauguaaccuuuguucauaaguauaacaaaucuuugaagaguguuuagguuauuaaugacauuauacuauagagugcagcuaauuauuuuucuguugcuuaaucuauuuuucuacuuaauucucagcuacaugcuuuccauauuuuaaaaucgagauuuccuuuuauguuuauucuugguuuacauuucuaugcucuucugucaacauuuaaugagugcagauucaaaugaauucuaaugcugguuuaagcaguaccuaacugguauaugugcugagcaggauaccaguucauuaaaaccaaauauuugaaguugagacucucugaauugcuccuuacuuuuaguagaaugugagcuguuggggagcguacaggcuauguauuucuaucuauguuucccuacaguuuuagucaaguggucuuguacguacuuggcauucccuaauguguuugcuaauugaguuaacgacauauuuauguauccauaacaccaaagaugauuuucggauuuauaccugguacauucaaucaggaugggcacuggcucugaauaacaguacggcugcauagauauaugccagcugccaugcuuaaagcugugguuuucaguuacccuuuaccacagaaccacaugauuacacuauguuccguaguuuguuguaauuuaaaucaccuuaagaaucauaagcagcuaaugaaagaaagcuaugauucaggauucuuuuuaaaguauugccuuaaaagauauuccauuuuucuuagauaaacugucuuguuuuuugcuuucuucaaaaauaaucaaaagaaaauggaaaaacauuuuuuuaaagaauuaauuuaaauguauuuuaauguugccuuuuuaacauuagacuucuaauguuuuuaaaaguaaaguccaaaauaugaugagauaaguauaguaaugauauuuuauucucauauuuuaggaugcuacuagauuuuuguuuuguuuuguuuuguuuucaaauaaauagggugaccauacauccagauuugccuggaagaguccuacuuuauaccuucuaucccagcauaauuauuauucauucuuagaaagaaauucccugguuuagaugauacaauuucugauugacucuuggaaauuuacagaggucuuauugcauaaguagauaaguuacuguuuaacaauuauaagguguuagagauaacucucauuugaaggacuuuuaaugucaaauaguucacagaagaggagaaauguauugccuccucucacccuuaaacacacaccugcaaacguauaugaaacuuugcuaguaacacagagaggacaaaguauuucuggccauaauagauuuguaugaagaguagaggagauuuauguauuagaauacaacaaagaaggaagagaugucuggaagugcaaaagcauuuaucgugguucccugcagccauacuaacaguagcuugaaaacaaauacugggccaggcaugguggcucauaccuguaauuucagcauuuugggaggcugaggcaggaagaucaccugaggucagaaguucaagaucagccuggccaacauggugaaacuccaucuuuacuaaaaauaugaaaaaauuagcugggugugguggcauacaccuguaguccuggcuacuuaggaggcugaggcaggagaaucacuugaacccaggagacagagguugcagugagccgagaucacaccauugcacuccagccugggcgacaagagcaaaacuccaucucaaaaaaaaaaaaaaaaaaaaaaaaaagaaagaaaacaaauacuggcuaauuuaguucuucuauaauauccagaaaaucuguuauuucauuuucucgugaaucagaaaauaguuuccauuguauuaaguuuuuucagaaauacauuacagugguuucaugcuuuuucugaguaauaauagauauaauagcuaauacuuauugaaugcucacuuuucaggguacuauucugaguacauuccauguguuaacucauuugauucuugaacaauaucugaaguagaugauauucuaauuuugcacugaggaagcggggaccuaagucaucugaguaauagcuagaaaauaguaaaaccagaauucuaacccaggcaguuuugcuugaaagccuguuuucuuuauuaacuauguugaaaugaaucaguaccuauauccagaaaaucguauuauuggauuacguguauuugucacaguccuagaaacuuuuuuuuuuaaagcauuucucugauguugaaguacaugcauacguauuuguggguagggaaguuagggagauuauaaggaacagucaucacauuuuugaaaaucugaauaagguuuuuacuguuugccuggcuuguguuaagaagucuguguuuagcugaagucaguuuugaaauauuuguuuauuggaagaaaaacuguaaaacuggaaguauuaauguuauaggguaggugauuuuguguguuuguuuauugugguaaaauacaaucuauuugucauuuuagccauuuauaaauauguaguucauuggcauuaaauacauucacaauguuauguaaccaucaccaugagcuguaccuaaaacuuuuucaucaucuccagugaaaacucugugcccacuaaacuccuucccuccuaaggauagccccuguaaccucuauucuacuuuuugucucuaugaguuuccuuauucuagguaccucauauaaguggaaucaugcauuugucuaucugugucugacuuacuuuguuucuaaaauaauagaauuuaauuaaugauugugagcuaacuuuaugguaggcuuuaauuuaggcuuuuaaauguuaauuuacuucagugucaucauauuugauguucauuuuuuuuuuuguaguggaguuuacuguagaauagaagguaaauucaguuaaacucauuuguuuuuguaugaacucuuaucagccucaaaugacuaguucugugggucuugggaacaauugaaauguagcccaguaguggaauucugcugaguugaagaagggucuuugcuuuacugagauauagcccaacuacuguggaccacaaaccaggaucccugcuuuuaaaguuagcuauaggguuuaacuguuuaucuagauaccagauguguaggauucugcauuuuagaaagaaguagauuucuuccuaaaagacuguugucuuguaucagugucuggcuaaucaucuaguacuacuaauuucaugaacuuuaaaaucuuauuuauuccuuaaauauguuaauuucggguuagggaugauauauaggaaucgggucagggggugggggcggguggcgaguugcucauaucuagggucauucugcauuuccucuaaguccugcauucucauuagauuauuuuucuguuagcagucugguucuuuagcacagcaguucucaaaacuuuuugguuacgucuucuuuaaacucuuuaaaauuacugcagaucccauagagcuucuacuuauguauguuuuaucuguuuuuuaauauuagaaguuaaaacugagaaauuaaaauauuagagauauguauaauacacucauuacauguuaacauuuuuaaauuucuuaugaaaaauaacuguacuuuuccuagaauaauuuuaaaaauuuagugggaaguggucuuauuuuaugcuuuuggaaaucucuuuacuauguggcuuaguagaaaaagcugguuucuccuguuuguuuucacauuaaaucuauugugauaucacgaguuauguggccccuggaaacuacacuguaagagaaugagcaugaaaaaggcaaauaacaucuuaguaaauuuuuuuuuuuuuuuuugagaugaaguuuuguucuuguugcccaggcuggaguacaguggcacuaucucagcucacugcaaccucugccucccagguucaagcgauucuccugccucagccucccgagcagcugggauuaccagcauguacugccacaccuggcuaauuuuguaauuuuagagaugggguuucuccauguuggucaggcuggucuugaacuccugaccucaagugauccacccaccucggcuucccaaagugcugggauuacaggcgugagccgcugcgccuggccacagcuuaguaaauuuaugaaaguaguuuugaccuggcagauucaguagggucucagggaccuccgggaauuccuggacagaacguugagaacacugcuuuggcagaagcuuggccuguauuggaugaauauuaucagugcccuugaggaaguacacuuuuaucccuuuaauugagaaacuaguuuaugacuauaauguuuauuaagcuaauuuuauaauaccaugaauuuuuggucuuacucaacagauuaccucaaauuaacuggcacuguuugccagaaauguaagcauuuuccagaguuaccauuaaaaaagaacucaaaguuuuugaaaacuguauuuauucuuguguuuuucuauauucaauuuaaaaagccugccuaucaguguuuucauuaaauucaaaacagagagcaaugcuaauuaucuauaauaaauagaauuuucuggcacaauuaaaauuuauuuaaauguaaauuuaauagagauuaaaagcuuucuuaggauguugauuuuugaaugugcuuucuccuccaggaugcacccuuuauaauaguuacauuuugaauacaucauugacaccacauuuuguugaaucuaauuacaguuuaauuugugccuucugcuuacacugcucuuuugaucgucucaugauuauauggaagcugguagagaucauuucuuuacaaguucucuauuaaaaaacauagguauuucuaucaaaaauguuuuguguaagauagaaguuuaucuucuguaggcuuuagauuuuauaaaauagaagaguaacagauccuaauaaagguaacauaguuuguccauuuuauaguguauguaaaauuaccuuuuuuaccuuuuagacaugaaguaugcugguaaauuuuugguuacuuuguugugugaccguaccacuuuuuaacccuuuuuucuuuucuuaaaaauaacuuaaaacuuuuuuugcaccuuguaauuguuuuaauuaugaaauaaugguuuugccauauucuuucuacauucugguuuguauuuaaggguggaugguagaugagaugauacacgugugugugcguauguuuuuguuuguguugaauuuuuaaaauccugauacauagaaacgcauuucugguagaaggugauauuuaaagauuuuuguaaaccuuguccuuuucuacucauuuugaguaaaacuucugagcuugauggcuuugaaauacaagucaugagacuuaaggaaagugaucaaguuuaucuguuucuuaaauaauagugccgacggaacuuggaauuuacuagugagaaauaggaagcguaguuuacauauucugccauuuuuuuucuuucaugugaauuugaauagagaaaagauagaugguuauugcauguauuggguuucuacugccguauaacaaguuacuccagaauguaguggcuuaaaacaacauacauuuauuauugaacaguuuucaugggucaggaaucugggacagcuuagcuggauccucugcuuuaaggucucucucagaccucacagucuucuccaaaagccugacuaaggaaguauuugucuccaagcucacucaccucuuuguuaaaaggauuuuguuuuuuucuaggcuguugcauugacagggcuucaguuccucacugguguaggcgucuuaauauguuagcuugcuuaaucaaagcauguaagccaagaaggcaacagagagggugccagugaaauagaaauaacugucuuuuguaaccuagucauggaaguaacauccuuugauuuuuuuugugugugguagaaauaagucacaauguccagcccccacacaggacauaaauaccagcagacagggaucauugagagccaugucagaagcuauuuugccuuaguuauauaaaauuaugauagacuacauugagaaugaguuuauagacaaucuguuuaguuuuuuugugagugcaaagcccacuauuaauuuugugggaauuuuuaguauggguaaauucuuuuuaauaugauguuuaacaggaaugcugccuuucuguuucuuugccucaguucuuucaaucuccaaaauaggauuucaggucuuacccccacccacuuuuacauuuaaguguauguguuauaugcuggaaaaauuaagcugggugugguggcucacuccuguaaucccagcacuuugagaggccaaggcggguagauugcuugaguucaggaguucgagaccagccugggcaacaugaagaaaccccaucuuuauaaaaaaugcaaaaauuaaggccaggcaugguugcucacaccuguaaucacagcacuuugggaggcugaggcggguggaucgcuugagcccaggaguuugagaccagccugggcaacauagcgaaacccugucuccacaaaaaaugcaaaaaauuagcugagcauggugguacacaccuguagucccagcuacuugggaggcugaggugggaggauugcuuugagcuggggaggcagagguugcagugagccguggucaugccacucacccuacacaacagugugagacccugucucaaccaaaaaaaaaaaaaaaaaaaaaaaaaaagagagagaaaucaucuucucuuuugagaaugccagaugguguaggcucucauaguccuuuuaagugucauagguagaugcuuuuguuucauaaaaauucggaaugggauuuauuuagucuguacuaaauugcucagcagugaaauuaggagggaagcuuagaaucggauccagugauccucauaguauaguccugggccagcaacaucaucugggaaauuuaggggaauguagguuuucuggucccaccccagacuuacugaaucagaaauucuaggggaagggcccagcaaucuguguguuuuaagagacucuccaggugauucucaugcauguucaagguaguuuuuauuuauuuauuuauuuauuuauuauuuuauuuuauuuuuuugagauggagucucgcucuguugcccaggcuggagugcaguggcgcgaccucggcucacugcaaccuccgccuccuggguucaaacgauucuccagccucagccuccugaguagcugggacuacaggugcaugccaccaugcuuggcuaauuuuuuguauuuuuaguagagacaggguuucaccauguuagccaagauggucuccaucuccugacuuugugaucuaccugccuuggccuccggaaguacugggauuacgggugugagccaccgcgcccggccuauguucaaguuuuaauaccacuaaucuguucagucuguuagagcuugaguauuacuuuuccaaaagguuuuggcuggcacuagaaaucuacuuuuacuacuguuacauacagcuuuccaggaaaaucaacauuuuuuuaaacucauuuuucagauaaaggauauagaaaagaaacaaaauacuuuccuuauuuaagucuguugucuagguuaggcagcauguguuugccaggaagauggagguguugggaggggaaagaagagggacguuugagaugaauuuucucuucccuuacacuguuucucuuuuauuaagaaaagucaaauacuaaauagugauuuuuaagugagaaugauguuggccuuacaugauaucacguaucaguuugaaaauacauucaguaauugucaaagaauugguuauauaguguuucaucaacuuuauagucuuguuuuaaugaacauuuacuuauaaagauuugcauugaaauaacaucuuagaugaaauggaggucucacaagaagggcccuugcuaguugccaugccaacuuucugauguguagguauugauuggaaagaccuauaaaugacaugguuuuuucuuugauuaugucuuuaauuccaguagauuauuuuugucuguccuaugauacugcuguaguaagauuaacauuaaaggcagacaguaauuuuaacuaccuuuguaauguacuuaauucuuuggucauaugucuuuuaucucuacauuuuguggaaguuuaacaacuuaaauguuuuugaggacuaaaguuugaaggggcugacuaguaauuuuuuaguuuuuagcaugaauuuacauuuuaguaagcuguaguaagccuuagcuaaagugauacauccugcucacauaaucauuuagguaaaguuauuaggauuauaguauauagaauggguggaugauuuugguauauuccuuuaucuuauaaaucuuaucuuacaaaucuguaucuuauaaaucuacgaaaauaaucauguauuuacuuaugaaaacuagaucaaauagugaaguuaaguaguguccguauuguucuaaagaaaauuagguuguaguauauauuaaaaacauuuaaugaucugccuuccuuacuuuucucauuuacuuuggagucugggacucuacuagcuuguaugguuuguuggauucuuuuaguuuaguaauuugggaaacaggaagguaaccucaggauggaugagaauugccauuagcuaugggucaguuuaguagacuuguggauucauaaagauuuuugaaacuugauggcugcuuuauguaucuuuagucuuguuggcuuuguaaguuuggaauauguuuuuauuguaugggugguuaaaaucaggugcuuuggucucuuuuuuaaggccauuugcuaccuuaagaucuuuuuaaucuaaaucucuuacucugauaaaacaugcacaucagaacauguuuaguguuagaauauguuuccuuugacaagaaaacauuugaaaacaauucuguuucuuuuuuuggcauacauuuagcuaauaaauuagauuauuuuuuggacuaauuuugaugcaguuuuuaagauaggauuuaggaaaccguuccaacuguuuuaguuauuuaugguauacaacuuuucaugaaaaaguuacuuuaaauugucuuacuuuuuuuuauuuuccugcuuagaaaucucucauuuuuccuccacugaagauaguuaaaauuugcaugccacauaaauugccuuucauguaucucuuaaauuuaaaaugcugaauuuaauuuuaguauuuaguaaauacauuuuacauuaggcuuuaagggcacauuuggucccuguaaauuaaaaauauacauaguuuauuccucagaguuuauaauguguacaaauaaugagugagagucacucaaauuaauauuugcuagcaccuguagaaguaaaucauucacguuuauguuaaugugcccuggggguguauauauaugaauugguuuuucccccuuucucuccuacaaaucaaaggaaauguuagccuuuucucacuucugccaacaauacuagaacagucaacacuugaaugaaccacaacauauugagcuuuacaaaagucaguaauauccaucaucuugaguuauccuuguacuaccugcaguauuagagaaagaacccacagaucaguuuuucuauuaaaauguuaaaauaacaaccucaggcauugauuaucauauuuaguaaggauuaacuucauggcauuugauaauugugugugcauaagugugcuuuuuaacugaugucuaacuuugugauuacuagugggggaaaccuuguuaucaaguuguuagacuggguuuucaucaaggaaguuggauguuauacucgaauuguuaguccucuacgagaaaacagaaugguucucuugagugaauaagccaggauaaugaggcgagggguuuuauuucaaaguuuguuuuggugauggcauaaauacauaacagguucugaaauccaauuacuauauuaaauuucaucacuuguuuuuuagguauuccaauaacuguaccaccuccagguaaaacuuuuuucauguuuucuccaucauuguuaauaaacaugaaauuucaagcuuauaguuacaggagagacgguguugaugcgguuagaauauggaauaggcuauggggauuucaagguccuauuuucagcucugccuuugcuucauuccaguuuugauuaagauauuuaguuuucuuauaccugucuuacccguuucuguagaaauagagauucugagaaaauucuuaccuauucaauuugugaagaaaacaguauaggauauaaaauaaaaguuuucuuaaaaaugucuuuacagaccaaugaauuuuuuauguaauauagugacuauaagagaagagaaagauaauuuauuuugucuuuaucauuauuuccgauuuuuuaauuuuaguccugcuggcuuaguaucgugagaaaauguguucuaaaccccacauagcaacuagacagacagcuggucagguggcuguucuuagaguggugauuguuuauuguuguaauaguaugaucacuaggaguuuauauguggcccaguguuuuauuuauuuauuuauuuauuuauuuuuacauuuuugucaguuauuucuuuuuauagugugauaucacaccugguagcaagugugucuuccugaguucaguguuaaaagccaagguguguaaagagaaugagaggugauaaugcuugcaagggugggucuaaauucaaaaugacuucaauaaacagaaagagugaaguuuagguagcauaguacaguauacauacuuagauguggaauacagacauugauuaugugugaaugugucugaaaaagacucaucagggaaagucaaaggaaucauuugugucuuuuuaguuuaaaaaacaaugugguugugaggcuguaugaaauaggauuguggacuuuaggacuaaugugguaauugccaaauuuuguacuuuuaagauguuuaauagaggaauuauagauccuaacacuggauacagugaagaacaugguaaacaugaaaacaauuugaaguggggcuaaaaauggauuuaaguggaccuuugagaaggauucagagaacugauucauuuuuucacagaauuacuaaaacggaggcuuaguggaaguguuuucacauaacuagaaggugauagacaguaugacaguggaauaccucuuguucucauuuaggacagugucugaauuguaguaugagagacuuaaguuagauaauuuagugcauuuccuaguagugagaguuguuaauuguuaacacuuggaaggaauugguaucauaaggaauugacaucauaaguuuuggaaaucuuuuucugcuaggaugcuuuauagccuaucugaauuugaaaguguaguguagauuaacuguuuuuuagccauauuauucugugguauuccauuuagguauugugaauuauucagaaugcagaccccacgauauagagguacaaauuauauuccuuccaaacuaauacacaaacuauauuaugugcuuuucuuuguaaaacaguuuguuaggguugugcuauuugaacauauuuucugguggauauucucagcuuugaacacuguacauuuacugguaagauuuuauuuauaaauuacacauuuuaaggaaauuucuauacuucuaaaacucgaaauauuuuuugaaagagguaauugcuauauaucugcuuuccuucuaaaauauuucaaauauaucugguggcuacuguuuuauguauggagaagguaaggcauugagauuaacuuucucauacuuacaaaaugggcuguguguggugcugaaaauaagaccgguguccugacucccaguuuguuuucuguguauuagaccagacugcuuacuuaaaguuuuauugcgcuaaaaaucuguucauaaguuugagcuccauuuuuuucuguccauuauuacaacauagagaagcacauucauauccccagagaaauuuagugauaugcagcaacuuuguuucacucuugacauuaaguguacauuguuaacauuuuuuaucuuaugauugaauguuucagguuuuccuccuccaccaggcgcuccaccuccaucucuuauaccaacaauagaaagguaaaucaguauggauacugauuuuugaucauugauagccuuuugacagaagaaccauauacuuggaaauauuuucagauauuuaauuuuauaaacacagcaccugucuuuuaauuuauaaaucuagaucuauguuaguuacuuuuauauaagauguuggaccuguagcccgauaucaaaacagggcaaagaaaacuaaaaucguaauauuuugaaauaauaucuugcuuugauuuaugacacacuugauuaaagaagcuccuagacuguuaaaaacccagcaagucaguuuuaugggaaauacaaacauaaauuacuggaaaucaugaauaauacaugucuguuuugggauaaaguagggaaaacuauuaugggaccauagucaagaaaagcugucuuauuccuugauacaccaucucagcuuccacaaagaaggauuagauccauucuguguggcaguagccuuauuuuuuguaccguguauuuaaggcuuaugcuaacuagaacgcuguacaaagaauauuuccuucauggguggcaguaugguguuuaacaacauagaaaucaaacaguguugcuaggcaagguucguaagcccuuugagacucaguuuuccuuuuuaccaaaaggguugauagaauugugaagauuuaaaaggcuacugaauauaaagugcaaguauaauucuuggcagauagaaaucacuaauaagaguuauuguuauuuccucuuaaguggcaaauaaacuguuaaaaauaguguguuucugaaaaaaugauucaaauaauguaaaaaggcaaaauaugugagaacuuuacaucaguagcaucaaacccugcauaugauuuucagaggaaacuauaaaaucaagaaaguaugaauugugagaacauaaggauuuaguuuuauugagugucuguuagacacauuuauuuucucagucaaaauguuaaaaaguauucuuuguuaauccugucaguggggcugaauuacugauuuaucaccaaaaaaccaauuauuuaagacuaaauuuuuagucugaaauauucugauagccugaaauuuucuauuacuuuacuuguaacucaagcuaaguugauuggauuauuuauguuaaauaguauuaguacauccuauuuuucuguaaaauuagguauuuuaauauuuuuuagguuaaaaaaaaccccauguuuuauuaauaaaauuauagaacuaaauuaucauuaaauuggugguuggauaaaaguuguaauuuugccuuguuuuuccuuuuguacuacauuauuaaaauucagaacuuauuuguaccagacauaaaaauauaucuuuuucuucaacaguggacauuccucugguuaugauagucguucugcacgugcauuuccauauggcaaugguaaguaguauuauuuagaugccuagauucaguuugaaucaguaaaguacuugaauauuuuuaaagcaauaaaaacguguucaugguuuaacaucuuacagagcaauuaaaaaauauuaacuacaggaaugaguggucuauguaucugccagguuagcaaacaauaaauuuaauguauuuaucaacugugcuuuuaaaauuaauucauggugacacaacagggauauuuguacuuugccuuuucuaaaaggauuuaggauuugucaccaauuugucucaaucuucguuguuuguaacguuucuauuucuucacuuauggcacacaccuaaccuuguuuccaucuuucucccucgcugguuuauuuuuuuucuguaucauguguagguccccuuucauguucauucuugacaacuuuauccauuccaaggccuucugaccccauuuucuuuugcaccucuugaucagucauuuauuuuaaaaaugcugugcauuguacuaauuuuuuuuuggagacagagucuugucuguugccuaggcuggcgugcaguggugcgaucauggcucacuguagcuucaaccuccugaacuaaagugaucaucccacgcagcuaggacuacaggcgugcaucaccaugccgggcuaauuuuguagagauagggucucaucauguugccuaggcuggucuugaacuccugggcucaagcaauucuccugucucagccucccaaagugcugggauuacaggugugagccaccacaccugaccuguacuaaguuuuaaggauagaguaaccuguauagagugcuugcccucauaaaaguuauaggcuuauggggagauagcugggugacaggaguuagagggugucaugggagcauagcagaggggucuccuacuccagagaaguggaaggguagauaauuugacuuccaggcuauucagagauaaaggagugagagggaacaugguagguauuaggagcuggaagaaguguguuguggcuggaauguagagacugugugcuuaugcaggacguuauagccaugcuguggaguuuggaccuuauucagagggcuguguggaaccaguuaguuuuaugcugaguugugaaguugcuacauuuacauuugaaaaaucuccauucuggcuaguuacgaugaggaaguuuugaauuuauagggugaguagaaaggugggguuggccuucuuggauuggaacagcaauaagaaguuguggaacaugugggggaguaaaaaauaauuuucucccuacucuuccuaguucuuaggauggacccuguauuaaaaggcacauuaacaagagagaaaagaacaaguuuauuaacauguauaccucauauauccaugggaaauaaccagggaaugaguaguucucaaagagauggcuuagaaauccagauuauauagcaucuucaguaaggagcaaugaauuuuuagagaagugacaagauaaaggaaaagggccuugagucuucaugagcaaccaguuguggaaaggcaauauauacuauauaaaggcuaguuggugaacauucucaugcaguuuccucuggugccuuguccaugccgauaagggucuaaauuugucuucagugaucaacuuuuguccuuucugguagagagaggaggaaggacaccuuugucuuuguaaacuuacaucgugcuuuuaggcaaauuagggagggcgggaagcuuuucuuguaucugcaucuguucagcuaccuucagcucaaaauaauccuuaugucagagagggauguuuuggggugacauauucuggucuccuacagaaguaauccagaggaaaaauuaggaugucauguacucaauaccauugaagauggagaugaagaaaauugaauagacuccgaaggauuuauuugauagaauaaagucuuagugguagaucagaaauagguaccagucauacacuucuagguaucucuaucaggguaucguacuguccuucaaacuguaccuguucaaacugcgcuugccauucauucacuacaaaagaugguauuuauguugacuuacuuguuucaaugacuauguuucuuccccuucuccccuuuuuuuuuugcuagauauuuaaguagucauaguccuuggguuguaaucuugauucccccucuuaccauuuaugugacuuaaagauauucagccauuaaauggacagcucaguucuuccuuuuaauguggaguucauugaaauacauugaagcaccuuaguccugccauuuaguaaaccaucaaauguuaccuguuauuuuuuauaauuaucacccuaaucuccaacaagcuccaaguuccuucccuuuucugcacucugaggcaguguagcaucauuguuaaagcauaggcccugcaguuagacagccuagguuuggguccuggguucaucucauguuaguagcuuugaauaauaaccuacaucguuuuuuucaucuguaaaauaaauuuugacuauuaaguacuugguaugaugccuuuaauauguaagcauuuggugaacaugacuuauuaaaguuugauuguuuuacuauuuuaaugagacuuuccaguuucuauuuuguuauucaguuccauguauauuuguuucaauacagauaaacaugaggaauacuccauauuagaaagagaguaauucuugagauuacccauucaguuucauuacagaauauuuuauuuuuuaaaaaugcuaacuugguauuuaacuuuuucucaagguaauacaugcacauuuuuauaaaaaagugagagucucuugcccacucuuuccugcccccaacucuucucucagagacaagguuuuuuguuuuuguuuuuguuuuuguuuuuuugaauggaaagccucuuuaguaauaacaauuauaaaccacauuguaagaaguaaauagaagaaaguuagaaguuuccuaguaaaacaagguuuuagaaugcauuugauaaauacagcuucuuuguuggugauuucuguuuuaccuuuguuuuuugauguguuuuuaguucuuucaguggucucuacagcauuucuauauauguuuaucaccuuauuucuugaguauauaacuuacauaccaucuguuaucuuucaauaugauagauauguauuuugcucaguuaucauuacuacccuucuguuuucucccaccaauaaaauuauauuacuauuuuugcuccucuucucauuuauauauguauuacuauuuuugcuccucuucucauuuaucuguuucauguaccauucuacugugguaaaaugagaauauuagugcgucuuucuaagccuucacugaacuuuucuuucuccaccaccuagcuuugcucaacuauacuucuuacaauguuuacauuuuguccuguaacaaaaauaauucguggucugacagauuuuuaaaucuaaaagcuaaacaauaaacaacauuuacauuauuaugaauguguaaauauugugcacugcagagauaauuauacacccaagcuccacaagggagaaaguuacaugacaaauaauucaaauuacaaguugaguauuccuuaucagaaaugcuugggaggagauguguuuuggauuucggauguuuguuuuggaauauuugcauauacauaaugagauaucuuggggauggaaaccuagucuaaacaugaaauucauuuuuuucauguacggcuuauaucuauagccugaaguuaauuuuacucuauuuuaaauauucuugugcaugaaacgaaguuuugacuguauuuugacugauaaccaucacaugaguucagguguggaauuuucuacugguggcauuguguuggcucucagaaaacucuggauuuugcaguauuuuggauuuucagauuaggaaaucucaaccuguaccauuguuuuuccuuguaugucaucaguuguguaaagucuuacacauuuuagugggguucauauuuggaacaugccuuucuccaccucaaguacauaaagauauucuuuaauacuuuuuuccucccagaaaaaguuuucaaguuuugcucuucacauuuaagucauuuggccaucugaaauuaauuuuuuagguauaaagaucuaguaguucccaaaucauuuauugaauagucugucguuccugagggauguacgauugucgucucugucaucuauuacauaucuauguguaugaaucugguuuugggcuuucuagauauucaguugguuagcugucccugugcuaauaaauuccauaauaucuuuaauuaugaguuuuauaguaaaucugauaucuagugcaucaaaaucaauuguugcuuuuacauauguauuuuagacugaacuuagcaaguuccaugaaaaacuugagauuuugauuaauaacauuuguauaguacuuacuacauaaugcucuuugaagcaauuuauguuaauuuauguaauccugacaguuuuaaaguagguguauuguuacuaucuccauuuuauagaugaggaaaucaaaauauuaauuuccacaugucacacaguaaguggcagagucaggauuugaaccuauguugccuggcuucagaguccuugcuuuuauuuacuauaccauauugcaauugcacugaugcucuagaucagucuguguggaauucauaccuuuacagcauugaguuuaucagugaucaaggacuuucucuccauuugcagagguguuguuuucaauaaacugcuauaguuaucuccauacacuucuugaaugucuuugguuggauuuaguccuuagguaccuaauguuuuuguugcuguuauaaguguuauauacauuugaacaguguguucuguuuauauuugcuuguauucagaaauaguuguuugguugguuauuuuuauagccauuuaccuuucugaacucucacuauaauuuguaaagucuauuugggaaauacucuugcagauaaugacaguuuugcuccuuuuuuuuucagauccuuguuugucccuuuuuuuguuuuguuuauuuguucuggcaagaaccuccauuauaauauuauauaacagcaaauuaaauuauaacaacauuauaaugucgaaguacucaaaguggaguucuuguaugauuccuuuuuucuuuauaaaggaaaugcuucuagauuuuuacuguuagguuuuugauagaaccaucagguuaaggaaauucuguuccucuccugauuuuccaagggcuuauaaaacuaugaauagguacuggguuguaucaaaugcuuucugagaugaucauaauuguuuuucuucucuaaucuguuaaugugacaaauuacauugcuacauucuucuaauauuaagcuacuguugauuugcugaaauaaaccuaacuugcccaugauugauuaucuuuuuucuagauaaacacugauaauguguuucuaauuauuuaggauuuugacaucuaaguuuauauguauaauaaaauuggcuuaggauuucccuuuauuuauacugcccuuaccugauuuugacaccaagauuauaccagccaggugggauaagucagggaauaaucuuuuuuuuucccuauuugcugggaguuuguguaauauuggaaugaucuguaccuucacucaccuguaaaaggcauguggccuuguaggaagauuuuaaauuacugauuuaaugucuuuaauaguuauuagacucuucaagauuucuuuuuuguuuugaguuugguaaguuuuuguuuuuguuuuuaguaguuaauccauuucggcuaaguuuuuaaguguguugguauaaagugcagcauauucucuuuauuguuuaaucuguguugucuguaguugugaucccuuuuugcuucugaugcuguuuauguguucucuuuuuucuuaaucuugucauaaaauugucguguuuuauuuguugucuucaaaaaccaacuuucaguuuuuuuccauuauaugguaguuuucuauguacuugauuuccauucuuuguuaucccuuuuuuuguuggauuauucuguuuuucuguguucuuauauuggagacuuagcucauuaauuuuuauucuuuucuaauguaguauuuuaagacuaaauuuucuucuggaacaacuuguaucccuaaacuuucgauaaaucuuauguuugucuauguuuaguuccuaaugauuuaaauuuaugauguuuuugacccaugaauuaucagaaauguguuuuuaauuugaaaugguuagguauuauuuucucauaacuuuuaaauuugacuucuaacuuaaauugcgugguggucagagaacaaaucuguuacucucauccuuugaaaguauauguacauuuucauaaauguuucauaugugcuugagaagaauaauauccuuuguuaugggcaguauccuaugugauguccauuacaucaaccaugcuaagaacauguagcucaagucuuuauuugcaugguggccugcgccuguaauccuagcuauuugggaggcugaggugggaagaucacuugagccugagaguucaaggcugcagugagcacuguucuguagccugggugacagcaagaccucaucucuuaaaacaaaaagaaaccacuucuguauuuguacugauuuuuucaucugcuuaauccaccaguaauugagagaaauauguuaaucucccaugaucauggugaauuuccuguuccuaccuguauuucuauuaguuuuuacuuucuaaaacuuaaggugauguuguuagcuaccuggaaguuuaaaucuguucuguuuccuugguaaauuacaucauccaucuucaugugaucauccuuucuuuccuaaguaaugcuuucuguuugagucuguugugucauuaauaaagcuacucuuuuuuuuuuuuuuuugagauggagucucacucuguugucaugcuggagugcaguagcgccaucucggcucacugcaagcuccaccuuccugguucaggcaauuccucugccugccucagccuuccaaauagcugggauuacaggcaugcgccaccaugccuggcuaauuuuuuuuuuuguauuuuuaguagagacaggguuucacuauguuggccagacuguucucgaacuccugaccucaggcaauccgcccaccucugccucccaaaguccugggauuauaggcaugaaccaccgcgcccagccugaaagcuacucauuuucgaucggggguuguuuuuuuuuuuuccucaucuuuuuucuuucaaccuuucuguguguuuuuauguuguuuauauucagguuauaguuagguuuuuaaaaaauacaaaucaacaaucuuuguuuuguaacugaugagucagucccuuuuuauuacugagaauauuuagcuauuugaacuuaacuguccaccuacaucuucgucaagucgucuugaauugacugaguuucuuucucacugauuuucaaaaaauccuguuuucuucauuguuuugaaacuauacauuuucuuuuuuuuuuuuuuagugguuacucuugaaauuuauuauucauacuuaacaauguguaguuacauauaauuugaacaucuuucuccaucaauacagagacuuuagaauaaucuuucucuucuaacuuauauccuauugugguucauuauuuuaguuuucuucuuuuuuaaaaaaaacucugcuauugaauagcguauauuguuuauuuggauuugcauauaugauuaccauuuauuuguucaaccauuacuucuuuucauguuagauccucuaggauaauuuuucuuuuucucuaucugauagacauuccuuuuuuuuuuuuuuuugagauagagccucacuguguugcccaguccggaguauaguggugcaaucucggcucacugcaagcuccgccucccagguucaugccauucuccugccucagccucccgaguagcugcgauuacaggcaccugccaccgcacccugcuaauuuuuguauuuuuaguagagacaggguuucaccaucuuggccaggcuggucuugaacuccugaucucaugauccacccaccucggccucccaaaguguugggauuacaggcaugagccacugcaccuggcaugauagacauucuuuugguaaagucuguugguuguaaguuuugcuuauuuuuuuguugauguuuacaaaggcuguuugaaucuugaaauaaaauauuguugaguacacuuuucuagguugaaauuuuuuucucaacacuuuuuuuuuuucuuuuuuugagauagucucacucugucgcccaggcuagagugcagugacaugaucucuguucacuguaaccuccgccucccggguucaagugauucuccugccuuagccucccaaauagccgggauuaccggcaugcaccaccaugcccggcaaauuuuuauauuuuuaauagagacgggguuucaccauguugaccaggcuggucucaaacuccuagccucaaguuaucugcccgccuuggcuucccaaagcguugggauuacaggcguaagccaucgcgccuggccuccucucaacacuuugaagaugucccaguguauucugguuuccauuuuuuauauugggaaguuuguggucaaccuaauucugauuccuguucaccuuguauaaugaagggucuuuauauguuagguuuuuaagauuuguuucuggaucuucccgauacuguggguauucauucaccaugugauauuucucuuuucuauuuauaaaaugaauuucuauuauaaucucaugacacauuuuuggugggcauuuuguuuuuuuaaaguaccauaacguuuguuuuuaaucguguuuuuucuuuaguugccuuuccccaucuuccugguucugcuccuucguggccuagucuuguggacaccagcaagcagugggacuauuaugccagaagagagaaagaccgagauagagagagagacagagacagagagcgagaccgugaucgggacagagaaagagaacgcaccagagagagagagagggagcgugaucacaguccuacaccaaguguuuucaacagguuuguugggugugcaggaguuuauacuauguauuuuauaagcacuuacaaauuuauuuucguuaugaggaagugaauuucaguucacuuggaaaagagaugcucagggaguacauaggaaagccaucuuaaaaugauaaaggauuagaggcuucccauuaccuugaacaguaguccuuaaauuuguuuguuuacuuaucucuuaaaagaauuuucuaccccuucauuuauuuuuaucuugccaucuaaguuuuucaucuuaagcuuaaauuaguugaccauauagauauuuccaguguauuauaaauauuaauauuuaaaaagaaaauuaucaccacuucuauuauuauucuauuuuuagagacggucuugcuuugucauccaggcuggcuggaguucaguggcaugaucauagcucacugcacucuuacauuggaagaagaugccaucuaagacuuucagagcuagagaagagaacucagugccuggcuucagaguuugaaaggacaggcugacucucuuguuucccaaugcauuguucccuaacguaggaaguccugggcucaagugauccuccuggccuagccucucaaguagcuaagacuacagucaugcaucaccaugcuuggcugauuuuuaaaauuuuuuguagagucaggaucuugcuguguugcccaggcucacucucuuaaaauauauccaguggauuaaaaacacuauagugauuuuccaaaauuauccauuuuuuaaagaaaauguacaaauagucucucuuuaagaauuggaaauuuuacauuucuuuuuguauucaaauuuuuacuucuguaccacuucccucaaagaauuuuguucuaauguaaaaguuucauaaucuuaaaacuuuuuaaguggguuuuccuauuagucuuuccugcaacacacuuauguguuaaguuuuaauguuuaaggaaauuuuucuuguauguguuuuaaaaaauuuucauccugauuuuaguuauuuauauucugucagugcaaaccacauguacaacaguggucucauaagauuacaauacuguuuuuacuguaucuuuuguuuagauacacaaacaccauuguguuaaaauuuucuacagaauucagugcaguaauaugcuguacagauuugaagcccaggagcaauaggcuauaacauaucaccuaguguauaauaggcuguaccaucaaaguuuguguaaguacacucugugguguuugcacaacaaugaaaucaccuaauaaugcauuucucagaacauaucccugucauuaacugacacuugacuguauacauauaccgcaaauuuugaaaauaauguaauggaauugcauccuuuaaugagaaggaggagcuuuccaccauccccagugaguauuacuauuguuaggaaaaaacagaguuuguucagaaugcuuaaaauauucaguaaaccauccuguaaacagaugugcugccauucaggcuuugguguuccauugauagagcacaggcagagucgauuuaccauaauucuaagucgauuuaccauaauucuaaggacuccaggauuuucagggugguaaaugggcaccaacuucaacuuaaaaacaccagcuacauuaaggaacaaugcauuaggaaacaagagagugagccuguccuuugaaacuuugaagccaggcauugccuucuccucucuagcuaugaaagucuugauggcaucuucuuccaguauaaggcuauuuggucuacauuaaaaauguguugcuuaguggagcuaccuucaucagugauuuuagcuagaucuucuggauagcuugguguagcuucuacaucagcaguuacugcuucaccuuguacuuuuauguuauauagauagugucuuuccuuaauccuuacaaaccaacuaaccucugcuagcuuccauuucuucugcagcucccucaccuaucucugucuucauaaaauugaaaagaauugggcuuugcucuggauuaggcuuugguuuaagggaauguuguguggcugguuuguucuucuauccagacacuaaaacuuucuccauaucagcaauaaugcuguuuucauuuucuuaaccauucauguguucacuggaguagcacuuuuaauuuucuucaauagcuuuuucuuuggcuugacaacuugucuguuuggcacaugagggcuagacuucagccuaucauuacuuuugacaugccuuccucuucaagcuuccucauuuuuuaaaagcuuaaucauuuuuagcuuuugauuuaaaaugagagaugugcaauucuuccuuucacuugaaggcguagaggccauuguaggguuauuaauuggccucauuucaacauuauuguuucucagggaauagggagacccaaggagaggaaagagaugaccugaacaguggaucggucaagaacauguacauuuauuaaguuuguugacuuaccuggaugcggcuuaugguaccccuaaacaguuacacuagugccucaaacuagauccuguucagagauauuauaacaaauuacugaguuuauuuuggugcaaaaaaaauugauaucgaugcauaauuuuuucauaguaugcauuuuccgugaacuuuuugaagaccucucauauugucaagcugucuaggacuggucgguagcuuaaaacuuuaccaaaaaaaaaugcacaagaaggaacugaugaggauuuacucaucuuuuuuccguccuuuggcuccugcuaauaugacuuauacauuguaggcacuuaauaaaauuuuauugaccaaguaaguaaacacuaugacacaugcgugugugugcaugaguauaugauuuguguuugcuuggugggaaaugugcuguugacuuuagccaauuggaaaugugcuguugacuuuagccaauuaagugcaugauucuucuaaguucaagggcauuacuuuccagaaagucaaauuguuucuaauguggaaaugaauauaugugagauagcauugcugucucuagaauguacauguuuauaaguaaggaacuuaaugcaaaacuugauaggaaauaagaguaaaauaaauugcuuugccaagcaggacucauaaauuuucuuugcauaaauaacacauuguuuauagaagauuuggcuaaauccucuaauucuucugcuucaaauacaugcacagauauuacugaguuuuuauugaaacuuaaaaaguguuaauguuuaaaccacauuugauauucagguugcugaacuguagggcauuaggagucaauguuuaccuaaauuugacuaaaauguuuaaggccacagaggcaaaaaguggaggaauuuugaguuguucugaauuaucccaggaaaaaauuacacucuggaaaauccaagugaaguauaaguaaagguuucugaaggcugguauuuuagcaguauggcauguaguauauguugcuuuacaaauuacagggccauuguuuugaaaauuacaggccaguuucaacuucuguuuuuuagggagcuuaauuaugggccagaaagaaggcuggucauucuaggauguuugaaaugaacucuaauaauuuccagguccagagaaaccuuugugguucagccacuuaucagaaaaggggauggaaggaggagggucuuuauauuuuguguguaggacccaaucuucuaccaucuguuauaagguucccaucacagggcugcuuucagaaucuaaaggcuccagguucaacaagagcugguuuuaggguaagaggaaaaagaguuaacaaaugacacauuaugagauaauugacuuuaacuauuuuuauguaaaucuaguuggagucauugaaaagccucauuuuuugagagaaguuaacuauauuuauuuccuauggugcuaguuuauucuacuugaagacaugauacuaaaaaguucugcuucugaaaaaauuaagcauuaaauucaccaaggacugucauuuauugagugccuacucucauaccaagcacuuuauaaauguugucaguucuguaagaagucuugaaaaagacuguuggcaauuuuacaggugagaaaaccgagguuuagagagguaauagguaauagccucggucacucauuuaguaaguggcaaaaucaggaugugauccuguguguacuccacuuguacucuuucugcuccucucuacugacuggcauggcauguuacuuuucaggugacaugccuccacacuccaaauacaaaaguacauauuuauggguagaaaaaaauaguggaaauacauauacaaauaugugcaaauguguauauuaauacauuuucuguuuuuuuaaauaagauucuaaaauuuuaauguaucacagauaauaacuuggucagcaguacaauugggcauuaagcauagcauuaaugaaucauuacuuuugcuagaacacaggcugacaugucuuuuaaaacauggcuuauaguugucaccugacuauguuaaacccugagauuccuuaccaucuugauguuucauacaaauuacuacuuucauaauucauauuaaacacuucuagaaaucaaagcucuucagcauauucuucuaaaagauuauuuuauucuaagugaauuuacugauguuaaguuguagaaaguguugacuucuaugcuaaacauaaaaaaagaaaaaggaagaaauaagagacuugaaggauaaagagaaagauggaaagagaaugucaguuaaaggacaugaaaggaaaagaagucuagggagguaaagaaagaccacccucuaacucuagccauuagucucaguuucaccagucuguguaauucaauccaaaaucagaaaauggagaugcagcuucuauuuaugcaguugaaauuauuagccauguagccccccugcccacacagauguaauuaggaugucagaaugcagguauguccaaucugcauuuuguauggaugcuguagaaguugcuuugaugucucuguucuuuauuuuuauacuucucuauuugaugaauauuuaguaauaaaccuaaaguuuaaaaacuuauuugcuuucuguuuuguaguaauugugagucguguauuuuuauaauguuaaacguauguccaagacuuuccaagaauauugauuagaaaucugagauauacaaauacuauuuuaauucuaaaaggagcaaaaauuuuaaaagcugauaacaauuuaaaucaguugcagaucucacuuuuucaagaaaugaaaaaaccaaagcauuguuauauuaaaucuuuuuaacagcuaugaaagcacagaacaaaauuggucauuuaacauguguaauuauuauauauuuauauucuuagcucuagugcuauuuugagaacaagcauuauuuuccucucaauucaacgaauauuucuuccucacuaauguuauaaaagaugcuaaugugaggauuuuggauuuggacugcagaucacaucucuuuuacaguuugaauccauucagaauuaaugguccaguugucaagaaaacauuucuauuucaauuucagcgaugaagaacgauacagauacagggaauaugcagaaagagguuaugagcgucacagagcaagucgagaaaaagaagaacgacauagagaaagacgacacagggagaaagaggaaaccagacauaagucuucucgaagguuugcucuuuaauaaaauagugaaccaauaguaugugagagauuuugacuuacuacauugucgcauuggaagaggggaaauuuuggccuaugaaccagucuugcuugguuucauuaaagaaaaauucagggccuugucucaaauuuuuuuaaaaaagcauuaaacaaaauaccuauuguuugccaaaaaucaacccuauacaguauuuccgguuuugaguuaaugccuguuucuaauuuguuacuguauauuauaauaugcauuucagaagcuguguauaggcacugggaaucugagauaauaucagugaagauggcccuauaaaauaaauacaaucccugcauaaaagucacauaaaacugauuauuccucacauuauauuuaugagaaaaugcauuagauuauuuuaaacccaguguuauauugagaauuuccuuagagugauuggauuuuugucacugauuguguauuuaaacagaacacaccuuuuuuuuuuuuuuuuuuuuccaguaauaguagacgucgccaugaaagugaagaaggagauagucacaggagacacaaacacaaaaaaucuaaaagaagcaaagaaggaaaagaagcgggcagugagccugccccugaacaggagagcaccgaagcuacaccugcagaauaggcaugguuuuggccuuuuguguauauuaguaccagaaguagauacuauaaaucuuguuauuuuucuggauaauguuuaagaaauuuaccuuaaaucuuguucuguuuguuaguaugaaaaguuaacuuuuuuuccaaaauaaaagagugaauuuuucauguuaaguuaaaaaucuuugucuuguacuauuucaaaaauaaaaagacagcaaugacuuuauauccaagaaaggaaugugaaugagucacuuaacagggaaucuaaagagcuguguuagcuguguacauacacagauuaucugagaaaaggucaaggguuccacuugggccacaguuuuuuuguuaaucaaacaccacucucuuaagaggcugcaucacaaaaggcaacaaagggccccucuaaggcuugagauuaaaacuagucuuuaucauuacugcugugacacucuugcuuaguauauuaagagacucauacauuuuugauaucacaacuuuuugauggcuuuucaauauucuaaauuuggguuccuggugaaaccaaaugggguacacuuucauauccaaauuaauaaaaccuauaaggcaucuggguggccucuaugaaauaaauuaauuaauuacccauaguguaguuucuaggaggcauguguacacacacucuucauuguggcacaaauuuaaaucgccucaugaccaugucugugagccagggucaagcugguuuggccuucuugaugcauuuuccaaggcccacugguggagcagcaugaguuuuuauacaguuacuaacgauuguggaaaaaaagagcuuuagccauuucuuacuaaaaacaaaacaaguuuauaauuaauucucugagcgagcauuuuuagggauaagccuaggagguauucaucggugaugguaacaaauaacaugguauuugaaagaauaaauuacuaggaucuuuuaaauagugauaauacaaaaguaaucuuaauuaguaucacauacuaaaagacaacuauaacuucugaaaaauauuuauucuuguuugaugaaagcaacguuucucagcaaugcauuuuaaaaaauauuuuagcuguaaauuaaaaauggccauaauguacccuuggcagacuucagcauauaccaaauuuuaaauuuaaaucagcuugaauucagugggguauacaaaucauuuuaguuguuuuagggcuuuuuauugaauagaaaaaauauaaacaauguuguagaguaaugagaaauccuccacacugaaaaaaaacuaguaguuuuaauuuuuuuggaaucauauuuucugagguguaacuggcuuucauuagaugaucauacuuuuccugacauuuuuacaauguauucuuucuuuaaauauaaaaacugacaagauaaauauaguguuucaacuucuuagccuauuugugauuuuucuguuuuccucugacccaucauugauucuauaaaaaagugccaggccaagaaacaauaguuagaguaauucuuccuuuaaguucuuucagcagucuugccaagcaagcauguaucauuccugauguacuucuaccauugacagcaagaagaauaucaccacaucuaaaaaaaaaaacaaaacaagauaugauuaguauuuuaauucguugcugaaguuaaugcaaguuuaucuuaguggugcuagauuuugcuacaucugaccauuuuaauuauguuaacuucuaauugagauauuucuugccucuuauuuacauucuccaaacucacuauccauucagcuuguguuagaaggaaugcuaaaaguauggggaguuguaguaugggaccaagaauauguguaauuauuuuggauuucucagaaguugaaugcuacguacauacuuuuaauccccacaaaguauaauaaauacaugccuuaucucaaauggggccaagcuuuggcauuuaugaaacaacauuuaauacaaguauuuuugauuagucauuauuauuaccuaauucuuccaucauuguaugcugguguuccuucaacaauggauuugaugaaaaaagguuuguuuccauuguauucuucauaaccuccuacaaugcagaagcccagacuuccagcuguguuucuucguaauacaauaucuuuacaguuauacaagcaccugaaauagaauguaaucaguguacaugcauauuuaaguuucacaguuaagggaauacuuacugugacucauccuccauuccuuuuguuggcauuuuuaauggcuaaguaccacugcauaggucccacucaaaauuguaucauaccuuggugaccuuugugcuguuagcuggcuuuuuguaauugaaccuguuuuccauaauuuugaauauccuuaaaaaacugacagcccuauuguguucuguuacacaucuacugggaaugauaaucauauuuuuaacuuaagacaaugcuugaauauguauuagcaaaaaguuggauaaaccuaaauccuuauuggugaacaaacacacuuauggaugucauauuuuuauuuacuugauauaauuuuaaugagggcaaaaauccuuugaauaaucucaaugaaagcaguuuaagccuaauccuaauaaaugaauucguauacuuuuuuugaccuuggaaaaauaccacuuuacacccagugcuacguuugauaagucauagagaagcaugcacgcauaaagugaauggaaacagaaacguuuaaagauuauaagaacaauucaaauaggaggaaaaacaaacugcaggaaacuggauaggaaguuauaaaaggaaugggagaaggaaaggcccagcucuucuguaaauuagaauccucaacuaaaauagcaaaugagauugaagaaauuuuuauucaguggcccccaauggaucaguguucauauagguacaggccaaguguuaacuauguuauaauugccauagaagugugugucaggagcugaauuuuacuccaggaugacguuguugaccacauuuguagcuguaguccgggaauugguuugaaaggaaauuggcauuuucauguugccaaaaaucagauauggcuauuuuguuuauauaccguaccuuaaaauauuaacugcuuuuuagaaaccaauaaaaagucuugugaaaugu

SEQ ID NO: 14370 - RNA, 3843 nt, Homo sapiens
uuacuuucuucacagcuguaguucucaaacucuuggggaucucuuuccaaugacacaagauuuuaugacccacuaaaugaaucucuuuguaccaaccacugcuugaaaaaaaucuaauuagaaucauagggguccauggugcagcucuuaugauguuccuuaguaaugucaaaaguaaaagauucacugauucuaggaguaagaaaauacagucaugauaauaauuccuuaauuccaaaugcuuugcacuacaccugucauuucacauguuauuuacuuuuucacaacucugugaaguuguagcauugcucaauccccacgacacuguaagguaggcuuguuucauuacuacagaauuucaucacuucuaagaugccaaaggguagaaugugcaaccuuauuuuuugugcccacccagaaagaaaacagaauacugccaauuaauccacaacacaccaucaauuacauaaaccaaaacacagccaguuucugagauauuaaaauguaaaagaaggagugucuuagaauuaaugaaauauggacuuucccuuuugcagaugaggaaauuucugcuguguuaaagacuaggcugcugacggagauuagaccaccacucaaagucgcaccuucuaacuucaacccaauggacuccacccaaccagaccuagugauuuugaaguugaucuuggaagcaagagagaaggcucccacuguguauucuugaaacuaccacuuuagaagaaaugauuuaucacugauagauggcagccacgaugguggcauuuuaacaagaaacaacaaacuaguuucagagggaaauaugaaugaccacuugcuuccugucaucaugauauacugcauuaauacaauauagguacagaucuugucauugggcauauuuugugucuaauuaauauguuuacauauauauaacuuuugauuauuucucugacuuggcuucucugcuggguuugcagucaugagagaugaauggcugguaaguugacagcagaagaaauagaccuuucgauacuuuaauaaugcagaacagucaauucuaguuagcaagacuguacaauauagguauagucaauuggucaacccuuauuauuugcagauuccauaguugugaauuugccuccuugauaaaauugaauuguaaccccaaacucaaugcucauggugcuuuugugguuauuugugggcaugcucaaagcagcgaaacuuuaagucaugggaugcacguguucccagcugagguccaacagugacgcucuggcuucuugugucagcuuucauacuaucagcaaguguucucuuugcagacuacuuagugccccguuuuuccucauuuuugugcucuucauuggugauuuugcuguaaaaauggccccgaagcauaaugcugaagugcugccaaauguuccuaagcuccagaaaacugugauguaccuuacagaggaaguaucuauguuagagaagcaucauucaggcaugaguuauagcgcuguuggccaugagcucaaaauugguguauuaaauaaggugccccagucagaauggcuauuacuaaaaagccaaaaacaacagauguuagcaaaguugcagagaaaaggggacacuuauacacuauuggugggaaggcaaauuaguucagccacuguggaaagcaguuuggagauuucucagagaacuugaaacagaacuaacauuugacccagcaauuccauuacagauauauauccaaaagaaaacaaacuguucuaccaaaaagacacauacuugcauguucacugcugcacuauucacaauaacaaagacauggaaccaaccuaggugccaaucaauggugauuggauaaagaaaauaugguacauauacaccaugaaguacuaugcauccaugaaaaagaacaaaaucauguccuuugcagcaacaugcaugcagcuggaggccauucuucucauugaauuaucacaggaacagaaaaccaaauacugcauguucucacuuguaagugggagcuaaacauugggugcucauggacauaaagauggcaacaauaggcacuggguacuacuacagcagggaggagugaguggggguaaggauugaaaaacuauugggugcuaugcucaguaccugggugacaggaucauuuguaccccaaaccuaaaaaaaaauucuuccuuauauuuauuuaaaaucugcuuccuaauaaauuuucuuuaauuaaaaauguuaauaucccagaaaaaauaaggcaucuugaaacagaaacguacauuaaacaagguuauuuauugauuggcugaugaaaauggugcaaacaaaggcucacaggaacccaacuucauucuugcuaaguagaauggacuguuuugggguccuaaaguaucaaaagggcuguuucuucugucgcccacuuaccagcuguucauaucucaugacugcaaacacaguggagaagccaagucagaggcauaaucaagaguuauuuaggucagguguaguggcucaugccuguaaucccagcacuuugggaggccgaggcggguggaucacuugacgucagggauuugagaccugccugagcaacauggugaaacccugucucuacuaaaaauaaaaaaaauuagccaggcauguuggcgcaugccuauaaucccagcuacuugggaggcugaggcacaaaaauugcuugaacccagaggcagagguugcagugagcugagacugcaccacugaacagcacuccagccugggcaacagagugagacucugucucaaaaaaaaauaaaaauaaaaaagaauuauuuauauacauauaccaaguagacaaaaguaugccugaugaucuggaaggaaacagaaaaauagaaugacagugguggugggaguauagguuuuuaacauucuuuuguucccauuuccaauuguuggcauuucuuuguagauuuacguauuaaaaacaagaacgacugucaggaaggcgaggaagcacugccuaacagagcauggcagugguggaaaagcagaccagggagcccacaaggagacaaugauagagaagucuuucuuugggagagcauccuuagcuguggaacaggccgagaugcuuacagaggaaggauggaccucuguauaagcucuguagccuucucaguaaaaaguaaacagaaaaaaauggggggagagaaggaaugaagaaagugagucuauggccuuagugcuucucugcuuaggauagagcacuggcaagcauaugaaaacacauacauuucauugcuaaaaauaaagaaucaaaagugcuuuuguuuaagccuugaugugauauuagcaauaaagagccaccaguugcaggagaaccacaauacauccauaacccccaaaauauauuaguuuaggggaauuguugucaacaguaggaacaauuaagacuguguuguuauagaaauacugugccuagcugguuugcaaaagaaaacugccucugaugacuuaggucuggagggccuuugaaggcaguuucuuuccugugaccaguaacugauuuuucacaaaauugugcauugacuauuucucacaagagguuuugaaaaugaagcuggguuucagguucgacucacaugagcuacuuuuauuuggacagucuuuguuuuucucagucucgucggcaguccuuccggggccuuccucaaucccuggccggggcugaggccuggccguuguuugggaugaaaagguauuggaaggcuggcugcuaauuggagcuugcaccugcagaccccagccuuggaggcgacucggcacaggcuacugcucuauguguguaugcuugug

SEQ ID NO: 14371 - RNA, 1603 nt, Homo sapiens
gagaagaggggaugcaauucagcagugccgggguccagguugaccagauuaggggucggggaugggacagcgcggcggcuggggaggugcgcacgcccggagagccccuuccuccccuccuguggcuccggggauguuuguccggugagaugcacugcggaggacugucgugcguuugcccuggaugcucccugcuccaaaaaucugucuaguucuugucaggagcgaccgcggcgaggcgagucgguccaaaacauugagcaauuuggccucggagccaaaaagccauuucccacaccgcccagcccgcggcuuuucggacgcggggcgguagggaccugauaugggccccauccaugcuugccucccacccaggaagauggagugaguggcaaguucuuccaggcacuccuugcgcacauccugaggucuuagcacaauucggggagcgaagugcgggaccggcgcucuggcugcgggagggaugcacaacgcacagccugccaggccagcaaguccuucccgaccaagacgcgaggccaggccaucggcagcucucgcacaccuggcccggcccaggcuccuggcucccucuggcaacguacucggguugggccacacucgucgcuccgaccuggccgacacccucccggaauagaacagcugaucccacauauucaaugccaaauggacgccgcccgcucccugggcgcagccgggcggaguuaauuucguguguaaaucugguuuccauggggguagacagcagaggaaggagaaguacgcacagacggcucugaagccggcagggagaggaauggaaaaaaggccaacuagagaggaccgagcagcgcugggcgagcucagacggcaagugccacgcacccccgcgcggagaagggugccggguaggggguguccagggcucgggugcccggagggagaauaugguuuaccucccaccuuucugucuuaccugcaaacaaguuuccccaguuccaagucgucccuaacuuccucacaagaaguucggcaccuuccuggagaccuuuccucucuuccugccugcggccagaacugagcgaaagcagagcccccgggcaaugcagaaaugauuccaccgaggagggggcgcgggaagacaggcgggggcgggggccacggagcacaaugagggccccuuggugugcgguucgaaauuccucaaaucccaguugcuggaaugcgaggcgacgacgacuucuucacucagggccaaauguguuugucauuauuccagaccgcccgcccgcgccgccgcugucgcccccgcgcuagggcgugcaacccgagcacacugcccggcaggcacccgcucucccuggcaccucacugacccaacaaaccgcuccagagcgccccaaacccuugcccacgcccgcgcgccucugcuugucccgcagccgccucaccgccgcgccaaaucuggccccgacucucucccagagcagcgccguccaguaaucacgcgcauucggccggcucccugugcuguaggccaacaccgagguccggucuccagccgagcccagcccgccuccugcgccccgcaaccccuucgcgc

SEQ ID NO: 14372 - RNA, 471 nt, Homo sapiens
gauuaucugccgccccaaggcugaugcugcgguuggacccggcgaguuagacccggggaacccugagacccacaccuuucggucaccgauccggcuuuuagcucuuuuccuagaauugucacuuuuccaccagcaacguauaaccuggucgcagcuccccggaggucaaagggaguacuucccuguggggucugcaggaaggcgcuggccaccacguccccaaaacgcgucccgccgcugcgcgccgcccacgguccguccccaggaggcacaaaaugggcccgccucggcgccagacguguuugcagcuggaaagcccggcccaaugccccucccccugcaucccuccucaguccgcgucccgagaggaaacuggcccaggggcgcagagcugggagccugggaucuccuucaaguccuucucgaucuaaggauuuaaacaagagccagggcaccgggggcuaacgacgg

SEQ ID NO: 14373 - RNA, 4239 nt, Homo sapiens
cagaacaaagucuugcauuuauuagaagcauauaaauacaacuuucuuuuuccagggggaaaaaacacuggaccaaaacaaaaugcccucaauguaugaauuuauagaaacauugaaguuucagaugagaaaccugaccucaguguugaaagaagagagaugagaaagcgaaaaaugaaagaagccuuuucuuauuaaauaauuagcucggggauaacaugaaguguuuucuaaaugaaugcauuuguaggaagaaauaaaaacauuggaauaacuugauuagcacauaugaauaacaauugauaacgccagugaacaaucaaagucuugaaauugaagucuuuaaaggacaaauguuucucacccccuaaugcuaucuccagcaucuaaauauguucagcaagagcugaugggagagaauuguuuucuaaaaugauuauuaugguauugcuauuacucaacaccaucagcaugucgaaucacauuuggcuccagcccaauguaaugugaaagaaagaggacuuuuuuucuuauaaauguuuacaauuaaacuggauaggaauggcaaaucuaggagacagagcccccuguuuucuuuagaaacuucuucccagauggcacucccuuggacagcauugcaucuuuggcucuuuguggcugcccauagaggagaacaauggugagaccugccccagggcacaauacugguuaccucugugccaagacccauuauuaaaagugucuuuguaaggacagaguugccagaagacaucuuuccauagcacauggucacuuuugugaucuuuagaauuauccaaagcaaauggccugaaaauaucaaauaaguuauugcuucuaucacaauuaauuacucuuccuuaaggcucuauuugcuugugagagcugucauaacaaaguaccauacaggggguggcuugaaagacagaaauuuguuagaaguucgagaucaaggugucagcaggguuuguuucuccugaggucuuuuucuuugguuuguaaaggccacugucucccugugucuuugcauggucuucucucucuaccugucuguguccuaaucuccucuucuuauaaggacaccaguuguguuagaugaaggcccacccuaaugaccucauuuuaacuuaauuaccuauuuaaacaauccuaucuccaaaugcagucucauuuaaagcuacuagggguuaggacuucagcaugaauuuuggggagauauaauucauuuaguccaugacaaagaccucugaggcuguuuugaauugaaauugaacuauuuuguucuuaauugaaauuugucuuaguuucagaaugcucuagcuauaucuacgcaguugaagaacauggaauuagaaacuucuaucaguuuuccuuuguucuugugggccuguuuguuuuccuuccuuaugcugucaauuucuccagugccuuuaugcuuuagaugugucuccuaggaauagcauauagcuggaguuuuuaaaaucucuaaucugaaaaucuugucuuuucaagguagcgucuaugcacuuuauugugauuacugauaaauuuagucgcaugagucauauguagucuauuaguccuuucaggcugaauuauauugugguaaaauacaaauuuagaaucucauucuguuuucgcacauucuucacuuaaaucauaaguucauuagguaccuuauuugccuuucaaguucgcaaagguaaucguuuuacucaaugguuuaccacugcauaguguaaacugccaucuuuccaggcugcuguaaguugccuugcuacccacuucacagucugaaagccaauaccuauauuuuaaauaugaaguuguuuguuuguuugcuugcuuuguuuguuguaguuguuguuaugauagaagcauuguauuuguaaauguuaauuucuguaucaggcuaaguuaugcugcaauacuaaacaauuccaaaaucuaaauggcauuacauaacccaaguucauuucucuuuuauauuacauguuccuugcagcuuugccacuucauucuugggcccacgcugaagaaccagucuuuuucugaaacauugcuaagaauguggcagaaggaagagauauggcagaacuucaucauggcccugacaaacucugcucugaaaaccuucaugauggugcugaaaacugacucccccugagaguuccuuggcuaaaugagucacuuggccaagccugacauccucagagugggaaaacaaucuucccaaaauaagggcaccauaaauuacauagccaaaccucaugucaguagaauggcagguaaaauccucccacaagaaggagcagcauauauuuggaaauaaaaaaugcaguccacuacaucucaaucauuacagccucagaggcugaaaauuugucacagggugauaugguuugucuguauccccacccaaaucucguccugaguuguaguuuccauaauuucugugugucaugggagggaccuggugggagguaauugaaucaggggacaggucuuucucaugcucuucuagugauagugaauaagucuuaugagaucugauaguuuuauaaagggggguucuuccacacacgcucucucgccugcugccauguaagacgugacuuugcuccucauuugccuuccgucaugauuuugaggccuccccagccaugugggacugugaguuaauuaaaacucuuccuuuauaaauuacccagucucggguaugucuuuauuagcagcaugagaacagauuaacaaauguguuuagcuaaaaauugaggcuucaucauuauauaagaaagaggauagauauaggggacauuaagcagucuucuuuaguggcuacucuaguauuuuaauuuacuuaacaccuuuauuguccucucagacaauaaaaaaccuuaugacacuuuaacccuuaucaucuuccccacaacuuaaaugcuuucauaucaaauauuucaguuauaucuuuuauuuagucacgaaaguuagauauuaauuuauuguuuuguccagucaaauuauuuuuagauuuaucuaauauuaacuaauauccaaaacuuuuuuuucugaaaguguaucuuucagaauuuucuugauucuuuccuagaauuuccaucuuucugcugacauuaucugucuguucuugcauguugucuacuuuuucgauuaaagaccuuaacguauuaacuguaguuuguuuaaaaauuccugcuuuaauaauuucgacauuccugccauaucucacucugauucaaaugcuucuucaguuccuucaaacuaugugucuucccuuugaguaugccuuguaauuuuuuguugaaaagugaccauaguguacugguuucaaggaacugcuauaagcaagcuuuuaguaaugugguuguaagguaugggagggaaugaaagccuucuaucacccuaugauuaggucucagucuuuuggugagccuacgucacugggcugugaaugucaccagugcuucuuucucaguuuuaaaaaucuccuuagacgcaucaagauggauggagugggcuagagucugguauuuccuuucucacacacagaaagcuagagaggacuagaguuuugaguauuucccuuucccuacauggaagucuaagcugaaguuggauauuuccuuuucccuagguagguuaggcucugauaaaacccuagcaaauuagauucugguaaaauaguuucuccugacaucaggccuuguuaagaacagaaugcccuggugcauuuuuaaaugguuccauuuuucuucuccuugccaaaagcuccugcagguaaaacucauaaaaguguggagucccccuaggauuagggcccccugugacuagguccuccuggagcuuuuaacucucagacuuguccacacugaaccucuggcaauucaucaauuacaguucagguuuuccuacacuggcacugguucccacgaagguuucugcugcugaguaaguugcuauucucucgacccaucucucugucucuccaauuugggggacugcaguuugcccuaugaccucacuucuuuguuggaucuaagaagggugacugauuuucaguuuguucagcuuuuugcuuguuuuuaagauggaguggcaacuucuaagcucuguacaugucagacccaaaaccagauguccaacuagaauugucuucagagaggaucuguuggugguacaacucucgauuuuuuguuggcuugu

SEQ ID NO: 14374 - RNA, 1467 nt, Homo sapiens
ugagagucaugguucauaauccauauuuggcaaaaagcacaggcagugccaaguugaauuuggguaagcaguuuggcauaagcuauuucaacaaugaaauggccgaugugaugauccucagggaauacaaaaagccuccuagcagccuucuguuaaaaacuuuuugguagggaugagucuuucuagcuacucuaagacacaucugaucaauaaaacgcccaucccggagcagcaucuuggcccuccggagaucaacguuuauagcgggcuccucuuggacucucccucucccuuucccuaaaggagcgggcaagaccaggccucaccggaaaacagcgcagccgaccgcccuccaccccgggagcaggggccgggcuccccucccccagccgaggccggcggagugcggcgcuuucaaaggccuggagccugguacucggcgcagccggcccugcagccucgcucgccccaucccggcccgcucaccucgacccgggccggcucggggcccugcacagccacaggcugcggcugcagcugcugggccggcgccggcgguucuuuguuccgguggcuaaggucuucaucugggccggcccggaccgcagccggggcccacagcagcggaaccagaaagagcagaagcagccggggcgccgaugcgcggccguucccuggagccgcggccgccaucccgccugccgggccggccgcgcacgggcgccgcaagaggaagugccggcgacgggaagccucgaccccgaacagccuccgcggcgcguccucacgacucgccgccgccgccgcuuagggagcagucagcaccauccgggaggugcaagcagcgggagugaggugaggggcaggccgaaguccgcagccccggcucggcgcccguccucuccggcggcggcuaaacuggagucagccagcugccucggcgcggcccagccccgacuccucccggccccgucccugcccgcgacggccucccauuggcccggcgaccgccuuggcgucgugacguccucugccagguugaggugcggcgcgggcccuccucccauuggauccggcgcucccggcagguacccggcgccgcguguccuuccucugcucgcauccucaccgcgccgcgcccggggcucccuuucucucucugugccccaccgucccaggacugcgagguccuucacuucugcuuccuccagagccuuccgccguaauguccgcacccgcuguucccugcgcuuagucucucuuagaggucaaauuagugcgagcgccucugguuacguggcgcugacucgcaggcacugccacgcccagcucuguuccgcucucccccgccgagccucugugccacccuccauguggccaccuaccgccaaaaacguucuuaggagcucaaaaugcuauuuuuuuuuuaaaguucugaaaugggauuuggaaauaacaugacauuuu

SEQ ID NO: 14375 - RNA, 80644 nt, Homo sapiens
ggcucacucgcgcccuugccgcugccaccgcaccccgccauggagcggccgucgcugcgcgcccugcuccucggcgccgcugggcugcugcuccugcuccugccccucuccucuuccuccucuucggacaccugcggccccugcgagccggccuccugcccgccccugcccccgcugggcugccugcugggcgagacccgcgacgcgugcggcugcugcccuaugugcgcccgcggcgagggcgagccgugcggggguggcggcgccggcaggggguacugcgcgccgggcauggagugcgugaagagccgcaagaggcggaaggguaaagccggggcagcagccggcgguccggguguaagcggcgugugcgugugcaagagccgcuacccggugugcggcagcgacggcaccaccuacccgagcggcugccagcugcgcgccgccagccagagggccgagagccgcggggagaaggccaucacccaggucagcaagggcaccugcgagcaaggugggcacgagcgcuucccucuccaacccugcgccgcucggcccagcgaagggcacauccgacggggcguccgcggcggccucgccccgcgcugcucacugcgauucccccgcgggcaucccaggagccagaugggagggaaagaguuggcagccgcggaaugccaggagcggugggcgacgcccccccuucuccuuuuuggugguuuuauuuugagaguuugcugcgugcguccagaaagugagggccggguguauauguagaaaagauuuuccgagaccucagacuuccccaugcccaaagcgcacccaacucgugcuaacaucuguccauuucucaucauucuuggcuuggggauguagagagaggugaagucaagagaugggggaaaggaguuugacaauuaaauauaaaguaaggacuuccagacagacuuuuuuuuuuaaaagauaggaucuugcucugucgcccaggguggagggcaguggcacgaucuuggcccacugcaaccucugccucaagcgauccuccugccucagccucccaaguagcugggacuauaagccugugccaccacgccuggccaauuuuugguuuuuuguuuuguuuuguuuuguuuuauagcgacggaguuucacuauguugccuaggcuggucucgaacuccugagcucaaguaaucccggccugcugggauuacaggcauaaaccaccgugcacagcccugauuucuuaguauugaagaaaauaguccacuuucuaaaaauuauagguucucaaacaguaaucuaacuagcuaauuauuugugggcaaaaauaaaauacaaacucuuugaagacuguuuuugugaugcacuuuguugucaaccuucugaccauuuuguuuuuccuuccuauuucuuugauuuguauuguuuugcauaauuuguccccaggauacacuguucagcagaaaugucuuugagauuauguuugauuguuuauuuuauuccaaacaaguccaagcuugcuguaaaugaaauaaggaaauaggccggguggguuggcucacgucuguaaucccagcacuuugggaggccaagaugggcagaucacgaggucaggaguucgagaucagccugaccaacacggugaaaccccaucucuaauaaaaaauauauauauauacauuagcugggcaugguggugcaugccuguaaucacagcuacucaggaggcugaggcaggagaaucgcuugaaucugggaggcggagguugcagugagccgagaucacaugacagcacuccagccugggugacagacagagaccccaucucaaaaaaaaaagaaagaaagaagaaaauaaagucuggacuugcaaauacacgcacauacacacacacauagaaauuuuaacucuaaugccugaaauaacauuuuccauuggcaguauuuucaagggaaagucagacauucaauguuggcagcuccugaucuuagccaagguagaaaagggagaggaggcaguucugagguuacagaagcuguugcuucuuuaacacaguucagacuuucuccagaauuuccaaauucuuucuuuagagcuuuucccagaaguccacaaacuaauagguuguaugucaucaauuucagaguucacuauugaaagccuuaaauuguguaacucacuaguaacuauuuauaguaucaucaccuuaaacuuagaaaauugcaacccaaaauaaucugcauauguuuacaauagaaacaguuauuuguuacuuuggaucucauuugucggucacaucaugaaaagauaaaugugcguuauuuaagaauuuauuccaaauauugagauuuucuuauaaacauuacaauggggaacuuuauaguuuuuucaaaauggcagauacuugccuuaucagagcagaagguuagcuuggugauuguucaaguguugucaauuucuaguuuauacuuaauauuccuuuuucucaccugcuacuuacaucaccaaacacucacacagucugauuauaaaauauugagacugacagucauauagaaccaguuucauaaccucauuaccauguacacccagcucaguaccucuccagacugcaaacccuuugaggguuccggcccggcuuuucuuuauauuuggggaaauguuagagaaaacagcaucuaaaacuggaaaccuugacuuaaauuagccauuucuucucauccuaaauugagagagaugaguucuaaauggcagagaccauuuauaggagaaugccaaagagagcagaagagaaugggaagccuuucccacagcagaaacuuuccacagcagagacaauagacugaucccuaucacauccccuaaauauuucuucugacaccuggauggguuuugacaaucauagaagcaaacuggacagagugccauuuacuucugugccauuucauacuggggcuuugcacagaauaggaaaugcauugucuagguuccucuagaccucuagguucccuucuauucucagaagaaacuuaaguuaugcuugaguauaacuugaguaggggccagguaggggcagcauugugggauucagccacaauggugugauucaaucugcccucuggucuuugguuccauuuaacaugcauuuauugagcagcuaacuugagucagcacuguacuaggugcuauauaccagggauguacaaaacagauuugauguugcugauuaagaaaguaucuguacaaguuacaaacucaccucccagagcacuugcccuggagcccuggagcuugccccagucuuccuccuuucuaagaucaccacuuacccaacugggaagagaucuuggucugcuuguuuuccauaccucucugguaggaggcaaagcgaucugcuugaaaauaugucugaaagauaaucagcaaauaauuucaaaucuuggaacugucauuaugaauuuacugccauuagauuguauugaggucccugaagucauggauaaccagaagggggaauuugaagauuccauuuaauaaaaagaaguugauacaaagaagcuaagauauauaauaaaauuucauaguuggaagagaacaugaugcuucuguauuccaauuacugauuauaccuuuuguucaaagucuuuuaaaucugagcucuuuggcaaucccauuucagccgcuuuggucucauuagguaccauccuuucucccucagaauuaauuuucacuucuggaaucagaaugucauucuuaagggucucccuuauuaguaccuuuaggaccaaguucaaacuaccuagcaggacauaacaggcccuucacaauauaacuccauucuauuauuuugaccucuucucuccaaccuccuuuaugcacuagccacaguaagugucugcuauucacacuucagcacauaugucucuaugcuuucaugccucuguagaaguugugccuucugccugcaacgccucucaccuccacacucaccacaauugcacccuccuucacuuccuuuccauccuuugaacucuugccuaugauccuuuuguaguucauaagcaugaugauugaguguucauacacaugugugagguaugucgcccccaaaccuuuuaugacauuggcacauuaccugucugacaugaaagaaaaauaauaauaaaaauuuuaaaaaugggcagccaggcgccauggcucacgccuguaaucccagcacuuugggaggccgaggcgggcggaucacgagaucaggagaucgagaccauccuggcuaacacaaugaaacaccgucucuacuaaaaauacagaaaauuagccaggcgugguggcgggcaccuguagucccagcuacucgggaggcugaggcaggagaauggcgugaaccugggaggcagagcuugcagugauccaagauagcaccacugcacuccugccugggcaaaagagcaagacuccaucucaaaaaaaaaaaaaaaaauuuaaaaaaugggcuguuaccuagccuucaaggaucagcucugucaguuucucugagaagcauucugacuuucccccaccccaaaaugauguauuuguucuucuagagcuaugcauccagccauuguuucaacuaauauuuauuccacguguacuguguaucuguauauaagaggcaguauagcagagaaguuaagaugaggagcucucaagccagacucccuuggugugaaucuugaccacuuacuaacuauagccuugagcaaguuauuugaccugucugcccaggguuuuccucacuuauaagacagggauuauaaccauuaucuaucucauaggguugucaugaagauuaaaugucaugaauauuauccauagaaagcguggaugaacauuaauuguugucauuauucaacaucaaaguaagcuccaggugggaagggagauuuugcucccucauauagacagacccaaggaccuagauaagugcaugguauguaguauguucuuuaaacacaugucuaaugcaugaaucaaugaaugaaucaaccuaugaauuggcuaggcacucuccuaaucucaggguaaguagccuugaauaagauacacagaaacaaggaaacauauuuucacacaauguguacaugcugugaaggguguacaucggagaaauagguuagagacuccagaugaaugagcaguauuaagugaggugaguagagccaugcuaagaacgcuugggaggauuucagcaaagggaacagcaaggccuugggcccugaguggagaacaaguuggcuacuauagaccuuccccaacugccacaaaagggcucuuugaaugucugucuuccccacuagacuguaaccauuuuaaaagagggauuucaucuuauaacuccuuauaaacacagugucuggcuaauaauugggcauaucauaaauauuuguugauuaacaaaggaauccucuuaagaaagcaccuuccuguuuggaaaugcaggaaagccccucuccugccugucugcucucuuuccuccuggcaucuucugccuuccuaaagucuaggccagggaauucaucugacauugauuugccuuccuuucugucaucagcaauccugaacucuaauauuggaugguaacuuuuccccccaaaucccaacauuuccauauccccuugccgaguaaaauuagguccagagcuauagaaacuguucuguaaguggaaaaugcuucaguauagauuuugauuuucagguacucauuuuauuugaugaguuuuaaaccuccauucuuugagaagcucauuuuagauucauuagacucauuuuuuauguugauaauauaucauuuaaauguccauguucuacuauccuucaguaaauguaugaacuucauugaaaguugaaacaaagggguuucaaauuaaaugaaguuguuaauugucugguuuaucuugggggagugcaagucaguguaauacuucacuaaacuaacacaguaguaccaugaggacugucagagagccagaggaggggacccagguuuguggaggaaaagccaagaaucacuuaguggaagaaugauguccugacugagacagggauaagaaggaauuggguggagaagagcuagcauagagguugugguagaguuagaagggagaugagaagaaaacacuguauauauacaauagaauacuauucagccuuuaaaaagaaggaaacuuugucauugccacaacaugaggggaccuggaaggcauuauauuaagugaaaaaaaagccaagcacagaaugacaaaugcuaugugaucucacuuauauguggaaucuaaaaaaagucaaacucauagaagcagaaaauagaacagcaguuaccagagaugggguugggaggaggggacaggauuggcaagauguuggucaaaggacacacaaguuugguuagagaggagacauaagcucaagagaucuauugucccucaugaugacuauaauuaauaacaauauauuauauaccugaaaauugccagccugggcaacauagugagaccucgucucuauaaaaaaaauaaaaaaauuagcugggugugguggcacacaccuguagucccagcuacuugguaggcugaggcgggaggauuacuugagcccaggaggucaaaucugcagugagccaugaucauaccacugcacuccagccuggguaacagggcaagacccugccucaaaaaaaaaaaaaaaagaaaagaaaaaaaaaaaagaaaaguucuaagaucauagacuuuaaauguuguuaccacacacacaaaaaaguguaugagguaaugcauauguuaaauagccugauuuagccauuccaaaaugucuacaugcaucagaacaucauguuguauaccauauauauacaauuuucaguuaucaguuaaaacaauuuuuuaagagaaaggagauaaccagagcauagccagcagaaggacucgcaugagguuuggugggacugccuagggagaaggaggcagcuggcugcgugacagagcccagugauaggggagggccugugaccccuuaaggagcugagacgcugucacagagcaaugggagcgcugagugauggagcuggauuugugcuuuuagaaaagcuuuguuggcugcuguugggagaauggauuggaagggggugagacugcagucagagacucccauaaggaagcuguuacuguaaucacaacaacagaugccuacacuccuucccaagacuucccucucugaucuuagaagcauugucaaaucuggguucccagccugccauggcaagcugcuugcuacuugggagugaaaagcccuuguggagcuuuuucuuauucggugacugcucauaaagugccuucaccucgcuugccuuauuagccaguccugccuccaaauuaccaccacuugcuccuuucaggagucucuucccccuaaagucccuauuacuccuucucucugcuuucagaucagaaacagaaaaagucaccuucccuaagagucugcuccaguccaguagaaaugcuuuaaaauuuuucuggccucagcugcccuucuugagcacagaaauuucuagaauauugaaugaaucacugguucuuuauaaucauuuuguccaguuucaaucacugcauuuuaggaaagauuugaaaaacugaaggacaaaguggggccuuagaggacuuaggauucuuucagaggaaaguaaucuaaagaacaaguuaauguuucuucaucguuugggaauuaguuauuaaauggaagaugccugaaaaauuauucucuuaauacaguucuucaggaggacagcauuaaaaggccuggaauuaaauagccacaaggcacauuuagaugacacagcaggaagaacuuuccaguaaaaacuauugaauaggauaccguguucaggcagaagucaggagacucucuuuaggagagcugagaaauaacuugagggggaggggccacaucugggggaggauuuuauaauuuuuaaaucucuuaaacuauacagcuuugagauggaaugauuaagcugagcaggcauuuguuaacauccugaaauacgauuuccauccugucccuagagccugcccucgggguccacuguagacuggccuucuagaagaaaccgccuuauaaggcucucuuggauaguucagugacagaacacccuuggauggaguccaaggccagcuagccuucacugauucaaaauuccucccuacaguggaugagauuaugaugcuuccuuuaccucaagccaccccuaccccacaaacaaucugaccucaucuguguuuuucauuguuagacaaauaacaucuuguuuuuagcagcuggggaacccugaauuaucgucaaaaaaauuuuuaagccagggaauaugaguguaaccuuuauuugaaauuuaggaguggcacaauuagaaagcuuugaaauggaaggagacuuagguauaugugaauuaauaagcccacuuauuuaagguaauuucaaagauuucccagugagucuuuuacucuuauguggggauagcaguggaggacuagaaauguucaagggaagcuucccccagccugucauauauggcuuuuccaggucaaucaagaccgucuccuccaccaggccucugagagaaaaugagaucagaagaaaaaagccaggaugauaauggggggagggggggaaacguuuacuuauuuauuuuuuuuacuuaaaauugauuguguuaaauaguugaccucuguuuuaucccaaguuggauuaauggcaaaaugauauggcccuuuugaaaaagcuaauguguugaauugccuuuacuguuuuacagaggagagcagucaaaguuaauuagaaacagcuggagcuaacaguaagccucacccccaucaaugucccuaccaggagaggguuaccagggagaggagcagucccgggaauccagggaggggccucuggucccaaaagcaggccagaguugcagagaaguuuugugucugaaaaauaagaaagguucauuucaggugaaacagaccuaggaacccuguguugacaaagccccauucauaugauaugaaguucccacaguaaagagcacugacaaggccaaggccaacccgacagguucaaagcaggcuuggccacugugaaaaaacaacccccucaaaacuucaggagaauguauauaauaaaugaagguacaauuucauaccuucacaggauuauugagaaggucaaauuacauaacagauaugaaagcacuguguaaacuaugcggacuaugcugcaccaaauaacuguaaagaauuauuaacuagacuguaaaugccuugagggcaaggaaugcaucugcaacggguauuugugaaguacuugacaguuugcuaaggacuucuguggauuuuccucauaugcuacucauaacaacccuggaagguaaggggaauuguuaucccaaauuccaaauaaagacacugcaggucagacaucacacaggugguaaauagcaauucugguacuuacuuuagauauucugcuacaggcuugcuauucaaagugugguauguagaccagcaacauugacucucugugcuaucuuucuuuuuuauaaacucggaauuauuucaaaauaagaaguuucuaacaaaagagauucagaagagucaaacccuugggugugaaaaaguuuuaggaagacuuuccugaauuuauuuugccuauauuuuguuucuguugaaugagcaaggggguuauaugauauauuugugucuaaauacaucuaaaagagcucuuucauucgcauaaaauaaacaugcuguaugauaacaaaguuuaugucagaguugagauggcucuuuaugguacauauaugcugugccuucuaaaaaaugucauauuauauucagugaaagaugauguuucuuaaaaugaaugaaugucucugagguggcuaacauuaguccuucuauagccagauuagcaaucuuagagccuggucaggcacaguggcucuuguuuguaaucccaguacuuugggaggccaaggugggaggaucucuugagcucaggaguucaggaccagccugggcaacauagugagaucucaucucuacuaaaaauaaaaaugaaauuguuaauuggccaggcacagugggaagcaccuguagucccagcuacucaggaggcuaaagugagagggucgcucuagcacagucaucaaggcugcaggaggcuaugauggagccacugcacuccagccuagaugacaaggugagacgcugucucaaaaaaaaaaaaaaaaagaaagaaaagaaaaagaaauaagaaacguagagccuggcagggcacaguggcucaugccuauaaucucagugcuuugggaggcugaugcagaggaucccuugagaccgggaguucaagaccaacccuggcaacauagugugagacccuaucucuaccaaaaaaagaauuacaaaauuagcuuggcuugguugugugccuguaguccuagcuacuugggaggcugaggugugaggaucacuuucagcccaggaggucaaggcugcagucagcuaugauugugccacugcacuccagccuggaugacagaaggagacccugucucaaaaaauaggaaaaccuuagagcccaaccuuucaguugcaauccagagguucuugaaggaucagcgagugugcuagggcugcuggcaugaauauuaguccaagaaagaccucuuggagcauaauguuugcgugugcuguuugaucauuuuccaggucuuucuaguaacucugaguaggcuagaggaaaagaaucacuaagguaacugucaacaugcucaaguauuugcuuucaccugagguuuaacccugaauguugaccuuaaccccugacuccagcacugucccaucaucaauuuucccaguuugaguaauaauauuuaguccauaucuaagcuauggucuaaggaauuugcauuuuuuuaaauugaagcauguuuuugucagcuaagugacaacuugcagaaggaaaauucaugcagggguuugagaacucaauuaagcauaauccauuuagacuuuuugagggagaagaaaaaagagggcuuucauauucuuacaggcagaaaggcagcugacuccaaucauccuguucuuucauguuguuuuucuugaagggaagucuccagcuucuacagagguuugucuuuuucucugagugagaaaugcucaaaggcauuuucauuuacaucaccacagauuagugugcaaguguucaagugguugaauugggaaagcuuuagaucugacaucuguucugcucucuucuggccugaccccaagcaagaaagaaaaauuuaucaagaaauagaucuccuggaacauucagaagguuuugaaagagaccacacagaaaugaggcuucaagaauuuuuuaggguagcccaagccugcaggauucagagccuguuccuucuccaugggagcuuucagaacuuucugcuccaggaacagaacuccaaaagugaauuucaauagcagaugcagcaauuacacugcaccccuggcuuccaaaggaccccccucaggaagccauagagcguuugauggagaaugaaaugcuugugcagcagugcucucugagugagagaaggggagaugagagucccaugcaguguggcugcuuaguagaaaugcucagcucagugggaaagggcaggcuggggcagagaucaagacgcugccagauauuugacaggccagggcuucggagccagaggccccucucugcucuguugugucucagaucagagccucagagcaggacggaaaaguugaucugacuugacucuuucugcacugcugggccuuugguucacuagaaaauaacuggcagggcagggcaggccuguucuggacccaguugcaguguggcaaagugagcagcucgugccccuuucccaccucuccauguccucucaucugaggccucuuucuucucacccauucagccuggccuguuacugcaugcugccccuuucucuugucugacugaacucaaagaagugagauuuucuuuucuucacccaccaacccuuucuuaguuacagagcuuggccaguaacuuuauaaauggugaguccugcucgguccacuccuccuaacuccguccccagauuuaugagccaccugacguucucccaagagagagcgaauaagcaaaaacuugguaugccaccucugaaaggcagccagcucaguccaugucauccaggagagauggucagcccuuuuguucuugacacuccauugggaugaaguuuuucacaugucuuaggaucauaauccacaccauauaucagccccaagccuaucucccuuuuuaggacaagcccaagggguaggagagagagcuguaaccccaugguugugacuguggguuugacaggucuccagugcucacccagggcugucccuaccaguuacuuucaacucuuagugccgggucacccagaagccaagauuggcugguguacgaggggaaauaaagcagagugguuaaggagaugaacuuuggagucagaccaccugggucaaauccccacucugccacuuaacuauuugugugacccuaaccuccuucauucaugauuuuuuuuuaccugcaagacagguauaauaacgauguuauuauacuuagaguuuugugaaguuaagugaggcaauacaugaaaaacauugguaccugguauguaguaggauuucacuaaaugcuguuucguuuccauguuuauuguuauuagcauuauagaacugaguaugaauuaauauauuagugccuugcugauguccuacuuugaccaguccaaacacaauacugccucauguguucccagguuagaucugaaaccuauguucagaccugcguaaacaaaauaacaggguaguuuucuuaaaaagaaaauucguggaaacuuccaucuugcucugcagagauucuagaacagggaguucugcccaucucuuggaagaucccagaguccaaaugcagacagucuaaugggaaccacccaggaugcuggccagaggacaugcuuugcuuugcagcauaaaauauuuccaucuucaagcucauugucacucacauuauuuuuaauagcaccuuuuagauauagaaucauuuugaauucagaggucacucacauuuaguaaucacuggacucucuccucccuggauauucuaccaguauuuuauacauaggaaauauucaauaauuuuuguuggaugguucaugggggaaaaaauugaaguacuggccccaaagagaauaugaaccaaaaucacagaguuuggcagaaaaagagcacaauuaaugcccauuauguacauauugaguauuaucuuuggcuuuuagagucuuauuggcggaaauaauaaaguuauugcuguaauucaugugucucuucuuuggcuuauacauguagccuuagcuuagcaggaacucauuuuuuaaaaaucauuuaaaaaucaaaacauucaacuauaaacagauguauuucgacucagaaagugcccacuuagguugauucauugcaucugucugagaggugauaauguccaccuuccaggguguguugacgaguaaagaaaugaagguaugaagaagagguuuaagaagcuggauaacuuuucagauccaccaucgccagcaaucuugagugaaauuggcagaacauugggacuacugacucaccauauacuaugcacucuaucaccuucuaaagcagugguucuucaccuuggcuguacaucagaaucaccuggggagcuuuacagaaugcugaugccugaguuccacuccaagauucucauuuaauugguuuggaugugaccugggcagcaggacuuuuuaaaacuuuccagaugacuuaauguccagccccaguucagaacuauuguucuaaaaagacuucaagucacuuuuugggaugcuucauuccuuugggauaaucauaauaauaauaggccaguuuuugcucaguuuauccagcaucuaguguuuugcaacgggggacuuugagaagaucuagugugccaugggaaguguaagcccuagaaaacaugaucacccaauguagugcaggcagcauaaaugguuuggcuacuucuuaucuuuuuggcuauuucagagcucuuauuugaaucagacagaacggaaauaugucaguuuuguugguauuuuaaaaauguaucccaaaacacucagaaaaguauucaccuaaagccacaugauccaaucuuucuauuauuucacuagaacauacgcuccauuagcccagugcuuuuuaucuauuuguucacuacugaaucuccaaugucuaaaccguccuugggauacgguaggcacuuaauagauucuuguugcaaaaugaaugcauaauuaagaguggauuuauuaugugcccuguuggaaaggggaaccuucacacugauggaagcccaccucugucaucuaucuggaaucucugauagggagaggcggcucugcucagcuuauuggucccccagcuuaggggaguaucucuugucacuuggcugaggccuuuccgaugggcaucuucucaaauuaucccuuauaguuacucucuauugucacaaaaucucugagacugacagcaguguuccguuccauuuuaucaucuccccucuaaucauuucccaggcaauggguauggggauugugcagccuugagaaaucuacuuaaccucucugagcaucaguuuucucaucuguaaagugaagauacuaccgaccucacaaggcgguugugagaguuacaugacuuaauguauuuuaaguucuuagcacaguguuuggcccacaauuggccuuuaauaaagguuaaucuuagucuaccuugcccuucaguuaaacaguagcagaggaaggcauaaguacaauacauucucauuauucacugaaguuuuguucuaguaagucaccacaagcacugaauuagcaaauacugaaccacugcuucugggagcaauucaguuagguuccugcaagccuccaaucacauuuuuaucaacugaucaauaugucauuuuguuuuaugugugauucuguuuaaaggcacguuauuuaauauaaauuacgauucauuaacauugaacucauggccaacagcaagcacugcagcucaagccagaaugaagcuugucuaacacccguauuuuccauaaggcauaucacagccugcuugcucauaaggaaugacuagacagcacuucagcacaaaguuuggggccauuuuagacagcugagucaccaucagaaagcacaaaaauacaaaaagaaguggcaccacacagacuguaggaggggugcuuguuugauagugugacagcugaaacuagaagccagaguggugccuuguuccaccucaguggggaccccgugacucaaauguuugcugcucugugcaugucugcaaaugauuugauuugggggaggcaauuacacuuuagcaaguaggugaauuugcaaauauggcauccacaaauagugaggauugacaguguuuggaaauggucaaggguucagcaacaagcauuagagaacuaccaaggauuccgagggcagaacccaagugugggugacgcuuccuuuauaugccucaaagcauaaaacgucauucagggcacagagcaguauuuaggaaauaauucuuggaugacucuugaugcaguuuaacaaacacguaaacuagccuuguuuugacuaucccaugaugagccuguuuuugcccugcacccuccuacaagauguuagugagaaguguagaguucauuaaguuuucauaggaguggcaggaagguuuugugggaggcuucuccucccauuucucugcacagccuucccaccagcuacagagcaucccacguggcccuuacuucacauggagccacccucaaaggcacuguccuguccacacccuccccacaaccacgccugucaucucucucccaguuuccacuuggcaaguaggcucugucccuggcucuguggagugcacccaucuuuuagcucaggacacaagguuacuuggauccucacuaucacugaaaguggaaaauuauaauaauuccaucacucacauccagugccugcuuuuuguaaaugaugugcugggugccagauggaaauuugccccaggagaaagacugccccugcucuaaggagcuuagaaaccugcaguccauccugguggaagaaagaagagggaguuagacucaauauaagagagucccuguguaagccaagccaauaaaaugcacaggaacaaagaaugcacacacacaccccucaacccuucauuuuuaauuauuggaagcauauuuucugggcaauuucuacuggaaggggaaaaaaugaacaaagguacauuuacaucuguggccugugaauacauuauaauuugcagacucuaugagcuuauacauaauguaacuauggcuagaggugugguaguacauaaaugaauuaguuauuacuuugcccaaagugacauuccagagugcagaugagugaaucuuauguuugcuuagacuugagcuaaggagagaauauugauccaaaagaaucuuaaagauuguauuuaaauaccuuaguaaaugcuaaggaaaaaauaugcaguaaauucacuucacucuaccuagcucccuggcaaauguguaaaaaaaaaauuuaauaggugcaaugaccuauugaugagaauacuguuuggcaguuagucucuaacaauugucagaaguuucacuuuuuggacaaaccacaguggauuuuaaauucuuuuuuuuuuuuuuugagacagagucuugcucuguugcccaggcuggagugcagaggugugaucuccgcucacugcaaccucuaccucccagguucaagcgauucucccgccucagccuccugaguaacugggacuacaggugccuaccaccacacccagcuaauuuuguauuuuuacuagagauaggguuucaccauguuggccaggcugauuucaaacuccugaccucaagugauccgcccgccucggucucccaaagugcugggauuauaggcgugagccacugcgcccagccuggauuuuaaauucuaaacuuacauauccuuguuaauuaaacuuuagcugcugugcagcuucaguguguccugggaauguaagcuaauuucauuuuauuuucacuaaagaucuuuuuuguuauuaaacacuaacaguggaaauuuguagaauucauugaaaucaaagacagucauuguuaauauuuuguauuccauucuaguuuuuuucuaggcucauaugacauuauuuugaucauacuaaccauauguauuuauaucuuguuuuucauuuagcaaguaggugaauuugcaaauguggaguccauauauuugcaaauuuuaaauuuauaacuaauauuuuccauguacuuaaauauuuuauaaauuuuauuuauaaaucuauauuuguaauaauuugaaugaaccauaauuuacucguuuuucugucauaaauaaccuuuuaauucacaucuuuagacacaaagaucuuucuucugaguuauuucuuuauaauagaucccaaauuggaauuaccaauaaaaugauaugaagauuuauauauauauauauaaauuuuuauguauugacauuagugauuccagcuuaacagccucuucuaaacaauucagacacauuaucuccuaaaaacaaaagcccaaaagcaaaacauuucaauaauacaauagaaauuacuuguuaauuaucauuagauuuguauugugacugcucaucuucaauggcauagagaccauugagaguuguaccugcauccuaguuucuauuuauaaaauuugcaguuacuagccauaaaaccagggacccugccuguuaccuaguuugcaucuaauauuaccaggaaucaugguuucuaucucagaucaugaagaguuauuccagcaagaacagaaaggauauguguacuauaauaguuuucuuuuuuuaaguucaauuugaucaaucaaauauuucaaaauaacagggagaaggaaagaauauuccuuuguacauaauugaauugagguucauaaaaagcauccgcauucuuacuagagcagcuugaaaauguuuguuguaagggcagccacccaucugagauguaaacgggaaaaacuuugugaaauuuggagguuuugucuuuaagauuuuuuuucacagaagaaaagaaaaggucucuacuauucuauuugacuacagucaauggcauaccuccagguugaaucucagcagcucuuuaaaugcaacuucccugcauaauacugagaccaugauuugaccgcuuguuucacuucaguuucugauaugugcuguuauucuccuccugugagggacagccuguuuccugcuccacuuauuaaaacuagaaaagaauuuacuuacaacauuuuuaccacacgugcccuuggagcucuccuuggguccuuaagagggcuggcaaagccuuguuucucuuuuucucaagcccuuuaaucuccagcacauucagcaacaauuguccuuuguaaggcagguauuccuguuaauacaguaaacagugcugagaauacauguauaaaauggaaaagcugcaugugauuuucaggcagaauuauucccguauucgacugggagauaggaacaguaacagcacagugcauuuucuaagaauuuucacauauguucauaugcauaucaccuuuuuuaauccucacaauaacccugugguaaaguauuauccucacauuguauuaauaaauuaggcaaccaagauucaguguguuugaguguccaagcagagccacugcuaaugggaauugaaugaagcuggaaugaggaauccaggugaguugguguguacacggacacacacacauguacccacauuucaauccaaaggaagcuaaaauugagugucagaagcaguuaaacauaaauaugcuucacucacucauucauucauucaugguucuuccauuccuaaucuuguaucuccuacauuaaauucccugcauaguuaauacucugcauuuccacagucuccaguuacucuggucauuaccaguauguggaagugcauaugcuuuugccuguuuuguucaaccguguguguguuuuugaagaaacacauccagagacucuaaggcuuuguuuugguaaauuaaagcaacuuaaauuccagguguuggcaguggcaguugucuaacauagcaugauaaaauuaucccccagguuccuauaugcgugguuaauuacaggugauccaacucccaaagaauacacauggccuggaucucugagcucugcugaauaaaauaaccaauguauaauuucauuuucugugaaaaauguuaacuaaacuagaaaaggugaucaaauaaacuguugcucucacauguuuuguuuuguuuuuuugagauggagucuugcugugucaccuaggcuggagugugcaauggugcaaucucagcucacugccaaccucugccucccggguucaagcaauugucccaccucagccucccaaguagcuaggauuacaggcgugcaccaccacaccuggcuauuuuuguguguguauggguauuuuuaguagagacgggguuucaccacauaggccaggcuggucucuaacuccugacuucaagugaucugcccgccucagccucccaaagugcuaggauuacaagugugagccaccaugcccugccuucucacauguuuucuaaaaauaaaaccucuaucacugaagagcauuaagaacuuugugaggaacaaauuaacuguucagucaguuugaauaaaauugagugcucuggggagacuuuauuguuguuuguguguguguuucaacacuacagaauaagaugugacugugacccacuaaguccuuaaaaacaauaggguauaucauaagaacuagaaagccuaacuucagacacugacaagaaagcaggaaauacuacguuucucaugguagcaagacucaggaaauucuuacgcaaacaaagagugaaggaacaguugacggcaguuuucugaaucaaucccucaacauauaaggagauggugggauuuggggaagaggaagagaagaaugaugaccaagaaggacaauagcuggucuauugguaaagaauguguucagcugcaaguaauagaaaacuuggcucuaguggcuuggccaaaaugggguuuauuugcuuguagaacagggaguuuagguguagaugguuucugguguggcuuuaaccacucagcagugcugucaaggaccaggguccuuucacucuuucugcucuaucauccuuugcauguuggcuuuuguauacaugcuuaauaauugcaagaaggcuucugcaccucagaucaucgucaucauuaaagacauuuagaaggaauagagaaaaggacaaugccagccacaugucccauuauaucaggugagcaaauguuucccagaagcccauacucagcaaauuucugccuaaucucauuggccagaaaugaucacugggacacccuauugucaaaagagacagagaagggggugguggacacuggggcugagucagccggcuacauugucugccauagcugggcagcaguucuuuuuagcuuuucauuucagacacaguugcugaaggugaauucaaagggugacuagaagcuuaguguuuuagagaccacagaccccaucagacuucacugaagugugaaaucagaugauaaaauaggucauagcuggggggaaaaauggaaagcuuuguagcaaauaugucuuucccaaaguucaguggaaagaaguccuaucugaaagaugucaaaccacauagaguccauuuugaaaugacauuucacucuuuccuucacagaaauaauggcuaccagaauugaggguuccugccugauuuaauuuaauauguggaaagggauaauuuuaaaaugaacucaaaaacagaaaaaguuauaauuguauauggauagaugcaguaaaacugcuuuaaaaaagucuacuuucauuuuuauaaauuguauaaacuucaauucauccucagaucuaaguaaggugaauuucuaauuauuguaguguuuuuaagcuuauuuaagucauacauguuauggagauuaauguuuuggagagggugggguucaaauccccacucccccacuuacuaaaugugugauuauuaaaugacaaguugccucucuuuuuuuuuuuuuuuauuuuuuugagacagagucucacucuguugcucaggcuggaaugcaguggugugaucuccacucgcugccaccucugccucccagguuugagcgauucuccugcuucagccucccaaguagcuaggauuacaggugcccaacaccacacccagcuaauuuuuguauuuuuuugguagagaugggguuucagcacguuggccaggcuggucucgaacuccugaccuccagaugauccgccugccuugaccucccaaaaugcugggauuacagacgugagccaccgugcccagccagcaaguugcuccucuuaaccucaguuuugucaucuuuaaaguggggacaauauugcuuacccaaaggguuggugagaguauuaacuucauaugagguucuaagcauagugcuugccacacaauagggucucaaucuggccguugcuuuuaucauuaguaguaguggcuaaugcuucagaaacagcccucaaaugucauacuaugguacuuuuaccuucauucuucccucuuuuucuggagggauaacuagagaugggaugaaggguagaagcagaaacugagagugguaggaaugauuggaugguauuauauggagaaaaugagggcuguucuugcccaaacuggucggaaccucaauauuuuuauauacuuacaauuuauagccuaccuuauuuuaacauuauauuuguggcaguuuacaucaccaugcuuuucagauacagcaauagugcuguaaaaagcacuaaacugccugggcaugguggcucacaccucuaaucccgauacuuugggaggcugaggcaggaagaucacuugagacuaggaguucaagaccagucugggcaacauagugagacccugucuccacaaaacaaaacaaaacaaaagauuagccaggugugguagugcauaucuguagucccagcuacucaggaggcugagguaggaggaucacuugaaccuaggaauuugaggcugcagugagccgugauugugccacugcacuccagccugggugacaaagcaaagcccuguaucaaaauaaacauaaaguacuaaacuuagaagaaaagagucugaauccuccugccucagccucccaaaauguugggauuacaggcauaagccaccacaccuggccaagcaucugaauccugacuauacauugacuaacagugaucauuggcacauugcuuaaucucuuugucccucuguugucucaccugugaaauggagcaagcaggaccuguauuaaaggauuaggguuaggguuauggaaauaaacgaagucacagauuugaaagccuuuguaacuguuaggccuuuaugaauccaagauuguauucccucugacuuuaccaacuauuguaguaacaacucucaaauaugcccagucaguuaacugauauaaccuugcguauagcugugucaguuauuuacuuuuuuccuauauaccucugguccacuccuccccuucaaaucacuaucagcaaguagugcccagggacuccuguguuauaacauuagccagaaccaaacaguuaguaaggaaucugcuacaacaaauuuauacagagcaaaauauaaaguauuuuaaaauuggcauccuuuugagauagucuguuccucuccugcccuucauuaguuggguacucaaggguuggcaguguuuucccaucuagaagcucaugcugcauauugaccugcaaagguauuaguccagguaccaauggcaacuuuuauguuauccaucaaucacuuuaaugaguacaagaaagcauccuaucacccugccaaaagacagaggaauuaagaaugacucauuuaucacuuaaaugugugaguguuuucuaugugucaggugccauccuggugcuguggggcacagaacacagacuccaguuuccaggggguuaccguuaaauggggcugaagcagcaacagugugucggucuccuguauucaaucuccucauaauaacugagccacuagaucaggagcaguggcucacgccuguggucccagcacuuugggaggccgagacagguggaucaccugaggucaggaguucgagaccagcuuggccaacauggugaaacccagucucuccuaaaaauacaaaaauuagcugagcguggugguaugugccuguaaucccagcugcucagaaggcugaggcaggagaaucgcuugaacuugggaggcggagguugcagugagcugagaucgcgccacuacacuccagccugggcaacaagagcgaaacucggaaucaaaaauaaaaauaaaaaauaagaugguaaaauuuguauguguauuuuacuacaauuuuuuaaaauuagaaaacaaaaacguaaauccucuagauaccaaaacccaagccccauggaaaacauuuaccacaaaaaggugacaagcuauccccacaaaugccaaaauauaaguggguuggaacaagccaccuaugccaccaagccugcaggcugucagcagcuagguggaaagacacagagggcaguaaugaggugaugacagauccaauaauagguaaaucucaacauagccaacagguuuucacuggaaaguccauuagugggugagugcaagggacccaaaggguggaaggggcuugaguagccugggucccgugaacucucaaaacccccagccggggcuccugauaugguuuggcuguguucccacccaaaucucacauugaauuguaacuccauaaucuccaagugucaugggagagaccugguggaaggucauugaaucauggaggcagguuuuucccaugcuguucucaugacagugaguaagucucacgagaucugaugguuuuauaaagggcaguuccccucugcaugcucucuugccugacaccauguaagauguaccuuugcuccuccuuugccuuccaccaugauugugaggccucccaagccaugugaaacugugaguccauuaaaccucuuuacuuuauaaauuacccagucucagguaugucuucacagcagugugaaaauggacuaauacagcucccuuccaggacagggcccuucaccaaagaaaaacuacuaggaauagaaucaaaauugagcaggacagaaacaauagagaugaaugaaacaaaagaccaaauaaaagugaaggagggaaacaaacccagaaaaucacagaaagcaaguuacuguuuuuaacacuaaaugaaaacaacacaaaauggaguucugaggaguugcaaaaagguauuuuggacaaugucuccuuguaaggcuguggaaaaccaauuuuacauuuuaaaaaagcacagagaaagauuaaggccaaaccccauacuagaaagaaauuuuauauaagagaagagugagagagagaaagggaauaacaucccuaccugcaaugaaagcacgucugcaaacaggugaaaacuacauacaacugacuaucugaauaacaugagcuaaaagacauuuuuuaaauaauacaaauaaagaguaacaagccaaaauuagaauaacucgaaaauguggugaagaucucaguuguuauuucagaaaugaaaccaaaagaaacacaauagcgaauaagaacaauagagaaucccuuaaaagacuaggagguuaaaaggaggaaaauuauuaaauuaaaaagaaaggaggaaugaucaaaagcagcaaccacugaagauaugcagagcagaucuagcauacggauaacaggagucacugaagaaggaaaccaaagcaagaaagcaagccaacacuaaaaauuauaacuccaaaaaacuucacugaaauacaagaaaaauguagaacuacauuuuggaagaccagacaguauaccugagaauauggaucuagaaugacaaauaccuauugauauucuagugaaaacaauacugcacuuuaaagaaaaagaaaaaaggaucuaggccaggugcaguggcucacaucuguaaucccagcacuuugggaauccaagguggguggaucgcuugaucccaggaguucgagaccagcccaggcaacauagugagacccuguauccauuuuuaaaaaaaauuauccaggcaugaugucacacaccuguaguuccagcuacuugggaggcugaggugguaggacaaacugagcccaggagucugagguugcagugagcugugaucacaugacuauaauccagccugggcaacacagugagaccuugucccaaaaaaaaaaaaaaaaaaaaccuuuuuuaaacaucugaguaaaaagauuaaaugacuuauaagggaaaagauuacauuaucaucagaucauuugacagccccugauuuuaccacagaaacuagaagccauugaauaauagaggcaauucagguuuccuugcaagccauuuuugggcagugccuuauaagugguggaagcaagaauugcugcacguguucagaggaaguagccaugacuuccaccuaggagggcuucauggaggagguggaaugauugcaucuuaaagaaaucuuggaaaauguuuaaacugccgacaucagaauaguauaaugcauaaacaugugacuuacucucaaaauguucaagucuguauaauguugaauucauugcacaccauuucauguccauguuuuuucuucaugauuuuuagaaaaggcacuucauuuuuggcuaaaggaauuuuuuuuaauacugaaauuugaguaauugauucuguuaauccagcauaugcuccuauuaaauaaauuguauacaauucagugacuucauuagagaugauaagccacauacuuaaauuuugugauacucccugauaaucugcauucauugauaauugagacaaaauuaaucauauauaaucaagcaaaaaugcgaacaaaauuagcugucagaaaagcauuauccagucuuuauuuuuuaguuaacuuuagauauuuuaacaacacauaaaaugagugguaggguauauuuguauuuuacuguauaggacaccuucagauaaauucuaaaaauaauuugcauuucauguaaugcuuuucacacaaaguaauggccaaacuuuagggucaguuugcccugcuucauaccacaugcagaacaaauuuaagauggauuaggacuccaaauagaaaagaaaaauucuuaauaaaaaacuauucaagauggauaaaaggauuaauuucaagaaaaauaaaacuaauaaaauagaacuauucugguaacccagaaaccauaagagaaaggauuaacagauuagcugcauuaaaauuucaaauuuauuacuuauucauucacccauucaugagauaauuguuuuuauugagaacauacuaugugccacgcaccauuccugcugcugagggcacagcaauguacuaaacagccagcaucacugcccuuguggcaugcuguauggcaaccaaaaccauaaacaaaacaggaagacaguaauagccuggagaaguuauuugcaaaauauuugauaagcaaacuaaauaucuguaguaaacaagagcucauguaaguugaucgauaaagcaacaggaaaaagagaaaaguaauaaauagugaauuaaaaggaacaacugcaaguggccauuaaacaugugaagaguugcucaacuucacaacaaguccugaaaugcaauuagaacaacaauaaccuacaauguuuccccguucagcuuagccaaauuuuuugaaaauuucucacucccacugcugggaaaugugcagggaaauggggaccuuccugcacuauugccaagaccagaauuccuaacaagcuuuucaaaaguaaucuaggaguauuuauuaaaauuaaacauucucauacccuuugacccagcaaucuuauuucuggaaaccucuccuacagaaacaaaagugcuaacgcauagggacauaaguauuaagaauauuuauuguaucauaguuuguauauagaagaauuuggaacaucuggaauauucuuaaagaauuaugcccauguuuggggacauuuugcagcuauuggaaagaaugaauuugauuuauguguauugaacuaauaaagcuaauacauaauacauggauuguucacugaaaaaaaggcaguuuaagccagguguggugguguacaccuguagacccagcuacucaggaagcuugaggccaggaguucaagauaagccuaggcaacauagacaaacccugugucuuaaaauaaaacuuuaaaaaaaauuuaaagcagcuugcauguuaauagguaugaaauuuucauuaaaaaaauaaaaacuauauguauaaacaguuuauauaaguuguugggggguuaggauuaucaggagguaaaaguagacaacuugcugcuucuuuauauauuuguauauuugaauuguuacagugagcaugcacuuuugcauuuuuuaaauagcaacaaaauauuuuaaaagaauacugaaccacuacaucauugauauuccucauaacuaaauuucgaagguucuuuucuuuccuucuucuaauuaccaaaaacuugauucaaauuuaaaacuauacacucauagaucuagaaugauucuggggugauauuucaguucaucauuaaccuuucccuaaccacuucccuguaucaucuuagucuaagagauuucaaacauggcaacuccaaagacgcaggucccagaagagcucucugagaccgcgauuugggacccacacuggucaaaagaggaaaaucacagagcauccuuuguaaacucagccuucucucaggaaagucuuucuuauuauaacugauauuccuugggcugaaacucacaccuguuccuccacuucugauguagagacaaagaggauucuugaccccaaaggaccuccuagaucauugcuucaaccuuuccauuuuacagaugaaaaaacugaggacuaaguaaaauguggggagaaaugguaccaaaacccacuuccccuacuugcuaaucagugcauuuucuguugcucuaguaguaccuuucuuucucacacaccagcauccccgagucgguucuacaacagugccuuucaccugguaagccaaagucuguuggaugcaaacuguuuacacagaaucccaaguagaagcuaaguuaucaacgucaaaggaccaggaaggcagggugauucaauugcaaacccaaagcagcagcacuuuggagccagaauagaacucugaauaguccuuuauuuugugcugaggaccuagaacuuccacuuuucuuucucuggagccagacuucaugcuggggcuuuguuuuaaaaucaaggccccagcggacucagaacuaaggaauuuuuuucacacauauucaaaacggaagcccugccaccauggggaagcucaagguccuugcucagcuucugcuuguguuugggcuacaugaaaaucucuggguggugguugauguuucccgcaccaaaugauuucugcacaaggcccgacauucccccugcccugauagaagggucacaccacacaccaagaaggaugugacuaauaaagagugugacuucagagaauuuacaaguccagacaacuucugauaaacauuuaaacagaggucaggaauguuuuccuuucugaggggaaaauauguggucuauggugugagugggaggggcuggugggggguaaaucuaagcauuagcuuccucccuucauaauucuuaagcauuuuaacagcugucauuuuuaaugcccuaacaggcuuucagacuuagaacccauagcugaguaugggccagaaagcucugugaaaaaaaaaugggcaauuccaaagugauuaccaagcaaguuuaaaacuaacauuaggaucauuagaggcacuuucccugggcccugcccugaagcuaagaauguuccagaaaguaucacucaaggcccauuuuaaguacccagguugggaucuucacuuccccugcugacaaaagggggaagcuccauagaggaaauggguguugacuuccaggaaaggaaaggugagaaggaccagauggcaucugucagcauccucagcccaccggagacauucugagaacauuggccagggccaaggaggagagauugaugagcggaagccaacagagauauccccuuggcaguggaaaggaaagcugcaggucguuuuugugacccaacacacuuucauugguggugcugauccagcuaaugucuuuuagcauuuuccuuuucauuggcuguuugguuugucuccugacauuuccuggaucggugugcacgguaggcauagggugagugaguaagacuaguauucucucuggucaguucuaaauaaaaaguaagaaaagaaaaugucagccaggugugguggugcacaucuguagucccagccacuuaggaggcuggagugggaggaucacuugagccuaugaguuagaggcugcagugagccaugaucaugcuacugcacuccacccugggugaaaagugagauccugucucaaaaaauaaaauaaauuucacucaaaaucuuccucuaaaugggaagauggggacucaguauuggaagaaagguucugauaccaacuuuaggaaaacccuucgugugucugcaaucaauauucuuuugaauauaucagcuuccguuguuucagcuauaaccccuguaggcuggagcacucgggcaaugugaguagaaugcagcagugucaauuucccuccuuugaaucuuagacagguagagaaauuaucucauuuuaaaguccuaaguauucccauacucaguuuuagacauuucuugcuuuucuuacugagauaaaguauguuauuuugaaaauccagucuucagaaaucucauucacuuugucauugguucauucauucuuguagucauucauucauucagguacccaccaagcccugugggagacccuguguugggcuaaagggccaugucaauaggccaucacucagaaaaccgugggaaucguggucaggauggaaguucuagagucaaaccuacccugaauccuggcucugcuucccaugugcucugugauucugggcaaguuauuuaaccucucaaagccuccaauuccucaucucuacaaugggguaauaagcauagccacuuaacuagauuucugugaggauuaccugagauaauauauggaugagccugcacugugccuggcauacaguaaacucaguaaaugauaauagaggcaaugguaaggacaguaguaacuuuuauuauuaacaauuauuaaugagacaaauagcaugagagugauaggaaaagcgcuguuagauguuggacagaagauaacugggaagauuucauauagaauuugacuuacuagauuuuuuucacuugagguuuaaaaaaaaucuuaguggagaaauugggaaauucccuuuccuuugcauuucauuuucuauuacuuuccugaagacugaaacuucaguguagaauuuagcugaaggcuacaucccagcauuugcauuggccuuggagugccaggguaauuauucugucaauuauuugacuuuuuaaagucugucuaccuugaagaaccucugcaaaggaggaccguguuaauguguaacacagagauaagcaaggcucugcucuuuuuuuuuucccauggcuguucaacuggaaaacugaaaugguucuauuugcgucucagccagcaguguugaaaggugggggauaaauggcuuuuacuaaugaaguacagugggaugugaauuuuagcaaugcaaaaugccacguaucaccugcaauuuguuuuuuuaaaacacacacacacacaccaaaaaagggaaaucacaagacaacauaaaccucgcuugaagaaacgaucguguuuaacaagaagacagcaaagagaaauacucugaguugagccaaguagaugugugcugcuuuuguagauggaauaaaugauccucacuugcauagacagcaaggucauuuuucucacccuaaauggaaggcauuaaucaucagcucugaagaacaacauucaggacaagaagaaacaagccaccgcagcaggagguauugaauugagccagagaacugggggcccuguggacgggagccagcucagcccagguagcagcucccagaucagcaggggugggugguggagcugguccucuugagcccuaacagcuuuguugggaacuuucuauuguucaagaaaucuccuaguuaccauccaugugcauuucugaaaugccugacugugcuccgggcucuguaggcucuggauuagcugguucucuguggaccccgucugcauaaaaagcaaagaucaaaggaacaugguagagcucuuuaaaaaaaaaaaauccuaaacucacaagugaaugggaaaugcauauuuauaucacuggcccaucaaggguaaggguguucugugagaggggaggaagagaaaucauuaagcaggagcgaagcucuucagauuaagagcuggaagaacugcauugaagacuaagaggagacugaaggcaaacaguggaucuuuuaccauuuuucuuuuuuuuuuuuagacaaguuugaaaucgaguuuuaccgcuuucccaucagcuacaccaaguaguuuacuugugcaguggcuaauuaauuuguugaggcagaauuuuagguuaccuaugagguaauauggaauagugguuaggaggugucuagcuuuuuaaucccagcucuaucauuuaugagccuuguagcacugggcaaguuacucgaccuuucugugucucaguuuccuccucuguaaaauaggagacaguacgaaccucacagggcugucgugaggguuaaauuauuuacacauaugaaugcccauagugagcagucagugaacagguauugcuguugauuuuguuaccguggccacaguugggugggguggguggugcguggcaggaaugaguugaggggggaaaagaguaacaugaaacaggauaauagaaugugguuguugacaggaaccaugaaagucauccgguccagcucccccuuaaccaaggaaacaaauccuauugcauuuuaaaauaauuguuuugaaauuguaaguaauagugccgauuuauugauugagugcucugugugccagacagcaugggaagcccugcgccugcaucacaacacuccacgaggccugagugcuguuauuaccccauucuguagaugagaaaacugaggcucaaaccguuaagucauuuagccagcaucaccuggaucggaaugcagaccugugugaaugcagagauucugugagugacgcggcaguucuguucccuuugcauuucauuuccuguuacauuccugaagacugaugaugcuucaguacaagauucaacugaaggcugcauuccagcauuugcauuggccuuggagugccagaguaauauguucugucaauuauuugaccuuuuaaaauaugccuucuuuuggucagcugugguggcucacgacuguaacccuagcacuuugggaugcugaggcaggcagaucacuugaagucaggaguuugagaccagccuggccaacauggucaaaccccguuucuacuaaaaauacaaaaauuagccggguaugguggcaugugcuuguaaucucagcuacucaggaggcugaggcaggagaaucgcuugaacccgggagauggagguugcagugagccgagaucacaucacuacaucccagccugggcgacagacagagugagacucugucucaauaaauaaauaaauaugccuuucuugaagaacugcuauaaaaggaggacuguuuggaugcguucuguggucucauagaagugaauguauaacauccaugaaugcaugccuuauucugcuuugucucuuucauauaaacgcagagcaccauauuuuguuuuuuguuuuucuguuuccacacuauacugacauacagaguacauauuuugaaaaauacuuuaauacuauuaauuuugaguaaaucauguuucaguacuagugagguuagcguuuaaaauaaauaauauuuauucauaaaaaauuuuccuuuggaaucaagccaucauuugauuggauaugauugaaauuaugaguaagaugaaggauacaucccugacaacuuucaacuauugcucagauacacaugacugcguuuucaggaagucucuuuauuguuggauauccuuuacugcugacagaccuucguuaccuugaccuuaaauagguaaugauucuuugaucuuagugcuucccucugaaguaacuaaaaucaagacugcucauucucugacauggcuucccuucaaauguagaggauauuucacagguguguccccaccccaggcuucucuuccuuaagcuaaacacccacgucaccuucuaagcugguuuucagaccccacaagauccuuuaaucugucgguucuacucuucaccucuuggaagggagccagugcugcaagacugucggaucuguacagagcaggcuggagccauacgcuuacacgaaggugaccaaaauggcuggcuucuuagcuuucuggcuucacugaugucagggagguugcaugguuaaauaaugaaggaggagugacaagcaagagccaagagagggacauccaaggacuguuuccaagugauccaugguagaggcuucauggcauuccuguuguuugugcuuugagcaagaauuccuugguacguugguucuaguaaagagaucagcuauggucugaauauuggugucccccagaaaauuucucuguggaagcuuuaacccccagugugaugguauucacaggugaggccuucgagaggugaaugggauuagugugcuauaagaagagacaaagaaagaugaucucucuuuccaccaugugaggcuacagcaagaaggcagccaucuacaagccaagaagugggccuccccagaacccuaccaugcucgcacccugaucuuggacuucccauucaauacacuucagaugcuuaagccaccaaguccaugguauuuguuauagcagcccaggccgacugagacaagagccuugguauucgagauuuuuauaucguauuccugaauucucgaaaguucugaaaauaaagagauguucauagggcccauauauaguuauauauaacagauccauguuccaaguggacaaggaugaguggaaaggcagguacuucagucauacacagauauucagguagcuccuugaugaccugucuacccaccacauuccucugccuugugucuaccuuuuuuuucaaaugugaaaauuaucuggacuuuauuuuucuacuugucaaauucucuuuagcuuuuuuuagcuguuguguugaccucuucuaucucuaaaaggcauuugguuauuuuuuuaauguuuuugcuucacugaagcuuagugugcuuuuuaugguuuuaugguuaccuugcagaaaucucauuagaaaagcacuuuaauauauuacuuggcaaugagacaucugacaauguucuaguucauuaguuaggaaaccuccccaagcuuggaggaauagacauuccucugugaaugguagagcuuugaucacuccugcaggggccaggauuuauuuuaaugcauuuuaggggaggagaagauauccuaagccuggcaaaauaaaaauaacacagauuaaggaaacaaugaaacauuauuuuaaaagaaaugcacuucaguuaauauuauucuaugggaucuccugaguccuuugaaggcagagcuuaucuuagaaaauaugucuccuuuagugggcaggagguuaguuaagcaaccucacaccagaucacagauuauacugaaaugauccuaauaaggaaagacuuuccaaagcuauacucauuuuagcaugaauaaauggauucaagucuuauuugugggauuuuaauuuccaacuuugaauuugcaaacuaucaaauuccuucaaagacacggugugcagagaaggcucugaguaauaggauugcuuauuuuuaaaggaagaugcccuuuagcaaagcacgaggcuuugacgugugaucagucaaggguccaaucagcacggauuuccccacauggcacuguuucuuguugaguuccaaccagauuuaauaacucauacaaaaugcaacuccacccugagggugccuagugcauucaaagcagauaaugcuauauuguuuuaacacagauuaugccaaaugaaguacaauuuaaauuccugaagcaugacaguccuugggugcuuguggcuguguuuuaguugggugcuguaucuuuucuuucuuucuuuuaauugaaagacuuaaaagaagcaagcugucugaaaaaguguuuaaaagagcuugguuuucaaaugguauaaauaggacagaggcagaggaugcuauggaaaaagggccuuccuccaacuuuaagagguagaggaaagaaaugggagagucugggcaaaagugacguaagccccugaagucaggcuggagacucuuuugugucucaugugaggagagaaaugggugaagccuauaguacuuucacacuccccugaaugggaaguagaggccagaugccaguugcagcuucuuuuuaacuuuuuaacaccuucagaggcaggagaaaaugguggguggggggaauguuuuuauuugggauuagagguaaauuuucaggccggacgagguggcucacgccuguaaucccagcacuuugggaggcagaggcaagcagaucacuugaggccaggaguucaagacaagacuggccaacauggcaagaccccgucuccacuaaaaauaccaaaauuagccaggcgugguggcacgaaccuguaaucccagcuacucgggaggcugagacaggagaaucgcuugaacuugggagguggagguuguagugagcugggauugcuccacugcacuccagccugggugacacagcgagacugugucucaaaagaaaaaagagagagagagagagagagagagagagaugcauuuuccaaagaggaaaguacgaugggcagaguuuggaagcucgcuugcuggugccaggacaguggcugggugagcugcugcccuugggaaagucgcuagguccucccaucuuuccucuucccuuuuuccucaccuuugugcgauagagauuaugaucacucccgaucaacuccacaggacuguccugaggaucagauaaagagaacacgcuuuagaaggcucaccacaaaugggcuguggccguggauguggugguggugacaguggaauuggcaucuggguuggcuuguagccuggccuguaacuguaguuguggaagcuuagggggcuguuugaagaggccccuccuagucugaccucaugagccagagacacuaguaaucuugggcaguucuggggcauuuuguuguuauuuauuuauuuauuuaauuuuuuuuuuuuugagucagggucacucugucacccaugcuggagugcacuggcaggaaucucagcuuauuucaaccucaacuucucuggcuugagcaauccucccaccucaguccccugaguagcuggaacuacaggcacacaccaccaugcccagcuaauuuuuacauuuuuuauggagacaggguuuugcuauguuguccgggcuggucuugaacuccugaacucaagcaauccuccccucucagccucccaaagugcugggaucacagaacugcaccaccaugcccaacccaaaaugcauuuauuuaauauacaucacaagcacucaacuggaggcuuaaaagacuaauaauaauaauaauaauaauaccacagcucaagauacagagugcuauacaaaaaucacagaaaggacagaccaucuaaggaaaacuuaaaaagacgacacaaggacaggcugggcagccugggucagggcuccuggcuggugaccugcuuuaaguagguuucuugcaggugcuucuuaaaagcugugggggguuuccagagcuuggcagcaugccuguucaacgagcuaucaauguuggguuugccucgaaggcuguggauggagagcaggaugguccugacaucauacagggcagaccacuuguccuucaggauguccaggcagauauuacccuggguguccauguuggggugguagcagggcgugaggaacuucaccauggguacauuguaaggguagccccuggggagcucuagggagagcuuauaccucaggucuucauaugcugugccagcugcucaauggaugguccccacccauuugaaaagguugccugauucaggcaaggcagaaaucccugugucacuaggcauugugaaggucaccaacuccugcuguagccuuuugcccacaagguaccgggcagcaccccugcuggugguggcuaggcagcagcaacgcuggugguggcugggucaagguuuugacaggccaucuagguggcacugacagaaagauaggaacuuaaagaacacaacugcaacugacuauuuaauuuuuuugagacagggucucccucuguaacccaggcuggagugcaguggcgugaacacagcucguuguaucaucaaccuccugggcucaagcaauccuucugccacagccuccuaaguagcugggaccacaggggcaccccacacaaacacacucagcuaauuuuauauauuuuuguagagauaggguaucugcagccauaaaaaagaaugagaucgugucuuuugugggaacaugaauggagcuggaggccauuauccuuagcaaacuaacguagaaacagaaaaccaaauaccauguguucucacuuauaagugggagcuaaaugaugagaacucaugaacccaaaaaaggauauaacagacacuggggucuaccugacaguggagggugggaggagggagaggagcaggaaagauaacuaucgaguacugagcuuaauaccugggugaugaaacaaucuguacaacagacccccgugacacaaauuuaccuauguaacaaaccuucacauguacccccaaaccuaaaauaaaagguuuuuuuuauuaaaauuuaaauuuaaaaaaagagauaggggucucaccauguuucccaggcuggucucgaacuucuguccucaagcaaucuuuccaucucagccucccaaugugcugggauuacaggcaugagccacugcaccaagccuaggacauuuuuaauaaucaccucccuuaccccagccaagguucccaauccucagagaaaaagcuguucaagacaaaccuuccuaagcagacccaaagcuuugacagcccauaugaaaccugccuaggaguacccugcuagccuccaugaccaaauaugccacagcaaggcugauguggcucccuuagaccuauucugauaucaacugagaucagucccuuauucugggcggagagccugauggccacaugugugcuguuagaggacacugcccacacagugaccacccagggaaaaagaaagagagacccaauuuccuuguguguguugcaacauggccaguguuagagauccaggguugcuuaaucuaaccccaagugauuaagaaccagcuaugauaccagacugagugcaaacuuaguugucagcacagauaaagaaaggaaauagacacaucagauguaaaagccccaaauaggccuccuacugacagauccugcucuccuaacgcaugcagaccucucugacuugcugagauguauguauauucaaugacagcauggaauugaaugguugacuagaaguggcuuuccagaggcugcagcaggaggaacauucuuuguaaacaccaaguauuucauucccccccaauauaucaaaaacaguguuuucaguaggaucuggaguacugcauugaugggcaucacuuuugaccaacauaugcucaugcgguaccuuauauagauucacacacuucuucuagacaggcuuugccaccaccuuaugcacauggacccucgggacuucaguaacuugcagggccagguguguucagagcagaagaaauaugaaguagugugcaaugaauaggugcagggagaacccaucuucaaaugaauuggccuuuuuaauuagcaauuuuaugugaacagauuauuuaauacauugagauguguguguuacagcauucaacacugauccacaagcuugaacacauuuguguuuuagaauuaaucgauuuuaaucaaguagaaaaaugcacugaacaucccuuguauccaaugcucauuaccccugcggccaguuugugagcuggcuuguguugucuuagacuuucagaagagaaaacaaaggucuucuuauugaaccuuuugguuguacauugcauguuugauuugagaacaguuaugguucaggccugcaguaagagauugagagccuuacaucauuauaaauguggccuggggcauccaacucauuuaacuagaggauaaugcagaggagugauuugcaacugacuucuuccucccacaaacuaauauuuuuaaaugguuugcacuuuuuucuguccccaaagggauuuguuaagugugauuuucagcaggacauguacuuuuuuuauuuguuagccauaauggaaaugcauagauaaacugaaucuguguuaacauaauaagacaaucaaauuuuuuguuuaguuguggggaagggacgggauagaggaaguagaaaaagcucccucaaacauaagcugaauauuuaugugguuuuuguuuuuauuuaaaccaaccucuuuagaaaauuacuuucuuaauaagacauuauacaaugaauuuuuccagucauuuugagggaaaaauaugguacucugggagaacuucuagaagaaagaggaaagacucacuuaagauucccaggaccuacagagggcuggugcugaauaguucccacugaggaccuuccauuucgguguuuuuugucuuuuguuuuuuugagacaggaucucacuuugccacccaggcuggagugcaauggcacgauuccggcucacugcaaccucugccucugggguucaagcaauucuccugccucagccucccgaguagcugggauuacagguguacaccaccaugcccagcuguuuuauauuuuuaguagagacaggguuuugucauguuggccagucuguucugaaacugcugaccucaagugauucaccugccucggccucccaaagugcugggauugcaggagggagccaccgcaccugaccccauuuuguuuuguugugagagaccauaaacagccuagaaagauagaaaucucaauaaugagaaguuucuguaauguguggcuccugcccaccuucucucugcuuauuugcugucuuuuuuguuuguuuguuuuuuuagagauagggccuucucugucacccaggcuggagugcaguggugacaucauggcucacugaagccucaaacuccuggagucaagcaaugcuucuaccuccaccucccgaguagcugugacuacaggcaggugccaccacagaaggacagaccaucuaaggaaaacuuaaaaagacagcacaaggacaggcuggacagccaccagaccuggcuaauuuuuuauuuuuuguuuuauuuuuuguagagaccagaccucacuauguugcccaggcuggucucgaacaucuggccccaacaauccucucaccucggccucccaaagcacugggauuauaggcaugagccaucaccccaggccuauuugcugucuugauucucuuuucugcucccuccagccccacagauggcccaagaccccaaaugggcagucaagcuuccccacuaaguugaguuucuuuacuggacaacucaagaugucuuggugagauccugucuugaaacaaugccaggaaaguacaugaggucuccuuccuccuaaaaacaccccuagaaggaggccugggaggggcaagccuggcgguucaaacuggugauucaaccacccacauaagacccucuaggcuuaugggugagcugggugaggggcucagagaauuucuccaaucuuggccagaaaggcuuccuuaccacuuucacauuucucucguguccuucagaaggggccugcauccaaaaguggccauggaaagcuucacagaauuagcuuuuauuguaaaaaaaaaaguagcaaauggaggaaugacugaagagaaagcaugcuccagcuaucagucaacuuugagggcaugagcccauguucuaaauuuaaacacaaucugucccuuucuccuuguauauccgguuuccuuucacuucccucggugccuucaacuaaucccauucuugguuuacugcuuggcagugauaauuauauacaugcacugugacaguucaaccuuucaugugccaguucccaucuuuugauauuuucuuuuauuuuuucuguggaaaauaauaugacaaaauccugccauuuguauguucuucauuuuugacuccaaccaugcacuacugaauagaaaguaucucagccuccuuuauuuuucucugccguuacugauguguuucuaggcccaucuuaucugugcauuagcucauuacuuauugucaucgcuugucacuggcugccguuucccccgccucccuuggguguugugucuacacaucuuugcuauaggggaaauuagauaguaaacugaugaugucaguccuuugacuggagguuagcauuucaaaugcucacauauuuuuuguuaaacucacuuuuuuuuuuuuuuuuugagacagggucucugucacccaggcuagaguacaguggcacgaucuuggcucacugcaaccuccaccucccaggcucaagcgauucucccaccucggccucccaaguaucuaggacuauaggcaugcacauccacacagggcuguugcccaggcuggucuugaacuccuggacucaagagaucugcccaccucagccucccaaagugcugugacuacggcaugagccaccacucccagccuaaagcccacuucuuuugaaaccucaaccuauuuccagaucagugauucccaaauuucuuguaaccacaaccucuucuccuuauguuugguuuagauauuuuaugauauccacauuuuucgcuacccuaucaauuauucuccagggggaagagagcaacauuuuuuguuuuuuaugaaaaacaaguaaaacuuuuuauuuuuuauuuuuuuuaguuuugaggaauuuuugagaccauacaauacucgguggucuauuggagaaguccugaaguguugcaaaaaagcaaucacugcuuugaaucuuggaauaaggucauuuuaaucucacucacuauguuuuuucuugauguguuuugugauagaaaacacauaauaugaaaucugcccucuucacaaaguuuuaagugugcaguacagugcuguuaacuauaagcacauugcuguacagcaggucucuagaauuuuauacccauugaacagcaacuccucauuucucccuuacccuagcccccggcacccaccauucugugucugcuucuauaaguuuaaauacuuuagauaccucauacaaauggaaucaugucauauuugcccuucugggacuggcuucuuucuuuuagcauaauguccuacagguacaucuguguuauggcauaugacaaguuaaucucacuuauuauuucuuaaaguguaaauacaagacuaacaaaaaaaaaucccuugugucuuccaugcacuguuuaagguuauagaggcucacaguuaaggcuuacguuuuggggucccugggaggauauaaguuccagcucuuuuucguauaaugaugaaaguaacauaaaagauucuaggauggcagguacaaagaacauguuaagaacagcccuugaaaauauauaucaucauugcagacaucuucuuggggucaacucauaauguucccaaauaaauaacuguccauccaugaggacuuuguuugaauauguuauugauacuuuguuuuguuuuugguuuuuuacccuaauucuuggagagaggacuuuaugacuaaaaacacaccaaaaaaaaaaaaaccuuccaaaaagagauuaugauuauuaauuaagaaagaacucuagcugaugauggagaaaguucaaagauguuguauuauucaguuuuuuuuucuucuuuuaaaacaauuaaagccaagcaugguggcucaugucuguaaucccagcacuuuaggaggccgaggcaggugaaucaccugaggucaggaguucgaaaccagcccuaccaacauggugaaaccccaucucuacuaaaaauacaaaauucacugggcaugguggcgcauaccuguaaucucagcuacuugggaggcuaaggcaggagaaucacuugaacccaagaggcggagguugcaguaagccgagaucacaccaaugcacuccagccugggcgacagagcaagacuccaucuccaaaaaaaaaaacuuaaaacuaaaggaaaauauuauuuguuugcuacugcauaauaaauuaguccaaaacuuagcagccuaaaauaauaauaaauauuuaccaucucacacaguuucuguggaucaaaaacuugggaguagcuuaguuuugugguucuggccuggaguguccccugaggcugcagucaguaugucagcagggacuuuguucuggcuuuggauugacucacucacauggccguugucaggaggacccaguuccucaucacauggaccucuccuuugugcccuuugagcauccuaacagcacagcacuggcuucucccagagcaagugaucccacaaaaagcaagaaagaagcugcaggcaugcacugucccucccacuguauuuuauucaagugcgucaccagaguaagucacuaaguacagaccacacucaaggggagcagaauuagcuccaccuaaaaagugggggguggauuugauaaagggauggaagacccaugccaccagaaggguggaugggaccuuaaccagauacucuagugauacucagggacaaagaguguauggagucugagcacaaacucacagcuaugguccaugcuggggcuggagauggggguagggagcaaaggaacaccuggccagacaacccugagaguccucugggagugaggaccguggagcagagagagauaacgggaauggaguaaaugacucaaagauguguuagagauuuccugagguugaggccaggaggccaccagagaagugaaugcagguaaagacagugguuuugaccaaagagcaaggguggaugccccaggccagcccaggagcuuggcgccacuggaggaagugcauuauaccaaucagagcuucuuuugcugcugcugaaauggaacggugccaucgggccgucuucuccacuggagaugcuccuucagcucagcaggacgcuagcucggaacucagacugcacguuuuugcggauugggaggagggccgacgccguggccggauagucucuggagcugccuuuuggggguguuugccuguuggcauuuucaguacuccacgcgucaagagugagucacuuucucuucuugucaugaaguuaaauuccugggaugucaucuucauuuucuucagagccccuuuccaaaacucaacuuuuguuugcuucacaaauugcccugcuaaccuccauagacugaguuuauuugucuugauggaugaaucagagucucaaacucaucucuuuugcuccagcucucuuggcagagaacacaggaagauggguuuugcuuauguguguguuuggggaggacuuuuuuuccuuuguuuuucugucuuagccauagcuugugggcgagccggcaccugggaccuugaccgccuccuggcgugggccgaggccacauggggaguucuccccaguacguuuugugauguucccuaauuccaggaugggcugcaguuuuccagauccaaggcucaggggaacugggggaauuacuucccuggagccagccuuaucuuauuuguccauguuucauucaugcaaauuggaaauacucccacaacuaaacugccugcugaccaucugccuaggcaguggagcuguggaugcuuaauggcuuuccucagcaccuuccuaaucucuuagcuucgcacuguuuccaugguagccagccaauugagaacagaucauguuuuugcuauguuauuaauaaagugcaagaaguugaauuccuguaauucuaguuccuuuucugccguuaucuaggaaugagcugaggcaaauauuuaaccccuggggccucuuauauaagagauuuggucaagauggaucucagggcccuucuaagucucaaguucauuggcuauaccaucauuuaggaauaugaaaauauuaguagggaaggauuuauuuaucacaagaggagaaucucuauacuuucucuugucacccagcucacuagaaaggaucugcaccuuagcaagagauuucccucugcauuguggaaucggcaguuucuucauguugggaaauagaaucuaaauucauguuuuucucuuaaaaccauacaaauguucuuaacaucuuuguauaacugaggcuuaugcuuugcugguuguuucuuuuaaauccauuuucccaauauaaaaauauugcuugucaacacagacuugcacuucugcaguuuuauuuguuuguuuguuuuuagucacccaggcuggagugcaguggugcaaucucagcucacugcaaccucccgaggugggaagaucacuaggcugaagggauccaaccaccuuagccucccaaguagcugggaucacaggcacaugccuucacacccagcuaaauuuuauuuuuuguguguuuuuuggagggguagagaugggguuucaccguguugcccaggcugcugugaaacuccuaggcucaagggaucugcccaccuuggccucccaaagugcugggauuacaggugauagccaucaugccggccugcaguuuucaaucguuacucuaaaugucacucgggcuucucccacuaaaaaaucugaccacuuaaccuccaauuuuuaaauuuuauaaauugacuaauaaaggaauauguugcuacagcguuaaucuuuaucuuuuaucuccuggguuuuaucuaaguuuuuaaaugaaauugcuacuguuuuauagauauuuaacuuacgaucuauguuaguauaaggguaaaaauugagaaucagcaacucuggucauuuuauugcucuaguugaguggcugagucagaaacauaaaaagggcauacccaaacauugaccuguuuguaccuacaaacagcugaggaccaauuuguaaauaggucacaguuaaucaaaaucucugcacuugaaucuuuuccaaaugcuaaaccaugcccuucuacaaacuguggaauaaaaguagucauagcuagcuaugucuagcauaguccagaguccccugaaaaucuuuucaaugaucugcaacaacaaaagccaguuucuuggaaugguuccuaaacucuuguuauuuaaaccuucauaggaaaauacuaaacuguguauuuugguagugacauugguucacucaacuacucagcaguuugcugauuaccugcucaacgccaggcguuggaacacaggaaagaacuagagagaaucaauugacugguccuuagcagcacagagcccacgaucuaaugggguaugcagcaauuucaaugcauugugaaaaugcuaugauaagggagagucauguaagaaccaggcccacauucuaaguuggagggguuggauucaggagugaagagaggugaggaaaggucaaaggagguuugucaaacaaaaaggaaacuaaucugagacauacaggauaucuaggaguuaaccaagcaaagcuacggaggggugggaaauggggggaauauucuagaaaaaaauggcaugugcaaaggcuaggggcuagggagggcaagacaugcuugaggagccacagcaaguucauuauggcuggagcucaggguucaggagggauguggcaagaaaugaggcugggaaaagcuacccagagccagaucuuaucuauucuggauuuuacaguuuaguaaauguauucauucaggaccauuaucuucuuucugguaguuagaaaguuuuucucaagaggaagauguaaaucuaaaacauuucaaaucccagagagaaaacauuuucucuaauagaaggauugcuggacucuacccaggaguguuuacuaaguguuaacauugacuuuuaaaguuuuccuaggauuccugccauacaagguaauucuaugcauauggcaucuuuuuaaugauuugcaagacgaaacacaaagcauauuuucaaauacugauuuucacauuaaacacugauugaaaacauuaaaauccaauaaaaagggcucggguucccagaucacuuuauucuaagauauggguaggacuucagccauuuggccacgaugggguuaucauccacccagaauucaguaaaaggaggaugauucccaccuauuugggguugcaagucuaagcuacuuauccagaaccacucagauaacaccucagaaacauuucagaccgggugcaaauaguaaagccaugacaccgguuuaugauuccagcaauaugugaccuuuucuccaaaauauauuaaugcuuuuacuuucuuguuuuucuuucuaucuugguagcuuguagacauaacuaaucuccuuggcuugacauugaaaaccucuguaaucuaguuuggccuacaguucuuaagauucuguuuucuucuccgcaaacaccucacucuccaacaaagcaaaaugagacacaacacuccagccauacggauuauguagacagguaucacgguagcaucggggaggcccuggguuuggacucagaaaaccuaaauucauguccugcccaccccauuuccagucugugugaccucgcacaagacacuuagucccacugaaccucaauuucuuuaucuguaaaaugacuggcuucucucacaagauugcuaggaaaaacaaaaugaaguaauggcuauaaaaacuugcugugaggcuaggugcugugguucacagcuguaaucccagcacuuugggaggccgaggcaggaggaucacuugagcccagaaguuugagaccagccuggcaacguagcaagacccuaucucauuauuuuuaaaaaaguaaaaauaaaaauaaaauuuaucugggagguguaaagcccauuauuaauguaaaguauaggaguccgcccucauccaugguuuugcuuuccaguuucaguuauaugcagucaguuuugguccgaaaauauuacaugggaaauuccaaaaacaaacacuuucugguuuuacauuccacacaguccugaguagcgugaugaaaucucaccccauccagcucuguccaggcugggaugugaauuuuuuccuuuguguggguauccacgcugucaacaccacccacucauuagucagucaguagcugucucagcugucagauugacugucaugguaucacagugcuuguguuccaagaaacccuuauuuuacuuaauaauggccccaaagcgcaagaauaauaaauuugguuuauuguuauaguuguucuauuuuacuauuaguugcuguuguuaaucucuuaccgugccuaauuuacaaaacagauuuuaucagagguauguauauauaggaaaauauuggaaaaaacauaguauuaauauauacuauuaauauauacuguauaaaguucgguacuauccacaguuucaggcauccacuggggguuuuagaaaguauccccugaagggauaaggguggacuauuguauuuuuauuuuuccugcaaacgacacacaguuuucccacaucuugaacauacugauccccuugccugaaagcccauuuccucuuucaugaauuuaguucugaccuacucaguaagaauuuuuuuuguuuuucagagacgaaaucucgcuguugccccaggcugcaauccaguggcuauucacaggcacaaucacaggcacuacagccucaaacuccuggguuuaagcaauccuccugccucagccucucgaguagcugggacuacaggaaaaaaaacuuuuuugccccgucacucaggcuggagagcaguggcgcaaucauagcucacuguagccuugaccucccagggucaagcaauccuccugccucagccucuugaguagcugggacuacaggugcacaccaccacgccuggcuaauuuauauuuuauuuuuuagagaugaggucucacuauauugcccaggcucccaggcuggugucaaacuccugggcucaagugauccucccaccucagccucccaaagugcugguguagcaggcuggaucuccauaaacccuuugcuguaaugaggaauguauaaguuaaacauuaaagcagaaguagaaaacaauggauaacgaacugggguaacuggugccugaguaagaaagcucgaaugcaaaaacaaaccuauuaaaaccuuaccuggacuuccucaaccucaaaccugauugagggaucaaagcgugcaccaagacccacuuaagaaacuuuccuacccacagacccauaguuaaaauuagauuaagaaacacucccacaaguagacauagagcuugaauuguguauauaagcuaaaggaaaacuuguaacuuugaguugaucuggugaguuacucugaccuucuuccuguaacugguugcaaaaauaaacucccuccuuucccagucugucugcaucuuguuauuggacucgagaacaagcagccagaccucauuugucugggaacucugggauuacagcccaggagauuauuuuuuauauuuguauuucuaucguaggaccaguugcacuucgccuguuuuauaauugcauguauaguugucuucacuuccugauuguaaaucccuaugggacaggaguccaacccuaacaucuuucuauuccucaugugacccagcacaucacuuaguucaugauggacugggacaaauuaauccauuccauguuuucaccugcuuaaugcuauacaaugcugaaaugugauuuaguuaguuauuauuguaguccuuucucaccuuuuaaaccauuuuccauaggaauuuccccuuaaggaauuaauucaacgaagcaguaguacaaguuagugcucuagauauagggauagauauuaaaguugaugaugauuagaugacauuuuucuuuuuuuuguuuuaaauauucuuuuuuaaaaaaaguuuauuuuagguuuggggguacaugugcagguuuguuacauagguaaacucgugucauggagguuuguuguacagcauauuuuaucacccagguguuaggccuaguacccaauaguugcccuuucugcuccucucccuucucccacccuccacccucaaguagacccagugucuguuguuccccucuuugcguucaugaguucucaucauuuaguucccgcuuguaagugagaacaugugguauuugguuuucuguuccuguguuaguuugcugaggauaauggccuccaacucccuccguguuccugcaaaagacaugaucucauucuuuuuuauggcugcauaguauuccaugguguauauguaccacauuuucuuuauucgaucugucauugaugggcauuuacguugaucccaugucuuugcuauggugaauagugcugcaaugaacauuccuguucaugugucuuuaugguagaaugauuuaugucccucuggguauauauccagcaauagaauugcugcaucaaaugguaguucuguuuuuagcucuuugaggagucgccauacugcuuuccacaaugguugagcuaauuuacaccccuaccaacagaguauaaguguucccuuuucuccgcaaccuugccagcaucuguuguuuuuugacuauuuaauaauagcaauucugacugguguaagaugguaucucauugugguuuugaucugcauuucucuaaugaucagugauguugagcuuuuuuucauaugcuuauuggccacaugugugucuucuuuagaaaaguguccauucauguccuuugcccacuuuuuaaugggguugguuuuuucuuguaaauuuguuuaaguuccuuacagaugcuggauauuagaccuuugucagaugcauaguuugcaaauauuuucuccuauucuguagguugucuguauacccuguugauaguuucuuuugcugugcagaagcucuuaaguuuaauuaggucccauuugucaauuuuugcuucuguugcaauugcuuuuggugucuuugucaugaaauauuuaccuguuccuauguccagaaugguauugccuagguugucuuccagggcuuuuauaguuugggguuuuacauuuacaucuuuaauccaucuugaguuaauuuuuucauaugguguaaggaagggguucagccucaaucuucugcauauugcuagccaguuaucccagcaccauuuauugaauagggagucuuuuccccauugcuuguuuuuguuagcuuuguugaagaucagaugguuguaggcgugcaggcuuauuucugggcucucuauuccauugaucuagauguuuguuuuuguaccaguaccaugcuguuuugguuacuguagcccuaauaguauagucugaagucaaguaacgugaugccucugacauuuuuuuauguucccuaauuauuaggaauugaacuucuguccagccugauuuaacauaugaugaucaguauguuccagaaagaucuguucuuuaaucaucuucugagcacauuacaagccauugaggaaagcuagcuagugcuaaccuuaugaaauauuuauggaauuauuauuccuuauuuuuuuguaaguuaaaaugcuccuugcugauuaaaaaaaauuacccacgacuuuuuugugaaugggauuaaucuucucucucucuguuccacagaccaugacucccuguucuccacagaggccaagcucccauggauaugggguggaaauuuggagacaggucaaagucauauguaucccaagagucuuguucuuauuuucucuauuugaguuuacuuugagcuuucuucucuucaagugucaguucagcugauguacuggcucagaccauaacccuuucccaaggacuagguaaaccuggauuacuuucuaccucuuccccuuuguugacaagcagcugguguuugugaaaaagcauugucuuagugcuugaagucugcugccuuagccaaguucagagauccauucauuaucuuugaagugcccagcuuccuaaaagggucacacauguuguuaaagagacucccugagaacauacccaaaaagcaaggaugagggaggcauaaacagcagcuccaaggccaauuucgggaguacugagaacauuuucuuccucgugccucuaaagaaugaguuuccuacuuuuauguaugguugcucugaagaggcgccaaaucugaaauccccuguuuuaugaggaaauuauuuucauuuacauaaacaaaagaauaaaaucuccaaggccagaacugaugguugcucuagaagaaaugccuuuggaaguucuacaauaagccccagguucacgugaccguuaggauacuuugcauguaguuucucccaguccuuguaaaggcauaauguccucaccuuuaaaacccaaucuacggaugggugcacuggcucacacauguaaucccaacgcuuugggaggccaaggcagggggaucacuugagcccaggaguucgagaccagccugggcaacacagggagacccugucucuacaaaacaaauuuuaaaaacuuagccagggauggugguaugugccuguagucccagcuacuuggaaggcugaguugggaggaucucuugagcccuaaaggacgaagcugcagugagccaugaucgugcuacuauacuccauccuggauaacagagugagagccugucucaaaaaaagaaaaaaaaaucuacuauagaaaucaugaaaaacuccuuucugugucucccugcacuguuagggaacuaauaauucaagugaaauaaaaaacaaaacucaaaaaaagaaagcaccauuaauuaaagaaaaauaaucacugccuaaaauuagccaaagugccaaugcagagauuucugaugugaaaaaugccaauaagagcagaaaagaguauuuccaugccacugcaaucuccuucugugagguaacaugucccacgugcauuggcauagcuuugcuucaccuuguucccauuucucacagcucacacccagccagauggacuccucugucccccagccugauaaaagcaagggugacuugccuugcuaaaugguaaauuccuuaugcaaagccuuccaguucucaccaggcagguccuccucuccugugaucagagagacauccccauuucccugauuucagagcagugcuauuuggcacuuuugagccucacuugaacagucuggcuguuccuggcccagacuguuuacugcacccacaucuagcaccuucucaauuccucuuagcacucagaaaaauugucuuguagcugaacucaaacacacaguaauacuuauccuaaguacccaagacacacacacgagaagaacuagcccuacacuagcguaagaggagcauucuauuccagguucagccuuagggacgacacuagagaaaauaccaaaaaugggagaagaaacacgaaauccugcuaggaagcugagagaaaaucugagaacacucagcaaagaaugcaugagcaaaggaugggauagauaacagacagcuuuucagucucuagacaucacaaaacggcucagaaaaugaccagaggggccaagcuggagaagaggaaaacacugagaaagagcaggaggagcucaguuaugcgcggcuggcuaacgucugggguugucugccagggagucacgguggcugggcugugacaaugggaguccggggccuggaggguaaaaacauacgcaaguacaaacgccagacgcccgccaagcagccaucacgcccugcgcucugcuccauggaagucugaagggggcuauucgcacacagagaucccuuuauucaaccuccuccuugcccgcuuaaagccaaaccgaaugucuuaacagagaggcaaucggaccagaaaugagcaaagggcggcucccaaguucgagggauuuuagauaagacccaugcacuccagacacagagccccaucuccauacagaacagucaagggcaggaaugaggagggcagaagagggacagggugcaggugggagaugacugcccuauuuuaugaaaauggaaagcaguccaggagaaccgcgaugacccuguccacccccgcgugauugaagugguggcggugcugguguuaucaggugucuguacccuucacccagaaccagcccacuggauuuucucaauucuccgugaauacuggcaccucccaaguaguacuuggccucucacuccccaaaaagaccuacgaacauaauuucuucuaaucugucccccucuccuccuuucuaacuuuccaccuuccugucuuccuaaucaucugaguaucuccuacucaaaaacaauguuuuaauugaguacuucuaccuagggaguuuuuuuuaagauaccuguaccagacuccacgcccagaccagugagaaacuaggagugcagcccaggaaugggcauuuuuuucgacacacccagaugaguccagugugcagccaggauuggcaaccacuggauaagauccugcaggacagaauccuuccuagaggccaguacccgguggcugaggcucugcgugucugcugccuauuucugcagaugccccgcuaugaaaucuuuuccaaccugcauagccuucuggagacugaauaaaccucugcuugguagcuccuggucuaagagggucacccuauacugcacugucggaccccacaggcacuuuccagugccgucagccucgccugaaggauuugcugggauuucuaaagugugaaucuuuuccuugggcagaguggugcuaaacacgugucugguucucagggagcugaagaacuuuagucuucuacugaagacccaagguguuaagucuccugguccuccuugguuguccgaguguacagggaacagcagaacuggccccauuguagcauccucccagggaguucaggccuuggccuucagcgucgcaaaauguuuucaggaggagguuuagcaaguccagcucuccugaaguagaagaucacuugggaaucucuuacauccucuuccccaggggcacaucuauuucuucuucuuuuuuuuuuuuuuuuuuuuuuuuuugugagagagagccucgcucugucgccaggcuggagugccguggugugaucuuggugcacugcaaccuccgccucccagguucaaacaauucuucugccucagccuuccaaguagcugggacuacaggcacgugcuaccaaaauuagccugacuaauuuuuuguauuuuuaguagagacggguuuucaccauguuagccaggauggucucgaucuccugaccucgugaucugcccaccuuggccucccaaagugcugggauuacgggcaugagccaccccgugcccagccaagcacaucuauuucuaagcagauugcuuagaauucuuguuagucagcgcagggccuacggauagagacuaagcuuuaaagaugggugagccucccuuacagguaguucaagaaacccuuccugaugucugaggauaccaggcacuggguuaguauguaggggccugagagugggcagggacuccaagaugaaguguccuagccaggcuuggugguugcucaccuguagucucagccacucaggaggcugaggcaggaggauggcuugagcuuggacuccugggaguccaagaccaaccugggcaauguaacaagaucucaucccaagaaaagaaggagaaauuuccuagggaaacucacuaucuaggcuucuaggaaucccagaaucaggugugaccauccacgugguuagcaauaaguuuccuaugggaacuucccacccaauucagugcuugcagaauaagaaagcgcuagcaaaaacauuuaauaucuuguauuuaaggugagucauaguccagacaggacaggcccaugagauguggaaaaaauguguuuccaaggcuauguuaacaucacuagggaguuucgucucgggaaagcacucucuauaaagucaguucuuccagguccucaaaccaauucaaaaccuagccugcugauucaacuuguguggaccucagccagucugguauuaggaugauaguguagguauuccagcuuccuaggggagcucugcugaauacguuagcucaucccugggcaauguuguuggcacagccccauguuaccucaucuaucacaugguuaccagagcgagcucaccaucuugcacaccugaacaugguuucaaguccuucauggauuugcuucauggcaguagcagggucccuucaagaaugacaccagaccacauguaccagaaccaccaugggcaagaaccacacccuggagucagacucuuugucaguaccccacuuuuuuuuaaugcuagacccauacaaggaaggggacaagaauaagaaaacaucaucaagggccaggugcgguggcucacgccuauaaucccagcacccugggagcccgaagcgggcagaucaccugaggucaggaguucgagaucagccugaucaacauggugaaacuccaucacugcuaaaauuacaaaaauuagccaggugugauggugugugccuguaguaucagcuacucuggaggcugaggcaggagaacugcuugaaccugggaggcaggggcugcagugagccgagauuguaccacugcacuccagccugggcgacagaguaagacuucauuucaaaaaaaaaaaaaaagauagaaaagaaagcaucaucaaauaagagauuuguuugcaagcaaccaacacauugcaagaagcaacuuucugugcauguucuguggucaauucaaaauuacagugauaauugugagauaucacaagauugacagucaucguagugagauauuugaguacuauguccacuugagaaaaacagacuucaugcucccuacgaagauucucagcaucaaagauuggacccaaaacgaggugucuuauuaauccagagguaacuagcaaucagccaggaacucaacucacaagaccugggcacgcggucaccagggcagcauuguauugaauggucugcucuuagauggacuggcccugcaaauacgugccuggaagcuaagcaaggccgugcuauucacuuaucugcuuuaccuggggugggguggggacgggccagguggucagcagugagcugauggaacucccucuggagaaacuagugagagggagugccaaaucugucuuccuuccacccaaaggaccccacauagccuucccagggcuaaaaugucagcuagacagugcuugccuuggcacuucuggucuccccacugggguucagugccuccucauggcccaggugauaccugaaauucagcaaauuuaaacccaaguccacccuuuccccuucuucaauccagcaccuuccucagacugacaccccugcuucuguucauggugcggcagccuccuggaaccuuugaggcucacagccuuuaaaucaugccucucuuuccuacauccagucaguuacuggguaguguuaguucuuccugaauaaucccccaagucuuccccuuuucucugucuucucauugcugcgaccuugaguuagagccuuaauccccgccaugucccauccugaugcggagaccuccaaaaucaucuugggaaaugccacuugaaucaugacacucccacuuucagagacacauuggagggugaggccccaccucaucugcuuucugcugugcccuacaccacacacgaauccucuucccgagcuggcccgcaugcucacuauucaaggcaggccagcguuuuccugccucuccucaggcaggucccugucuuucaccuuccuugaugaaagucuaauuucugaaaugaaaagcaacagcucauacuuacugaauguuuaccccaugccagguacugugcuaauggcuguaucuuguuugauccuuuugauggucuaaugacugggauacuaucauuccauuucacagaugaauaaagcaggggaagugaaauaacuugugcaauguugcauaacucaggagugguagagcagaauuccugauuccaaguccacgcuccaaagucacuauagucuauuaccucccagcauuuuguucuuacucuuaaugcgcuaagccuccccaacaccaccccaacagauuauauuuagagaagaggaagcaguucuuacacacuuuugcccuaaacaguguuuggcagggucccauuauuauaaacuauugguucuucauucacacuaaaguggaaaugacuaacaguagcuuccauaacuagaugaauuugccuuaaacuaaaagccugagauuaaaucuggccuaugcugcuuaagcuguuguacuuucuucuccuccccugcuguccucagccaguaccccugagaccgugugcuagauucccauaccaggguucagcugcuacaucaucccgccucuggaaguucccuaaaugacuugccuuggcagauggcucugcucuuuaauuagccauacaguuacugcuuccccuuauuuaauaucaggaagcuuccacuuguuucauccccuuccccaucuuggccauagugccuuccuacuauucuuuucccguuuuguacuuuugugugcuccuguucccuuuaauguguuaucagaaucucaucucaaucuagggauuuuugccaaguugucugaacucucuaucuccauaugugguaucugagguccuucuuaaacccugauuuuccccuuauuugguauuaaugcacacacuauuuucaggacccagcaucaagagucaaggugaguguuguuugcaaaucuaucauaacucggagaaguccccauacucaaaugucuuagccauguuagcauguacucagcaagaggccaugaacaguggcucaugccuguaaccccagcacuuugagaggccgaggagggaggaucacuugaagccaaggguucgagaccagccugggcaacaaagcaagacccugucucuacaaaaaaaaaaaaaaaauucuuuuuuaauuagccgggcaugguugcacuugccuguaguccuagcuccuugggaggcugaggcagaaggacccaugagacuaggaguuuggagucugcagugagcuaugaucguagcaccauugcacuccugccugagugacagagcaagacucugucuauaaaaacuuuugaaaagccaggugcaguggcuuaugccuuuaauccuagcucuuugggaggcugaggcagguggaucaccugaggucaggaguucgagaccagccuggccaacauggugaaaccccaucucuacuaaaaauacaaaaaucagccgggcauggugauggcugccuguaaucccagcuacucaggaggaugaggcaggagaaucgcuugaacccacagggcagagguugcagugagccgagauugcacaacuucacuccugccugagcgaaagagcgaaacucugucucaaaaaaaaaaaaaaaaacuuaaauaaaaauaaaauaaauguucagugagaaccauaaugugaauaguauaacccagcaugauuuuggugugaggauaauugauaaucauuuucuuccagcagaccuacccaucucggugggauuugcuucaagugauguauauucaaauuaauuugcaucuccuggucauauacuaauugguuggugagugguuaguagccaagaaacacugcuuauggcaagagaaagucaagugaaagauuaaagaaaaucaugauuaauaaucugccagcugauaaauaagauaguuauaacaccacuuuggugagguguacgcuuuuggccauguguacacuggugcauuuucaagacaguggcuaucuuuucacuucuguuuggcuaaucauguuauguuguucugaaguuacugcugcccuauacccacuucacacagccugagcucugucuccuuccaaugaacaugaagaucuuuugauuccguaguuccugguucuguucugauuccgacaggaugcuggcauccucaauuaggccagcuaaggaaagcauuagaaaacagugaugcacuacacucuguggaacuuaccgaaaccaacaggauuuuagagaagaaauaagggggagccugaagcugucaggccgcaaaaaaugucaaagagaaaugaaacuucagucuuagaaugucaaauaaagugugauaagaaauaagaggagggaagauauuccaaguagguaagggcaucagcauaagcaaaggugcuggaagggguaaugaacauguaauggugggugagcaggacugcugggagcagacagugaguuuggguagaaaugacauagaagagugaauugguaaaaauggaagagaugaugggcaaaugagaaagcaacgaagcaaaaaauauauaguacaauaugauauuggaggacagaaaugauuauuggggguaauuugacuuuugaccauuucccaggcuuaauucaaguauauuuagcuuucaaacaugacuucuccuaauaucuucuacacagcucuuucagaugaaaaaaaaauuggcuaacuggguaaagggugauaccuuuauaagcucuauuuuuuuaaucccugaggaagugaaccauguuaugagucacauacaucguguuuagguaggugaggaaaugcauugaacugauuugcagagaaugagagcuccagacccagacagugagacuucagaacuucauaaaugucaaagcaucuuugacaucuaugucccagcucuaggacacauucaugauagguucacuuacuuccaaacccaaagaggauauucuuagacacuuccuaguuucuucaucuuguaaaagugguuaaguggcuuguccaaggucuuuuggcuauaaauuguagacaaggauucagagccaaguguucuguccccaagaaugcuuuugucucuuuuuuuuaaauaguaacaucaugaggacaucucaggucauggcuggggagugcuuugugcucuguaagggacuaggaaauuguucacauacuucuucaauauuguuccugcugugcuuuuuauaggauaacacauuuuaacucuguccucacuaccaagacuuuauauaaaaucagcuggaaugaauugcuggucaaauucaaaauuaauuucaugucaaagucuuuuccucaugauauuuguguguuuugugagaacugccuuucuuaaauucuucugaaccaacucauaauacuccaaauuuaaauccauccaucuauaaaacuaccuuuucuguaucaguaguacuuuuucagaacauaccuauuucuagauuauaaucaaauauucuuaaaauaaucugguagucugugaguccuuugucuagaacuuaauuaaaaguggcaaaggaggccgggugcuguugcucacuccuguaaucccaguacuuugggaggccgaggcagguggaucacgaggucaggagaucgagaccauccuggguaacacggucaccccgucucuacuaaaaauacaaaaaguuagccgggaguggugguggaugccuguagucccagcuacuugggaggcugaggcaggagaauggcgugagcccaggauguggagcuugcagugagccgagauggcaccacugcacuccacacugggcgacagagcaagacuccgucucaaaaaaaaaaaggggggcggaggggggcaaaggagaagccaggcauggugacuuacaccuauaaucccagcacuuugagaggccgaggcaggcagguugccugagcucaggaguucaagaccagccuggccaacauggcaagaccccauaucuaaaaaaauacaaaauuuagccaggcgugguggcacacaccugcaguccuagcuauuugggaagcugaggugggaggauuguuugggcccaggagauugaggcugcagugagccauguucgcaccacugugcuccagccugagugacagagaagacccagucucuaaaaagaaaaaauguagcaaaggaggaguaugcagacuuagguggagauucugcaggagacuucuaaguacuuuuaaggugauaugauucauuaaauugaauuuuaauuuacuuuauuuuuaauguuuauuuuuuauuugcauaaacuuauggaguacaaauguaauuuuguuccaaggauguauuucauaguagugaauuuuuguuuucuuccaagguuagaacuuucuucuuccuugcuauaacuuccuucaggaucuggcuaucuuucuucauuuuuucuuucuucuccuucuccuucaccuccucuguauuagacuguucuuaugcugcuaauaaauacauacccgagacugaguaacuuauaagaaaaagaugguuaauggacucacagcuccaugaggcuggggaggccucacaaucaugguggaaggcgaaggaggagcaaagucacaucuuacauggcagcaggcaggacagcaugugcaggggaacugcccuuuaugaaaccaucagaucucaugagacuuagucgcuauuacgagaacagcacaggaaaaaccuguccccaugauucaauuaccuuccaccgcguaccccccaacccaugacacaugggaauuaugggagcuacaauuugagauuuggguggggacacagucaaaccauaucauccucucucccuucuuucccuucaaggaauguucaaaaagaagagacccucuaaggaaugaucaaaaggaagagacacucuaaaguuacugagcgagaguuauaaaaaauagggaaggcaagaaaaugaauuuagaggguugagaaggaucuaaagagauugaaugagaauuaauugaguguguaagguaaaaggaaagugggguagccugguuuggguacagucaucuggauagaaaaauguagguaguccaccuuggguggacaucucuuuacaucaggcagcacugcagaugacuugguugcuuucuggaguugccgaggguggguacaaggcagagggaggcagcgcacagucauuuauucuaugaacaggauguuugcuagacagauguuugagcagucuggagcucuuaauggaacaagggcaaggauaaauaaauaauuggaccuauccugauguuugucccuauacauuuaagaauucugugaccuguuuuaaacggaauccaaacacugaguaugaguuagaugauaauguuguuauuacccuugaccuggccuugaggacugauuuugagcuuucuguaugagaaaauuagcucagagugaccuaaaaauuucuuuauucuuaaaaacagaaauaaauucucgaucugccuugcccuucuuggaagaaagguagaguggaaagaguuagaaguuauuugguacagagucauugaguacagugcucuccugagguagaacagaacugucagggauugaauugcaggacagaccugcaauucaagaugauuguuggcagugaaauugcugaucaauggaaugugugggaugauaguucuugagagucggggaggagagugcagcauuguuggggcuggcauuguauccaccgaaaacauuuucagcaucucuucucuucuauacaagacuuguccucuuggugucccugugggucaccauuaagucgcuugcuuauucuuucucaccauguaucuucauuuaccuuucucuaaaacuucuguaauuugcuuuuaucaagagauuuuggucgcgugcaguggcucacaccuguaaucccagcacuuugggagacugaggugggcagaucaccugaggucagggguucaagaccagccuggccaacauggugaaaccccaucucuacuaaaaauacaaaaauuagccaggcaugguggcgagcaccuguaauuccagcuacuugggaggcugaggcaggaggaucgcuugaacccacgaggcagagguugcagugagccgagaucacaccauugcacccugggcaacaagugcaaaacuccaucuaaaaaaaaaaaaaaggaguuuuuccauucccucugcauauucugggggaauuuccagaccagguaagugguaaagaaccaaucagagcuuaguaaauagguauccuacuggguaucagcucugaagaaaguacuggaaagaauguugaaucccuacagauucuuccaacacaggaagucacguggaggccaacccgccuccauguacucuaagaggucuguuuggucccuugaauauuacacuaauaauuuauugaugugacuuuccuuugcaagagacugcaucucaaaaccaaaaggccguucuguagccuuauuucuuagcacuuuccaguuuacguauuguuuguuaaacuuuucauuguguuaguaaacccagcauuuguucaaggauauuugaaauagucaaagguuuuuguaaauguugugcagcaaacugguccuaacagccccuccucugcccuuccacuacaucaccccagcaggagucaguggauauuauagauuuuugugguauggaagucuuguagaauucuagaaauagccugguggcaggauugacaaaaucauuuacauucuuagaauaauccaaauguugacucagccuguuuaccuaagguauuccaagcauugggagagagaaauaggaacccaugauaugauuuguccuaauauugaauccccugacgauggcugucauucaaaguauuccuggguucagguauuuuuaaagaauucauggcugggcacuguugcuaacacccauaaucccaguacuuugggaggcugaaguaagaggauuacuugagcccacgaguuugagaccagccuagucaacauagcaagacucugucucuacaaaaauaaaaauaaaaaaagaauucuuacuuguccuagaguguucugcuucuuggaauaguaagaugauugggggggaacagauauauuagaucugcccucuauuuagugcuucaacuuuaguacaauuaauuucuaaauuaugccauaguuauuggugcaaagauagacacauagaccaguggaaaagaacagagaguccagaaauagacgcacacauauacagugggucuuacagauuuccacaaaggcauuauuaugauucauuaggaaaaagauggucuuuucaacaaauggugcugaagcaauuggauguccuuuuaggggaggaaaaaugaaacuugaccucugccucauagcacacacaaaaauuaauucaagauggagcaaaaacuuaaaugugaaaaguaaaaccauaaagcuuguagaagaaaacaggagaucuucauagccuugggcuaggcaaaaauuuucuuaaacaggacacgaaaagcacuaaccacagaaaagaaaacuugauaaauuggacuauacuaaaacuaagaacaucuguuuuaaaaucccaugggaaaaauccauagcaugucuucaagaucucuggcagaaaaucaggcuggaacuugcccauuagcacuccagaaucugcccccugcccaagaccgaugacccugcuaccuguauuggcaauagggagauggacacagguuaaaguaaguagguuuuggcagggcugaggcccucagauccucacaauaaaauugucuugcauuccuugugugguuuggauaugagagaagcagcuuuguucccgagcucccccucaaaucucugaaaacugguaugcucuucucagaacaauccuuugagauccccugagcuuugaaguccuccugccaagucugugugugggaaggagaacagagcagcaugagggccaucagagaggugggcgaaggcaguucaaagcccagccagauccggcucugugguguccaaacccuuggggucccauagcccuagaggaagcccgggauagggugaggcccagcccuuugcaggguucuguauugcugcauccagacuaggaaaugucugagacagagccagaaacguaaauacugcaccacugugcucaccacauucauguuugcagcagaagagccaagcccccuggccaggauauaugcuuccuauucagaccuaugguuuggagggaaggaagcaugaaauguauuuagagcuuuccaaacuuuugauuguuuugcacauuccuacaaaaauaaaaauaucccaugagauuaaaaaaaaucagcuucuaaugcuuuagaugagugggaaaaucuugcacacuggggucauuuccuuucuguuucaagaaauuaauauugugcuggaaauagccuguugcagaaggggagacuuuauguccuuugaaugcugauuaugccagaaaacuuuccaguccuaaaggggagguugucccuuucccaggacucugaugcaagaugacccugcaguuuguacuuugcuaggauaggagacccaagucagcagagauuuaaaauucagaagggaucauuaauuuauucauucaagaaaccaugcuaagcauggaauaagagccagguuagguucuggagucucacacugccccacaugaggaucccagacugccagcuccaugacccuccucugcggacggucccaagucuuucugaaggccccuggugauugaacccuggcauucagaauuagcagaagugacauacuaauuaccaguaacuaaaaaguugguguucacaucucuauugcagaugccgggaagccaggccgucaggggacaggcgcagucagcaagcacccgcucucucgguaucuguuggcuuccacaguuuuguguuucagagccaaaccagaaaucacccaggggguuacuugcaucagcucuggaaaauguguaaaggauugaaguccugagacuuucccauaaugucuuauuuaggcaucagucucccucaguugauuagagcaggaaucagcaaauuucuuuauaaaaggccagugacagugacuauuuuagccauacagucucagccacaacugcucuagcagccagagaccacaggaaacaaauaaguguggcuguguuccaacagaacuuuauuuuauggacauuuccuuuacaauuuucacacgucaugaaauauccaucuuuuaauuuuuuuucaaccauuugaaacugcaggccgggcauaguggcucacgccuguaaucccaacacuuugggaggccaagguggggggaucgcuugagcucagggguucgagaccagccuggccaacguggcaaaaugcuguuucuacugaaaacacaaaaauuagcugggcaugcacuuguaguccuagcuacuugggagacugagucaugggaauugcuugagcuugaacccgggaggcggagguugccgugagccaagaucaugccacugcacuccagccugagcaacagaguaagguucugucucaaaaaaauaaaauuuuucuuaauuuaaaaaaacaaaaauccaaacaccauucuuagcucauaagccaugcaaaaacagauggcaggccagauuuggcccacaggccauaguuagcuaacccaggaccagagagucauaccacuuucauagcaaaaaggauacacaugguuuguguugacucugaguagggaacuucuccagagggugccaugauacagaaggugggggguguguucccuaauugggggaauggagaagcaucauucuggccucucucaguggccccauaccugcugacucuauuuaggccguggcuugagggugccccccacuugccaaugccuccugccagggaccuggacacugagaacgcugggaaagggcccucuccuuggggacccuggucacacccaauagaucagucacucuucuuccuucuuaccagcugccucuccugagcacacuggaagaaggaccccuguaccaccuuccucgacacccgggccucuucuguucaaaggugccuccuggccaggcaugguggcucacaccuguaaucccagcaguuggggaggcugaggcaggagaauuacuugaagccaggaauucgggaccagccugggcaacauagcaagaccccgucucuacaaaaauaaaaaauaaaaauuaacugacaugguggugcacgccuauagucccagcuacucgggaggcuggggugggaggaucgcuggagaccaggaguuugaggcugcagugagcuaugaucaagccacugcgcuccagccuggguggcagaaugagauucuguaucaaaaaaauaauaauaaaauuaaauuaaaaauaaagaugucccuuccaauccccugacgcacacagcacuccacauguuucuuuucuucccugccucaucacccuuuucaaccuuagauccuaagcuucuugaggcagagacuuccaucuugucugggugcuuagcacauuuucaaauauucucuuagauuuuuuuucuucauuacccauggagcgguugcuuguugccuuuccaacccaaaauagaaauagugguaaacaaaagaagaaaaacauugaacauuuuggaacuaaaauuuuauuacuacuggaaaagucccagauaauaaaaaaacagcugguaaauuagcacucauuuaagcauggucuggggaagaagaaaauuuuaauaacacauuuuucuuccuaauuguuuuuguuuguuuagauuuaugcauucccaaaguggaccuuaaaaucauguugguggcaggaggaagccaguguggucuuugaaauuugcuucagauaauccaucaaggggauggccucauaaacaaaauuauuauuuucucccuaagaugcugacucaugugaaggacuguuuaaaagaugacuuuggcuuugugcccucuccugcagguccuuccauagugacgccccccaaggacaucuggaaugucacuggugcccagguguacuugagcugugaggucaucggaaucccgacaccuguccucaucuggaacaaggucuguggcacagacuuuaagagacauccuaggcugacaagcuucucuugcacugcacaaggaugguaaaacguuaaauccucagccugcuuuguugacugcggcucccgcaaggugaagccuuagggcagucauacaggccccuccccuggauucauggaacaaaaaccagucccugccaugcuuuuguuagcagcauccuagaaucugagaaacuggaagaacaauaaugcugaacaccugaacccaccuucagggugugugugcaccugugguguguguaugugugugcauaugugggugcgagugaaagugugugugucuguguuugcgcccucaguggagacaguauagcauagggguuaaaagcguacguuucucucuuucugucccaaaauaccaccuccaagcccccaccaagcuguuugugauggcaucagucuccucauuuaagacugaacauuuagcugauaauuuagauccugucugcuuggaggcauuauuauuauuuuacugggaggcucggcuaagaagguaaaaggacacaaagcccuguagccuucuccugggagcauggauuauuuuuucagauucccuaagugcugggagauggaugaguacauuuuaagggcacuuggaaguaggauagaaggaaugaggugggaucuauucuccuaaguaccaaggcuguagaaccauaaguuagggacagaggagaccacuccagaacagagcauuaaaaaggaacaagaggaggaauagcaaagaaaaaaaugucuccuuucugaauuuugcuaaaugcuggccccagccccaaguggaaaaagcaugauauucuuuuaauaaaucagcuuugaaaugacuucccaaauggaaaaaaagaaaaaaaaaagugugaggcugggugcaguagcacaugccuguaaucccagcacuuugggaggcugaggcaggaggaucacuugaguccuggaguuugagaccagccugaccaacacagugagacuuccuucuuacaaauaauuuuuuuaauuagcugggcauggugaggcaugccuguggccccagcuacucaggagacuaagguggaagaaccccuugagccaggagauugaggcugcagugagcugugauugccccacugcacucuagccugucucaaaaaaaaaaaaaaaaaaaagagugugaauuccuuagccaggguggcugaguucucugcaagucaggguuucucagccucagcacuauugacauuuggggccagauaauuauuuguugugcgggcugccugugcuuuggaagauguuuagcaguauccccagccucuacccacuauauaacaguagcauucccccauccccccugucgugagaauuaaaagcaucuucagacauugccaaauguccccuaaggguguggagcuggggaauugcccuggacugaaaaccacugcuguuagccucaacucuguucucuaccuuauaaaaguagcauguaauuaucauaaagaugaaauaaaguaaugcaaguaaaaauuacuugauacauaguuagcacucaguagacauuagcuacuguuccuggaaauuuuucccuucaaguggcauuaucuuguauaauuaucuucauauuugaaggacaacaucaucucagcauguauggagaagggaaaagaaaacacuuauuugccaucaacuaacaccucacaauuauaccauacacuuacguuuuugucuuuuuuuuuuuuuuuuuuuuuuugagacauaguuucacucuuauugcccaggcuggagugcaauggcaccaucucggcucaccgcaaccucgccucccggguucaagugauucuucugccucagucucucaaguaguugggauuacaggcacccgccaccacgccuggcuaacuuuguauuuucaguagagacaggguuucuccauguuggucaggcuggucucgaacucccgaccucaggugauacgcccaccuugcccucccaaagugcuaggauuacaggugugagccaccgcgccuggucguuuuuguccuuuuuauacauuuugaauugcugagccucacaacuauccuacgaaaaauaaaaauuaaaaaauuaucaaacucaugcuaccaaaaaaggaacuuaguuuaaguaaaagggcauaaccagacauccauuuuaagcugccuuacuucuccagcaagcucuaagguggaugauagucucccuugacuauuuuguuugcucucugugugaccggagaagcaacuucuagaacuccaggaggacuguggcucccgcagucggagcucuuucuguugcaaguucuaccagcccauuugaaaccagccuaggcaaaacaaaaagcggggcgggauccagccucaagggccccugcauccagguacacacgccaucagaacucuaacucuugacucuuugcucucaauauacuagucucauuuucuucugcuucagaaagcuuccuaugcagugggagauaucaacuccacucacauuuuuauuacagcuuaaagaccccagaggaaagaaagggcuucccuucucccugcugcauugugaaaaucccacgaagggcucaagcccaggucgggucaccugcuaagcucuggcucccccaugcggccggagggaugcggccacugacauuggcaccggcgugaauccgccugguuuguguaaaaucugggaacagguaccagaaaaugccugaggugggggugauggcagaggcaacacuacuauaccauccuuuacagugaagcuucucuuaaaggagcaauaaaauuucaccccgaucaguuauguuuuuaagaggaaggcggagcaagaguaagagcagaaaugcaguccguggauggguuccccuccauccuuacugcaagaacugcaggcguuccucacugcuaauuuggagauugcugguuugcucaggguguggggagguggagaaauaauguuccgaggaauacccaugaaaagcuccguugcaguucucuacaguuuucuagggauacuuacacaaugagaagcgagggucacccaagcguccuggggcaugugaccuuauuggcaaaucuuggcaaagaauaauuucuucaguccuugcucuacccaaucccagcuacaguauucacauaccagaggaauacgucugccucgggaaucuuuucccuuuuaggacuguacagggcagaucccaauagacaaggccucccugagugcuuguccucagggcuagucagaaacaccaaggcaguugaggcuggugugguggcucgcaccuguagucccuagccacucgggaggcugaggugggaggaucgcuugagcucaaaagguggggcugcagugagcuaugauggcaccacugcacuccagccugggcaacagagcaagauccugucucugaaaaaaaaaaccaaaaaacccacuaugucagucaacgagaugggugcugaaguaaagaagugaagaggaaguaggagagaaacaauuuuuucugcagacuuuccagaacaagcaaaacccaacugugaugcucugccgguuuuccucuaccuucauaauguaauuugccacaugcaugacccaaagcaauguuucuuacacugcagaccaugacccaucagugacuccuggaacuaauguagcgaucacaaccaccauguucuuauaaaaaauaaaaaauagaacagaaccuauguuaaggcaucacacuuaccacuuaugaaggugucauuuccuaaaacuuuuguauauuccagauauacgauaguuugguccaugucaaaacuaaggaaacuugggaagucacugaccuaaauaauuaaacaggguauuuguuuucucaucgcuguccuuguaaccagacuguuaagaauacaaacauauuuacuaucauguguguuucaaauccaauuuaagaguagaacaccuuuuuggauagauuauuagaauccucacuuguaaaacaagagaaacugaggcucaaauaaagacagcauguccuucuugcucaaggauucuuagcaacagcagaauuaaugguacaagccuuuucuccaugacacuugagacuacgguggcaauucuuacgguuggcacagccuggcgaguggucuuuacuuuccuuacugguaguaaggaaagcuggcuuuaacaagccccauaccuuucagcaaacuccuagccuagaaagauucgaagggcaauauuuugaaaugggaacgugaacugaaauagccauauuugacuuaacccuuuuaaaucaaagaugaugcucacagcgaaagcaaaacaccuucccaauauuuguuucugagacggagaggcucucuguuuaauucuuuucuugccugaauauuucuucagauuagggcuuccuugaccucuaagaauauuuuuuaaucaaaaauagugaccucuaagguaauaguaauaagcagaaauuauccaaagacguauaaagaaagaguugagaaucuccccccaccuccuccuccugccugagguaaccaaugugaacugcccugguuuguaucuuuccacacucuuuuucauauccaagcauauucaaacauauaucccuacggugaaaugagaauauagugugccaguaaauuauucugaaacucgcuuuucucaacaaauacuucauggacauccguccaagucugcuucucaacagcuacguaauauuccaaguaugaauacuguaauuuauuaaaucaguucuguauuuuuucuguuguuuccaaauuuuuguuaacuuaaaaaaccuacuuuaagcaucaaaguacacauaucauacauacuagugauuguauugcuauaagauagauuccccaacaguuaccuaagucaaaauauuuguuucaguguuaacagacauugucagauuacuuucuaaauagauuguaguaauucacacucccaccagaaauggagaagugccauuucucugcaucuuuacuagcacugaauauuaaccucucuuuuuuaguuuuaauuccaauuuuaacuagaaaacacauauuuauuggccaggcacaguggcucaugccuguaaucccagcacuuugggaggccaaggcaaguggaucacuuaaggucaggaguucgagaccacccuggccaauauggcaaaaccccgucucuacuaaaacuauaaaaauuagccaggcgugguggcacaugccuguaaucccagcuacucgggaagcugaggcaggagaaucacuggaaucccggaggcggaggcagagguugcagugagcugagaucgcaccacugcacuccacccugggugacagagcgagacucugucucaaaaaaaaaagaaaacacauacuuaacaacacuuagaauccccuuacacgaauaagggagaguuugacauauaaaaauuugucauaugaaaauucuuggcacuuuuuucuauguuuucuacaugauguauaaccuuuuauaauuacguaacauuaauuaaaauacgccaugccaacacuugugaaaagaagggaaaaauaaaguauaucuauauugugauuuauguuaaauauuauauuuaacaagauacauuucccuuuccauaguggaucagguuaauuagcauaaaaugcuguuacuaagagcuaugggauuugaggcuuaguugcugagauucaguauuucagugcugcaguguuuauuuucuugcuuuggucacacauaaaacucauaugauucugaaauucaguaaauaaaggucagagucauauuacuugagaccuuggaucaaauuaauacuucuaccaaaauauucuuacaacccauuuuuaaguaacuauuucaaaagcuguauuagcauaaaccguuucugccagcuacuugggaaacuaagggaaaagguaccuauugaguauguuugucuucacagcauuuaugagaaagacauuaaguuacgugguuuucucucacuaauaguggcaaugugggaaaauuccagaaaaaaaaugcaaaaagccaggcuuuccaaaucaugcaagauauuuuuucuagagcaggaauuggccuagaucacaugugguuugcugaaucccaguccuggcaucauaaagcugagaaaauacaguguagguuugaagccgacacaacagcagaguaccaaaaaacacaugguaggagugggauccacaugggaaaagcaacacugagauggaaguuaauaaaguguauauauuuauuuauauauuuauuauauuuauacauacggugucuauauauacacacuauuaucuggucuuuauuaagauuugcuuuauuauagaagaaaaugaaaaggaaacuagcuauuugagguuguaaauccuuucuaauuacaaagguaauaucaauaaaugucagguuggcucuuaaaggagaucugggauggaaugaacaaacaauucguauauccuuuuuuuuuuaaaacucaccauuaucacaaggcuuaaaauauuuguacucuguaacucagcugcuaaauguauauguaucgaggagcuacaagugaauuucauucuuuuguauauuuuccagaguuuauauaauaaaacauuuugccuuuuaaaaugagggcaaaaaggauacuauucaguauuggccuugcaccaaagaaacugaguuucuucugaaucuugacaugacauacacagaaacagucagcaaguuuugucauaaaagaacaaugacagcacauguauuugacagcuguuuuuuuuuuuuuuuuuuugagauggagucucacucuguugcccaggcugcagugcaguggcgcgaucucagcucacugcaaccuccgccuccagguucaagcaauucucccaccuuagccuccagaguagcugggacuacgggugcucgccaacacaaucggcuaauuuuuguguuuuuacuagagacaggguuuugucauguuggucagucuggucucgaacuccuuugauagguguuuuuuaucuuagguguucaguaaaucauuugauuaauucuuagcccucagaauaaaguaaugguauuggcuuuggucucagccuauuuuccauugaugaagcuguugcaggaagagccccaaggucccaagcaucaaaccuagugcugggugacaguucaucaguugaacauggcaugacaggcaaaaggccuggaacugagaagcagaauuuccaagagcaugagugaaugaaugauggugaccaguggcaggaaauuaugaccauguauauuccccaggcaugcagaaaaauacauuaguuuaaaacauguacgcuuagcaggaaacuggcaggaagaaauaaaagaggaucuauauuuuaaaaguauuuaggaaagggaaauaguucagugaaaugcuggguuuacucuguuagaaagucugacauacacuaugugcaauuguagggauguggccacuuccaaguagaugaucugguguacaaaacucaguauuacucuccuuuuguuuuugcagguaaaaaggggucacuauggaguucaaaggacagaacuccugccuggugaccgggacaaccuggccauucagacccgggguggcccagaaaagcaugaaguaacuggcugggugcuggugaguaccaguaccaagagcuggcaagaguuucauucuuagcauuagacauaagcagaccuggcaaaggugccugauguaccgccagccuaaaggugcuugcucuuccacaucuguuuggaauagccuuaccauggagucgcugcuccucuuucagagaaacuaaaggaaaagugcuuuauugcauguuuugaaaacaaccaaugaauuaacaagaacuaguauuuuccuaagaguucaaagcaaaauccucacacggagcugcguggcccaagcauuguuuuaacugauuaucgauuaauaaauaccuuauuuuacuugacccuggauauucauggagaauacuuugaucauauacccuuaucaagguugcccuuaaaccgauaauguguaccuauccaguuuuuaaccuaugcaguaugaucaaaaguuguccaugacauuuccucauaugaauccucagcaaaccaaauaugguaguuaucgaagucuccuaucacaggacuugcacugcuucuagcaguaccuuugcuaugaauccccuggucaucuuaggaaauuuaugaaauaaugaccucacuggaaccacugacaaaagagaagaccaccacagaggaauacuagaucuuuuuucuuucacagguaucuccucuaaguaaggaagaugcuggagaauaugagugccaugcauccaauucccaaggacaggcuucagcaucagcaaaaauuacagugguugaugccuuacaugaaauaccagugaaaaaagguacacaauaaaucucacagccauuuaaaaaugacuaguacauuugcuuuaaaaagaacagaacuaaguaugaaaguaucagacguagcuauugaugaaauucuguaguuagcaacccauaagggcauuaaguaugccauuaaaauguacagcaugagacuccaaaagauuaucuggaugggugacugaacaucguuauuaugacuuagaugcuuuuaccuuaucuaacauguaagagucaaaaucaaacuugccuggaauggcuucuauuucccauagcuuucuaccuaucuacuuggcauuuucccuuuguguugugacuauuaaauuccuauuuaaaagaaaaugauugugggcaauucucgcccuucacuuuugcuuuuaaaagaaaaggccacaaaggagaguauauuggcaaauacccaguucuguucugccuccccuuccuucacugccaaaaagcuuccucugaagaacccauccugugucauagcagugcuacuuuacauuuauauaguucuaugaaacugaugucugaauuggcuuucccuuagacaaaagaacaaaauuuaccgucaccaugugucaaaccauuccacugugcagaucacucagcugugauaugaaaagaaauauuaaguaaagaaguauuuggucagauucucuucagccauaauguguaaugucaggcaaugaaacagaacaguagcuaagagucaagccaugcguuugagucucagcucugcuacuaauuauuccuccacuuuaccuuuugaaggagauccggacuacaaaggaaaggucuuuaaccucucugaaucucauugugaaaugugcucuuccaguucuauaauaagauguaccuuugaugcaucaaccaauacagcaaaauugccuuucauagcuaaaaucauguaacuugaguuccacagagcacuccagcauaucauuuauacaauuacucauauauccuuuauccccauauuuuaacaucuucauuuauuuggaaacacucaacuaccugccaauucaaaagucaaccacauccccauauguaacuaauuuuuaucuuuuuuuuuuuuuaaacaggugaaggugccgagcuauaaaccuccagaauauuauuagucugcaugguuaaaaguagucauggauaacuacauuaccuguucuugccuaauaaguuucuuuuaauccaauccacuaacacuuuaguuauauucacugguuuuacacagagaaauacaaaauaaagaucacacaucaagacuaucuacaaaaauuuauuauauauuuacagaagaaaagcaugcauaucauuaaacaaauaaaauacuuuuuaucacaacacaguacauauuugucauuuuuaaaaagccacacaauagaaacaagacaccaagauauuuaauuaucuuguugacuccuguaaaauagcuaaacacucaucauucgcggugcaauacucauagacauaaguuccugaaacaauaguuugcaugcguaaggcauucgcaccaaagaaaucugaaaagaaaaaacaaaugguaauuagcagaauuguauugaagugaccccacuucucuaccccagaaaaagacaaagaucugguacuguagauaaugaauaaaugaguggagcugagaacacacauucugcuaccucagcuuauggugguucuuucuccuaguaggcuuugguauuuuacccauucugccagacauaauuuauauucacccaccucaacuaaaagguuuucaaaaacucauuguuuaaaaucccuuguacaaagucuuauuauuuccaaaagaugaauagcuuagagaaauuaccacacuaaaaccuaaacugguuuuuagaaaaaucaaauuaucuuuuccuuauuuagaacucggaaucucacagaagcaugcuaucaaaauugugaaaaugccaaucuguucugccacacuaauucugccuggauaaucagaccaacacaguuuccucuaaacaaauaucaacugccaguaaagucuauacacaccuggguuuuauugcggcagccccugcauucauauguauggguccugguguuggcaaucgccauuauuccacaaagauugcaaacaugaaccugauauggaucugaugccucaaacaaucuuucccuuaaaaacugggcugcuccaugggcaaucugacaaucucguuccauuucuccaaaacgcaggccaccaucacuguuaagagaaaaaaauuauuacuuuguacuuauuuuuuauuauaaacaccgccuugaauaauggcaaagguggagaauaauauuugcaaagacggauaacuaggcucuaauuuuuauacccuagcauucucucuauugguggggagaggagaagucuaccaacuauuugacgugcauuagaaaguccccaaaugggcuaagcaaaguggcucaccccuguaaucccagcacuuugggaaguggacuggguggaucucuugagcucaggagccugggcaacauggcgagaccccaucucuauuuuuuaacaaauaaaaauaaaaacagaagguccccaaauggaguggauacauuagauucuuaaguagagcauuuaauuuuccucauaagacacaauaaagcauagaguggagguucaucaugcuaucauuuaacuuucuagaauucaacucuau

SEQ ID NO: 14376 - RNA, 1921 nt, Homo sapiens
ccacuuugggaaugcauaaaucuaaacaaacaaaaacaauuaggaagaaaaauguguuauuaaaauuuucuucuuccccagaccaugcuuaaaugagugcuaauuuaccagcuguuuuuuuauuaucugggacuuuuccaguaguaauaaaauuuuaguuccaaaauguucaauguuuuucuucuuuuguuuaccacuauuucuauuuuggguuggaaaggcaacaagcaaccgcuccauggguaaugaagaaaaaaaaucuaagagaauauuugaaaaugugcuaagcacccagacaagauggaagucucugccucaagaagcuuaggaucuaagguugaaaagggugaugaggcagggaagaaaagaaacauguggagugcugugugcgucaggggauuggaagggacaucuuuauuuuuaauuuaauuuuauuauuauuuuuuugauacagaaucucauucugccacccaggcuggagcgcaguggcuugaucauagcucacugcagccucaaacuccuggucuccagcgauccucccaccccagccucccgaguagcugggacuauaggcgugcaccaccaugucaguuaauuuuuauuuuuuauuuuuguagagacggggucuugcuauguugcccaggcuggucccgaauuccuggcuucaaguaauucuccugccucagccuccccaacugcugggauuacaggugugagccaccaugccuggccaggaggcaccuuugaacagaagaggcccgggugucgaggaaggugguacagggguccuucuuccagugugcucaggagaggcagcugguaagaaggaagaagagugacugaucuauugggugugaccaggguccccaaggagagggcccuuucccagcguucucaguguccaggucccuggcaggaggcauuggcaaguggggggcacccucaagccacggccuaaauagagucagcagguauggggccacugagagaggccagaaugaugcuucuccauucccccaauuagggaacacaccccccaccuucuguaucauggcacccucuggagaaguucccuacucagagucaacacaaaccauguguauccuuuuugcuaugaaagugguaugacucucugguccuggguuagcuaacuauggccugugggccaaaucuggccugccaucuguuuuugcauggcuuaugagcuaagaaugguguuuggauuuuuguuuuuuuaaauuaagaaaaauuuuauuuuuuugagacagaaccuuacucuguugcucaggcuggagugcaguggcaugaucuuggcucacggcaaccuccgccucccggguucaagcucaagcaauucccaugacucagucucccaaguagcuaggacuacaagugcaugcccagcuaauuuuuguguuuucaguagaaacagcauuuugccacguuggccaggcuggucucgaaccccugagcucaagcgauccccccaccuuggccucccaaaguguugggauuacaggcgugagccacuaugcccggccugcaguuucaaaugguugaaaaaaaauuaaaagauggauauuucaugacgugugaaaauuguaaaggaaauguccauaaaauaaaguucuguuggaacacagccacacuuauuuguuuccuguggucucuggcugcuagagcaguuguggcugagacuguauggcuaaaauagucacugucacuggccuuuuauaaagaaauuugcugauuccugcucuaaucaacugagggagacugaugccuaaauaagacauuaugggaaagucucaggacuucaauccuuuacacauuuuccagagcugaugcaaguaacccccugggugauuucugguuuggcucugaaacacaaaacuguggaagccaacagauaccgagagag

SEQ ID NO: 14377 - RNA, 15043 nt, Homo sapiens
uguaacacugucaggucaauuuggaagucauguaugugcaaggcaaguaugaucacauaugcaguaaucuucgccuucauagaauccgaaauuaaguuccguaaucuagaaaaucaguggcaauaaaggagaaacaaaauuaaacucucagacaauuucuccaaaagcaaaauaagaacauccaauccuauucucauaugcacggaaugucuucccaacuucaggaaaggaaaaggaaugugggugacuuugcccuuccaagguuccugggccucacacacaguggagcagugugccaguccauguuucccucugaggcagauagagaaagcugggccuacacucuaccugggcacugcuagcgcuuugagcuggugagggcccugugagucuguccccgccugcccagcagggcugcugggaaaacaaucaucccgaaaucagcugugcugauucuuccaagcacacucaagagcagaaaacacacgccaugcaaauggcaggaaggaagcccaggggcagggccugcgggucuuuccccagagucaccgaguugggcugcccuuuucugcaaugcugccuuuccgcagaacaccagcucugugagacaucgggaagggcuauucaaaaguaugugaaguaaaacaagucuuuauuguaggacuucccagagcuucuaagguucccaaaagguaauacuuuucuaagaagggcagaguaugucauauuuagcauuugcuaaacuuacuggggccccaggagccuuccaaauggcagcagucuuuucagcacugcaucuccguggacauggaauugaguccaagccccugcuccucacucccaacccccaccuacuuucuccugcacaagaaaaaucccagcaaccacccccugaccugccauuguuguaggucaagcaaguaaagugcuucagcaguuugguguugaugauguggggaacuccaggucccagagcaccuacaacacaaaguugaguuugaucauuuucucucaaaacccucaggccacaccucaaccaugagcuaagagaaaaggccaacagcugggccacugcaaugaccagaaccaggugguaagagaagcagggcccacacaaagcagaacagccacaucaaaaugaaaacaugcuuggugugcugcagccugcaguuugcccugcacgagagaugcuggugauggggcaaugacaagaaaacacagccugaggccuaaggacccagaguuaacaugaccuuagaaaacaaaaauugugcugaaagcucagggagagagggggaaagguggaauuggaaugugaaaauaagaacuaaguggccaggcgcgguggcucacgccuguaaucccaacacuuugggaggccgaggcaggcagaacaccugaggucaggaguucaagaccagccugaccaacauggugaaaccccaucucuacuaaaaacacaaaaauuagccagguaugguggcgcaaaccucuaaucccagcuacuugggaggcugaggcaggacaauugcuugaacccaggaggcagagguugcagugggccaagauugcgccacugcacccuagccugggcaauagagugagacuccaucucaaaaaaacaaaacaaaacaaaacaaaacaaaacaaaacaaaacaaaaaacaacuggcugggcauaguggcucacacuuguaaccccagcacuuuaggagaccaaggcaggcagaucaugaggugaggaguucgagaccagccugaccaacauggugaaaccccgucucuacuaaaaauacaaaaauuagccgggugugguggcgggcgccuauaaucccagcuacucaggaggcugaggcaggagaaucccuugaacccaguagguggagguugcagggagccgagaucgagccacugcacuccagccugggcgacagagcgagacucugucucaaaaaaagaaaaaaaaaaaagaacuaagcaaauacaagcugggugcaguagcucacgccuguaaucccagccagcauugugggaggccaaggaggguggaucaccugaggucagguguucgagaccagccuggccaacauggaaaaaccccgucucuacuaaaaacacaaaaauuagcugggcgugguggugcccgccuguaaucccagcuacucgggaggcugaggcagaauugcuugaacccaggagauggagguuguagugagccaagaucaugggacugcacuccagucugggugacagagcgagauacugucucaaaaaaaacaaaacaaaaacaaaacaaaaaaacaacaaaaaaagcaugacuaagcaaauacagucaugucccacauuacaguguuuuggucaaugacaggccacauaugugacaguggucccauaagauuuuuuucacacagggucuugcugucaccgaggcaguggugcaaucauagcucauuguaaccuugaacuccuaggcucaaacacucuuccugcuucagccucccaaauagcugggaauacaggcgugcaccaccccagcuaauguuuuuauuuuuguguagagacagugucuugguauguugcccaggcuggucucaaacuccugcccugaagugauccucucaccuuggccucucaaagugcugagauauaggcaugacccaccaugcccagccagucccguaagauuauaauaucauaguuuuacuauuccuuuucuguuuagauauauuuagauauacaaauaccauuguguuacaauugccuauaauauucaguauaguaacaugcuguauagguuugcagccuaggaacagcagcuuauagcauauagccuagguguguaguaggcuauaccaucuagguuuauguaaauauacucuaugauguuuguacaaugacaaaauugccuaaggauacauuucucagaacauauccccaucauuaagcgacacaugacuauacugaaaaacaggaguauagacuacuggaugcccaaucacaguaacaacaacuaaauacaccuugugccuaaaaccacagacaucuucuggguuuccaacucuggguagguaugagggugugacccgcaaaggauccuagcuacaggugacacuggguuaccaucagauugacucucuccuguuagaaauaagcugacacaacacaaaccugccacaagccuucaagauacaucuguguaacucauaagcucucucuauauauacacacacacacgcacacacguggcugauguuuguucuaacagucccuuaaaguuuuccuuuuauuugaccuggauauucuacuuugccucaugcagaauagaaguagcaaauguuagcucuggaaggacccugaacuaucauauaauccaacguggccccaauuuucagaugagaaaaugggagauccagagagaaaaaggggccuggcaaguccccucgacaugucagcaguaccagaaugaaucucacaguugacaguaaagacuuggacagacauauccauuuucuucucucaucagaacucaucuaagaauuacagacaaauaauauacuggaaacaauuagaauaaaauguuuaucauagacuuacuuuuccgcuuaacuacccuaugagcucgaaauuugaugaggguauccagaaaccauaugcaucgggccuggcggucucggcucuccacaucugauggcaaagacuucaacgcuucuaugacaaaggugcaauggcuaaaacaaggaaaagaaaaggaggccugugucaggguaagaugggcucugucaggaacuacuucccucuuacaacgagaacagcaggcgccucucaccccgacgcacucaacagcugaugaaacccugggcaacaaggcaagaccccaucucuacaaaaacguagccggcaugguggcacauguguguggucccagcuacucggaaggcugaggcgggaggaucacuugagcccaggaggucgaggcuccagugagcugucugcgccacuguacuccagccuaggugacagagcaagacccugucucagaaacaaaaaaaaacaaacgaacaaaagcagcugaugaagggccaguacacucaacacuccuuauaauaggagaacaugguucagugcagggaugaauaaagggcuagacaguaaauauuuuaggcuuuggaggccauacaaccucuguugcaacuacuugacucugccaucguagugcgaaagcaggcacagauauuacuuacguaaaugaacagggcugugcuccaauaaaacuuuauuuauacuuuacuuacucacaggcagcaggccagacuuggcaugugggcuguaguuugcuaaccucugaccucuguuuuuauagucaggagcauagacucuguagucagccugccuggguuucaauccuuucucugccauuuaaugguuuaggcaaguuucuuuuuuuguuuguuuguuuguuuguuugagacugagucucacucuguggcccaggcuggagugcaauggcgcaaucuuggcucaccgcaaccuccgcuuccuggguucaagcgauucuccugccucagucuccugaguagcugggauuacaggcaugcaccaccacgcccagcuaacuuuguauuuuuaguagagaugagguuucuccauguuggucacgcuggucuugaacucccgaccucaggugaucugcccgacucagucucccaaagugcugggauuacaggugugagccaccgugcccagcggggcaaguuucuugguaucuggugcccugguuucuccaucuauaaauuggggccaaugauaguacagguacucuccuccugagcauuuuuucuggauuaagagaugaugccaguaaagcucuuagaacagugcuuggcaaaaauguuaaggcucagucaaugcuaacuauuauuuucaggcacugcucuacugcuagcaagacccuggacucacagagauaaaaaggcucuucaagaucaucucauagaugccucauuuuacagauagaaaaacugaggcuucaagaagggaagauaagggcagaguucggggacucaguuuucagacuccccgcucagaguucguuccugcaccugccccugagucacaaucacauuaagacaacuaugaacuaguaaugagcucuuuuuuggaaauaaaucuuugaagcaaaaaaaaaaaaaaaaaaagaaauaauaauaauaauuccaaggcacuggauuucaaugaccaguaaaauuuuaaaacaaaaacuggaggaacaaaccucagauugacaacucuuuaucaaaauaaaauuauuaaaagaaaaaacucaaaagcaaaaaaaacucacuaucauaaaagaagcuguuuuaaugggaaaggggagggagaaggaaauaaucucugaauuauuuaaaauauacaauauuuuaaauacauaaauuuaauguuagaaaaguuugccuaccauaucaucacagagaaaccaucacuuuggccagcacccauucccaggccagcauuugggcccugccagugacaaucagcaccagcaugacacugggugacacaggccagcucuaguucccagccccagaguagaaggccucaccacccucugcccugucgcaggucccacggacucagagaccagcccucucccucgaaugugacccacagcuccugaaagcccaaacauucaagaaaacacuggcucauucauguccaaugcuccagacacacuuccucacugacugacgcccagaggaccugcacagugucugacuacuguugggucccaacagcacuccccagaauccccaucugcuuaagucaggguaccuguucuccucaaucaucuucaguauuucuucugacgugacguuccugaaagcuucagaugggcucugaagagcuucauacuccgcaggggaaagaacuaguuacaggucaagaauauaauccaaccaaaauagaaacauccaacuagcuaggucaucucauagcaguggcauuucacagacagggaaacaggcucagagagccaaagaucacacagggcagaucacauaggggcagagcuuggugacucaguucuccgacucccagcccagagcccauucccugcccaggcuuuucugcuuuuucucaucacaaagccacugcaggcauuuuccuucugaccggaccccuuggguggugaaauucuaagcuccaacccuuccuucaacaaaaguggucugcccuagacuuugggcauuuggcugguucaacucuuauuuugacucuccauggagagugagccccacaggucuaagcugugggcauuuggcauuuugcugaggaauggauuugaaucccaggggccggucccucagcuagugaggaagccaaguuaaccuccuggcaagagcacugagcaacugcaaagguuuggauggagcucuugugaaugucacagaacacagacacccucagagaaccugacugcacacacgugcaaacaucucaacuugugaaauaaggcagcuuuucuacugcaagaaggauacgaucuucaaauuuauacacgucuucaggcuuggcugcaucaucauagcagggaggaagguagagggagucaucuugcaagucauuguggauagcaucgcugaccagagcuuuucaauaaagaaacaauccauguaucacccuguuuguuuccaguuccccaacauucuuuucagucugugcacuucagaccaccaaugguccagaaaccccaagucuaaaugcuucugccaaagugaccucgccuccccaucaggcugacugcuucaggacugccauguucacucaugaacaaacacaagcuaggcacuggagaagguggaggugacaagauuccccucagguaacuuacaauagaguugggauugacagcugugcuaauacauaaacauuuacaauauaaaaugagagaaacuaaaagugagggacguccaaaauagccuuuaauggcuuaacuucuagaaaaacuugccacacauuguagguggaacaaaacuuucagaauauaacacuguaacugccccacaagaauaacuccgcagccaggugugguggcucacaccuguaaccucaacauuuuggaaggccaaggcgggaggauggcuugagcccagaaguuugagaccagcccaggcaacauggcaagacccugucucuccaaaaaacuaaaaaaauuagcugagcaugguggcacacaucugugaucccagccacuugggaggcugaaguaggaggaucacuugagcccaggagguuauggcugcagugagccaugucugcaccacugcacucuagucugggugauagagcaagaccccaucuccaaucaaucaauaaauaaauuugugaaaguguugaaaucuauauaaucauaggguauggaaagauuuuccaaaaauuacuagaauuucauucuuaauagaaaaacugcucugcccagggcacaguggugugcgccuauaauccuagcuaccugggaggcugaggcgggaggacugcuugaagccaaggguucaagaucagccugggcaacauagcaagaccucaucuccaaaaucgguaaaaagaaaagcuacucuuacacaaacuugcucuuauguucuuauaauguauuugaacaauaaauacauuuuaaaauaauacaauuaaauacuccagcugcugaauaccggaaacagagccacugaucccaaagugaaaugccaccucuggaggcucauuuccaucaacacaucagccuuuuugaccaaagcuucccugcaacgcacaaggagagaccugaggccuucucccuccucugugcccugcaggccauaaccccagcaccauaagcacggcaggcauguauccauuccaugccugucccuguacuugacuguggaucacuagaagacaaagccaugucggauguuucuuacuacuuccagaaccuguccgugagaaggccuucagcaagaggcugaaaggaauccagcccuagcucccagcauuccauguguggguggguaaaagaucucaagagaagagaaagcugucauuaugggcagacucuuagcccaaguuccaacuucuuaccagucacacccuucguaucaaugauagucucugcagcuuuagccacugcacgauucaaagauucauugccaacucuguucauucuccugguguucagagcucgcuucuguuuggugguaccaaaggcuucaauacaagaauccaucuguuuaugagauaaaccugguuacuggggacaggacagguaggugcugccccuccuagcugugucacuauggggauacucucagcaucccagagugaucacuaccucaccugugaauaaggcugaaucgcaccuauuuaccucacaggacugcuguaagcaccaaaugauauuaacagauugaucaaucaacagcaucuccaucaguaagauauaaagacuugacuaggauuagggcuggcaaaucuguagcacauggcuuaccauucucccauccuaugcccguaacagacaggaauaguagaaugguaauucucccaucuuacacccguaacagacagggcuaauagaucacugacuccuucccccugaagcaaaaaguagccucacaacccuucucaauacagugcuccacacagcaccaaagauucaaucaguuugucaucuuggggugagaugaccuuuguagggaccuucuacauugaaaauccccaaguuuacuuuguuuuaacgugaauguuuucaggcuacaaccaauauauucuaaaacuuggacuaaauccuaaaaacaagcauuaugcuacacuuguaucagcccagagaaccgacuccaaacauuggcacagagcuguguucagcugccccagaugggagccagacuguucucugugggaccaaggaggcuucugcagguacaaacuaauuguccagagaaacagacugaaugagcggggagcagccagggagacccuugaguucaacaagcucauuucacugauggagaaacccgagguguagaaggaacuugcuuaaggucccacaucuuaauucuaucacacucaccuuuucucuguaaguuuuggucugacucucuagcgccaguucacucucaacugauacaucuaucaaaacacacaaaaacagagagaaagaaaagucaauugggaggccuacaaauaguaauaguguuuaauauucauuugucuaucuaagaauaauagauuucuuuacuauaggacuucccugagccuaacaugaguguauacugugaauauuuaauaugcagcuuuaguauacaguuaaagaacuuggaaaauaaauuagccaaaucaagcggucauccagcccaaccucuucauuuuagaaauuaaaaaacagaaggcccacagaugaaauuacuugccccaggucaguucaccagguaguggcagagacaggauuagaaaacaaguccuuggcucuuuccagaaaauaauuuugcuuucuuggugaaagaccuaaaagcaggcauaaacaugagguaugugguacuuaccgaugcucuccaaucaucuacaaaguacucaaauaagggcaguauaacuuaguacacaacaguacaagcucuggaguggccuugccuguuaucucagccaucaccccugauaaggucaucuaaccucugugccaguuucaucacugguaaaaaaagaacaacaguacuuacuccagaagguugguauaugcauggaaagugcuuagaacagugacuagcauauaguaaggacuuaaauguuaucucugugugugugcuaccuagaauaaacucauauuuacaaacuucuuacauauaacaacaaaaauauguuuaaucaacacguuaaauuacaauuuuccuugccucccuggauuuuacaagaacaguuggaagaugauuuaaauauaguuauauauguuugcaaagcagggggacaccuaggaaauucacagauggguguccggacucaagagaccuuuaaaauuacguguaaaauuuggcuaggcacgguggcucacaccuguaauacuagcacuuugagagaccaaggugggugaaucacuugaggccacgaguuugagaccagccuggccaacauggugaaaccccaucucuacuaaaaauacaaaaauuagccgagugugguagcgcacaccuauaaccccagcuacucaagaggcugaggcaggaaaaucgcuagaacccgggaggcagagucuucugugagcccagauugcaccacuacacuccagccugggugacaaagcgagacugggucucaaaaaaaaaaaaaaauuauguauaaaaucccauauuaaaaaaaaucccauauauauguauuuguguaucauauauguuucucagaaguagguccagguccuuagcagauucucaaaagggauggaagcacugcuuugagagaauaaaacuggaacuaaugccucugagguaucaggcagauucacaaugcucccaauguuucuuucuugucuaucgcccuauccugccaugguucccaguauuuaagggcaucacuaaggauucaaguucugagauuuaaggaacagaagccccuugagugugacccuuuuauuuauuauuuuggaagaucucacucuagcccugagcauucuaagaugacaaagcagagaaacaauguaaauucuuccacuggauuagggaaaaaaaauagaucuuccucaaauuaguguagagacuuguccucaacgugaaaguuacuauacaacuuaauaagcaauuuccuuugucuaccagaaauucuaaaaccucuuuaccccaacuauaacaguuaagaauuaagaaagaacccuuucggccagaacugccaucuugcaguaauucaucaaaaugacaaacacaaagggaaagaggagaggcacccaauauauguucucuagaccuuuuagaaaacauggaguuguuccuuuggccacauauaugugaaucuauaagaaaggugauaucguagacaucaagggaauggguacuguucaaaaaggaaugccccucaaguguuaccauggcuaaacuggaagcgucuacaguuuagcaugcugcuggcauuguuguaaacaaacaagggcaagauucuugccaagagaauuagugugcguauugagcacauuaagcacucuaagagccgagaaagcuucaugaaacgggugaagaaagaugauuagaaaaagacagaagcaaaagagaaagguaccuggguucaacugaagcgccagccugcuccacccagagaagcacacuuggugagaaccaaugggaagcagccugagcugcuggaaccuauucccuaugaauucauggcgugacagguguuuaaaaaaugaaagaccucuggacuguaaaaauguuucucuucauugaguagaagugugguguucucucccccaaagaaauauuuaaggcaaauuuuaauuauguccuaguucauuauguaaugucuuuacucuucaaauuuaauguauuucuugcugaaagacgugagguagcuuauugugcaacaaacuccucgauuguuuagaaaauggccagguauuacguaugaaauauuuguacugguuugaagauagucccuugaaaugaucaaggaagaaauaaaguaauuuacaaaaauaaaaaauaaaaauaaaaagaaugaaggaaguucuuuuauggaaaagauuuuauaucagacauguccucuaauauucugcucugaucauugcucagauugcuuuuaugaaccucugaccucaagucucuaaacacuauggggacaggaucugugucugucuugcuuacugccacauccacagccccagcuuggugccugguacauuagguuaucaauaagugugugcugaauaaaaaacucuaggccgggcgcaguggcuagcgccuguaauccuagcacuuugggaggccgaggcagguggaucaccugaggucaagaguuugagaccagccuggccaacaugguaaaacgcugucucuauuaaaaauacaaaaauuagccggguguggugaugugcaccuguaaucccagcuacucgggaggcugagguaggagaaucacuugaacccgggagguggaaguugcagcgagccaauaucacaccacugcacucuagccugggugacagagugggacugcaucucaaaaaaaacaaaaaacaaaaaacaguguguauauaaaaaaccauuuucucaacacagacaaagcagaaaaaacagaauaaauaaauuaaaauaacuauaaaauguguuuuauaaaucuaaaacucaagccaacucauccagcaaacccaaacuaugcauuauuucugucagcuuucaugacugggaccuaccugaaaauaguggcugcauguugaacaauucagcaucauauacuuccauuuggccagaggucuuguucaaaauucccacaaagugccugaauaaagaagaaauaauacaaauaacaauggauuauucaaaagcauuauuuguacagcuuucuuuuuuuuuuuuuugagacagagucuugcugucacccaggcuggaguggaguggcaugaucucggcucacugcaaccuccaccucccggguucaagcaauucuccugucucagccugcugaguagcugggauuacaggcgcacgccaccauccccggcuaauuuuugcauuuuuaauaaagauggguuucaccauguuguccaggcuggucucgaacuccugaccucaggugaucugacccuaucagccucccaaagugcugggauuacaggcgugagccacugcaccuggcccuguuuccuguucaaaaguucucaaccuucucucugcccacacaccugaggaaugcaucaucuacucauggguaacaauaaucuccccuaccccuaccccacagcaauucucugcauagagagggaauaggaaaggauaggaugggaugggaggauaugaggugguucugggaaaaaaaaaaaagcuacuaggugauucugauaguugaucacauuugggcucacugcgguaguguaauggaaaacucuuuugggguguacgaaccuagaauuacacuacaauuuauggcacaacaguuuuauggaggcaaaaucaaguaaacggggaggagaccaauuggaacuagggcaucucugagaggggagagugcaggguuaauaguucucagcaccuauacacccaucugaccucuccucuauuggaguaugguccaccggggcucagaaagggccuaguuuguaguucauuguuggguaccaucacagggcccugucugcaucaugccagcccccgagagugauacaguucaggcuggacaaucuucacuguacagagggggaggcugggggucagugaugcgcagaguuacccagccacucagucaaucagcagcacagcuggaugggaaucccaggcuccucuuucccaguccagagccuucaacacuaccaaguucuuuaccugucguuaguucccagguaaacuucacgcaagcuuugaccuacuagucacacauuccaaauuaauggagagaccugccuuuuggaauaagacagcuauaaauaaacaagauuacaaaugaaugagguuuuuaggaaauucaaguuaucuuuccuuuccagcaacgucuacacgugcagggaagggcucugggucuaauaggaacacagggaucaccuaguaaaccucucuagauggcuccugcuacccuuaaaacagacaggaaacagcagugccagugcugccaccacucccaaccccaucacccuucccacugucccuuccccugccauuaccugcacaaaguguugcauuugagggcuccagucccaaaauuguuucccacauaggagagccuaucuguuucagcugccuaaaaugcagagaggggaaacuccauuuacaaccaauguugaaagguauuaagcaucauuucucuuuucuacauuugcugaggcuuuugaauccagacucacaauggauuagaacuaguucaucucuggcagaugauccagccccacuaucucuaagggaauauggggugucccugcaggggaagcaagacgacuucuggaagagaagccucagauggugcuagcuucuaaaugguaugaaaagcucuugggggaauucugccacaagacuugagagagaggcccugggcuucuggcacuuaaagguaugcaacaaagugauucuguaagcaaucucucuuuggccuguucuuuguauacucucaggaccauggcugauucacuccccaaucauaagcaagcuuuccugcuucucugcauuuguccucacuauccuuuucacucgaaacaccaaacguugacugccaaacccucauuccagccuucaaggcucagcuccaacaugaccucaccaaggaaggcauucuggcagagaccucuccucccacugagcucacucugcccuguacucuuccccacguggccucagagcuuuguguaaaagugucccucacagccaguucucaucucucuagagcagagguucucaauccagggaaauccacucuggugcuacuggcaucuaaugaguagagacuagggaugcugcccccacagcaaagaauuauuggcccaaaaagucaauaguccugagguugagaaacccugcucuagaguaugaacucugaguggggcuaggccugauuuggcuguuuuccuagaagcuugcagcacagggaugcagaggggcagguuccauaaaugcuuguugaaagaacaaaugaaugaaagauggagccuguccccacaucccaggcugcugggcaucagaguucuucaaagcuccauuugcuacuacuccccuuuuucuccccucacucccucccacauccacccacucccaggggccuucugagcccugcagaguggagacagcuggcaacugcuucacuuaccaggauccguugauuccucuuccugggguugg

SEQ ID NO: 14378 - RNA, 5569 nt, Homo sapiens
uuuuuucagagcacuuauuacuguccuaugacugcugugcugcuguguauuuugcuuauauuuauuguuuguuuguuuuugagacggagucucacugugucgccuaggcuggauugcaguggcgcgaucucagcucacugcaaccucugccuccugaguucaagcgauucuccugccucagccucccgaguauagcugggaugacaggcacccaacaccacaccuggcuaauuuuuguauuuuuaguagagacggauuucaccauguuggccaggcuggucuugaacuccugaccuaaggugauuucucccgccucagccucccaaagugcugggauuacaggcgugagccacugugcccggcccauguacuguauauuagcuauuuaccugcuacuagaacauauauuucacaagagugggaaucuuuauuugaucuugucacuguuguaucucaagcacuuagaucaauaccuggcaaauaaaagguuaccaacaaauauuugucagacuaguaaaugaaucucugcaugaugguuguguuuaacguaucuauuggcuuuaacuaugauaaucaguugagguuaaucauucuuaaauuaugaucuagucugaauuaucuguaccuuaaaaaguaaaacuacuauuuuauuagcuaaggcauuaauuugccuuauauuauuuuucauuaggaucccucaguaucuuuuggaucaagcaaggcuaguguuuagaauuccuuuauuuuaugcugcaguggacuguacgugaucauaaaguguauugacuaguggaguuuaaaauuugcggcagguuauuuaaaaaugcuuuuaagauuuggccaauauuugaaaccuccagcaugauaauauuuuucauuuuauuacauugaccuuuuagcaaguauuuauugaguaccuguuaaguacugaacacauuaagucagucagugggauuaugauuaauagcaugagguuggcuuuagaaagaccuggguucacauucuugcucagcugcuuaguuuuguuaccuugaguagcuuuugaaacuuaguuucaaaaagcuacaaauccacaaauagggaugacugugcccauaguugagcacugaaauaauaguaagggcuaauaguguaauggcauguaagaaguauuccauaaauguuaguccuguuaauauuuuguuaucauacauggucaucaagcccugcccucaagcaguucacagucuauuaaaggaaauugauuccuaguuauccuucuaaguuccuucccuacuuugcccucacaauauuccagcuacacuggccuacuuauuuguccuugaauacucacucuaaugaugcuccauuguaggaccuuugcuuuaguuguuuccucugcuuguaacucuugagacagugaccuggcuaggucucaccucuggucauguuaaucauuaaaguauaauugaauaacugugauaaugaaaauuuuuacagaguauugugcuaacucagaccucuaguucaggguagauuucauuugagcuaccuuugaagaaggauuauuccaggcaaaagcaacagucuuugcagcuaaaaagagcauacauacaaaaguaaagcuacuguuauauuagcuaaggcauuaauuugccuuauauugauuuucauuaggauaccuaaguaucuuggauaaauuaagaguaguauuuagaauuccuacuaaauucugaauuugggaauuuagaauucacuuuuuuuuuggaaugacucaaguaugaggugaugaucaugaaugguggaaagaaugaaaaguuuauguacgggacaaaauaucuuugugaaauggaaagagcuacugaggauuaaaucgauauaguucagagccuggcaugaaguagguacacaguguaugauaaaauuauuaggcaggagaauacaucaaauuuauauuuuaagagaauucuaggagcaguguagauuggaaguagaaaagagacuagagaaagcuagcuagaagccaauacaaugauguaagggguguguagaugaugacuucauuuaaggcaguaguggcuauagcaaagagugauuuuucaguaaauaggauaaagauuggacauaagggaaaaagcuaagaaugucuuuuacuuuguauuucuagcuuacauuuuaagguuuaaauucuagcuugcuuuuuuacuguuuacagagaaaugcuugaauuuaugaugccuccaaacuuaagaggaaguuuaggaggaaaaucaauuuuuuaaaaucguugcaaccucugucucccagguucaagcaauucucuugccucagccucccgaguagcugggauuacgggcaugugccacuguucccgucucguuuuuguauuuuuagcagagaugggguuucgccaugugggccaggcuggucucaaacuccugaccugaggugaucugccugccucagccucccaaagugcugggauuacaggcgugagccaccacgcugagccuuuuuuugucuuuuaauaaaugguuuguauucuuuaucaugaccaguguguccaaauuuauucacuguuagguaaaugagugucuugaguauaaaugaguucagaccuuuuaguaaagaaaaaugaauaugugaaagcagauuauuauuagauguuaaagucuagauacaaguccagguucucuggauggcauuagucagcaaaucauuuuuucauuuuauagaauuuaccaaaguauucauucuugcuuauuuuucuuagaaugcauaaacuuguaaaaccuacuacugaaaagaaauauguggaucuuacugugucauuugcuccagacauugauggagaugaagauuugccgggaccuccaguaagauacuacuucagucaugacacugauuaauacaaguugucuuaacguuacuccaggaccacuugauuuuggaaagagugcacuuaauucagaagcuaaagaaaaucaguucauaauacuauggauuucucuuucauuaagccuuaauuuuaagggaaacaucaguaagaaacugcacugaagaauuauaaaacauuuuggggcauagcauacacuugucuaacgguucacacguggcuaugaucacaagcaacuuugaacuggaaugcuauuuacaaaaguuuuguguauuaaucuguguauuaaucucucuggauaaaaagaaggaaaaaauauguaugaccagaacagauauggaugaagaaauugaaagcaacgaaugcaacuauucaaaaaguuuaauuuuaugaauuucuuuuuuguuuagucuugaagacugauuuucuaugcaaauaguguuuggcauccugcaccucugauaugauuuggcuuugagaauuuaauaccacugggaagaaguaugguagugguggaugaaggguggauauuuuaaauugugcaguuacaguuuacuguccuauuaccucugcucguuuaaccaguuuguuauaucacuguguccccaaaaucaggauuuuuguugauagcaucaguguuguaggagcaauaggucagaugagacauauuaacuuagacuaaacgugaacaguauuauauggacucucacaacgcucuuagagaauccgugaaugugaacagacaaauguggcuaaccauuugauucuucaguaugccuucuaauguggcuauuuuauuuaugugagacucuaaaccugauuguccuaauauauaaaacuaaaagauuuuguaaagggagugucuuuagaaauagaugaaauguagaauguuaaaaauuauugcuaggguagucuuuuuuuuuuccagaaaccuaauuaggguauuaaauuuuguguuuuuuuuguuuuuuuuuuuuaaacagaagcauguuauuucauucccauucccagaaagggaguuaaugaagauaaaaauuuauuuuuuaaggucuuuauugagagaaacuuuguuuucugauaugaacuauugcagauguuuuuauaaauacuuucauuaaaaugauguaaacaguaguacccaacacuguaaacucagugaaaauaguaaaugauucuuuuauuacuaagacugucaugcauucugaagcaguuggcuuuuuuuuaaccauaggaaguaauuucccucuagcuccuuuccuucuacucuccugcucagaccauuaguagguacuuuguuaaauaaaaaacuagauuaacaucaauauuacuccaauuugguaucuuuuacacuauguauuauaccuacuuucuuuuuauuucauuuacaaauaguuuaaauuacuuuaucaaccagcuguauuguuucccucuuguaaaaguaccaucaaguggggaaaauguauguggaaguggagagugaauuuguaugacuaaaggauaaucuguacauggggaagugggcaaaaguggauaggaugaauuuaaagaaaaugacuaccuuuggaaaaaagaaauuaaauuuuguucacauauccuacccuuucccauugugcauaucccaagugucauauuuaaaacuaagguuacuuaaaacagaauccaggaauaucaaggcucuguggcuuggaauuuuagaggauaggacuaauaaaaggacuuuugcaaagaaggcuuuuuuccacguucacuuuguuuuguguucuuugaaaguaacugauacuuuucggguaguuaauucagcaguccauaaauaugauccaguaacuugcuuauauuuuauugaagucucgacagcucuucagaaguaaauuuagaacgaugcugucaguucauauuuauagauauuaguguuuuagcagauaaaacaaaaucaacaaaaauuaaguucauuuugugauuaaaccugcaaccauuuuuccauuacuuuuuuucuauaguuaaugguuauugccaugauuucuucuguuugguucuacuaagcuagaaagccagggugaaguuaaugauaauucccauuauuuuauuucuguaccaugagauugcuguugaugacugaaauaccaggugcaaaaauuaaugauuugauuuuuguacaguuucaaugaguauuuuuuacuuauuaaaaauaaauuaagaaauguaagaauaucuuuguaaaucauguuucauaaguugacuccagagauucugauuuugcuguuuauuuugugaguaauguugcuuugguguuuccugauuuucaaguuugcaaucauggagauacagcaguuauuagguguggaaggacauuaccucaaauguccucagauggcuccaggaaauucuuuuaaaacaguuggagagaaauagucgugaccauguaaaaccuagaggaucugguaaaucccauacuacugguuagggauuuguaaaguccauuucuuuuuagaguucaaagcaguucuguuacuuguccauaaguuccucauaaauugucccaaagguaggacauggaaauaaauguauaucuuuauuuuuuaaucuacuaugucacacucuggugauauucauggaacauuaaaaaagcaacuauguuuauuuuauaauuaguaaaaugaagauagaaaauuguucuuuugaaauuuuuagggaaaa

SEQ ID NO: 14379 - RNA, 1116 nt, Homo sapiens
aggacagaucagacauuguguaaugaugccugaaauaaacacugaccaccucaacgagcaacagguucaacuccuggcagagauguguacacuuauugaugaaaaugacaauaaaauuggggcugagaacauugagaaaggguuauugcauugagcuuuuagugucuucuuauucaacacugaaaauaagcuucugcuacagcaaagaucagaugcuaagauuaccuuuccaaguuguuuuacuaauacuuguuguaguuaucuauuaaguaaaccaggugaacuugaggaaaaugauggccuuggagugaggagagcagcacagaggcagcugaaagcugagcuaggaauucccuuggaagagguuccuccagaagaaauuaauuauuuaacacuaauucacuacaaagcucagucggaugguaucugaggugaacaugaaauugauuacauuuuguuugugaggaagaauguaacuuugaauccagaucccagugagauuaaaagcuauuguuaugugucaaaagaagaacuaaaagaacuuggggaaaaaagcagccaauugugaaauuaagauaacgucaugguuucaaauuauugcagaggcuuuucucuuuaaauggugggauaacuuaaaucauuugaaucaguuuguugaccaugagaaaauauacagaaugugaauauguaggugaaugauuacugaaaaauuucucuacuuaacaaauuuagaaugacuuuuuucauuuaaauuuaguuuacuaucaucaauguauuauauacacugauacuuuacaacuuguguggaaaaaaauaacuuauaauuuuguaucacacaccuuguauauguguucugcuucuaaacgacauuuaugagagauuauugugaaaugagugagagcaaauaaaaauuuaaccugugcagacacacaugcuuauggcaaauuugaacaaaugagugaagccccguguuuuuaguaagcugugauaaacauuuccggagcacucgcagagcacuguuauuuuccaggugcuuuauguaucguuaaauuuuuaucauaguucagaaaaaugugcaaaggaaacuauugcuuagcuccuucaaaacaguccuaa

SEQ ID NO: 14380 - RNA, 913 nt, Homo sapiens
auuuaaaaaaaggaagguuggaauccaucaguguucuauuuagucaucuucuccuucauccuccucuccuuccuccccuucaucauuaucuucaucuucuucaccuucauccucauccccuuauucaucaauaucuucuaauccuuccuccucuucaucaucaucaucaucuucuucuccuucuccuucuucaucauccauaucgggaaccaaguaguacuguaauggguuuggccagauaucaucuuugaugaccucuccuaacucaucagcaccugcaucagaauggucaguaaaccagguaaagaagcucucugguuccucaugcugccucuuccugcuggcuuuauucuguguuugacuugaacguuucgucaaauccuuuccagauuuccauuugauuucgguggacuucgaagauggaucaccacucucauucagaagaaauucuuuggagagaacuuuauuuucaaaguaaggauuuucaucaaaauaaaaaucuauucuguaaccugauuuaauaucuucaaauucugucacuucaacucuggucaaauaaugcagugccucuucgucuuccuccccaagcagugcagacacuuguggauggcugacaaauguuguuacccaaaaauuugggauuuuggcgaucaauucugaccucuucugaaaaaaugguuggcggaguuuguuauauuucuguucuacuuucaaaaucuccucacuggcuuguucauuaagucugucuguuucauuuuguacuucaucaauguguucaaucgcuucuugcuguucuuuuucucccuucuucagcaagccugcagaggccgaugucuccuccggucacagagcaggagguggucuugguuucuucuuuugaggcuggaguggagacuggcguuuaggcgccaug

SEQ ID NO: 14381 - RNA, 913 nt, Homo sapiens
cauggcgccuaaacgccagucuccacuccagccucaaaagaagaaaccaagaccaccuccugcucugugaccggaggagacaucggccucugcaggcuugcugaagaagggagaaaaagaacagcaagaagcgauugaacacauugaugaaguacaaaaugaaacagacagacuuaaugaacaagccagugaggagauuuugaaaguagaacagaaauauaacaaacuccgccaaccauuuuuucagaagaggucagaauugaucgccaaaaucccaaauuuuuggguaacaacauuugucagccauccacaagugucugcacugcuuggggaggaagacgaagaggcacugcauuauuugaccagaguugaagugacagaauuugaagauauuaaaucagguuacagaauagauuuuuauuuugaugaaaauccuuacuuugaaaauaaaguucucuccaaagaauuucuucugaaugagaguggugauccaucuucgaaguccaccgaaaucaaauggaaaucuggaaaggauuugacgaaacguucaagucaaacacagaauaaagccagcaggaagaggcagcaugaggaaccagagagcuucuuuaccugguuuacugaccauucugaugcaggugcugaugaguuaggagaggucaucaaagaugauaucuggccaaacccauuacaguacuacuugguucccgauauggaugaugaagaaggagaaggagaagaagaugaugaugaugaugaagaggaggaaggauuagaagauauugaugaauaaggggaugaggaugaaggugaagaagaugaagauaaugaugaaggggaggaaggagaggaggaugaaggagaagaugacuaaauagaacacugauggauuccaaccuuccuuuuuuuaaau

SEQ ID NO: 14382 - RNA, 12307 nt, Homo sapiens
cgcaugcgcuuuaugcccgcuguugcuggcgcgugcgcguaucagccuuggcuggccgguguauguccgcuggauugugaggcccgggaucugggcuccgccguggugcagaaaugcugugccggcucggcggucgguggcugcggccgcucccugcccugcagcuuugggcuagggaccugccgcuugcgccgguuccuacgagcggcgccaagcgccccacucucccagugugggcaguggcaccagucucugcaguacaugcgaacggcugguacgaggcccuggccgcgucuucgccggugcggguugcggaggaaguacugcucggcgugcacgccgccacgggccugcccugguggggcagcauucugcucuccaccguggccuuacggggugcugucacgcugccuuuggcagccuaccagcacuacauccuggccaaggugaggggcgccgagccgugcgcguacccugcgcugcaaccccugcggcggaggaaggccgacauucacucaggguuuucgaucgcacgauguugccuucugcagugcuuaguguuuaaucaucgugaccauuucauugugaccauuuuagcguuaaaaaaaauugaacuagcauuagguguguuaaauaagauacuuugugacacguguaccugucauuucuuuugucuuacuggauuugugcuccaagcacaagugguuacuauacuugcucucggggaacggagacaaagaaaucagucgcagaagaaauuguguuggcgaaaccuacaaaauuuaugucuuaaaaguuuuaauagccaguaugucugcagugucuuucgucccaaaguauuccagcuggucuuucuuauuaggaagaaacuacuagacuaacaguuugcgaacuuguuuccucuccagacccgacuaagacugugucugguuggucgcaguuacuugaccuuuuaaugcugaauccuuuuuucugaggaaucaggcuagcaguaccuuccuugccuacuucacagcguuaucagagcaagucagauaauacggguuaaagugcuugauuauucaaaugggauauuucaaaaauaguggcuuucuuguuuucagguugugagcauggggaaaaaaaaccggaaacaaaacaggaacggaaucagcagcaacauuaaggcagugagccauuuuacaggaagaaugagcacagggcaggaauaaaugcuauuuuuacuuuugauuuguggcuaucacaguguauuaaagguucuuaacaaacugcuguuuucuccgcuuacguuacuaggaaauguagagauggaacaguaaagcccagggugcaguucuuaucuaauauuuguaacccugugaaguaggugcuguuauauauuuuauaugugagggaacaugauuuuagagguuaaguuacuugcacaggaucacauggauaaguaugcauugugaauuugguugugacugaggacauuuuaagcaaauuaacaucuugugcuuagaauuaagauuucuugauaugaucaguaaacuacauuuuuaaaugacucgagggaauaaugugaaagauuaugagucauuaugaauaaagauccuuuaugugcucauaacaaaaccuauuuuuuagcuagguggaaaauuugcagccagaaauaaaaacuauugccaggcaucuuaaccaagaaguugcaguucgugcaaaucaguuggggugguccaaaagagaugccagguaagcuaauuauauccacguaagaccauacgcacacauacacacacacacacacacacacacacacacacacauacauaaauugugauguuaauuauaaguuugaguauucuguaguuuuggcaguaaaguauuucuuuuuuuauauauauauauauauauauuuuuuuuuuuuuuuuuuuuuuuugagacggaguuuugcucuuggugcccagucuggagugcaauggugugaucucggcucaucacaaccucugccucccagguucaagcgauucuccucccucagccucccagguagcugggauuaacagguaggcaccaccaugccuggcuaauuuuguauuuuuaguagagaugggguuucuccauguuggucaggcuggucuggaauccugaccucaggugauccacccuccucggccucccaaagugcugggauuacaggcgugagccaccgugcccagccuacucuuuuauauuuucauaaguuauuaauauggcaugauaguuucauaugcuggacugaaagcaaagaaauaaauagauaaagauaagaagaguauguuccuauucuuuagggauuccagccuauugaaaaagacagaccuguaaucaaauaaugaugucagugaacuaacuguuauauaaagaugauguacaaggagcuagaucaucaaggaaggucagggcaggguucacaggaugaaggcacuuugccauucuuuugugauauuggucaacaaaugacacagguuauuuacaaucuugaccuuuuggaaaagauacagcagguaauagccuacaggaaagaggagguagaaaacaagugccacaguagaaacacuuugauagcuaagaugcugucuauccuuugugguuauucugugcaguugucugccuggguucuuggaaagucccaaucuaagggugcuugauugcgcccaaggaugucugcauucauucacugggaacuuacaagcccucuugcuucaaucaacuccucaaucaguuucccaaacucuaauccuuacuagacugcgaaaaauuauucuccuuuuuacagcaauggaaaaaggccuuugugguaucaaucuguguuauguguauauuauuaaccauauauuuuuauauaguuguacauuucccaacuaucuuuaauacgagauuguguccuauauuuaguguuaaaaagaucugacauuuuaaaaaaucguggugauagcuuaaugucuuuauuugguaaaaauuaaaaguugaccuauagguuugaaauuuuacuuaucaaagaagucgaaagcuucagccauaggccaaaagaaccagauuaauagcugcuugccuggguuaucaacgcagccuagauaagacuuguggcaccuugcuuaagcaguacuggcaggaugguugugcagauacagccuuacagauguuucuuucuaggaggaaacaucugagggcuucuggcauuuucuuuucuuuucuuuucuuuuuuguuuuuuugaacaagacagaaucucccuguguugugcaggcugaucucaaacuccuggccucaagcaauccucccacuuuggccucccaaguagcuggaauuacaagugcaagccacaguguuggccagcuuccugcauuuucaauaguauugagucuugaaggguaaaagacggugugucagauggacagccaggaaagugggcuuuccacacagaugauauaauacaguacuuccaaaggcaugccuaugcggaagucugauuuguuggaugaacuaaagucauucagaccagaauaugcaggugucuagaggaguaacgagauaaaauuggaagaauaggcaaaugugaaauuauggaggaccuagaaugucuuuguguacugucuuauuauacacuauaauuugacuaaauucagaaaaacuauugaaugccuccucuguacaaaauauaugauacaggagauuuaaagaugaauaaaauagaacacuguccccuaaacuaagaauacuuuaguuuuuguuuuuuaacuccuauucucuuggaccugaaggaagacuguauucuaaaaaguaaaauuucaggaaaaaacaguaguaacuaauaugguuaacagagaaacagauuaaaaauaucuuugugagauaguugauugaaaaauggagacuauuuugacaggccaagagcauacacaguauaaaaccacauagcuccaaaagguauauucagggaugaagugguuaaguuuggcgggaguggagagauuugauuaaaguuugcuuuuagcuuccauauuuccaauauuaauuguaguuauaccaugucaguagugaaauuuaccuuuaaagccuaaucagccaaagaccaccagagacaaagccuguagucugacaauuucagauuguuauguaacuuguguaccauacuguagaaguuuugauaaaaggcuuuauuugccuguuguuuaggcaacuccuuaacaugccugugacagcugaaacccuuauacaaauccuuuagcuaauaacuacagcaggcgcuauuugugcuauggaaauaaagcacgauucuuagaugacauuuucucuuuccccuuuuuucccccuaaccucaaucuaggcucacuuaucuaaagaauaugaggaggcuaauuucagagcuauaugugcgagauaacugccacccuuucaaagccacuguguugguuuggauucagcuuccaauguggaucuucaugucuuuugcucuccggaauuuaagcacgggggcagcacauucagaagguaauuauuguaugucuucucccaaagaaguucucuaacauugucuuuguacuaaaaaaaaaaaaaaaaaaaaaaaagcauacuuuucauaauuacgauauguuuacuaucuuccuuauaaggguauagaauuuaaagucuuaaguguaaacagauugguuguguugugaacauuuuguauugagaaaaaauauauauauugugcgugaaaaacuggaauaaauccagugcagaucuuuccugugagggacaccuuauuggaauugucagacuacuuauuuaugucuuauauauuuuucucugcuauuuuuaggacuucuauuguuuuauuuauaaaacuguuuuagcagguuuuucuguucaggaacaguuagcuacugguggaauucugugguuuccugaccucacugcacccgacuccacuuggauucugccuaucucuguuggcgucaucaauuuguuaauaguggaggucaguaguuuuaaaugaaauuuguuugccauuuauggggauuuuuguugcugcuguuuugacuucaaaucuguuuuuguuugaguuggugaagauagcucugaguuagaagugagaucccuugguuccugguuccacgucaggcauuggcuuaggccugucccuuaaccucucugggccucagaacucucgaaauuaaaguaaaagcacuaguauacuuccaagucucuuucagcuucaaaauuauaugauucugauacauagaauuuugugacuugcuuuuggcaaaaacaguaauaaagaugcccagucaaucugguuguauucuuaaaauagagugauguuccguguguguguuuaauaugugaauuuguaggcggagaacacaagucaggcccugacugcuauuuucuugcuuuaugaccuuagaaaagucauugaaugucuuuauaagaugaaaugggaaaaacauacacauagaaaaugugaccucucagucaugucuuuuuuuuucuuuuuuuuuugagauggaguuuugcucuuguugcccaggccggaguguaauggcgcagucuuggcucacugcaaccucugccuccugaguagcugggauuauaggcgcacaccaccacacccggcuaauuuuuguauuuuuaguagagacaggguuucaccauguuugccaggcuggucucgaacuccugaccucaggugauccacccgccuuggccuuccaaagugcugggauuacaggcaugagccacugugcccagcccucucagucaugucuuaacccuuaucacaggcugcuuuacucagcaguuuagggaaagcgugcauauaauuucauaaauuguucucagacucugaguagaacagacuggacuggaagaaaucuuaaaaaugauuuaccucaguagagaucucccagaccucaugaccucugaugccuguuugugaaaucuaauauaccccuuauucuuucagaugaggaaaauggagaugauagaauauaaggucuuaagugaaaguuucuugaggaaagacucuaccuguaguccaaauauguuucccuaagagcacuagcacaguccccugugguugguguucagugaauauuugguagaaagaaggaagugauaagcacaagguuacagugaaucaaugucaauccccuagucuuuuccucuaugucaucuaaagacuaauaaagguguuuucauagcggggcaugguggcgugcgccucuaguuccagcuacuuggaagcugagucaggaggauuguuugagcccaagagauggaggcugcagugaguugugaucccaccacuguacucuagccugggcgacagagagaaagaccucaccucuaaaagaaaaauaaaagcuuauuaaaagcuuauucuuacucaacauacacuaugugcaaggcauuguguuuuuuguuuguuuguuuguuuguuuuuuucuugagacagagucucacucuguuuccuaggcuggagugcaguggugugaucuccacucacugcaaccuccaccucccagguucaggugauucucuugucucagccucucgaguagcugggauuacaggcgcccgccaacacacccagcuaauuuuuuguauuuuuaguagagacuggguuuuaccauguuggccaggcuggucuggaacuccugaccucaaaugauccgcccgccucagccucccaaagugcuggaauuacaggugugagccacugugccuggccauaggcauuguuauaagcaauuuacauaaaucaacucauuuacuucuuggaauaacccugugagcuaaauauuauccuuuuuuaaugcagagaaagugaggcauaaaaauguaaaacuacguaguuuggcucuagagucauaauuauggagaagucuuuuuuuuuuuuuccuucuuuucuuuuuuuuggagacggucuuacucugucacccaggcuggagugcaguggcgugaucucagcucacugcaaccugugccuuccaggcuuaagcgauccucccaccucagccucccuccugaauagcugggacugcagacaugccaccacgcccagcuaauuuuuguauuuucuguagagaugguuucgcuauguugccuaauugccuaggcuggucucaaacuccugagcucaaacaaucggccugccugggccucccaguucugggauuacaggcccccagccuuacgcagaauucuuaaguggagcuugaagaauccugugacaguagcuaccauauaaaucauuguuaaguggagcuugaagaauccugugacaauagcuaccauauaaaucauugcccuuguuuuuugguacaaagugucaaaaaaccuccguuuaagaauuugacauaauuaguguuuuuuuuuuguugucguuuuuuuuaagagacaggaucuugcuguauugcccaggcuggagugcaguggcaugauuauagcucacuguagccucaaacuucuggacuagagugauccuuccaccuaggccaguuaagauuuuuaaaagauggaugaucaagcugagugcagugguuggugcaugccuauuaucccagcuacuugggaggaggaggcgggaggaucacuugagcccaggaguuugagaccagcccuuaaacuggucucaguuugauagcaagacaggucucaaaaaauaaaaagaugaucagccauauaaauuaaucaguguuuuguguguauauauauaacuuuuauuaaaguguagauggaggccagugaaaaaucaguuuauauuuuaaagcuugucugauuuaauaugcguuuuaauaaucauuaugcauguauauguucuaccccuucagauuugugcucuacaaaaaauuggaaugucucguuuucagacguauauuacguacuuuguccgugcaaugucgguguugaugauaccaauugcugcaacgguacccucagugaguaagcaccaauauuguguguagcaugugcuaaauccucucugacuuuagcuuagacuggcugggauccugccucuucuuuuuuuuuuuuuuuuuuuuuuugagacggagucucgcucugucacccaggcuggagugcaguggcgcgaucucggcucacugcaagcuccgccuccuggguucacgccauucuccggccucagcguccugaguagcugggacuacaggcgccugccaccacgccuggcuaauuuuuuguauuuuugguagagacgggguuucaccauauuaaccaggauggucucgaucuccugaccuugugauccucccgccucggccuccgaaagugcugggauuacaggcgugagccaccgcaccuggcugggauccugcuucuucugcugaacuuccucugacuacuugaucccuuaccaaaucaguguuucugugguaacuaaucugucucuauuucuugccuuuuuuuaaauuuugcaacguguuuugcauaauaccaugaauaugguauuucuuccauuugacuacuugguauauugaauuaguucugccuauguagacuggagcaaagaauuuagcacuuaaaaagaaacaaaacaaaaugcuaagaccauuuggguuuguguaugguauuauuuaaucucauaacaacucuaugaaauagguaaacuugucccuguauauaccuaauuaaucuuuauagaaauagaaaaagaaaugguuauguuugcaguuaguucagucuuuugcauguuucccacaaauacuuuagaaguuucuaaggaggcaaaagcuguguuagguauaucuccauguuuacucagagcuaacacauaaagucgaauucaguuguuauuaauaguuaggguguagcauauauaaaacuaccucacaguauuuuuuuuuuuuuuuuuugagauggagucuugcucugucgcccaggcuggagugcaguggcgcaaucucagcucacugcaaccuccuccuccuggguucaagugguucuccucccucagccucccuaguaccugggauuacaggcacacgccaccacacuuggcuaauuuuuguauuuuuaguagaggugggguuucgucauguuggccaggcuggucuugaacuccugacccaggugauccacccgccucggccucccaaagugcugggauuacaggugugagccaccaugccuggcccacaauauuuuuuauaggaaucuaaaacaguauguuuuugcuaucaaaaucuauuuuuuaggcuguuacugaacauaauacugucauuaauccuaugcagaauaaguuuguucaucucuaaaauagauaucauaaugccugugagaauuaaugaaaugagugccuauuagagaacuuuuuacauaaaguaguaguguuguaaaauacccuguaaaaguagaacggcacagauucacuacauuuccacagagcaaucauaccagcuauauacugaagaacgccucagauaaaauaaaauacgagcaguuaaguuuuaaugagggauugaguucaaaaugaguaacaagagaucuaaaacacaaugccuuaaauacccaaaauuuauccugucaauuauaggaaaucugauuaagcagcuuagggaugaugagacaaguccaugaagaugagagacccagacugcugcucucuuucugcuuuguuauccacagccugugauuucaaggcuacacuacggucauggcuguuagagcuuguuaucaugcaggaauagaaaagggugccucaagugcagucagccccuuuuaaggagacuugccagauguuccaccaaacaguuguguuaacaucuuaguuuuaugaccaccccucacugcagaagaggcaaggaaauauagucuuuuuuuuuuuuagaugacagccuacucaaauaaaaauuaagauuuuguuacuaaggaagaggggagauugauacuuagcuggcaacuuauagacugcuguaguuggccgcagguucuuuuucuuuugguggauaaaucagauaaugaugauagccaauauuuauuuaacacugacuuugugcuaagcacuguuuuaaaugguuuacauauuuuaccccauguaauugucccaacagcgcgacgauaaagguacuauuauaaucuucacuuuggugaugaggaaacugaggcacagagaaguuaaguaacucauccaaggucacuuagcuauaagugauagagucuuaacacacaucuaagcaguuuggcuccuccucuuaacuacugugcuaaucuaccuuugaggaugugcugcuuucugccccuaaagacugacuuuggaacaaauaacaaauguaagugcugaauguggaccacauacuugcauaccacucuacaugaauuaucucauuuauuccucacagcaauccucugagguagaugcaguuacuguccccacuuuacagaugaggaaacuggaacagaaggaaaauaacuuacucaaagucaaauagauggcaaguaggauucaaauucaggcaguuugccuccaggaccuagacuuaacaacugcaugauuuuguuucuggggccugauuaccuucugaugcuaaagaaaaguuuggaacagguguaaguauaggaguauuucaggagguuguagaacuucguauugaccuaaauaaauggucacccggggccacagaccaguacugguccauagccgauuaggagccggcugacagcaggaggugaguggugggcaagugagccuuaccaccugagcuccaccuccugucagauuagcagcauuagauucucauagcacgaacccuauugugaacugcacaggugagggaucuaggguguacacuccuuaugaggaucucauuccucaugauacgaggaauggaacaguuucaucccaaaaucuuccuccuguccauggaaaaauuggccccuagugucaaaaauguuggggaccacugcucaagaugguaauacaaaagaaauuuggagauaaugcugaggcuguuugucucagaagaaggcaaagaaaaugcauuccuuacuacacugagaaacuggcuguugggaaacauuuggaagauagaugacuguauggggaaaauuagguguagggaggcuaaguuugccaucauaagugccacacuuccagcauucuaccuucaguauguaagcaguuggacaggacuuuugguggggaaaaaguuauguuccauugucgaagaagggagauaagaucucucuugagccucugccuaggagcuucucucuuuuuacuuucuacccuaaauacuucucuuuuuccuuuauuuuugcuuuuuggucugucuguaaccuuuuuucccugucuauuaaaucuaucccaggaaucuaguagcugcugcaagucuugcuuagucuuggcauacuuguauuuacaaagauugucauuuuauuuuuuauugucuggacugugauguccuuguagaauuacagaugcuaacauuuaugucuucucuuuauagucaauuguucucuacugguuaugcuccagcuucgugggccuuucacagaauuugcugcugcguucuccuggauuucgccaacuuugccgaauaccaucgaccaagucagauucagaaacuccuuauaaagacauauuugcugccuuuaauaccaaguucauuucaagaaaaugacauauuuuccaauaauuuugaaacaguugcaggagucacuaucaucuaaauguauuuagacuuagaaauucagauguuacuugauuuccuuuuauuuaaaaucauuaacuucaugaaauauuguagguuaagauguaauccagaccaggcacaguggcucaugccuguaaucccagcacuuugggaggucgagguggguggaucaccugaggucuggaguuugagaccagccuggccaacauggugaaacccugucuguacuaaaauaacaaaaaaauuagcugggcuuaguggcaggugccuguaaucccagcuacuugggaggcugaggcaggagaaucgcuugaaccuggaauacagagguuucagugagcugagaucaccccauugcacuccagccuggacaacaagagugaaacgcuaucaaagaaaaaaaaaagauguaauccagauauauuugacaguaauuaaaaucuuuuaaauguuauaaaugcaguauguuugugaaaguauuagaauagaaccaaagugccugucucuguuuauaaaguuacaguuuguuagagcuaccagaacuuuggagaauaggguuagcuacugaaugauggcaaguuaaacuaaacaauacugcauauuacuguuuuguaaaauaagagga

SEQ ID NO: 14383 - RNA, 2007 nt, Homo sapiens
aaguuuccuggaugcaauguaaggaggggaaacccugagucaaaacccugagcugacagucugaggaaguugaagaggcuagaguuggcagggcagauucuggaaagggggaacuauacagaugagaacucuagagaucugaagggaauguccuuggauguucaguugaguauugaucagaacaugcaugugaagaaacuacccagaacuggggaaagaaucacacacagggauuagaggaaagaguauuuguagcucauauauggacagggauagugccuguucccaacagccagauuggaaaaccacauaauuuagaagacaucagacauuuuuuuuuuuaggauucuaagaagaaucuucccucagugguggguaagauuuaauccuagagguugggcacggugauucacgccuguaaucccagcacuuugugaggccaagguggguggcucaccugaagucaggaguucaagaccagccuggccaauacggugaaacuccgucucuacuaaaaacacaaaauuagcuaggugugauggcacacacuuguagucccagcuacucaggaggcagagacaggaggaucacuagaacccaggaggugaaggcugcagugagcugagaucaugccacugcucuucagccugggcaagacagagcaagacucugucucaaaaaaaaaaaaaaaaagauuuaauccuagacuaaaugcuuuuuggucuuuucuagcgcagcuuaaaagcaaaauuuccuagaaccagugauaaagaaacagugauuaaaucaaccaaaggaaaaauauacaugauauaaagagggccaaagguaaagaugagagauuucuuaucagaagcaaugcaaacuagaagagaguaaagcaauauccugaaaguacugaaagaaaaaaaaaaacuuaucaaucuagaauuuuuuacccaguggaaauaucuuucaaaaacaaagaugaaauaaggauauuuucagauauuaaaagaagcugaaauaauucaucacaagcagaccagcacuguaagaaauaguaaaggaaaauuugguauuuuuuucuuuugcuuuuccuucaagcaaaaggaaaauaauaccaaaugaaaaccuaaauaaaagaauggagagcaucagaaaugguaacaacaugaacaaauauaaauacauuuuuauuauuuaaaugucuuuaaaagauaacugacucuugaaagaaacaacaaauauaaugauaauguacuauggcaggggucccccaacacccaggcugcagaucaguacuggaggugaguggugggcaaucgagcauuacugccugaacucugccuccugucagaucaggagcagcaggcaucagauucucauaggagcacaaaugguauugugaacugcacaugcaagggauccagguugugcacuccuuaugagaaucuaaugcuugacgaucugagauggaacaguuucaucucaaaaccguccaccccacaauggucuguggaaaaacugccuuccacaaaacugguccuugaugccaaaaagguuggggaccacuguacuaugugguuuauaaaauauauagaaguaaaauguaaggcaaaauaguacaaaggucaggaggggaaaauagaauuguacuauuuuaagguucuugcgguauauguuaaguaauguaauaccacuugaagguagaacauaacaaauauguauaauauaaacccuaaaucaauaacuuaaacuuuauguccuauuacugugaauuauaaagaauuauagcuaauaaaacuuuauauaucguuauugugaauuaaaaagaauuauaacuaguaagccaacaagggugauaaaauggaauaaauauuacacaguuuuucuaaaagaaggcaaaaaaggaaagggggaagaagaaaagauggaacaaacagaauacaaauagaaccaaaauuaucaauaauuaaauuagauguaaauagucuaaacucucucauuuaaaaaccagagauuauu

SEQ ID NO: 14384 - RNA, 2147 nt, Homo sapiens
gaguuuccugccagucgggagggaugaaugcagauaaagggagugcagaaggcacgaggaaaccaaagugcucuguauccuccagucuccgcgccuccacccagcucaggaacccgcgaacccucucuugaccacuaugagccucccguccagccgcgcggcccgugucccggguccuucgggcuccuugugcgcgcugcucgcgcugcugcuccugcugacgccgccggggccccucgccagcggugagagcuccuggcacuggggugcaucccagccucugcggggccgcugcguuccagggaacucucccagcaaccugcccuauaaaaaugucuuucuuccccagcugguccugucucugcugugcugacagagcugcguugcacuuguuuacgcguuacgcugagaguaaaccccaaaacgauugguaaacugcagguguuccccgcaggcccgcagugcuccaagguggaagugguguaaguucuccuguguugcuguguccacugugacuuaggcaaguccuccagccugggucgucaaccuuuguggcucaugggugcauccucuuuuucuuuacuucagagccucccugaagaacgggaagcaaguuugucuggacccggaagccccuuuucuaaagaaagucauccagaaaauuuuggacagguauuugucccuuugaucuuugugguguuuuaauaucuucuauggaaagcauauacuucacaauguccuuauucucucuguaggauuuagacuaugcuuagaauuauaagguuguuaagaagaauaaggaaacuuuuuuucuggaauguucuggguaaaccuuuaucaccaaucuuacaugccugaacaauuacacagagcucauuacugacaucuauuuuuugucugcucuuugcuuuuauugauuuuuuucccccaccaaacgcuuuugaaaaccaaauguagcauacaagagugugggaauugguuauacuaauauaacucuuuucucaacaguggaaacaagaaaaacugaguaacaaaaaagaccaugcaucauaaaauugcccagucuucagcggagcaguuuucuggagaucccuggacccaguaagaauaagaaggaaggguugguuuuuuuccauuuucuacauggauucccuacuuugaagagugugggggaaagccuacgcuucucccugaaguuuacagcucagcuaaugaaguacuaauauaguauuuccacuauuuacuguuauuuuaccugauaaguuauugaacccuuuggcaauugaccauauugugagcaaagaaucacugguuauuagucuuucaaugaauauugaauugaagauaacuauuguauuucuaucauacauuccuuaaagucuuaccgaaaaggcuguggauuucguauggaaauaauguuuuauuagugugcuguugagggagguauccuguuguucuuacucacucuucucauaaaauaggaaauauuuuaguucuguuucuuggggaauauguuacucuuuacccuaggaugcuauuuaaguuguacuguauuagaacacugggugugucauaccguuaucugugcagaauauauuuccuuauucagaauuucuaaaaauuuaaguucuguaagggcuaauauauucucuuccuaugguuuuagacguuugaugucuucuuaguauggcauaaugucaugauuuacucauuaaacuuugauuuuguaugcuauuuuuucacuauaggaugacuauaauucuggucacuaaauauacacuuuagauagaugaagaagcccaaaaacagauaaauuccugauugcuaauuuacauagaaauguauucucuugguuuuuuaaauaaaagcaaaauuaacaaugaucugugcucugaaaguuuugaaaauauauuugaacaauuugaauauaaauucaucauuuaguccucaaaauauauauagcauugcuaagauuuucagauaucuauuguggaucuuuuaaagguuuugaccauuuuguuaugaggaauuauacauguaucacauucacuauauuaaaauugcacuuuuauuuuuuccugugugucauguugguuuuugguacuuguauugucauuuggagaaacaauaaaagauuucuaaaccac

SEQ ID NO: 14385 - RNA, 3297 nt, Homo sapiens
cacagagcccgggccgcaggcaccuccucgccagcucuuccgcuccucucacagccgccagacccgccugcugagccccauggcccgcgcugcucucuccgccgcccccagcaauccccggcuccugcgaguggcacugcugcuccugcuccugguagccgcuggccggcgcgcagcagguggguaccggcgcccugggguccccgggccggacgcggcugggguaggcacccagcgccgacagccucgcucagucagugagucucuucuucccuaggagcguccguggccacugaacugcgcugccagugcuugcagacccugcagggaauucaccccaagaacauccaaagugugaacgugaagucccccggaccccacugcgcccaaaccgaagucauguaagucccgccccgcgcugccucugccaccgccggggucccagacccuccugcugccccaacccuguccccagcccgaccuccugccucacgagauucccuucccucugcagagccacacucaagaaugggcggaaagcuugccucaauccugcaucccccauaguuaagaaaaucaucgaaaagaugcugaacaggugaguuaugguuuccauguacacaggcgacuggagccguuggucagaaauacuggcaugugcccccuaaaaauaaaaucaggaaaacccagggguuaguugaaggacuagaaauugggauuauuguuuucacaauuaagguuuccuuuacgauaauuacugcucuggugccagaggauauucccaaugccuggcguccccacccugguucuuccuucguuccaaugaauguagguaaaacugccuucauuugaggcccaguaggacaaacagcaacagguucuggcuguuuuuaauccaauaguacaguggagaccaccgccccaccccacccccauuccuaaaagagcaucccaagcuuagaggucccugccacacagcacagcugucauaggcaguagccacuugguugccaggcuggggaaacugcauucggaaaacucuagaggcuggaggagcagggcaggagaagaguguugugcaaucagcuuucccgagcaccuacucagggcacccauuuucucauugcagugacaaauccaacugaccagaagggaggaggaagcucacugguggcuguuccugaaggaggcccugcccuuauaggaacagaagaggaaagagagacacagcugcagaggccaccuggauugugccuaauguguuugagcaucgcuuaggagaagucuucuauuuauuuauuuauucauuaguuuugaagauucuauguuaauauuuuagguguaaaauaauuaaggguaugauuaacucuaccugcacacuguccuauuauauucauucuuuuugaaaugucaaccccaaguuaguucaaucuggauucauauuuaauuugaagguagaauguuuucaaauguucuccagucauuauguuaauauuucugaggagccugcaacaugccagccacugugauagaggcuggcggauccaagcaaauggccaaugagaucauugugaaggcaggggaauguaugugcacaucuguuuuguaacuguuuagaugaaugucaguuguuauuuauugaaaugauuucacaguguguggucaacauuucucauguugaaacuuuaagaacuaaaauguucuaaauaucccuuggacauuuuaugucuuucuuguaaggcauacugccuuguuuaaugguaguuuuacaguguuucuggcuuagaacaaaggggcuuaauuauugauguuuucauagagaauauaaaaauaaagcacuuauagaaaaaacucguuugauuuuuggggggaaacaagggcuaccuuuacuggaaaaucuggugauuuauaucaauauuucucaauuuuuuaauuguguuuauuuuucuggguguucaauuugcuauacagauaaaucaaacuaugaguuaugcuucauuucaugcggugauugcugccaauacccuuggcucucaccuagugaagaaugcgcuuuacuaaacuaugggcuggccccuaaugggagagucacugauauaaauugcccuuuuuauaagaaguuucuuucugucuugcuacucaaauuuaccuccuuaaaaauauuuauauuaucuuaacaagggcucucauuucauugcuuuuguugaacaauauuucucauaauuguugacaauuuaaugaagcuggcagugaaaugguggcuaaaauauuucguuuuucaaaacucaaaucauuugugucgucaauagaagcaaaagugaguggcugaaugcuucaccugugaaaagaucugauugaaauuugggcucagcuuucuagccuucacauauaaguaauuagcacuaagauuugcgguguuucaauccuuuauagcaauauaccaacuauaaugguuuuaagauuggacugcauucauuugcaucguuccuaguggaauuuugaugggaccucauagagcgguugccuucuggggaacucuguauucaaugcugucccagaacagcagcagcacuacagguuuuuaggacagaagcaaaauuggcaugucuaaggaagaaauaccccaauaauauaaaagaaaccacacuccaaaccugaaaaggaaggauguucgugcaugcaugaggugugugcuuguuucugauucagaacucauucagaaauccugagcccuggguaacugccucuaacagaggcaagaaggugagacuggcagccucaauacuucaaaucaaauucuggaucaucccaagaagcugggcaaauagaggucauaagcaacaagaaacaaacucugugagcuuuucucacaacuaaaaaaguuaaaaacaagaaucucuucauaauuccaacauuauuaguuaauuaugaaugagaugaggaagaagaauauuuguaaacuauacauaagcaaauaaaugcaaaccauuugagaaacuccauaaaugguagcauucacucccuaaccccaaguuagaggacacuggaaaauguuuacaaguagcauccaaggguucaauaaaaccacuccuuacaccuaagacaaguccuuacccucaaacauuggagcuugcuguacuggcuaccuagcucuggcuaauauggaacagggaacauaaaaaggacaaaagagaugcuuuuauucacauggugguuaaagacagauuucaaaggaucagauugacuuugguguaaauuccagcucugucacugugaucuugggcaaguuucuuuacu

SEQ ID NO: 14386 - RNA, 2150 nt, Homo sapiens
ccgggccacaggcagcuccuugccagcucuccuccucgcacagccgcucgaaccgccugcugagccccauggcccgcgccacgcucuccgccgcccccagcaauccccggcuccugcggguggcgcugcugcuccugcuccugguggccgccagccggcgcgcagcaggugggucccggcgcccugggguccccgggccggacgcggcuggggugggcgccccgcgccgacagccccgcucaaucagcgagucucuucuucccuaggagcgccccuggccacugaacugcgcugccagugcuugcagacccugcagggaauucaccucaagaacauccaaagugugaaggugaagucccccggaccccacugcgcccaaaccgaagucauguaagucucgcccaucgcugccgcugccacugcugggguccccgacucucccgcugccccaaacccuguccucagcccgaccuccugucucacgagauucccuucucucugcagagccacacucaagaaugggcagaaagcuugucucaaccccgcaucgcccaugguuaagaaaaucaucgaaaagaugcugaaaaaguaaguuauaauuuccauguacacaggcgacuggagcuguuggucagaaauacuggcgucugcccccuaaaaaguaaaucaggaaaacccaggguuagcugcaggacugaaaaaauuauuauuuucacaaaguugccauuaagguuauuaaucuguucuggugccagaggauauucccagugcccagggucaccacccagguucuucccuccugccagugaauguagguaaaacugcuuucauguaaggucucauuggaguuugccaguugugcugaaguguuuuccaccuguuaaaaaacacaagcuucauuuccccuaguuccuacugacuuucagaccugaaaagcagacccccugguuuuuuguaaaaguuuaggguugaagugcagagauuucacaauaauauugcacuggguauauaacugguugccaccaccuauuagccaugucacucagagacaauauuauuuaguuuaucugagacucagcaaaacagggaaaauaaugguagcuacaucaugagguugcuuugaggcucaagugaggcccaguaugacaaagagcaauaggcucuggcuguuuuagccaguaaaacaguguagacugccacuccuccaccccacgucacccccauuccuaaaagagcaucccaagccuagagguccuugccacacagcacagcugucacaggcaguacccacuugggugccaggcuggggaaacugcauucagaaaacucuagagccuggggaaacaggacaggagaagacuguugugcagucagcuuuccugagcaccuacucagggcacccauuuucucauuacaguggcaaauccaacugaccagaaggaaggaggaagcuuauugguggcuguuccugaaggaggcccugcccuuacaggaacagaagaggaaagagagacacagcugcagaggccaccuggauugcgccuaauguguuugagcaucacuuaggagaagucuucuauuuauuuauuuauuuauuuauuuguuuguuuuagaagauucuauguuaauauuuuauguguaaaauaagguuaugauugaaucuacuugcacacucucccauuauauuuauuguuuauuuuaggucaaacccaaguuaguucaauccugauucauauuuaauuugaagauagaagguuugcagauauucucuagucauuuguuaauauuucuucgugaugacauaucacaugucagccacugugauagaggcugaggaauccaagaaaauggccagugagaucaaugugacggcagggaaauguaugugugucuauuuuguaacuguaaagaugaaugucaguuguuauuuauugaaaugauuucacaguguguggucaacauuucucauguugaagcuuuaagaacuaaaauguucuaaauaucccuuggacauuuuaugucuuucuuguaaggcauacugccuuguuuaauguuaauuaugcaguguuucccucuguguuagagcagagagguuucgauauuuauugauguuuucacaaagaacaggaaaauaaaauauuuaaaaauau

SEQ ID NO: 14387 - RNA, 618 nt, Homo sapiens
uguggcgacaugaaacugcucacccacaaucugcugagcucgcaugugcgggggauggggucccguggcuucccccugugccuccaggccaccgagguccguaucugcccuguggaguucaacccccaauuuauguggcaucauacguggcacguaucauacgugguacauaugauaccuaagguggaguggucggcguuccuggaggcggccgauagcuugcgccugauccagaugccuaaagggccaguugagggauaugaggagaaugaagaguuucugaggaccaugcaccaccugcugcuggagguggaagugauagagggcacccugcagugcccggaaucuggacguauguuccccaucagccgcgggauccccaacaugcugcugagugaagaggaaacugagaguugauugugccaggcgccaguuuuucuuguuaugauuguguguauuuuuguugacauauaccguuuccgaauucugccguguguauccccaacccuugacccaaugacaccaaacacacaguguucuugagcucgauauuauauauuuuuuucucauuaaagguucaaaaccaaaauaaauaaauaaauaaauaaaaauaaaaau

SEQ ID NO: 14388 - RNA, 1173 nt, Homo sapiens
gcagcccgaccgcgagcgugccaagcggcuucagcagcuagcggagcgguggcggcggccccgcucaggagaccaccagauuccccucuucccgcggccucgccauggcgacccacggacagacuugcgcgcguccaauguguauuccuccaucauaugcugaccuuggcaaagcugccagagauauuuucaacaaaggauuugguuuuggguuggugaaacuggaugugaaaacaaagucuugcaguggcguggaauuuucaacguccgguucaucuaauacagacacugguaaaguuacugggacccuggagaccaaauacaaguggugugaguauggucugacuuucacagaaaaguggaacacugauaacacucugggaacagaaaucgcaauugaagaccagauuugucaagguuugaaacugacauuugauacuaccuucucaccaaacacaggaaagaaaagugguaaaaucaagucuuacaagagggaguguauaaaccuugguugugauguugacuuugauuuugcuggaccugcaauccaugguucagcugucuuugguuaugagggcuggcuugcuggcuaccagaugaccuuugacagugccaaaucaaagcugacaaggaauaacuuugcagugggcuacaggacuggggacuuccagcuacacacuaaugucaaugaugggacagaauuuggaggaucaauuuaucagaaaguuugugaagaucuugacacuucaguaaaccuugcuuggacaucagguaccaacugcacucguuuuggcauugcagcuaaauaucaguuggaucccacugcuuccauuucugcaaaagucaacaacucuagcuuaauuggaguaggcuauacucagacucugaggccuggugugaagcuuacacucucugcucugguagacgggaagagcauuaaugcuggaggccacaagguugggcucgcccuggaguuggaggcuuaauccagcugaaagaaaccuuugggaauggauaucagaagauuuggccuuaauauauuuccauugugaccagcagcaggcuuuuuucccccaagaagaugaucaaaacaaaggaugaucucaacaagagcuguauuuuaaguauuuagacaguucuuuguuagcugguuucuaguugaauugguuaucu

SEQ ID NO: 14389 - RNA, 1271 nt, Homo sapiens
cggcggcugccuucaaacccggauucuguuuccgugcacagaaauggugcccggaggccgccacuuucgcaucugcgucgcuucugccuccgucgacacaaccucuuuuccccuccccccacgggcgggguggcgacggccucuccgcuccgaaggaacaagguacaagagccgaaaacgauucggaaacaggaacggugggcuacccacccuaaaacauccccuccagaaagccugcucccacacuuccuguauuaagcuuccaucagcgcgccuucgggagcugcugcgugccuccccccccacuucgccaccucauccccaauaaaccucaaccccaccugugcacucggagcccucugcccgcaagacgcucgcgggucaccucccuucccaggcggccucccaccccucaccuagaggaaagacuggucuucucucacgcacacacggcaccguagggagccggcaagaacaaugucucugccgcuacaccuccggcucccgggcucacacaccggacgauugccucgcgccgcggagcgcgaauggaaugucccuuuccgaccaccacaccgaccuccccucccggcgcccguacacaccuccagccaacggcggcggcggguacgucgcgcggaggucagaagagucgcugaggaccgggugcggcggguucuuauugcucgccgcccccuuccuccgacaacucggaagccucggaagccggagagccgcgaguucgucugccucacaaccaccucuucccgggcgccaggcgcugcgacgugcgacaaggaccacggacgucccgcccccuuugccaccgcccccucuuauuguuuuaccccugccgaaagggccagggaacccccgagcacagcgucagccaaucacgcaucuccuccagagccggacccaaccuucccgugucccucugcggagcacgcgcaguacgcugccgcgcucgcacacgcucgcgcccggaaagccggggaaccggaaccggccuaaagccaagauaagaguccgcugauuugacgucacaagcaggcugccuuucuccggucccgaggcuccagccuugccgcccuucuuccugaucgcgcaagcgagagcugguucgcagcaacgcagugucuuuuguagacugauauucugguccuuuuuauuaaugggaaggagggaauuuaguaaucucucugaauaggugucugcagguugcugcuguagacgagcuuaaaaugcagccggugauuucagcuguuugc

SEQ ID NO: 14390 - RNA, 2239 nt, Homo sapiens
acacuauaguugccaagaaaauguacuucuuggaucuugcaguguagauagcauaacugaccaauggcuccgccucaacugcugagcucugcugaaauccauacccugauauuuaucccuagguugcugcaaaggccagcuuccuaaggcugcucccagcucaugacugagcacagcagggauacuaaggcgggccucuuucugggagaugccagacuucugggacaagcccauuuggcuaaaggauuccccaccccaauggccuugcugaacuuuuuauacauggacuguauauauaucaaaugcuuccuuccacccaaccuuccuuccuugcuugccucuuuccuucacaaggaucacaccugcaucccagguccagcucccuguuuucccucaaaacucucuugcauaguacccccaucugggacuguuucuggaggacugggacaaacacaaccuccuauucauaggacugccaaggguauuaaaugaguagaacugugcaaagaaacuaguaaagggcuggcguagaagaaacacucauuuaacgaacacuucuugaguccuggcugugugcaggucuugguccugggugucugggacaccacagugagcaaagcaggcaagaacaccagcgaugccugcuuuaagcuccuucccaacuuccacaucuuuaacaggauaccaagagcccuucaaagucugaccucuuggggccucaacaccuccgacuccacccccugaacaccugagccuacagucaaaaggaacuuccuucuugcuuccuacagguuuugcucuuucacccccaaugccuuugcucaccguuuccuucuccgugaaaugccuccuccucccuuuuuugcacaucuuccauucuugcacaugccccuuacgugacaaacuuaugcaucccccaggccccaguucaauguggggcccuaggucauccaggcagaacaugcuugcuggcaugaucucagcaggcaccugguagaagcacuugcuacauuguguuguaauugcgguaacgguguccccgcuaacuugcgagcgccucuagagcaggggaaugucccagccaccuugaauccccagcgcguggcccaugggaggcccucagaccuaucugcggaaugaguaaaugagugugugaaccagguucggcaauuucgguggggcgagcgcugggccugcggugcagggcgcugggagcggccaggccgggccuggcucaggcgccgcagccacucagggccaccggggaccggccggggagggcgcgggccgaaucacugccgccgccgcagggcacaugacugcggccuccgcccccgcccgccuccccgcgcagucgccggcgguugccucgcgggguugcggcgagcccggcccgcgaacgucacgucccugcgcgcucccugcacucucccgagcugcgcuaggcgggcgccacggcugcccggcgaaggaaaccgaaaccgaguccgggcccgucccuccgcggccccauccgcccggugcacccggggccgcgcucgccaggccgcggagcccagagcugcgcgcacgaaccgugcgccgggagggcgugggcguggcgccgaagggucccgggucuucgacgccucugcggcggcuccucccuccuugcaguuggaucccuggcgggugcggcccggcccggcccgugagcggcgcacagaaugggccgaugcugcuucuacacggcggggacguugucccugcuccugcuggugaccagcgucacgcugcugguggcccgggucuuccagaaggcuguagaccagaguaucgagaaggugaggcggggcgggcuguguguguguuguggagucguccagcucacccucccaucccugcugcuacaucuuguaugggaaagaccagcacucaggcagacccuccgcgcuagagcucuucuugcgucccugucuuccagggcuugguaggcgaggguuaaagaaggaugaggaaggauggagccgacucuguucccuuuacagugauaaguaaggcuauggauccugacuuuuaaaaaggccuucgguuguguucugucguuugcaucucuccccacuccuuccgucuacaccccaaucucaggugggcccaaacuuguuuccuucccacuucaugaagaaacagaacugaaugaaagacaccgcagaagaggcagguuauguugucugcuugcuguagccuuugaaguggugug

SEQ ID NO: 14391 - RNA, 4273 nt, Homo sapiens
agacagacauuuuuuagagcaguuuuaguuucauagugaaauugaacaaaguccagagauuucccauauagucccuguccccauacaugcacagccuccuccauuuucagcaacccccaccagaguaguacauuuguuacaacugauaaaccuacauugacacaucauaaucacccaaaguccauaguuuauauuaggguucacuguugcuguugugcauuuuguagguuuggacaaauguauaaugacauguauccaucauuauaguaucguacagaauacuuucacuguccuaaaaauccucugugcucgcccauuccuccuugcaucgccccuaagaccuggcaaccacugaucuuuuuauuguguccauuguucugccuuuuccagaaugucagucauguaguuggaaucauaugguuuguagccuuuucagacuggcuuuuuucaucuagugaaaugcauuuuaguuucuuucauauuuuuuucauggcuugacagcucuuuuuuuuuuuuuuaaguaaugaauaacauuccauuguguagauauaccacaguuuauucaccuacugcagaacagccuuguugcuuccauguuuuggcaauuaugaauaaaacugcuguaaacauccguguguggguuuuuguguggacgugaguuuucaguuccaguggauaaaugccagggaaugugaucacuggaucuuaugguaagaguauguuuaauuuuguaagaaacugccaaacuucuuuuaaaaguggcugugccauuuugcauuaccaccugcaaugaaugagaguuucucuugcuccccauccucaccagcauuugguauugucaauguucuggauuuuggccguucuaauagguguguagugguaucuugguuuuguuugguuguuuuuuguuuuugccuaugacagagcccucaggacguccugagaacauguucccuaguaucuuguuguuuuaauuuguaauuuccuagugacuuaugaugacagccuuuucauuugcuuuuucaccaucuguauaucuucuuaggauuggccaguuuuuaaaucagguuguuuucuuauuguugaguuuuaagugauuuuuuaaaaacacauauauuuugaguuucuaaguaauuuuauuuugagacagcuuucuggaguuuacagugauugauagucuuuuuccucuucuccagacgggcucugaaaaccaucuggaggagcuuguaaaugagaaaaucuugcccuccuaaauguaugaggaggcuuugcuuuggcuuuuggaagucauccacagguguuggaaucccagcaccgaagagccccugugauuaagccuucucauaaagcuucccucuccuucccucuuuccccuuaguucugccucucaugagcuuuuucugacucuaauuucucucauucagcuuuguguuuagcuuucccaccacaaacaaauuguuucuagugcaguuaagauuccaggaagauugccaggguguauccuucaauuccauaaaaaggaaagauauuaacuaaaaacauauacaugugcacacaaagucuccuucacccgugccuauucucuuauuaacuuuuuccccucuucccacaaacagccccaguagacacacaguuucagucucaaucacucuucuaccucucucauuucuuggcacaugcaaaaugucauuuccagcaugcagcaaaucacaucaaagugcugccugugcccaaaggccacguggcuuccucugagcuccucauuccucuccuugcuagccugggugauuaauuagaggcagauagguuagaguguugggcaguuacuccuagcgaugacacagaaggaggcugagcaaggcccaaauauggcccuuuuuacccacccuuccaaacaccaaaccucuugcacaagagaacauuuauaagcuggguccucugccuguaagccuacuaaaugauaacagcucagugguacugacugcuuugucuuucuuccagcuccucuacuagugaccucuccaacuaugaccaugcuuaucuaaggcggagcccugaccagugcagcucccaggggagcauggagagccuggagcccaguggggcauacccacccugucaucuuuccccugccaaguccaccggcagcauugaccagcucagccacuuccauaacaagagagacucggcuuacagcucuuucuccaccaguucuagcauccuagaguauccacacccuggcaucucuggccgggagcguucaggcuccauggacaauacuucugcucgagguggccuccucgaagggaugaggcaggcagauauucgcuaugucaagacagucuaugacacccggaggggagucucagcagaguaugaggugaacucuucagcccugcugcuucaagguagggaggcccgagccucagcaaauggucagggcuaugauaaauggucuaauauuccucggggcaagggagugccacccccauccuggagccagcagugccccaguuccuuggagacugccacggacaaccuuccuccuaaggugggugcaccccugccuccagcucggagugacaguuacgcagcauuucggcaccgugagcggcccagcuccuggucuagccuugaucagaaacggcucugccggccucaggcaaacucuuuaggcucccugaagucuccauucauagaggagcagcugcauacugugcuggagaagaguccagagaacagccccccagugaagcccaagcauaacuauacccagaaggcccaaccuggccaaccucugcugccgaccagcaucuacccgguaccuucccuggagccacacuuugcccaggugccucagccuucugugaguagcaacgguaugcucuacccugcacuggccaaggagaguggauacauagccccucagggagcaugcaacaagauggcuaccauugaugagaaugggaaccagaauggaucuggcaggccuggguuugccuucugccagcccuuagaacaugacuugcuguccccaguggagaagaaaccagaagcuacagccaaguauguccccuccaaaguccauuucuguucagugccugaaaaugaggaggaugccucccugaagagacaucucacaccuccccaaggcaacagcccacauuccaaugagagaaagagcacccacaguaacaaaccaucuucucauccccacagccucaaaugcccucaggcucaggccuggcaagcgggugaagacaagagaucuuccaggcucucagagcccugggagggcgauuuccaggaagaccacaaugccaaccucuggaggaggcuggagagagaaggccuaggccagagccugucaggcaacuuuggcaagaccaagucagccuucucaucucuccagaacauuccugagagucugagaagacacagcagccuggagcuaggccggggaacccaggaggguuaccccgggggcaggcccaccugugcagucaacaccaaggcagaagacccugggaggaaagccgcuccugaccucgggagccaucuggaccggcagguuuccuacccgcggcccgaggggaggaccggugccucggcuucuuucaacagcacagacccaagucccgaagagccgccugcccccucgcacccgcacacauccagucugggccggagggggcccggcccaggcagcgccucggcucuucagggcuuucaguacgggaagccccacugcucggugcuggagaaggucuccaaauucgagcagcgagagcaagggagccagagaccgagugugggcggcucugguuuuggccauaacuauaggccccacaggaccgucucaacuuccaguacuucugggaaugacuucgaggagacaaaagcacacauucguuucucugagucagcugaaccccuaggcaacggggagcagcacuucaaaaacggggagcugaaguuggaagaggcuucccggcagcccugcggucagcagcugagcggaggagcgucggacagcggccguggcccccagaggccggacgcucggcuccuccguagccagagcaccuuccagcucuccagcgagccagagagggagcccgaguggcgggacaggcccggcucgcccgaaucgccccugcuggaugcccccuucagccgcgccuaccggaacagcaucaaggacgcacagucccgugucuugggggccaccuccuuucgacgucgagaccuggagcugggggcgcccguggcg

SEQ ID NO: 14392 - RNA, 3203 nt, Homo sapiens
gugagccugcgcgcccggccgcgguggugggcgggaggauggugggcgggcuccgagcccagcuccacuggccccggccgcggggcucgccccuccguccccaaacgaccgucuccgcugccaugagaugccgacagccugugcgcuggccgccacccccugcuccaucaggugcuggaaucugaguaaaagccugggcgcgagcucccagccccggggccugccaccggcuccacgaagcgggcagcuccagcggccgccgggagaaggaagggcgaccgggggagacgggucgcagggacagcacguggcggaaaguuagccccggacuagcacgccccacccggagaagccggccuggaaggggcugcggaccaccaggcggagcggugggcgaccgaagugcggcugggcuggccuccucgucuccgcacuggaagaauugcccuuccgcaagucuucccuucccacaugggggcccuccaggccgcaccucggucgcccaccgcuucccuugagaagggagacuaaagacaggcaucuggaagcugucacuguggcgcgcgggcagacaggggaucccauuggagaggaagagccguaguagucgcugcugccuucggccgacccaacggccgccugcuugggaggaagaaaaagaacgcccccgcugaagaauuaaggcagccauugguugcucuagggguaaggaccgaggccuccccugggugucacuggagcagccacacgugggggaucagccgacuucauucgaucgcuggcgacagacccggcgacccguaggaaugcgcgcuggggcugcggcuggagggcguggcgacggcaacaggcggguggcucgagugggugcgacucugggcgcgugggacugagaacuccuccgccguggggaagauuuuuuucccagcagauguugggguguuacugcgugucugaggggccggcggaauggaggggucccggugcgugcagggcagcgaggugugucagaugagcuguggaucccugcggccccacgugggccggagaggggggcccacgacaacaagcgauugaggacagcgauggacagggcggggaaccagcuggguggaagcacagggaguguggugaggagggaagggcugugaucugcccucgguacgacgccccaagggacagccuggccuccugaauuagggaaaagacaaccggucucuuuagacgggcgccucagagucugaccugagucuucaaacgcccagauccccuggggccuugagucucccugucccgcuggcccugccucgccugcgcuucaggacuccgacgcccccgcagccuugggcuaagggucagucguccccgggcgcggguccggcugcccuggaacugaugcuggauuucgcugguaggugggcuaggggcuuggucaccccgucugaauuccacugucaggacagcuguggaaccgccagagaaaagucuggccaugaaagaaaggugaggggcgccgacgcagagcuuauuuauucagucugugggcggacucagacgugcagagcaccaaccucuucaauuucugcccucuagacuccaaaucuuuugaaauuagggaccaccauuuuaugccaaacauacaguaggcgcucaauaaguguugaauuaagauuacacauaaaugggccgggcgcgguggcucacgccuguaaucccagcaccuugggaggcugaggugggccaacauggugaaaccuuggcucuaaaaaaaugcaaaaauuagccaggcaugguggcgcuugccuguagucccagcuacuauagaggcugaggugggagagucgcuugaacucuggaggcggagguugcagugagccgagaucgcgccacuacacuccagucugggugacgcagugagacccugucucaaaaaauauauaauaauaagauuacacacagaugggugcugugcaaagggagggggaagacaaauacuuucuucugcagcucugguacauggacauuuuguccuuucuccauaaggaggaucagacagcagcagcacugcccauggaccagaggccucauguaaggccugggaaaagagggcuccacacaccaccaaccggauguaagggcaguugcaaaggaacuguguuaucuugaccagaacagacuguagaauuuguuuaucaaauuuuuuuuuuuuacuuauuuauuuugugaauguauaugcuguaaacucaucugcuuagauuguaagaaugugaaugcccuaccuugguggguagguuaguuuauucuaaucagcaaaacuuaacguuacauauuccaacaucucauuugggaugugaagaugcuauggggaggguggguauccuggcauugcuagaauguuggagccuuagcgagagaguggcagaguggggagaaccuggcacuucagcuacagaugaucacuuaugagcuuuguuauaucaaauaaguuaaacuuucaucucauuuuuuuuuuuucuauuguaaaauaggguaguaacagugaguccugggggaggacguguucuguuagccagauccacucuccaaccugcugucuguccuuuggagccuuaacucaagagacuuucuuucccucuagcuuccaguugagugaaggcacuaggaagcaacagcgauggaacaaagaggaaggaguaugguuauuuauuccccccuggcucccuuacuauggcaccauugcaggcugguugccucccucaaccaaaggaagcagccaguaucccucccuagggugacccagaguaaaccccuaugguuucccuucauuuugcacauaccuuugcagauagucuuuuuauaaaacucuacucacauuauccaguaggaaugaacaucucauuccuucacagaauuguuuugagaguuaacugagaaaauacuguauuauuauuauuagaaugaccuauaauuucuguccaaacugagaaacuuuugaggcugggaaaaggggguuugugcugauaguaaugaugucaggacaauaggaaaaacaaggacuuauggccaccccagcuauuauugccaguaaacucugcuuuagacauauuaagcaaucaagaaguggucguacuaucacgcuucugucacuagacuaugaaugucucaagguaagagugcuuuuuugucuauuagcuucugucaca

SEQ ID NO: 14393 - RNA, 2362 nt, Homo sapiens
ccagauggauagcucccaguugauccauugucgggagcuuguggcacaucaccuuucuacucugcagucuucccugccucugaauuccguuuaugucuaccguccccucaagcacacccuggugaccugugacaaaggaguguucagauuacaucccuccucugucccaggcccagacuucuccaaggacaacagcaagccagaagugccagucagagguacagcagccuuuuaccaucaucucccagcugccagugggugcaagcagaccucuacuaaacgcaaaguagaggaaauggaaguggaugacuucuaugauggaaucaaacggcucuauaaugaagauaaugucucagaaaauguggguucuguguguggcacugauuuaucaagacaagagggacaugcuuccccuuguccaccuuugcagccuguuucugucauguaguuucaacaagugcuaccuuugaguguaaacuaagguagacuacuuugggaaugagaacaugcaaaaucaggaaaggcuguagaaggaaauauaccuuaacaggcugauuuggagugagccagaaaaaaaaaauaaaacucucauuauuuguguggcuaauuauaauucagcguuauuuaagcacauaaagaccaaaaaaaaaaaaaagaaauccaaaagauccaaacuuuuuuuaaacuuaaaaaaucucuuuguaguaugucaguugcacuuuuuuucugccauaauguaacguagcuugccccgucaaaaauucaauuaaaauucauggccagcaauccuguucccccucagcauccugauuuaauuuuccuguugcuuuugcuugcuucuccauuuaauaguuacugaacuuuaugcauguugaucuauauugauuuucacugcaguugaaugaacaaauuauuucagugugacagccaugacucaaguuccaauuagucugaaaaggguacuuuggaauugucccauauuaaucagagauggcaaaagaaaaaguucucauauuaccagguugauuuugugucucauuucaaauuuuaauuuaaaauuaugguuuucauuuuuguuuaccuuaaagugaugcuuaaaaguggcauguaauuaggacacuuagguuuguugaaagcauuuucgacauuuguauaaaagaauuugugauaaauauauccaggugcucaccaaagaaacauguauuaacaacuuaaauuagauuuuucuaacugauaguuuucacucauuuauaaucaguaggagagacugucuagauguuggggcagcucuaugauuuaagucuguaacauguuauaacugaauuuaguacccuaguuuuguuaagcuauuaggauuuucuaauagaacuuacucccccugccuccccagccuuauguuucuuuuaaugacuucuggauccugagcucccuuugcagucugaaaaagguauugcagucagaacuguguacugaugauaaaagccucugguagcaauaaaaaguuguccuuaacuuuuguuuuugugacuuuuuucugguugugaagagguacagguuccugauuggcuaggcacugcuauuucaacuagagaaaacaauagaaagaccaagaauacacuuacugaaaauaaaacaugaagaggaucugaaugugaucgagggauauagguuuuagacauaagaauuuuucuuucgugauauuuuuucacuggugcacugugaauccuccaaauaguaaauuuacaucuuaaugugacugcuugugagaguaggcucagaccccuaucuuuaaaaugucauuuuuagccauuuuguaauguucagauuuagcagaacaagaguauuuucaggucaucaucugauuuguaaaaaauucuugugguaggguugacuuaccuguuuuaugaccuuaaaauccaauuaaaugggaagcauuuacucacaugucaguaaagggagugggagggaagauagcaaaggauuggcuucacagauagacauuuuaaaaauuucucauccugaucuucaucuguuuaauucaucugaauuguaggagcucuaagaaguuuacaacugcauauguucauaguaucuguaaaaugauacagauacuaugaaacuuccuccuauuuaacagaugaggacauaguuguguuauguagacagcuagggauaaaacugaguuuagagucaguauuucauuuguaguccaguagcugcaaauugagcagaauguuagaggacaauaggauuuucacuuuucagucuuaagguuuucaacauuuacaaauugcugguaaguuaguuuggaacacagcauucuucucaugggacaccgaaucaagugggauagugggcugcu

SEQ ID NO: 14394 - RNA, 10316 nt, Homo sapiens
caaaacaaaucggggaccuuuaaaaggcguaaugagaccagaaacgaucuccuuccgccccucugucuucccccguuccccaacgcagaucaaucgcggaauaagcccgacgcccagauuccgcucuccgcccuagcgccaggcgggaggacuggcucggcaaagccaaggagagcuagggaggccgcgagagaggcucgagacggcagcuuaggggcgggacucuuuuuuaaaguccguggaggaagugcaggaucccuccgcggggagucacgugccccgcccccuugggggcgucgaaacucuuaacaaaaacaaggggcucggggagguuuccgcugaggcggcgggggugcggcggugggcuggucuuccgcggccggcguugcgccgcggcggagggugggcgcgcggggagcgggauggagccggggcugugaggccgaggcggcggugccugggaggaagggucggaugccggaccgggggcaccgcugaggcgguggguccccgaccugcgagacagguuuggaagcccccgcugcgcccaguccgugcggaccgcgaggccgcgggcggguggaggcgcgucuccggcacggugaguggacccgcccagggccgccguggguuucuuuguucgugguggggacugugggcuuugaggagguugguaccaugcgagugccucggugcugccugcuccucauccgcuggagcgaccagggugcugcccucagccccagccccggggggagcuggcgcccgcgauggacagauagaugcucgugggguggaaggagguugcgacuagguuaagggcagucuccgccucggugccccccgcccccgcucguguugucacggggacuugcuggcguggugcuucucgaauugacagccccggggcucugcagaguuguggggccccggcaucaguggguggacggguguugucccuacgggcgcggggcgggcgggcuggacuggacuucucuccccggaccguagccgggugugccgcgccaccccagggcuccugggacggggguauccgccucucggguaaguccggaaucggcgcugcagcagcggacgggaaaagcugggggcgggacucuccgagaggggcuucugcagcugggcgccccgggcgggcggggcucgggagucuccucccuccgcuucuuuguucagucgcgagacucucccuccccuccccccuauugugcaacaccccauccccgggacccgcugcagucgcucgccacacugcaguccccugggcagaaggcccucccuggcgcgacuucagguggggcagaccgaggggacgccggcgcccgcggacaguuuccuguuugugaaacgccaagaggccagggcuggccggucuuacccagcgcuggccggcggaccugaccacggcuccucccccugccacaccucccuggccgugguggggauugcccuggggcucuggcggacgugacuggucccuucacccgcuccuugucggggugugcuggggcgacccuugcuggagguacuggccucagcccuuucucccgcuuccccaccccucuuacccccagauuacauucucuguguggugucuuuacugcagaugaaggauuugggggcagagcacuuggcaggucaugaagggguccaacuucucggguuguugaacgucuaccuggaacaagaagagagauuccaaccucgagaaaaagggcugaguuugauugaggcuaccccggagguaaguuggcagaaaagauaacuugcucaagcagcugauggggcuuggaggagguaacccccccgcccccguugaaucaugacuaaagccugcaaaauuucuuaaaaguuguucuuucuggaguaccaagauaaaccuuauuacagguuaaugcuuuuguuucuuagcaagaaugagagugauacuuuagagaagugggguuuuuuguuguuguuuuuaauguggcacccuccucgcugccccccauacuccagccugcagcuucaggaugggagaccccgggugaauugaguaguucauuugugcaaacacccucugccugugaaauacauauuuauaguagaaucuuaaaugacuuuagaaaagcaaacaaaagaacccuuucucuccauuccaagggaauugaauuauauuugcuauaacucucugaaaucuugcaacaguucaccuuauauugaauugcugaagcucuuuuaugaugcguauuuuuaagaagcagugauuuacgucuuacagaugauaaaguguauagcuuuaguuaagcgauaccacucuuuccaccuauauucuugaagauugagggaaaaaaauuaaccuuauucuugggaaaaaauuaaccuuauucuuuggaccuguauguguuuuucaucugguucuaagaaaauuguaaaccuugguucuugguuuuuauugcagaaugauaacacuuuguguccaggauugagaaaugccaaaguugaagauuuaaggaguuuagccaacuuuuuuggaucuugcacugaaacuuuuguccuggcugucaauauuuuggacagguucuuggcucuuaugaagguauuucaucauuuuuauaaauaugucuuccuuuuucuaugcccagugccuagcacacaggguucaagaaauauuuaucgaauggguauaauaacguccacuguacauaaaaauuuauaaucagaauugugaucguuagugccagaauaagacuacaagauuaauuguauuguuguaucuuagguuuuucuguugugucuuagguuuuaccucuuaaguacuuucucuugaauaugugacaaaagagagacuacuauuuuuuagguauuugccauauauuuauaguccucaauauaagauuucaucugccaucaugcuucucuugaagccagauuuuuaaaauacugaagcaugacaaaugaaguauaacaguuuauuaaauaugaccggcugccuucccuagaagucucuucaaagcagggagccaugguuuuauuaacagucaccagcaauggcuagaaaaauguggggaaucuucugccaguaggauugcugucagcugcugggucaguucucagggcacugaaaagaaaagggccgccaucuguccauggcagcuuuuacauaugucccacucugcacaacucgugauauuucucuugggcaaaauuacauugaaauauggaaugacucuuaaagauuuuuauguaaaaagauaaguauaaaauauuuuaauaucccaguacauuuuuuuuugguguuaaaaagcuuaauuuauuuugggagagauuauauuaugaauuucauaagucugaaauacaaauuauacuuuagugcuaggaaucuagcuuuugaaccugcauggaaauuuuuguaccugcauuugaauuuacauaauuuaaagguucaaaaaacuuuuuuuuuuuuuuuuaaauagagauggaggcuugcuguguuggccagaauagucuugcuauguuggccagaguguucucaaacuccuggccucaagcaguccucccaccucagccucccaaaguccugggauuacaggcaugagccacuguucccugcugccuuuuuuuuuggggggggggggaggucgagaacgucuaaaaugugaaaauguguauaauuguggguaaagagccaguacauauaagagaaacaacuugauuguguucugucuuaagaauaggagcaucauuacaauauucuaaguaucugcuaagucaaagugacaguuguuaaaagaagccucuuguuuuuuucucaggugaaaccuaaacauuugucuugcauuggagucuguucuuuuuugcuggcugcuagaauaguugaagaagacugcaauauuccauccacucaugaugugauccggauuagucaguguaaauguacugcuucugacauaaaacggauggaaaaaauaauuucagaaaaauugcacuaugaauuggaagcuacuacugccuuaaacuuuuugcacuuauaccauacuauuauacuuugucauacuucagaaaggucagugggauuaaagauacauuuuguacuuugaacauugcuauagcuaacaguaaauaauuggaauggcaaugaaauuuauauuuuuaccuucuucaaacuuucaacuuugacuuuauugguaaaucuuuuuuuuuuuuuuuuuuuggagaaggaauuucgcucuuguugcccaggcuggagugcaauggcgugaucucggcucacugcaaccuccacuucccggguucaagcgauucuccugcgucagccucccaaguagcugggauuacaggcgugcgccaccacaccuggcuaauuuuauauuuuuaguagagacaggguuuuuccauguuggucaggcuggucucgaacuccugaccuuaggugauccaccugcuucugccuuccaaaguggugggauuacaggcgugagacaccgcgucuggcccuggcaaauauuuaaaaucauuuaaaaucauuuaaaucuuuggaaguuuaauaaaucuuuguucuuugcauuguauaggaaagaaauacugagccuugauaaacuagaagcucagcugaaagcuugcaacugccgacucaucuuuucaaaagcaaaaguaagucgauuccuugcuuauguauauaucucacaguuuguauuuugaauuuuuaaaaaauauuuuucuuuuuuuucuuuuuucuuacagccaucuguauuagccuugugccuucucaauuuggaaguggaaacuuugaaaucuguugaauuacuggaaauucucuugcuaguuaaaaaacauuccaagguaauuacagucauuauucuuuaaggcaaauuuuuuuccugauguuuauuuuuuucuguggugacuuaaacauuaaguaauacuuuaugggacucuuaacuuuuacacuuguuuuuuuucuuauaucucuaguguuaaaguucucaaaaugcagcuuugacccagacaguauuaauccggaagggaaccuggucacuuagcucagcuucuuucugcauauaggugccccuucuguaguaaucaugccauaugauaguacagcuguuacauugccacauaugcauuguucugaaaugcauacuagguaguagacucagaacaaacacuaaugggauaggaugggaucccaucacaccuguaggacugaacugucaucccauuagcagcagcaucaauuaacaccagcaauguugauguuuuaaacccgaaugucuuuucaaauccuuuaggccagcuaaguaaaaguaagucuuaccaucacaaagagauauaaaacaaaagcacaauacuuuuucuuaaacucucagucuaguuggggaaaugaggaacuuaacaugaagugguguguucugucauuuguuauugugucuuggugccagguaauagugaauauagagaguacuuugggauuuuuuuuuuuuuuuuuuuuuuuuuugagacagucuugcucuguugcccaagcuagagugcaguggcaugaucuuggcucaccgcaaccucagccucucggguucaagugauucuccugcgucaaccucccgaguagcuggggcuacaggugcucaccaccaugccaggcuaauuuuuauauuuuugguagagaugggguuucgccauguuggccaggccggucuugaacuccugacuucaagugaucccaccugccuuggccucccaaagugcugggauuacaggcgugagccacugugcccggcuuacuuuggguuuuuuuuaagcaaagaaauagggcagacuaggagaaacacuaugacugggagccuguuuggagcaaaagaaucuuugacagugaaaguuucagcgaaggcuuaacggccaagaaauugguggacuagacagauauaaaagucauuuuaggguagacuuacagguacaaugucuaggugguagucacaagcaggaguaaggcuguccaacucaaacagugguuuuggaagccaagcauggaaaugaggcaaggagucuugaaugaccaagauuuguaccuaaugguggauauaauauuagcauaauuggcaggaaauuugggagaaguuaauuugugaugagagcaauaugauuuuagaugcuuguguacacaggugggugucuaguagguguuuggcguuuuggaauaagaagauaaacuauaguuagagauugagguuuggaauuucucaugaagaagcaguaguugaaacgguaagaagcuguggaauccuuuuuguaggggucaguugaagcucugggguuuucagcguuggccuuuccccccaacauuaggagccaagugaagaaagguacauccccacaaguagaagcacugucagacuggaaggagguuuuuaaggagguggucaggaguauugaauuuuuauaagagauccaauauaaugaaaauugaaggucauugggugugucagagguaaugucaguagagcagugagaaggaagugguagaaaccagauuacaaguggguuaggauguagcuacauuaggugaaaaugggaagccaagaaaauagaucuucuguuuucuggugaaaauaugugcaugugaagcauuuuguuuguaacagauaacuuuuugcuuuaguuaugauuuuauuaguuuuuaucugaacuuuuuauugauagugauagcuggaaccaucuucagugaaaauugauucguugaaauaaacugaaggcauuccgaaggaggagggaaaaaaauacguaaaaagaaaaacaaaaaagaaauaaacuggagcacugcccagugguggcggaacuauguccuuuuugggaaauuccuguucucucauaucacuaacuucuuuaguuuuguaucugguguuauaaguguguauuaccagcaauccaaacaaugccuuguugcaggaacccaaauugguuucuguaacaaaaggaauguuaaauuccuuugcauugagacuaaggacuauacuugauagcugauuuauuaacagacccagaguguuuuuaggucaguguuuucuuagaauaggcaaagcuuucuguguauugaauccuauguaguuuuauacuuacggugcucuucuccuaaaccagugguucccaaauuuugaaaguuuggcugcacauuacaaucaccuagggaacuuagaaaacucuugaugcccauguugcacucauugucaauuaaaucagaauaccagggguggaagcggguagugggagccaggcaucuauauauauauauuuuucauagcucaccuagugauuccaaggugcagcaagauuugggagacauugccguaaccucuuaaaauauuuuuuuuucagauuaaugacacugaguucuucuacuggagagaguugguuucuaaaugccuagccgaguauucuucuccugaauguugcaaaccagaucuuaagaaguugguuuggaucguuucaaggcgcacagcccagaaccuccacaacagcuacuauaguguuccugagcugccaacgauaccugagggggguuguuuugaugaaagugaaagguaggcagguuccuugacuaauuaaacuucccuagacuaaauauuacugaguuuauuauacucagaacuggaauaguguaagacaucagagaaagcaagcaccuacacuaagagcuaagaauuaaagcccccacucuucagguaagcaaauuaaccagaaguaguauuuuaauauguaaugauuuauaagguccucuccaauuuuuuuaguuuuuuucuuuuuuauauuuuuuugaguagagauagggucucgcgauguugcccagggcuggucuuacauacucccaggcucaagugauccuccugccucagccuccgaagugcugagauuacaggugugagccacugcacucggccucuuuucccuuuuuaaagugguuguuuuccaucuuucuccuauuucccuugcucuugaaauacagcuaaaaaaccccaaaaaaacaaaacugaaaaagaauucugggcuuuguaauguuaguaugaauuccuaauauugugcuguggugaagagauugagggguaggugccuggaaaauaaagggaaucaccaccacugauggggaagacuucuauauauguucucagagguuugucaauugguguugucuuauucagaauuugauuacuuuguuuguaaagugaauaacuuugcuaaauuuguuuguuuuaugccguagagauaaagggccagaaguuucauuuucauagcuuguuaguuuacuuugauauuugacaguguaagugguauaauaaaucacugaugcaagaaauacaucuaaauagaccauaugcuaggagguauguuguuuuuagucuucauuacuggauuuaaaauacuuagaauucuacaauucuaauacuugcugauaguuauuaauugguacaagaauaauaguuuggcaaauaguaacuuguuuaaacuuaagaaaaccuauauuuucuuucuuucuuucuuuuuuuuuuugcaugugccaccaugcccagcuaauuuuuguauuaauauuuuuuguagagaugggauuuugccauguugcccaggcuagucuugaacuccugggauuaagcgaucugcacacuucggccucccaaagugcuaggaugacagggaugagccacugcacccaguccaaaaaaucuauauuuuccaaugagauuacuauagacuucauuuaggaaguccuuauaaauuuugucucuguaaagcauaaauuuugaauauaaaaauccucacuagagauauagcagcuuuauuuuggcuauaaaacauuuaaguguguuuuaaguaaugguauccucuuuuuuugucucuuuuucucuuuagugaggacucuugugaagauaugaguuguggagaggagagucucagcagcucuccucccagugaucaagagugcaccuucuuuuucaacuucaaaguggcacaaacacugugcuuuccaucuuagaaaucugauuguucugucagaauuuauauuuacagguuucaaagcaauaaaugggggaauagguaguuuccugguuuagcccccaucuagucaggaauuaauauacuggaauaccuaccuucuauuuguuauucagaucagaucuggccuauuuucauauuuauccuaagccaucaaaugggguagugccucuuaaaccauuaacaguacuuuagacauuggcacuuuauuuuucucguagaucuuuagcuacuuuggggaggagggaaggugcugauaccuucaauuuguuacuuuucaagauuuuuaaaaauaacuaguguagcuuaucuuaaacauuuuauaaaaccuucagaugucuuuaagcagauuggaaguaugcaagugcuuccuuagcagggacaguggauaauccuuaaugguuuaucauagauuucacccuccccccuucucagaagagugaguaugcucuuaaaugucaaacacauuuuuguuguuuuguuuuuuaaaugaucagugucuauuugaugugaugcagaucuuauaaauuugggaauuauaauauugacauuucugugauuuuuauauauguaaugucuuaauugagauuucuguuaaggcagaaauaauuaggcuagggcucuuaguuuucauuccuauugcccaaguauugucaaacuaugguauuauuuuaauguuacuuuaaaaauccauaaucugcuaguuuugcauguacuuauaugaaaacagugcaguaaguugaaaacucaguaucuauggaauugauaaauguugaucugguguaguauauuuuaucgcauuuucuuauauuaaaaaaugucugcaugauuacauuuuauuuccuuuguaauuuacauuucagaauaguguauugcuauaugggugccaagauugaauaugaagaacccgaguguuuguaguauuauaguuuuaagcaaaucuguguggugauacagccauaagaauggggcuuauauaaacucuguacauguaagauuuuguacagagaauuuuuaacuuuauaaauuguauaugaacauguaaaucuuuuaaaauguacauaaaauacuguauuuuuuuaccuugugugugauagucuagucauugcauguaaauauaauuuauuauguauucuguaguauaaaucauacauugaugacuuacauuuuuacugguaagucaacauccguuggauguuuucugaaguggcucuuuuugaagugauaauagauuguaauucaaaauaaaauuauuaaugaauucuccuuguuuggga

SEQ ID NO: 14395 - RNA, 2683 nt, Homo sapiens
ucucuggauuuguccucuagaguuuucccuugcagauucaucaagaugagcaucagggccccacccagacuccuggagcuggcaaggcagaggcugcugagggaccaggccuuggccaucuccaccauggaggagcugcccagggagcucuuccccacacuguucauggaggccuucagcaggagacgcugugaaacccugaaaacaauggugcaggccuggccuuucacccgccucccucuagggucccugaugaagucgccucaucuggagucauuaaaaucugugcuggaagggguugaugugcuguugacccaagagguucgccccaggugaggugacccagguguccagguggggagggcccuuuuguccaggguagggacagcuguuucaggaggaggaggggcaccauggaggcccagagguuucugauggugccagugaggaagcucaggaaggccuuggccauugcccagccccucugggaaaggacugcucaccaugcaggguccacugaggaaacagaaacuucucuucuaguggcucugaaagcuacaggcaauggggaugaggcaaaauccggagggaaaagggguuggacaaaaucagagagggaaaaguggcagagaggagaacagcugaugucugggauguaaauaaaagcucagguccuugccuuaguuuggagccucucuucuccuuuacccacaggcagucaaaacuucaagugcuggacuugaggaauguggaugagaacuucugcgacauauuuucuggagcuacugcauccuucccggaggcucugagucagaagcaaacagcagauaacuguccagggacaggcaggcagcagccauucaugguguucauagaccuuugucucaagaacaggacacuagaugaaugccucacccaccucuuagaguggggcaagcagagaaaaggcuuacugcauguguguugcaaggagcugcagguuuuuggaaugcccauccacaguaucauagagguccugaacaugguggagcuugacuguauccaggagguggaagugugcugccccugggagcuguccacucuugugaaguuugccccuuaccugggccagaugaggaaucuccgcaaacuuguucucuucaacauccgugcaucugccugcauucccccagacaacaaggggcaguucauugcccgauucaccucucaguuccucaagcuggacuauuuccagaaucugucuaugcacuccgucucuuuccucgaaggccaccuggaccagcugcucaggugaggaaggauggugagcuuucucuucagaccacagcagagccuuucuuuguuacaguaaacaccaguggguaugcacugugagccugugaggaaguaagagugagggaacacuagaauauccaugcauuauccuguugguggcucuguccugauacggguaucacacaaccaucccaauaaagucagagggaucuccugggcuagaugcuauagagaaggugccaagcuaggaagcuagcuacugcaggguuuagaucuggcgagagugcauuugugaauuccuccugaggaugugugucuaaguuaagaugaugggaaauagggaggugaagagggcacuaaagagaaugcccaucccacuccuauauuuuaaaauaugaggucuauccucaccugccuagugaacaggcaaaauccuauguuucccugucagcacccuguuuugagcuccaggucagguaauuaauguaugggaaauacaugaugauagaauagagggugagggagcaggagcaaagaaugguaaaagugauagaugguuugcugaugguacaggcaugucaggguccccugcaaccuggccaacccagcugauguugcaggauccugccuggguuugucauuuaugccugugucuccaucgggcuccuguggcccagagaugugguuuucuaccugacagaugaggaaagggagacuuagaguucauggacuugauccaaucaccucggugauggugaaggacugagccucgauugggacugcacugaaggaacagagucuccauucccacaccccaggugcugacuauccucagaugagcagagcagcccuggguuauggagagcaucaucucucacccugaagucauccccaccucucuccucuaacuccuucuuguucucucccaggugucuccaggccuccuuggagauggucguuaugaccgacugccugcugucagagucggacuugaagcaucucucuuggugcccgagcauccgucaauuaaaggagcuggaccugaggggugucacgcugacccauuucagcccugagccccucacaggucugcuggagcaaguuguggccacccugcagacccuggacuuagaggacugugggaucauggauucccaacucagcgccauccugccuguccugagccgcugcucccagcucagcaccuucagcuucugugggaaccucaucuccauggcugcccuugagaaccugcugcgccacaccgucgggcugagcaagcuaagccuggagcuguauccugccccucuggagaguuaugacacccagggugcucucugcugggggagauuugcugaacuuggggcugagcugaugaagacaccgagggacuuaaggcagcccaaga

SEQ ID NO: 14396 - RNA, 1277 nt, Homo sapiens
ugaaaaaugagcuaacagagaucccauugauggcccacucaccaacucuguacgaguccauggauuucacccuacacaagaaauucaaccaaauugauuuccugaacagagaaaaaagagagggggaaguuggggaaaguaagccagguauguuugcucagacguaaaagauaccacagugcaagcagaauaacauuucaucugaccacacgaagcacaguguuuaaaaugcauaaugaagcuuucuuccuuacugccugcuccucgcaggggguuauaaauaagcuccuagaaugccacggguuucuguauuagaaaaagcaacucacuguguauuaucaguuaacuugaagaaaaggucacaacagaaauaauaguucuaaaaaauaacuuugcuuucuagcuguaauguuucucucccuuuagauuuuguuuccuuuccuucccauuucagcacaauuuacacuauuuacauuauuuuuggcaaugugucuggagcaaaacuacaucuguuuaaugguuuucaguuuucaguuuguuuucaaaauaauaacaaucuuuuuucuuacauuacaugcaugccaaaaaaaauauuguuuagaucauauuaacccagcuuaaaaauuaagcaguccacuuguaggcucuuaaccaauaacauaucaucuuagggugguucuguuccagccaacaaacaugaccgaaaacccacuggaagucaggcccuguccuaggugcuaggacuacaaacauggccaagccaugggccuagaauuuuauaguuuaaagcagcuaucugaaucaauguuuuauuaucugugugaagauaauagagaaguggugugaauaaccaaaagcaauccuaugccugacucaaaaauaauaucaaucauuaaaggagacugucacauggagucauucaugcuacuccacugccucuauuccucacugggccaggaaaaugguagaaggaagugcaggagaccacagaguggagaagguccagagacaaaaucaauuaucugcugcuagauugucaagaacuggguauacuucaucucccacuuuuaguacauggaacugcgcauacuaacucuuggauaauucugcuuuguuuguuuuuaacuacccaacugcuaagauuuccaguuugcuuauuuuugcauuuuuucccucaagggauuaaaaauggauuuucuuaguuuuguggguuuuaaaaauaaucacaauaagaaugauuuuaaaugguuacaugaauccaauuaaagcgagccuaa

SEQ ID NO: 14397 - RNA, 12979 nt, Homo sapiens
gauguccaaauaugacuuuuauaagaauauuccaggcagcaagcaccacuccuuguuguagccuuucuaccccuucuuaugaauggaaucaugcugcaaaaaucaaaguucuuaccaauuuucaguccuaaugucacacagcuaaauaauuacauucaugucaucuuuggaaugcaacauauugcuaacuuuuuuuuuaaauccuggugaaauagcucaaauauugguaaaggggagaaacuuccaagcaaguagcugcaagagaaacaugaaaacaguguaauucugauaguuaccagguaauaaaguuaguggucucuauaaagaaauuauaccuuucuucaagaaaguuaaugcaaaugauuuuuuuuugccucacuuuguuuucucuaauuagcugacauuuaaguggguugaucuuacucuccacuuucccuuugacuuggagaaaaagaauuugucagacacugcugacuuuucaaaguuaucaccuuacaacuuccaaauuaagcuuccggauuaagcuuggucaaaaaauuaccuuaaaaaaauuauuuauuuucaauguagagcaauucugauacuaagaucagaauuuauauaagcuauguuuuuuaaaaaggagaaaugauggauauucugcuaauacauugcauauaacuguagauaaugagccuacaauagcugaagacuauuaagauuaugcagauaaaaacaucucaucccuaaaagaauggguaagcaaaagcuucuccuccucuauaaugucagcauuagaaagcaaccagaaaauagaaaaaguaaaaacaacuucugaaugagguaauacagaaacagcauucuuucuauagcacugaauuauucaaaaauauaaugaaauucaaggaaacaucagaugcugcagguacaugaagacaacuuuguuuuuauaaccaauuucaggcagauaaauacuagaauccuuuccaauuucuccccuaugaaacugaagugucaccaagauuuacagcccccucaaguucccuuuucagaggaacauucauuuacauaaacagauaauccuagauaaaaauuuccauuagacaaaggugaaauggaucaauuuucucugccaagacaaaucuuaaaucuugaacagauagggucauuauuacaccagccccauuucagaaauaauguauuuuuaaaaaaucagccgauagcagccauuuccagcuuuccaauuaucuuuaagaaaagcuuauucuguggacaauaaagcacauuacugcacaauaugauacaguccauaaagaucacaauguuuuaugaaagguuaaagaaagcucagcacauuuaggggaaugucauaacccgcaaagucuuucaagacuucagcugaagcugagggcaugcugugcaaacacgguacaaggcaacucaguauuccuuucgguaucaaaacacugaaggaaaaagcauaugcuaggaugauucuguuaugaauccugcgauuccuacagacaagaugggagagaaaucaaaucacaagaaauaucucuuuguuuuugaaacaaccagauucacucauacgagaguuacauguccacaagaaggcaaguguauuuucuugguacucagugucugucucacugcucuuuaagcaacucuuucaugcuguuucauuaauauuaauaaaacuauagagaaauaagaaguuaucugguuuccccccauucuuuguaaaaugcccuaguaauuuuaaaugacuaaggagcaagagaugugugcaaugauacucacauaauaauuacacaaggaaguccaaauucuuggaugccucauauauauauauauauacacacacauauauauuacauauauuauauauacacauauauauuauauauaauauauauguguguguauauauauauauuaguaucaguaugagucuggagauuuggagcucacuccauauuuucuucuguaccaaccaucaacugcaugaaacuguuucagaggcuaaugcuuucuuaucaaauuaacagagaaauaauucacuguaccuguaacaggcaaggcuacaauggggaaagagauaaaggagacccagucucaguccuuucaggaacuuaugcauaccauggaagguguggaguacagguugggggcagacuauuuaaauuugaaauucagauuaaaauuagaauauagaacuggaugaaagaaaauuccaucagauucacucaaauugcaaugaaccuaaaagaaugugauucugcaaacucccaaaauuauaguuugaggugaauaacagcuuugaagaagcuugagacaguuuuuuccauguuauccagagauggggaaauaccuaaaucuucuaaauacuacuguaugagagaauccacugaaguccaaguuauuauuuuuaaaaugauuuuuaaauaaaauucauaucaaguagucuucuagauuauguaacuaaaacaagauucaguucaggaaauaaauuaccuuuaauacaaucauaaauucaacagauauuuaagcuauauucaaauauuuuauuuaaagaaaacucagcagaggcagagucaaauacacuguucauucuucuaauaggacagaccaccuaggagaagugagaaguggagggaggagagaaaauuaaucuguuccauauuuccaaaggccaaaguuuuuauguaauaggccaaaauagcaagggaaaaagaacguggcugccuaguugucguuugaauaauagagauuuacaggucaaaaaauagaugaaguuggacgcaugguucugggauugagccagguagauugaauagaggcaaauucuucucuugaaugcacguucucauguugcaccagagagcggaaacugauaugccaacauuucccccucuaaaacaguuguccauccugagcuucuuauuaaugcuauucuuccuugcuugcuucuuuucuucaccugcccagaagacaggaauaucaggagaaaguucagaagaaaguucccacccauguucacauaacaggugcaugccugugaucaaaauacuuaguaggaauagaaaauaagucuucaguccuauaaugagaugggaaaauaauuuuauacuuaaaguuggcaccagauucuuuguugugggguguaagggacaccuugauaaguacuuggaauagaauaugagaccucaggguacuaggcuaugcucugaauaugacaaggaaagaaaaauguguuugucuuucuaacaacgagaggaagauaaagcagggguggggagcaggagcagguggggccagagaacuggcagaaugcuguaaggagcacaaagugacuugccacuaaaauccacaacaaacucacuaaauguuugaugugagugaauuucauacggaaacaaauaaaggagcaaaacagugaauugaagugaaaauagcaaagccucugcaaaggcaggaacagaccacaagcacaaugaaaucagcagaaaucuucaagaagcuuagaacccuaaagggcagugggauucgagguuagaggcuauccuaccuugcucucaaguuugaaggguccccaggugucugucuggaacaagacuucuaagcuaccuuuugcuuugcaagggaucuuuacaagucaauagaaggaacaugaaggagaaacuuguggcauugcuuuuauaagcauacuuuucugaguagaagugcaccuuaaaugucauuuuaacuuuuuaugugcauguaaauagcuauuauuucaguugcuggaauauuagucacaacaucuaaugauguggagauuguugccuuauaaaacucacagcuggguagcuacauggcucaaggcaaaagccuauuuuaaaauccauugcuuuaggaggagaauguuuauuaaaacauauaucuauuaaaaauauaugaugccucauuggucauucucuguguugcagugccaaccacaguuuuuccagcagggcugaguugauaccugaaaacuuggcaagguccacagccucauaauuuaccaguccaucaaaaaauaaauaaaucccaauaaccagaaaguaaaucaccaaaggugccugcacagcagcccauaaacucguguuuacacaggcuccauggagguagccauugcugucaguaaaauauuucuaagcguguagggaagugaauguucaaaaaggaauaaaugcuugaucuccuugugacagaaguuaaaugaauuaauaaugaagauacaguaagugggacugauauuuguaaaauguagaaaagugugcuggggaaaauaaggaagacuaguaacugguguuaacaagggcugaaaaaaaacauacagaaagacugguaacuucauguaauuaagcuacaaucuaccuucaguaguucucacaauguugcuuaaguuauagaggaagauaaucuuuucaccaacaguaacaaacuaagaguaacuuguagggauaaacaauuuccaaagaaaaacuccugccuuuuaaaaauguaccauuagcccaauccugaugucuacccuuguuuaaaaaguagauuacuuaaucucuggauagucuaucaucuaaaauaaauaguugaauauauauuuuuggucugaaccuaguagagguuccauaaacacaugguucacugaauccaaguccuuuaauugugcuuauuuuccuuucugccaccaacuuugcacgauuauuuugcuuuaauacauuuccaucaggguaaaccccaaaaaauguagagaugaaaauguuccaagaggguaaagguaacgaggcaugugaaaauguuuuucaacaaaguugaaaaaugagauuuagaauaaggcuuaucuuugacuuucaacuauuauaauucucuguuuuucaccauuaucgugauguagaagcaauggaaagggucauucaacugaaaccuagagagcaauggaacuaauuaauugaccaaguaacuuucgcaaagccaauggcauagaaccucuaaaucuaucuuucuggaauccaauuaagagcucuacucggugcugaucccaugucucugcuuuacccuuaucuacaugcauccaggggucuguaagaacacugaguacaccucccagcuccucccagcuccccacuuugaggcacuuuuuuccccagcugccuggaugguccagcugucacugguucacagcugagucccucccugggcacuacccucaacagaagggaccugccucaccccaaauuaagcaauuucccauagggcagccccacagccaguaaguagucaguguggggauacaacccccuagaaccugaccuauaauaggguuucucuuuuaacuuacagcaaaauucgacugaaaccuagagagaaaaagccccauugaaagcuauccaauguccauccauugccauuuuuuugugcgcaguugaucucuauuguuccaccuaaagaacacucuauugcuaauagccaucccuuuacugacagagacaaaucauauugauuuuacagaaaagugggauuaauucucuacugaacucaggagagaauuauuucauaucuccuuucaauaccaucuuauucaugccccuuccucaggcaauuguggccauauuccuagaguagaaagaaaaacuagaccugaaauggaaucguuuaugaauacuuccaaaggaaauaggccaauucuaaccaauuuucaccuuuauaauucaguaacucccuugaaugaagcugucugcuguggcccaccugggaugucacaagaacuagcaauuuugaaguuuucuuaccuguuggaaggucuagaucgccuccacucaccaagucuuuucuccaacuaccagguuguaauagguaaaauuauucuuccauccuuggaguuguucauccagacuuauuuggagaaauaauaaagguuucaaaauguagaguuuuuacuucgguagccauggugcauuugcuuccuaucauugcuauaccaaauuuccaaaaauauaguggcucagaacaaugcaaacuuauuaucucacaauucuguaguucaaaagucugaaauaugccuuacaggcuaaaauaaagguguuggcaaggcugaguuccuucuggaggccccagaagagaguucagcuuaccuuuucuagcuucuaaaagcugcccacacuccuugaaucauggccccacccuucaucuucaaggucagcaguguagcaucuucaaaagucugucucucugcuucugucacaauuugcuuacucugacucugcugucucccuaguaaaaagauaaccucccgagguggagccaagauggccaaauaggaacagcuccagucuacagcucccagcgugagcgacgcagaagacgggugauuucugcaguuccaacugagguaccggguucaucucacuggggaguguuagaaagugggugcaggacaguggauguagcacaccgagccugagcugaagcagggcgaggcauugucucaccugggaaguacaaagggucagggaauucccuuuccuagucaaagaaaggggucacagauggcaccuggaaaaucgggucacucccacccuaauacugugcuuuuccaauggucuuagcaaacggcacaccaggagauuauaucccgcgcauggcucagaggguccuacgcccacggacccuugcucauuucuagcacagcagucugagaucaaacugcaaggcagcagugaggcugggggaggggcgcccaccauugccgaggcuugaguaggucaacaaagcagccuggaagcucgaacuggguggagcccaccgcagcucaagaaagccugccugccucuguagacuccaccucugggggcagggcauugccaaacaaaaggcagcagaauccucugcagacuuaaaugucccugucugacagcuuugaagagaguagugguucucccagcacacagcuggagaucugagaauggacagacugccucuugaagugggucccuaacccccaaguagccuaacugggaggcaccccccaguaggggcagacugacaguucacauggccagguacuccucugagacaaaacuuucagaggaacgaucagacagcaacauuugcuguuccccaauauccacuguucugcagccuccgcugcugauacccaggcaaacagggucuggaguggaccuccagcaaacuccaacagaccugcagcugagguccugacuguuagaaggaaaacuaacaaacagaaaggacauccacaccaaaaccccaucuguacaucaccaucaucaaagacaaagguagauaaaaccacaaagauggggaaaaaacagagcagaaaaacuggaaacucuaaaaaucagagugccucucuuccuccaaaggaaugcagcuccucaucagcaacggaacaaagcuggauggagaaugacuuugaugaguugagagaagaaggcuucagacgaucaaacuacuccgagcuaaaggaggaaguucgaauccauggcaaagaaguuaaaaaccuugaaaaaaaauuagacgaauggcuaacuagaauaaccaaugcagagaaguccuuaaaggaccugauggagcugaaaaccaaggcaugagaacuacgugacgaauccauaagccucaguagcugauucaaucaacuggaagaaaggguaucagugauggaagaucaaaugaaugaaaugaaaugagaagagaaauuuagagaaaagaaaauaaaaagaaacggauaaagccuccaagaaaucugggacuaugugaaaagaccaaaucuaugucugauugguguuccugaaagugauggggagaauggaaucaaguuggaaaacacuccacaggauauuauacaggagaacuucccaaucuagcaaggcaagccaacauucagauucaggaaauacagagaacgccacaaagauacuccucgagaagagcaacuccaagacacauaauuuucagauucaccaaaguugaaaugaaggaaaaaauguuaagggcagccagagagaaagguuggguuacccacaaagggaagcacaucagacuaacagcggaucucucagcagaaacucuacaagccagaagagagugggggccaauauucaacaugcuuaaagaaaagaauuuucaacccagaauuucauauccagccaaacuaagcuucauaagugaaggagaaauaaaauacuuuacagacaagcaaaugcagagagauuuugucaccaccaggccugcccuacaagagcuccugaaggaagcacuaaacuuggaaaggaacaaucgguaccagccacugcaaaaacaugccaaauuguaaagaucaucaaggcuaggaagaaacugcaucaacuaacgagcaaaauaaccagcuaacaucauaaugacaggaucaaauucacacauaacaauauuaaucuuaaauguaaaggacuaaaugcuccaauuaaaagacucagacuggcaaauuggauaaagauuuggcuggauaaagagucaagacccaucagugugcuguacucaggaaacccaucucacaugcagaaacacacauaggcucaaaauaaagggauggaggaagaucuaccaagcaaauggaaaacaaaaaaaggcaccaguugcaauccuagucucugauaaaacagacuuuaaaccaacaaagaucaaaagagacaaagaaggccauuacaugaugguaaagggaucaauucaacaagaagagcuaacuaucccaaauauauaugcacccaauacaggaggacccagauuuauaaggcaaguccuuacagaccuacaaagagacuuagacucccacacaauaauaaugggagacuuuaacaccccacugucaacauuagacagaucaacgagacagaaagucaacaaggauacccaggaauugaacucagcucugcaccaagcagaccuaauagacaucuacagaacucuccaccccaaaucaacagaauauacauucuucucagcaccacaccgcacuuauuccaaaauugaccacauaguuggaaguaaagcucuccucagcaaauguaaaagaacagaaaugauaacaaacugucucucagaccacagugcaaucaaacuagaacucaggauuaagaaacucacucaaaacugcucaacuacauggaaacugaacaaccugcuccugaaugacuacuggguacauaaugaaaugaaggcagaaauaaagauguucuuugaaaccaaugaguacaaagacacaacauaccagaaucucugggacacauucaaagcaguguguagagggaaauuuauagcacuaaaugccuacaagagaaagcaggaaagaucuaaaauugacacccuaacaucacaauuaaaacaacuagagaagcaagagcaaacacauuuaaaagcuagcagaaggaaagaaauaacuaagaucagagcagaacugaaggaaaugcagacacaaaaaacccuuauaaaaaccaaugaauccaggagcugguuuuuugaaaagaucaacaaaauugauagaccgcuagcaagacuaaugaagaagaaaagagagaagaaucaaauagaugcaauaaaaaaugauaaaggggauaucaccacugaucccacagaaauacaaacuaccaucagagaauacuauaaacaccucuaugaaaauaaacuagaaaaucuagaagaaauggauaaauuccuugacacauacacccucccaagacuaaaccaggaagaaguugaaucucugaauagaccaauaacaggagcugaaauugagacaaucauuaauagcuuaccaaccaaaaaaaguccaggaccagauggauaugcagccaaauucuaccagagguacaaggaggagcugauaccauuccuucugaaacuauuccaaucaauagaaaaagagggaauccucccuaacucguuuuaugaggccagcaucaucgugauaccaaagccuggcagagacacaacaaacaaagagaauuuuagacgaauaucccugaagaacauugaggcaaaaauccucaacaaaauacuggcaaaccgaauccagcggaacaucaaaaagcuuauacaccaugaucaagugggcuucaucccugggaugcaaggcugguucaacauacgcaaaucaauaaacauaauccagcauauaaacagaaccaaugacaaaaaccauaugauuaucucaacagaugcagaaaaggccuuugacaaaauucaacaacccuucaugcuaaaaacucucaauaaauuagguauugauaggacguaucucaaaauaauaagagcuaucuaugagaaauccacagccaauaucauacugaaugggcaaaaacuggaaguauuccuuuugaaaacuggcacaagacagggaugcccucucucaccacuccuauucaacauaguguuggaaguucuggccagggcaaucaggcaggagaaggaaauaaaggguauucaauuaggaaaagaggaagucaaauugucccuguuuguagaugacaugauuguauaucuagaaaaccccacugucucagcccaaaaucuccuuaagcugauaggcaacuucagcaaagucucaggauacaaaaucaaugugcaaaaaucacaagcauucuuauacacuaacaacagacaaacagagagccaaaucaugagugaacucccauucaccauugccucaaagagaauaaaccaccuaggaauccaacuuacaagggaugugaaggaccucuucaagaacuacaaaccacugcucaaugaaauaaaagaggauacaaacaaauggaagaacauuccaugcucauggguaggaagaaucaauauugugaaaauggccauagugcccaagguaauuuauagauucaaugccauccccaucaagcuaccaaugacuuucuucacagaauuggaaaaaaauacuuuaaaguucauauggaaccaaaaaagagcccucauugccaagucaauccuaagccaaaagaacaaagcuggaggcaucacacuaccugacuucaaacuauacuacaagguuacaguaaccaaaacagcaugguacugguaccaaaacagagagguagaccaauggaagagaacagagcccucagauauaaugccacauaucuacaaccaucugaucuuugacaaaccugauaaaaacaagaaagggggaaacaacucccuauuuaauaaauggugcugggaaaacuggcuagccauauguagaaagcugaaacuggaucccuuccuuacaccuuauacaaaaauuaauuaaagauggauuaaagacuuaaacguuagaccuaaaaccauaaaaacccuagaagaaaaccuaggcaguaccauucaggacauaugcaugggcaaggacuucaugucuaaaacaccaaaagcaauggcaacaaaagacaaaauugacaaaugggaucucauuaaacuaaagagcuucugcacagcaaaagaaacuaccaucagagugaacaggcaaccuacagaaugggagaaaauuuuugcaaucuacucaucugaugaagggcuaauauccagaaucuacaaugaacucaaacaaauuuacaagaaaaaaaacaaccccaucaaaaagugggcaaaggauaugaacagacacuucucaaaagaagacauuuaugcagccaacagacacaggaaaaaaugcucaucaucacuggcuaucagagaaaugcaaaucaaaaccacaaugagacaccauaucacaccaguuagaauggcgaucauuaaaaagucaggaacaacaggugcuggagaggauguggagaaacaggaacacuuuuacacuguuggugggacuguaaacuaguucaaccaugguggaagucaguguggcgauuccucagggaucuagaacuagaaauaccauuugacccagccaucccauuacuggguauauacccaaaggauuauaaaucuugcugcuauaaagacacaugcacacguauguuuauugcggcacuauucacaauagcaaagacuugaaaccaagccagaugaucaacaaugauagacuggauuaagaaaauguggcacauauacaccauggauacuaugcagccauaaaaaaggaugaguucauguccuuuguagggacauggaugaagcuggaaaccaucauucucagcaaacuaucacaaggacaaaaaaccaaacaccucauguucucacucacagguaggaauugaacaaugagaacacauggacacaggaaggggaacaucacacucuggggacuguuguggggucgggggaguggggagguauggcauuuggugauauaccuaauguuaaaugacgaguuaccgggugcagcaaaccaacauggcacauguauacauauguaacaaaccugcacguugugcacauguacccuaaaacuuaaaguauaauuaaaaaauaauaauaauaaauaaaauaaaauaaaagauaaccucccaucucacacccuuuaucacaucugcaaaguuccuuuuguuacguagauuaacauauuugcagauucugagauuagaacaucucagaauggacaucuuugcagggccauuuuucagccuaccuuacauagcuauuuauuuuuccaaggaaauaaaaaagaauuaccugcauucuccaggauaacuaguuguaaaguucaggucacagucgcaccucauaaauauugucucaagcuuuucuccccaguucugcagcugcauaaccaaacaccauugugcuaguagaagcucauccacucagcugcauaaccaaacaccauugugcuaauagaagcucauccacucagcugccugguuucugcuaacucagcugggagccuauaaauuuggugaagcuguauuugugggaauccuuucucggguuuagagggguggagagcuaggccuacaaccuucuuuuaaacaggcaaaaacugaaacuguuuaacugaaaguac

SEQ ID NO: 14398 - RNA, 2870 nt, Homo sapiens
uuuauuuuagauauuuuuauuucuccaaauuuguuauuuaucaggagugacugaaauaaaaaauacaauugagucccaucaucaucaucauggaaauggcuuuaagagaaaacuggucagaugaauauuauugcuucccauuuucaaccaguaaauaguugccacugagaaacugacagccaggagucugucaagaaugcucaagauauguuauauaauacaacaugccuguucacagggggaaaaauccuaggaaauaacuuauguguacuucuugauuucaucauacaagacaagcacaaaagcaccacccaugccucugagaacauuggaccaugcacccuugaaaaaagcuuugccuccuucaucacgagcaaucuuccgccagcagucaagcgugccuguguacaugaugucagcugcaaagaauaaagacauggaguuagugacugaaggccgaugaaaaauccuaagauucacuaggcuaaauaaagcagagccccaccucuaagaacgucagcuuuaaauccaacauucacacauuagcaugggcaacacugaaauauuaaugcuaugaccacaggaauacagacuacccauuggucuuaaccucuaacaccauuuaagcacccucauucauaggcaucugaagggccagcucaaaggcaguuguggaacagacacagaugcuaucaaccccaucccuugacuuggacagacagccauuuuaaagguauguaucaccaguuuguggcagcagauugccccacgacuacaacuuuaucuucugcucaaguggaacuuacuuccuuugcgcccugacugcaucaucaugcggcggcgaacagugucaaauggauaggaagucaacccggcaacagcagugacagucugugcgaucauccagcugaugacgaugugaguguucuugggauccggaagcauuccugggaauaggaaagagaugcuuuuaccaaaaagcagaguuuuacugacuuccuuuccccacauccccuaaacacgucaucuguacacaaggguugcauuggaugaucuuggcuuccuuuagcaauuaaaaaaacaacucuuuagcucuuggacuguuagguugguacaaugcucuuuuaaacugucuccuaagaacacaacguuaaagcccacagcaaacuuacccuuugcagugucauagauaccgaaguaggcggcucgguagaugauaauacccugcacagacacguuaaagccuugguacaggcccuuaaucccaucagauuuguagaucuuaaccaggcagucaccgaggccucggaauucccuuucagcuccagcuuuacccacaucagcugcuagacggguacgggcaaaaucaagaggguacacaaaacacagggauguggccccugcggcaccacccgaugccagauucccugcaaaguagagccaaaacuggguucucuuguccacaccacccaggaagaucugcuuguauuuaucuuugaaggcgaaguuaagagccuggguggggaaguaucugaugacauuggccagguuaccgcgccagaaggacagaacucccugcuccuugggaauacggaccacgcagucuauaaugccuuuguauugcuuaucugcagugaucugcuugcuggcaugcugcaccuaacagacaggaaggaagccaacagggacaguuauaaccauggggaagggaaagagaagagcuuaugccaucucgaucaaugcccuuuaagguaggcuccccucucucaaaucuagucuucguauaucauacuggcuggacccucccaacccucugaggcugucacaggggaagaggugaucugcaccaguagcauuaagccuccaccccucugaguggagagggggcauccuccagcggacccgugaccuucagaccuaggagaaaggucauuaccucaaacccagguucagaggcauuagggcgagucccacauagggcgcggucaccuuggggaccgcagccuacgccucaagucuccugagcugcuuccgucucgcuccgcccccacuccgcucccagaggugacccgagcgccgccgccgccagcccuacacgcuagcccaggagcgcccucuagagccggcacuggagagcgcgcggcgcagggaggcaggcggagacgcggcggcagcggccgcggcugcgcgggggcggacguaaaaggcacacgcgcuucccggcgccggcuuccggcccggcgagguuugagcgcguccgcgggcugggaggccgcuggacccgggcgcauggccucccccgggcaguuaucuccuugccgcgaccuugaggucuucgguaagaacuggcguuccucuuucuaacgccggcuuucggccuucgcccuugacgcccaggcccggggaggccgucacucagaaacugcuccauccgaguccgccgccucggagaugccgagagccugguccugcccucugcccccggccccuuccuagacucacuacuucaggucacuaaaggcgccucccaccaguuugacuucuguucugccucugcgccccgcucuggccucuccuaagccgcuucccuggccaugucuuuagaguucgcuccccgccaccccucgggcgcccgccuucugugcgacccuuccccccacuuccugguugggcuccuggaucccaggacguaccugcagcagcagcuugacccgcucgaugggcgcuaccgccgucuuggagauggcugcggccacuccaccugccaggaaguccuuggcgaaggacacagcggcaucugucauguugaaagaggaggcagacugcugcaggacgggacugggccgggaaccggcuuugacuccggcgcu

SEQ ID NO: 14399 - RNA, 2956 nt, Homo sapiens
guuuucaucuuuaaaauaugccauguuuaucugcuuuaauuuugaaauaagagcuaugcaaaaaucaggcaugugcaaggaaaaucuaccuaguauuuggacaguucugcuuggguuaauggcguuaaaagcaguaacauaacucacuuucuugugcugugugucuaucuccagugauggaggauacuggcauccagcgaggcaucugggauggagaugccaaggcuguccaacaaugucugacagauauuuuuaccagcguuuacaccaccugcgacaucccugagaaugcuauauuuggucccuguguccugagccauacuucccuauaugacagcauagcuuucauagcucucaagucuacugacaagagaacaguaccguauaucuuucggguaagucuccacuguagcuguguagguguaugaggguaauguccuguuggaaauggacuaaaaauaauuauaaugacaaguggagauagguuuugccuguggaaaaaugcaauaaugcaagcaaucccauuucacacaucaaaaauuagaaaaggaaaauuaaacucaaauuauugucaacugauuuuuuggaauaaaugacaaaauuugauuuggaauguuagaaauaucuaaaucagugcuucaguucuggauuauccuggugaugaacacgacuuccuaaacucugggagauuucacugggguggaggcuauuugcauacuaacuaguuucugcaaguucuuugacaaguauuggguacaucugccuuccauuugaggaggcuucuucauccccuaaagauuaguuucuuugguaauauuagcuagugcccagaguuuguauuuaaauaaaaauguuuaugguuuugacaguaaagcaucaucaaauccauaugucugaauuggaagauucagaccucucauuuccuauucuucuuuacaaagaaaaucuauuaauuguucuagccaagauuaggaacaugauugccauagcauaauuucuaagaucuaagcuugcuuuauuucugaaacaaacaaaauucuccauaccuuuguaauguggaauaacuuagaaguaaacucucaagggguuaacacuaaauuauaagaagaaauuuccucauuuaguauucaaccaauauauaaaaacggugacuuaaauaaacuauaugauugaugcaguguuucaaagaaugguuaucuugccuaaugguuacaaacaugaggacaggucccagcuugggccaaacuuuuggaagcguggucucagacaauuuuuggaaaagacuaacauagaagaaauggucuugauucuucugauuucauucccucaugagggucccucucccccucuccuucuugucuucuuucauuuauuucaaaccgcagguagacaccucagcagcaaaugguuccucagaaggucucauguggcugcgguugguccaaucggccagagauaaggaagagcagaaccuugaagccuacauaaaaaacggacagcuguucuaccgcucucuccgcaggauugccaaagacgaggaguuacuaguuugguacgggaaagaacugacugaguuacucuugcucugccccucuagaucccacaacaaaaugaaugguagguuggcucgcgaccggcgugugggcccuuaacuagcgggggagagacgcagggagcggcaggggcucacccggcgcguuggcgcgccuuucuucccuucgggugucucauaggaagauucugagauguagucuggaaugaaguuaaacagauaggugaggauaaagcgaggaaacuugcuuguuugcuguauucccuccaaaucaggagggaaaguuagaucagguuggucauucuuuucucaggcacucaggcccugagaaaugaagguggauuugucaaggggaugguggcaaacuggcuugggggcgaugcugaguaaucauguggugugcgugugugugugugugugcgugcgugcgugugugugguguuugcucacuaagcagggucguccccuuacacaugccuggaaugcagccaacguuuccaguuugaguuccccuauguggcgcaucugcguuuccgcugccccaagagacuucacagcgcugauauaaguccccaagacgaacaaggcggcggcgugggcaccaaggaccacgggggcggcggcggcgguggcaaagaccagcagcagcagcagcaggaggcaccuuuaggcccgggucccaaguuuugcaaagccggcccccuccaccacuacccaucccccuccccggaaagcagcaacccauccgcugccgccggcggcagcagcgcgaagccauccacagacuuccacaaccuggccagggagcuggaaaacucccggggaggcagcagcugcuccccagcccagagccucagcagcgguagcggcagcggcggcggcggcggccaccaggaggcggagcugagucccgacggcaucgccacgggcggcggcaaaggaaagaggaaauucccggaggaggcggcggagggcggcgguggcgcuggucugguagggggccggggccgcuucguagagcggccccucccggccuccaaggaggaucuggugugcacaccgcagcaguaccgagccucgggcagcuacuucggccuggaagagaacggccgccucuucgcgccgccaagucccgagacgggcgaggcgaagcgcagcgccuucguggaggugaagaaggcugcccgcgcggccagccugcaggaggaggggacagccgacggcgcgggagucgccuccgaggaccaggacgcuggcggcggcggcggcuccuccacgcccgcggccgcgucaccggugggcgccgagaagcugcuggccccgcggccugggggcccgcugcccagccggcucgagggcggcaguccugcgaggggcagcgccuucacuucggugccgcagcug

SEQ ID NO: 14400 - RNA, 1462 nt, Homo sapiens
caacacaaauuuauuuucuuauaauuuuagagaucagaagucuaaagugacccacugggcugugguccuucaggaaguuuuaaggauaaccccuucucuugccuuuucuagcuucuaguggcugcuggcauucacuggcucauggcccuggaucacuccagccucuguuucuguuguuguauuuccuucucugacucuaauucuccugccucucucuuacaaggacccuugugauuacauuuggcccaccagacaaugcaguauaaccucccuaucugaagauccuuaacuuaaucauaucugaaaaguaccuuuugccauguaaggcaauguauucacagguuccaauguuugggacauggacauuuuuggagaaaccauuauucugcuugccacagucaccuuuucgggcaaccaugaaaaguaccuuucuccauguaaggguauguauucacagguuccaauguuugggacauggacauuuuuggagaaaccauuauucugcuugccacagucaccuuuucgggcaaccacaucauggaauauaaugguacuuguauauuaaccacucauauuguucugaguggcuaauauaaaacaccuuaucagacugcauuauucacaguuccagcuaaaaaaagguaagaauacuugacagccuuauauuucucugguagacuccugcccaauaauugauauuuacuuauuuaauuuccuguuauuuuuucuuguacaguuagagaauuuuaaaaauuaugcauaaauagguuauauuauccuuacaaguaauaaaagagacaucauuacaaaauguuaaauauuuauugccaaauggguuguugaaugugacaggacugagaaucacugaguuagagaguuaaauauuauuuuuaaugaguuaaguggugcuggaacaucuaccaaauauauuuuaaaucugguuauggcaguagcagcaagucugaaauuaaagguaaguauucuacaggaaauaugccuguagacagauaugcuuccaguguagugcaaauguaacagaacuuccuucuuagcucugaaugccuucccucucagacacugcccucuucuuggccagcccucuccuccucacucucugcuucaggcccugaaggcauggagaaacugacagauaaugaagcacucucagcugcaggaacacagacaacugggcucuuuaccauuucauggagcaucgcaaaggaaaaacauggcucugcugauaaaggcucuuacguuaguauaaugauggcuaggaaggcaggugccaggaaaaaagggaggucagugaaaagacaggacaacaggacaccucagauggggaagagggaguccugaaagcagggauggggcccacugggcucuucuggguugcaguaaacaccuuaggcuauuucuauuaauauauggacugccaauuuaaaauaauguuuaaaauucaaaa

SEQ ID NO: 14401 - RNA, 29222 nt, Homo sapiens
ugcaugagugcuguaagaguuuaauuguaagacaaaagcacugcuacauuauacuuuaaacauaagucaucuuucagaaggaaggauucagugcaaauuaaaacccuaugaaagcccaacuguaaauuucauaugaagacucuagaaguaaacuucuagaacuggaaacacuugguuccaacagaauuugcuuggggagaauaugucuugaaaauguuaaaugguacagagaacaucauguuuaagucaaccagauacuaaaaaaaagacaugcugauaggucuuaauacauaaaacuaauugauuagcaguagcaugcuuuauauaucaaugauuauaaaagcaauuuacaauaaauuugagcauuucuaaguuuuauuuacugccuuagccaaucucuuaacuauacuguaauaaaaugccauucuuccaauuuuuauuuuauaauaaaaagguuuucacuucaucagucucagacugguguuuuauauaaauguuaagcucuguauaauccaaagccauccauacaacaaaaaagaaauuauguaauuccuuuucucaaguguuuauucaaagcauagcuuccaugccauguuaaaugucacguuuagguacuggcauuaacagaccucuuaaguuucuuccaauucuuuuuuuccugagaaauacaaaagucaggaaaguaaccuuccuaauucuagagugcaaacagaguacagccucuuauaacaaaauuaaauuuauacaaauuaaccuugaaguacucucuucccaauaccaaaugacuuaaaguuucccaaaauagauuccaauaaccucuauuaucacuguuuaauaaauuaaugccuaucucuaauuucuuugaagacuuuuaaagaauuucucccuuaacaacuaaaauaacagauuuggauugcuauuacaagaacaccaugcuccuacuuaggcucuaaauccuauaaagcauuucagacuuuaauacaauaauuuuguaagguccuuucuccuugcccuugggagaacaccugcccccuaccccccaccccccgcuccaauucccugccuuuacagggcuuacugggggaaauuuauuaacauuuaggaacuacccuacugcuucaacuuccuauauuauauagucaguccccuggagacuauucuuuaucucagcuacucuauacuacugccauuuacauggaaggcugcuggaauuaugcaaccuucuugagaaucgaaaaggcgcuaaggacaauagggcaauauauaaccagcccaauuagagaaaauagcaagucaauuucuaucagaguuguugauuaccaauucauaauaaugcaauggauggcuaagaucagggcagaggcaagauacagacaauaaggggaguguauuggcuguagagaauuuuaaaacaauaccaagcaacucaccauguucccagccuguagccacccccaccaccuacuuucccugacuugguacauuacuguuguucacugucaucuuguacucauuagaauguuaaaaaucauaucauuuuuuuuuucaagguagacuuaggguccacaacuaaaaugcugguuuaguaaaacauauaccuuuguuuuuacagaagauguaaaaacaaacccuuaggaaacaguguguuuaacucuaucuuaaagaguuaacacauuaaaguccuuaacacauuaguaugcaauuaagaucacuuggaggccaggggcggugacucacgccuguaaucccagcacacagggaggccgaggcaggcggaucaccugaggucaggaguucaagaccagccuggccaacauggugaaacccugucucuacuaaaaauacaaaaauuagccaggcauggugguaggagccuguaaucccaacuacuugggaggcugaggcaggagaaucacuugaacccgggaggcagagauugcagugagcugagaucgugccacugcacuccagugugggcaacagagugagacuccgucucaaaaaaaaaaaaaaaaaaaaaaaaaaucacaugguguaugugaaauacagaaucccaggcaacacucccaaacaauucuaagugauucugauauagaugccuacaagccucuuugaaaugccaaccagcuuauaaucaacccuuacccaauuuaccagauuaaaagcaacuguuaccaacuaacaggacaagcggacuccauuugcacaacugaauauuuaucuugcuagaaucauuuuacccauggaaauuuucaggcgacuccuaacuaugccuaguaacaguuugaauauggcuaguauuaaagaaaggauauacccuucucaacccuaucaaaaguagguaucuuaggcugggcacaguggcucacgccuguaaucccagcacuucaggaggccgaggcaggcagaucacuugagcacaggaguuggagaccagccugagcaacacaguaagaccccaucucuacaaaaaauuucaaaaauuaggccgggugcaauugcucacaccuguaaucccagcacuuugggaggcugagguggacggaucaccugagcucaggaguuugagaccaggcuggucauauggugaaaccccgucucuacuaaaaauacaaaaguuagccagguguggugguguguaccuguaaucccagcuacucgggaggcugcgggagaauagcuugaaccugggaggcaaagguugcaguaagccaaaauugcgccacugcacuccagccugagagacagagccgagacuccgucucaaaaaauaaaaaugaaaaaaaaaaauaaauaaacugggccgggcgagguggcucacacaaucccagcacuuugggagauugaggcgggcagaucaccaggucaggaguucaagaucagccugaccaauccagugaaaccccgucucuacuaaaaauacaaaaaucagccggaugugguggcgugcaccuguagucccagcuacucaggaggcugaggcaggagaaucacuugaacccgggaggcggagguuuugaugagccaagaucacaccacugcacuccagccuggacaauaaagugagauucagucucaaaaaaaaaaaagaaaaaaaaaguauauauauauauauauauauauauaagcuggaugugguggugcuugccugcagucccagcaacucaggaggcugaggugagaggaucgcuugagcccagguugaggcugaggugagcugugaucacaucacugcauuccagcuugggcgacagagcaagacccuuucuccacccccccccccaccaaaaaaaaaaaggaaagguagcuuucaaaaaaaaucaaauuuuaugauaguuuagggucauccuuaaauguuaguucauugauaaacugcacuauuaagaaacugcuuccaaauaaauuuauugagaugugaugcuauauuauggaucuagguuuugacauuucagguuaaacucacuccaaacaaaauaaacucagacauuucaggaucaacacaaauacugugauagaaagauuguaucuuuccaguuuccaaaauuccuaauaccucaaaggcccuaaacauacguuuaaaguacuagucuuaauuacaaaaagaaacuuucccaagcacuaaaauaguaaaagcagagacuaaauuaguuucucauguauacaacagacaggcuuaauaacuggauucuaaugagacuaccuuucaaaacugucagcaugaacuggcaccuggacagguguuccacacccacacuguauucucaacugugcacaaccaaguacaaagaagcaaauacuaucccaggauguaaagaguauuaugcuuacaugacuugcaacccuauacacaucgaagguuaggaaagaaacagacaaaaaaggaaacccaggacccaaggaagagaaauuaacucaccugguagcagacaccuacuaaaccaaaagguaucaaaaucugauucagaacaacagaccuagaaagcucauuacuugagaaaaagugggauuccaaccagagucuacaaaaccguuuugagaauugagaucaaagcuacaugacacuacccauuaguaaacacagguuaauuugauaauaaaccagcaaacuacuuguaaauuucacuuuguuggucaaauucuagaagcagggguaccgagcucccuguuaauauugauuuaccuguccuuuuuuguucuccuaaaccuuacaccaaucacccaccuacacaaaaaagcuacaaaaaauaaucugugucaugcccagucucuucugaagucacacuaaaaacgaguuaucuaaaaaaacuggggaaugggggggauaauauuucaggaguucgagaccagccuggccaacauggugaaaccccaucucuacuaaaaauacaaaaauuagccaggccugguggcgcaucccucuagucccagcuacuugggaagcugaggcaggagaaucgcuugaacccaggagguggggguugcagggagccaagaccgugccacugcccucuagucugggcaacagagugaggcucugucucaaaaaaaaaaaaaaaaaaaaaaaaaaaaaaaaaaagaaagaaggaaggaaaaaaacaauauucugccagcugucagcaguguggauaucacagauuacaccacagaacacccugacuccccgcaaagauuuaggaauuggcaguccaaauaccuguagaaacauagaugaaacaggucaaaagaucgauucaaagucgcuuaacaauuaguuaaaccuccagauccucuauacugcuggcaauugacuccugaacccuggcagaaaacuggagauguacucucuuaagcaaguuagaaaagagcuguuggacugaauaggcacagugaugaaaauaaacaguuuacuuuuugagaucccucaacuucuuuuuccacugggaucagaaacugaccaccuuuucuuauccuuuagggaggagaguaagacaccucugguaagcaugaccagcuucagaaaacaaaacaaggaaauguaucaagugauuucucaauaaaaugacacagccauaccacccaacagugaagccagugauugaaaagcacccugccagacccacacacauaacauucaauuagcauuuaaaauguuccacuccuaaauaugacccaaggaucaccaaacaccugaagaaauuuucuaacaugaaaaccagaagccaaagcaacaggaaaacaaagcaucuuggaaacaaacuuuuaaacagguuaucauuaauaaccuuagagauaagaaaaagguauguugauauuuauuuauaacagaugaggggguggucuuagaaacugacacaauuggccaggcgcgguggcucccgccuguaaucccugcacuuugggaggcugaggcggacagaccaccugaggucaggagguggagaccagccuggccaagauggugaaaccugucucuacuaaaaauacaaaaauaagccgggcauggugguguguaccuguagucccagcuaccugggaggcugaggcaggagaaucgcuugaacccaggaggcagagguugcagcgagccgagauagugccacugcacuccagccugggcgacgagagaacuccaccccacacacacacccacacccaaaaaagaaacuaacacaacuuaaauuuugggauguuuuuaaaaguugacaauuaggcaaggugcaguggcacaugccuguaacuccagcacuuugggaagccaagaguucaagaccagccugggaaacauagcaagaccugguaucuacaaaaauugagaaagauuaaauuaacagaaacacauguccagggcuuauacccaaacaagaauuccagagaacaaagaucgagaugguagauggggaaagaagaaucaguucaguaauauuucccguaucugaagagcaaguuuauacaaugacaagauucagugagugaccaguacaauguauuaaauaaacccaagauacaguugugaaccauaagaacaaugguaaaauuccaagugauuucagcguuaagaaagauuccauauguaagaccaagauuuaaaauaaauuucugggucaaagaacaguguagcacacaccuguaaucccagcacuuugggaggccaagucagguggaucaccugaggucaggaguucaggaccagccuaacauggugaaaccccauuaucuacuaaaaaaaaaaaaaaaaaaauuagccgagccugguggcacacaccuguaaucccagcugcucaggcggcugaggcagaagaauugcuugaaucuaggaggcggagguugccgugagccgauaugccacugcacuacagccugggcaacaaaagcaaaacuccgucucaaaaauaaaaaaaauaaauaaauuucuggccaggcaugguggcucacaccuguaaucccagcacuuugggaggccgaggcggacggaucacagcaucaagagauugagaccauccuggccaacauggugaaacuccgucucuacuaaaaauacaaaaacuagcugggcaugguggcacaggccuguagucccagcugcuaaggaggcugaggcaggagaaucgcuugaacccacgaggcagagguugcagugagcugagaucgcaccacugcacuccagccuggcaacagagugagaugcugucucaaaaacaaauaaaauaaauuucuucaccaaaccugaauucucuacauagcuaaacuuaguaauccaaugcaaaauagaacuuuacagacaggaaggucucuaaccuauuggaagauauccuacaccaaaccaacaaagccauagaucuaggaaacagaucauaaauugagaggcaaagggaaacccagaacaauggcaaagccccaacucaacaguuacucaacaauucaaaaagggcaaacaguucagauuagaacacagaaaaccaucaagaaaaacaugaaacuaauuaccaaauuaauguauauaaaaaaucuuuuuucaauucuuguuaccguuugaaaaucagugucugcuggacagaaaauuaucuaggccaagagguacugcuagaaacggcucugagaauugcaauuuaaaugagucagacauacagaaacaaaacaguacaaaaaucggguuacaaguuuuuuucaagaauggguuugaucuccaaaauuaauccuuaaaauuaaaucuaaguagugucucucauuuaguacuaauuaacugccaaaagugcagcuuguaaacauuuuaacacaacaaucaaaauuaaucugguagcauguuuuuagucacacuaaaccugguuuuaauucaaucuguuuuuacccccuccccgcacauuuauaaaguuuuugaugugaaggccgaacacggugguuuaugccuauaaucccagcacuuugggaggccgaaggaggaggaggauugcuugaggccaagaguucaagaccagccuggggaacauagcaagacccugucucuacaaacaauaaaaauauuaguugggcacagugguaugcgccuguagucccaaucacugaggaggcuaaugaggagcacuugagcccaggaguuggaggcugcagugagccacuguacucuagcaugaacgacagagggagacccugucucuuaaaaauaauuuuuuauugagagauuuacauaaaauaagcauaugauaccaaaaagaacccuagcuuaacaacccuaacacaaaaaauuuucauuuauuuugaccaugagucagcaaacuuuucuguaaagggccagacuguaaauuauuuugcuuugcaggucucuguccuaacuacuaaacucuaccacuguaacacaaaagcagccauauacaaaacauaaacaaaugagcauagcuggguugcaaucuuauaaaaacaggacacagguccucaauuuggaucuaucauaaaaaaacuuuaauaacacuaacuuuugcucauuaaaauguuugcuuaguuggaggucaaauucuuagcaucagauguaacuccacaaaaguaagaaagguauuccaucacuucacuacuauagaacuguauaauaauacauuucucauuuguuaccuuucuaaugaacuauucugagcagucugaaguaacugacugcacagccuuagauuaccacucaggguggaacucuuaacauucacuuaaguaauaccuacaaacgauuuuccauucaaguugauggguaucaauucccugaaugcuaauaacagaacucaagaagcuuccaacaaaugacaggaaaaacaauucugacuuaauccuauaguuaucacuuagacucuucaguuucacuuucuuaagagugacucaaaaaguuccuuaggcacacauacuaauaaucacaguccugaaauuuuaaggcccuaaccaaaaaaauaaaaccuuugagaaauggaaaauaaaaucauucaaacaaauaagcacacacacauaaacacgguauauauuucuuuaauccucccucaacacuugaauucaucuaugaaguccaccacagcucuaaaaaucucucugaacuagccgcauuucuauuauaauuaacagauuuuaaguccuuuuuauuuaauggaagcauaaaacauuaacuaucugugcaaagggguacuuuugcacauuuauccagauuuguucuaaaaagcacaauacauauuaagcaaaaacugggcauuugggaaaauauucauauaaaucuuaauggcuacauaaggaaguauuauuaaaacaaccaacaaacaaauugacauuaagucauucccaauuuggacagggaggacacauuauggcaaaaauuagauuuugcuaaaaacauuucaaacuucacugcaauuuuaaucauguccucaauuucggcaagccugucuuccaaacuuaugcuuuuaauaacuugaauccaugacaauuuuuccuauucugaugauaaaagagccaauacauuuuuauacaaaaggauuuauuaaaaaaccaguaagacacuacuacaucaugacacugucacacugggcuuuuaacacaagacuugcucuacaauacugggggaaagggcauaaaacacaaauugauucugaagcauagcaauuaagaaauaaaacaaugaaagcaaauuucuuuuaaugagaacucagaauuaaacuucagagggacccaacgucauacuuccauucagggacuugauacaaaaaauuuaguuugaacugcuauuagcagguggcaggagccaccuucaaaugaaucuucaaauuggaaaauacugcuucaccaccuggagacaaagaagaaaaaauagaagucacucugggcaggcuacaacacuuaacaaaaauuuacauaaaacugaguuaucccuauguuccacuauauguaaauacuguauaacauuaaaugugugauauguuuuauaaauuaaagcugaacaguagaguccaugagcuguaaauccacaugugcaccacugguuuaagaugugauaugcuuuuacaaguauucuuuaaaauauaaaaagcuuuaaaguauuuacccaaagaacucauaaaaaggucaauuugguaaaaggacauuuugacccaagagcaucuaauauuuaagcuuauuuuauuggauaagcauaucucuuguccaucacaaguuauagaaaaguuauauacgacuaaaagaaaaaguuaucuacuguaauuauaggaaguugucacaacaggaauucagcucaagaacuucuugcaauuacugcuacaacgucuauaaaugggaaaagcaagcauuaaaauagauuaauaaaauauaaaauuaagacuggaaaauccagagacaagcuguauccuuagaagaauaaauaguuaaaauuauucaguaagcugacguauuuaaccauuacugggccuguaaaaaaugcauuaaaauuacauuacaaauaguuuuuaaaaagcaaagaaauaagugaaggcaaagcuugaaguauccauuuuauuuuauaaugcugauacaggauguuggaagagaccauaccaaacggcagcauucgagagcgugagcaucucguacccuguccgcauugagcgggccugugagaaucgugaagucagcgcgacacagggccugcaaugaaguucccgcuggcggguacaaacaagguauaaugucagaguuaguaggcaauacuuuuuugcugcaauuccuuaauuuguacccauuagcaguacuuuaccuguuaacuuuacugacuuguuaauaauaggacaaaaaggcaaaagcuuaagagcaccuguguuacauaucuuugaaagucacuauguuauaauaugguaagcacuucugggugcugugaaacucuuaaauuaagcauuguuuuaugaacaauauagauuauaaaaacuacuauuguaaaugacaaaaaaaaacuauuuuuagaacauaccuguuggggauaaguugcaaauggaauaauuuaguaugguuuguagcuauuuugaugaccaccucgccuggauaccuucccauaaccacucugcuggucuaaaauaaaacaaguguuagaaccagaacgguagugguuacauacuaauaaucagaacaguaccuaauuuuaaacaaucucaaaaaauuaaggguagcuuaauucccaagugugaaaaauucacccugagcaaucauuuaucaaauaauuuaccaaauauguagugaaugcauacaauggcaggcauucagaaugagcugauuacuugacuuauuguauaaaaugggagacaauccccucacccuuacaguuuaaaaguuuuaaguuucaaaggauggacagcugacccuuucacaaccaccagcaaaaaauaucuuaaaauuuagaacaaauugucaaccacaaucagugcuuaguaucucugcccuucuaagaaaagggccccaaucucacccaauccaucuuugcugaccuucuucugacuuuaauuaaccuauuauugugcagcaggccuagucaccuaagaaaggauauaacuccaagaacuggucuaaccaaggaaggaaaagaaaaaccacuuaaaacaaugcaaccaaugcaaccacucuccuccaaaaaaauguaagauugcuucuaguagaacccuuuaccugacgacucaacaguugcuacaaaucagguggagagcaacuaccuuaguugcacaaugaagucagggcuuuccaugucuaaaagucaaguuuuuugguucuaucaagcucaacaucuguuuuaagaguuucuacauuaauaauccuaaagcgaggauacuauuaguuuuaacuggcaacaugugguauuauucaguuuuauaggauuaagacacaucaugccaagauuauugguugguccaagaagugacauuuagaauaccuugagcuuaaaagaucugaacugagcuuaaaauuuuuaaauccaaguaaaacaaaugcccagcaaacauauauagaaccacacauacacccuacccuuauaaugugugugugauauaggcugggaggaaccaagcaauaaaauggcugcaguuucaaguuuccaggaauuugaaaccugaagacauuugcacuuggcaaggcuacacuaaccuuucugccuauccaaauuuguacaaaauaaaugucaaauagcaguuaauauaaaaaguauaguacuuacugcuauaaucaccauauccauaguaguuguuguaaccaguguagucauauccuccauaaccaccguaaccuuggcuguuauauccauaguugccauagccuugauuccaauaguuacuauaucccugguuccaguuuugacuggggccugcagcacauuaauagguucacuaaagucagaagaucagcaaagaucuuuacuucaggauaauuaaaaagcagaaaagcuuaagauagaguaaacuuaggcucuagcuuaccaccaccucuuccacgagcucuuccugcaaauccuccucuagauccccacuguugcuguugcugauauuguuccuucgacauggcuacuuuuauuucacacuaaaagagaaaaauuacauuauuaaacugacucaagaaaauaaaaguugcuaaauaaguuucuaauaaccagaauagccaacauguuuaaauagaguaggcuaauuugaaacuuuccucagucaguuuauuaauuaaaccaauauuuaguacuuaagaguaaucacuuaugaguacuugcuagugauguuacuucauuuuacuugucaaguucuaaaaacuauuuuugugaaagccuagacaaaaacacuaacaaauguguccauccugcuccccacaaaaaguuggucaaugguaaguaaccaaugagaaguuuuuaaagcaugcaaagaacuuaagccuuuacagagaaagauaaaugguuaagcucuuuacaacagcuaguuuucucuacaaguaaauggaugcuuaacuuacuuuacuaagaccaacauugugguauuucuuuuccauuaucuucuucacugguucuucuuccuuaaagguaauaaagcagaacccacgccucuuauuggucuuguuguccauggggagcucuauggauuccaccugguauuaaaaaacaaauuuuaauaugcuaacaugcauuuuauugaccuuaaaagaaacacaaguuuagaggggggaaaacacacaaagaaaacauguauuuggcacugaaguucuagucuccuguuucucccuauuuauucuaauccuuuuaaggaauucuucaaauuagaacacccauuccaucuaaggucuucacaacuauuuacaaaaauaagcuuuaccacgcacugacauuuacuaccuaacucaagggucacaaauucaaaugcccacaaagaacaagaagaaaacagucaaaucuaagaaaaacagaauaaaaauguauuugagagaaaacaggaaguaggguggugaggacuacuaaaaacuggagagcauaugcccaaaccaagauggaagcuacuacucaguuugagagaugcugccguacaggagggcagcgucaguucccauguugcgugcucuugcaaguauuuuuuaaaaagcuagauacugaguuuugugggcaauaucucaaauccucaacacuaaaaaagcacuuauuguuucaaucaagcaauaaaugucugugggacguaucuggagcccaaggccacaaauuucucaacuuucauuaauucauaaaagaaaccucuauuaucuaccuauuucacuaaugagucuaaguuuguuuuacuuuuaauugagacggggucccacuauguuguccaggauggucuucaucuccuggucuccaguaauccacccacuucggccucccaagugcugggauuacuacaggcaugagccaucgcguccagccucacuaaugagucuauaaugauuagucucauuaaauuugcacuuacacaugcauuucaacugauaaggcacuacacccuauucuuaauuccuuuccuauuuucaacaaaagucuccuucuaaucuagauuucuuccucuuaauugucuguauuuaagaauguuugucuauuucaucuuuguauacucuaccccagcaauacucugcauagaguaggugcucaaugagaaaaacacauuauccaaccuucaaagaccugcuaaugaaguauuuacaauauccuuauuccaaaacagaucacauaaucuacccuaacagcuuugaaaagccaagugacucugaguccauaaugggacaaucacauucacacuaauuuugacauaaacugggucaaaacauuuauaacauaccucaccaaaaccaccaaaguacucccuuauuuucucuucagguguaucuggagaaaggccaccaacaaaaauuuuuuuaaccggcucuuuuguuuucauggcuuuggcccuuuuaggaucaaucaccuucccauucaauuuauguucuuuuugauccaugaccuaaggaaauugaaguuuucauuuaaaaaauauauaucuuaacugaaguucagagacuauuaacuuacuuaaaaauaacuauaaauacagauaaugccaagcauauguugacuugcucaagauuaaacugucaagucaugguggugauguaacaucaacuaacauauacuguuuaaaucuaaagguaagaaugguaggacauacacaaauuuaaccaauuacuagauaaccauuaccuucaauauauacaaacaugacugcuacuucccuuuagcacuauauacaaacauaacugcuacuucccuuuagcccaggaucaaaauaaugauucaguuaaaaguugcuugccuaacaaaauuucaaaauauggacuucugugaauugcuaaaacacauccuuuuaacuaggcaucuuuaagucuauaguaucuuuaaaguuaauuucaaaauuuagcagagccuggaacacaaauuauucaggaaauaauuccugaaccuaccucuaucuucauaaaacguauuggggcaagaacuauucuuccuuccuauacuaucaaaauggggaaccacaaauaggcaaacucauuguaucaaacuauccauauguuaauauuuuauauuauuaacugaucagaacacguaacacacuaccuuaucuacacucuccgauucuuuaaauagcacaaagccaaaaccccuugaucgcccugugauaggaucuaacuucagagugcagucuacaacuucaccaaauuuggaaaaguaguccuucagaucuuucuuuguagugucccagcuaaggccuccuauaaacauuuuccuguaaagacaaaaagcaguauuaaaaugcuuaaaaaaaauugccuuaaauauuauccacaucaauaacacaccuuuuccaaacugcaccaguuuacugggcaguauauuaaaacaucauucuuccuacauaaccacacaucaggaacauccuauuccaaaaagcuggcuuauuacugcugcucccaaauaauuacaaaauagugagcaagcagcaaauuaagucuuucaacuugcuaaaagauaaacauauacccaaaguaaaaauacuguacauaaaaguuuuccuuagauuaaaaaguuaacagcaaaaaaaccagaaucuuagcuucaaauuucucuuccaaauguucauuaaacuuguuaaaaugcuaugcaguuccccacugaucucagcaaccagcauuggugucuaugcugaagcuccuuuucuauuuuaacaguucucucauuaacaaaacucuuagcacauaaaauggaaaauucuacaucucacaauuaaguugugagccaauuuuuuugaugugcuaagaguccuuaagacaaaaguaaugugcaauauaaacaauuuagugaaaauuauccauugaaguacaauccacuaauuaacuuagaugauucguuuacaguagaaccucaguuaaccagcaauaaaguauuuaagccuuuaaaaugcagaaagugaugggugguaagcggaaauccaccaagacacucuaagaccaaacguauauacucaaaauaaaauauuuuaaggcgaaaucuuacuaacauuacagcaaaacaccagaaaguucagaucuggcagcuuuacauaggcucccuuuguacaaaaauaaauaaauaaauaaauaaaaagcuauccuauaccuaaccuucuuucuacccuuuaaaaagacaggacuggagguuuuuaauuuuaaggguaaacugucagaauuuguuacauaauggcuaaaaaugucaccaugggaaucaaaucagacuugcucaacauuuucucuucuuuuuaacuggggaagggucauggguggggacugggaugugacacuaacucagcucuauaaagaaauuaaaggccuuucauuaggaaacaucuccaucuugugggcuuuuaagauacugccacuaaggcccauucuuggaauaaaaggccaauuaacugucccuugaauuagggucuuucuucacuuccuccaagauaccugauuaacugagguguuacugaucuuacuauccuaccacagucuuguuuuacuucuagugacaaagcaaacuuucagugcagaguaagucuuagguauauacugcgcuucccacuucagguuagcuuuucaacuuacauguauucuagagcugggccauuuauaugcuuaauguucaggacuuccucaaaguuuccaggcuugaaguagcauuuauaaaacaacuuuggcauuuuauaaucaaaugaacaaaaauacccauaauguuuuguguauuugaaauguuuacuucuugccaauuucauggaagaaauuugaguuauuuucucaauauacauuuucuuuaauuugaauaguguguaccuucuaauauacaaucuuuauuuacauaauuugcuauaaacaccuuauuuuuaacuuacagguccagaauacuuccuucacagacagaaguuauuuaccaacauucacccuguaaaggugaguacacuauauuuuuaaugagaaagagaacugacuauaaagcaaugaccucuugcuaagaugaccauaaguuccacaacagaaauaacuucaauuaaguugagauuuaacuauuaaauuacccuuuccaugauuauuacagaaauuucucaauaauaacuaacaaacuuugaaaguauuucagccugaacacaacaguucuaacaaaaacauuuuuuaagcuguugaaaggcaagaaaauucucugucuggucuauucagauauggagacagaacuaguuuugauuuuauuuaaccaaaaagcaauguuuauauugggaaaauacccuuaauuuaaaauuauuaagaaacagaaaacaauuacaaagaaauaaauuaaaacaccaagaaugagguaugugguauuauucugaagccccaaauguuuuucagacaagaagcagauuuucuuaaauaucaccuaagcauaucaucagcuggcccagcaaagugcucuccaaacguacuccccaccuuuaguaugguaguuguuuaauaugccuaccuuagagcuacaaggguucacugaagaugcuaucccuccuaaacuaauaaucaaauaucaauuauccagaauauuaaaaacuucagcuauccagcacuuuuggagaauaaggagccaaguauuauuccaccucccuuaaagcaccgccugcccucucuaaucuuuccccaauuguuuuuaaccuucaaucauuugaaaugagauuuuuuucuaacagcaucacacuuuucugccuucuuauacuucaaauacaguaaucauaauuuaacacuauggcucagacaucacuauuaugcugauuuagaauauccacagggucuucuaaaauuagcuauuaauacaccaaguccaucucauuucuucacaaguucuacuuuucauuuuugccagaucaccaguugcuguucuaaaaagucucccuuccguuuugcagaguaaguagccagcugucaaacuuuucaaauucuguguaaaguagaagucucuaagcaagcaccuaaguggcucgucuuugagacaaacguauuaauauuuuggcagcccaagaacacucuggcuuuuucuucuguucuaaucaaaaaagguuguuguucucaggguaugcuuaggcuuuaaaaaaaaaaaaaugguugcugaccaaauaggugaauaugcuacaaugaacacaaacuggaccaauucuauuccaucuuuacuaaauggaacauauuaauuccauuccaucuuuuucuguuuuugguugcuuaguuuuugagacagucucacucugucgcccaagcuggagcgcaguggcacaaucucagcucacugcaaccucugccucccagguucaagugauucucauuccucagccuccgugggagggauuacaggcugcaccaccacgccugacuugauuuuugcauuuuuaguagagacgggguuuccccucguuggccaggcuggucuugaacuccuggccucaagugauccgcccgcuccagccucccaaacugcugggauuacaggcggaagcuaccauacccagccccaaacucuaacuuuauaguacaauggggaaaagucugcuuaucuuaauuauggauaaaugggcacuuagucucuacaauguuggcauacaugcucucccucaaacugauggcauaaugauuuuauauauauauguguguguguguguguauauauauauauauauacauuuacaaauacuuauuuuuuucuuuuuaaacagagucucacucugucgcccgggcuggagugcaauggcaugaucuaggcucacugcaaccuccaccucccggguucaagcaauucuccugccucagccuccugaguagcugggauaacaggugcaugccaccaugccaggcuaauuuuuuuuugcacuuuuaguagagaugggguuucaccauauuggucaggcuggucucgaacuccugaccucgugauccaccugccucggccucccaaauuagaggcgcgagccaccaugcccggcuaaauuaucuacauauuuucuaugacuguaucuugcuuuuaaagcacauguacugucuguccagauuaccucugcugccuugaauacaaagcauuucauauugcugucacuccugcguagugcaaacacuuuccaaugaaguagacagaacuucagaaaauacccuaaggagccauguuaaaaacgaccaagacuuguucaacuagcaacaaagauggccccuaacgcugcaauaaguuuaaacuuugauccuuaguucuaagugaaucaaucccaauuaaaaugcaggacuucaucuacuguauuuuauuaacauaguugaguaucuuaauccuagcugugaacuaaauauucagcaccccaaggcugaauaugguauucaguuuaaaacaccuacuccacaacagaagucuccuugcuuucacauuggcuuccaccaaauuguaaaauuaaaugacaagcauaaaguuauacaacucagcauagauaacuauccaagugauaugcaguaucauucaggaauuuaggcuccuuugugggacauuuuaucaucuuuuaaagcaaguuaaguuuagaggcaauaaagacaaaaugccgggguuuaaacccuacugcugccuuuuuuuaagacagggucucacucugucucccaggcuggagugcacuggcuccaugacagcucauugcagccuugaccuccugggcucaguugguccucccaccucagccucaccaguagcucggacuacaggcacccaccaacacacccggcuaauauuuuugcagagaucagguuuuacuaugucgcccaggcuagucuuccaacuccugggcucaagcugcccaccucagccucccaaagugcuggaauuccaaacaugaaccacuccaccuggcccccugccucuuacuaauuguguaacauuaagaaaaaauauuaaaguccaagauuguuuucccaucuguaaaaagagcauaccucagauauuugcagaggguuaaaacuaguuaacacacuuaaaggacacagaauagucugacacacauccuaaaugauugauagaaguuacuauuuugaagggguaaagcacuauaagcacuaucuaaacauaauuuaauaaagcaaacuuuuuauuuacucaauggcuuaauuuuuuaaaacugcauaggcuuuauaaacuuuccaacauuaaaaggaaaaggccacaaugaguuuuauauaaacauauucuaauauuuucaaugcugccaacuugaaauaacccagaaauuuuuaaauaguccauguaaaaaaauauauaaacuaaaaauuaggugguauuucaacuaagacccuuuaaauguagcuuccaaaaucaccuugaugacuuggucuacccuacauuuaugccaguaauuuuaguaaagaauaauuuaaaacauaaaaggaaauauacauggagcaauccuggcugguggaaaauguuccgauuuaauaauccuggcuuuuccccaucaauaaacuuauucucuggacuauuuaggucacuagguuuuuaacauucccagucaauauuaacuauuuuauuccaagauaccuccccuaauaagucuuuauugucaaacaccuuauucaagguaaaaaguuagccauuauacucacucccaauuuuggaauaguauucuuuuucuauguucuauaacuucguauuauuuuuacuuuuuuagagacgagaucuugcucuguuacccaggcuagucacagaacuccuggacauagcgaucagccucccaaagugcuaggauuacaggcaugagccaccacacccagccaauccuuuaacuuuuaaacacuuccuaacaacuuaugaucuuacauacauggcuuuauaacaaguucugacaguuuaaaaaauacaacagaaugucaaccugauauacauuucagguauaaaacauaaaugaccaaucacugucaucuuuuaaaguaauguuacucaagcacaccauuaaauccuuacugaauuuuuccaguauuuuauccaucauaauuauucuucuaaaauccuaaaaugacaaacuaaagcuaagucacuaguuaccuaaggggaagggaggagguuacaaugcaacuagauaauaucacacguuaggguauuuuacaaguuguaugaaaacuaccuugggagagagcuugacaagcuuucaucgaguucaaauacuaaccagccuuuuuagaucugaucugguauaaaauucaugaaaaccacuuuuuugagacagagucucgcucuauugccaggcuguggugcaauggugugauccuggcucacuucaaccucugccucccaaguucaagcaaucuucccaucucaagcuccuggguagcugagacuaugggugcacaccacgaggcccagcuaauuuuuuuuuuuuuuuuuuuuuuuuguagagacaggaucucaucauguugcccaggcuggucuggaacuccuggguucaaucugcccaccucagccucccaaagugcuauauuacaagcgugagccaccgcacccagcccacuuuuuuuaacuauuuaaaacuaaugagacauuaagguuagccaauaacaaaucuuccccaaaaaacacuuuagucaauaaaaauauaaauuuugguauuauuuccccaucauuaaagaauagguauuccucucccccagcuuucuacagaugacauuuucaagguaagugugaaaaagaauuccauuuauucaagacuaauauacaauggaccaaacauuuucagagacuucucuguauuaaaucucauuacuucacacuuuagaaugaaccuaacuaaaugacuacuaaaaagcgaaguugaaaaaauaaacaucuaauaaaugaaacaugacaguuuuuuugggagggggacagagucucgcuuugucgcccaggcuggagugcgguggcgcgaucuuggcucacugcaaccucugcuucccggguucaagcucuucuccugccucagccucccaaguagaugggacuacagaugcccaccaucaugcccggcuaauuucuguauuuuuaguagagacaggguuucaacauguuggccagguuggucucgaacuccugaccucaggugauucgcuugcgucagccucccaaagugcugggaugacaggcauaagccaccgcgcccggccaacaugacaguuuuuuaaauaaacuuuuuuuuucuuuuuuugagacggagucuugcucuguugcccaagcuggaaugcaguggugcaaccuugucucacugcaaccuccgccuccaggguucaagugauucucccgccucagccuccugagugacuacaggcgcauguaaccacaccuggcuaauuuuuguauuuuuaguagagcugggguuucgccauguuggccaggcuggucuccaauuccugaccuuaggugauccacccaucuuggccucccaaagugcugagauuacaggugugagccacuacgccuggccuaaaaauaaaacacuuuaagagaccaggucucacuaucaaaaugcaguggcuccaucauagcuuccugcagcccugagcuccuuccugggcucaacacauucuccugccucugccuccugaguagauguaacuacaacuacaaacacaccccccaacacacuagccuuuuuuuuuuuuuuuuuuuuaaagaaacaggggucauauuauguugccuagcuggucuagaaauccuggcaugaaaugauccucauaccucaagacuucugaguagccagugauuacaggcacgagccacuacuuuaauuaacuuuaaaugcuuaauccaauaccuccuuuucacuucacuacaaggaagcaaugacaucuuguauguuuacguuuuaaauaagcucucaaucagcuuuguaagguaaacucccauuuaccuagagguuaaggaauagguauuuuccuuaaccugaagguuaagguucugguuaacugagauuacuacauauucacaauucuauaaaacuguguacuggaaaucaauuuagguaucaaugcugaagucagaaaaugauuuguaccuugaugaauuuuccaacguuuuaaaaucauguuacuuuucaaaaguguaaggaaaaaucuguaggagauucauuccaugacauugucuguugguugcuuuuugaguauauuuucucauggcuucaucuaucuugcucauaagacuaaauggggagacagacuuccuggcugugugggcucugugguagucugaagucuagauaagcaggaguuuacagugcaagacccaauacuuaaacugucaccuugauuacuggccaagcaccaccaguaaauuggagucuucccuccccacccccaaauauucuuaaauaccuagcuccaacguacaauauaauacuccagaaacuaaaacaugcuuaccuuuacuccacaggaguaaaucacuggcaguaucaacuauuagggcacuggauaaauacacacaagcuaugaaagcaggcuauguagucaauccuccuguggugagcauuguuuccaacacauagaucagcaaaccaaguaacaaacaugucguauuaccugaaaccacacuguuggaagugaagcaacagaaagagaucccacgcuuucagcauccaguucagugcccuaucuacuaaaacguugaagcagaacugaagucaaaucaagcuuggacuaacauaaguuauguuucacccauuuguaaaugugcacacacuugagguacacagcuuccaaguggaaugggaaaaaaaauuacucuauuccuuuuuaaaugcuuucaagcaugguauguauuaugacuugaaggcuaaaacuaaucacauccuucacguuggcauaaauaguauacucaauauguauacucaaauguauacucaauaguauacucaaaauguucucguauuagggcagccuuacccuaauauuauguauuaggacgauagcagaguacccaggaaauauuaaaaacauacacugaguuuguagaaagggucacauggcuuaagggaaaaaaccccagauuuaaggcaaaguauguguaucucaaaaacaagcacugaaaaacuucaaugacauucucccaauuccaaacuuaaaaaacgagauuauuuuuaguaucuuucauaauagaugaaaauuuacagugagaaguauuuaauacucuucgcuuaaauguucaucuaaagaucuggggacaucaauuucuggaauuuuuaacucgggaaauuugucaaaggcucccaagaaugcuaacacugagaccaaucuacgcagggucucaacuuuacuacauacaguaaacccaacuguacugaaucaaaggccaguaaauuuggcaugagacuacucuaaaagaaauuauuuuacaaagcaaacaauguucagauugccccagaagcacuaagguauaagaccauaaucucaaacauuuaaagcaaaaacaugagccuagucuuuuauaaucagacaggcaacaaccuacagcaggauucacagaauucccaaaugggaagaaucacacuugggcucauuauacacuaaccauuaacaggacaauaucuacuguccuguuauuaaagaagcauugcuggacuuuggcuaagugaauggggggacuuuuuugcuuccuacccaauccaaugcaggaaagucuauguaccuaccuuguaaaacuaucucaaaguuaacacaacauuguaguuuccauugauuuuuaaacuuuaaaaacucugcccucagagagcuugcuacauggcauguauauuuugccagacacuaaauaauuuuaaaguaccuaccccaaaugaacugcagcacugcagagaacagaauggguccacaccacaaaguaaaaugagaaauuccaaugcuuauaaguaaaaacuacggauguuaaugugggaaagaguaaaucaaagugaacucaggagggcauacuauggaaauaauuacuuauucuaaagucccauaguaaacuguagaaacauccacuagagguguaacaggcaugccuuccuaaaaauagcuguccauucuuacaugcaaaaggaaaaaaaccuauuucuaaaaccaacugauuuuuaaaguauuuuaggaugaaacuguaaucacuuuauucucagauuugcagaaggaaaugcacacagaacuguguuuaauaaauucaauuuggauacucuauuaaccagucuuacccucaauauugagacuauaaaacuguugcccuuauaauaucccucaaaaugggagaaagaggaagggacagauacgguggggagugcagacaccaaaaaaaaaaaaagagagagaaaaaagucugaaaguuuuucauucaaaaagaaagccuuaacgucuggaacaggauagggcugcauaauuggaaaguuaagaaaagucaaauauuagagcccuuaaaaaugagaacauuauuuuuaaguguaauuuuaaaaucaaccuggcuaggccgggcgcaguggcucacgccugugauuacagcacuuggggaggccgaggcaggcggaucaccugaggucgggaguucgagaccagccugaccaacaugaagaaacccugucucuacuaaaaauacaaaauuagccaggcaugguggaauaugccuguaaucccaacuacuuuggaggcugaggcaggagaauugcuugaaccugggagguggagguugcgcugagccaagaucacaccacugcacuccagccugggcaacaaaagcuaaacuccgucucaaaaauaaaauaaaccuggguaaaauuuuauuuucaguaaaugacaguugguuacuaucuagaauguuuauuaacuaugaauauaaacauuucuccauuuuuccugagauuauucaaaaaaguuguaauauuacaucguuuuagguagcaggucaaguguaauuacuucgaagagucaaaacacugaccuucaaauuuaaguuuauggucauuucaaaucacuggaaacaauuacaugagacucaaaauacauaauggaguaaugucaaauaguuuauaguuuaaucuuaauuugccacuauuagcuagcagugaaauugagcugcuagugcccaccacucaccaaauacagggaauaacauucaucgaaacugugaccccagucuuuuuuuuuuccucuuuuuugcuuuuccccuugccuguuucccaucugcuuuuucuccaagguaaagcuggacugauuucaguggaugagaauacagugauaagcaaaucuuuaaauguuacccuaaauaggcucuuaaaauagaauguagcuuguaaagauauaaguuaacugccugcaaguuaguggccuucuacucuccaguggugguguauaaaccccugaaaauucaaauauaauccuaaaagcagaaagacugacauuuaggggaggggaaaggauggauaaaaagaacaauacucaaccuaccagccuccaaagagaagucaugcaauugugaauacaugucaaccaacuguuauuaauauuccagccaaaucacacugaaaauaaaaaaucugguaagagcuguaguggaaagccacauuagcccaccuuuuaaugguauauauauacacacacacacacacacacacacuucuuauuaaaggucuauuuacaaauaugcuagguaaaagacaaacauuuuuccauaauacacagugcugcuuaaagaacugcuucagacaucuccagaauauuucaguauaacaugcaugacauuuuaaacacaauauuuuauaucaaggagucuucauauuuagccauuaaacuuaaauuccaacaaaaauauuuuucaucuuaaaauaaaucaaaugugaagauuacgguaauauuuuuucuugcucgauauaaaaauaucguuacuaauuguuuagcuuaaauugccaaacugcaacuacaugcauuaccacagaccaaauaccauguaacggcaucaauuuugcccaaagauuacacaugaugccuauaaaagguauauaucccagguacaaaccuacuguauguacuauggucuagaauuuccuggggaucaaugggcaacuaaccaauacacagccucuacauauuaugacuacugaaaccuuuauaauacagaaauaaaauuuaaaaguuuuaccauucuucccgcugugccgucgcugcuucagagugucguggggaggaguuugaauggcuagggaauuaacaaccgguacagcaaccaaucaaaauucuaguuuuaguuuuugacacuguuaggguuaaaaacuuuaauucauuuacacuucaacaguagguaacuauaaagucagcugcuuugcgauuugaauuaucagggcuaacagaaagccugccccaaacaggaaguuauacaauuaaucauuuuggugccucuguccaaagaacagaauucagcaaacgaaaaccaaaauguuaaagguuuuaaguuuccaaauaucuaacaucuuccuuucucaaauaagcuauauacaauucgaguugguucuguuuaauuuuuaaaaguuugcuucccuucccaccaccacucccccaaaaccagcacuaucaucaaacagccugacaagaaucugccuaggcugggcuuaauaaacccuauauuccaaagugcuucuccccucccaacuuucccuccaaauccugggcucuuucucaguaaaggaaaucguguuuucuaauacuagauuaaagcgacaucuuguuauauccaccaacaccuuucucuuuacaguuaaaaaaaaauucagacacacacacaccccuccccauuacaaaaaggaauggaagcgugaacccacgaucaucggucaguaaucggagcuaagaaaacucaaccaagaaaccugauuuagucccuccugcuaacucccguauuauguucccaaucccaaaugcugcauuuuaauacacuaaaugcagauuuagguaguauauacaacuguuauuucaauuggaggaagcaaguuaauacuaagaaauuugcaccaaaaagaaaaaaaaaguaucccauagcacaauacaggauuuguuucucuuaagaggacuacaggccucccuuagugggcgggaaacagauaucaagacaccaaaauaggauccugggcaccgggaaaaaaagggggcuggggguuguaaaaaauuagguugcacauaaaaaguaagguacaaucuguacuaacaguuggggaacccaauagcugagggcgcgaaaagggugcgcgguuagaauaacucaguggggugggggaaggguagaugcuaggccggagauaggaacagcuccagucaagugcaggcccgaucgacuaagaacuuaaccagagcccgcggagcaaaaccaauguaccaacaagaaacucggagcauuucaccagacccaauuuggucugcaugucaaaauguagggccuguaugaguaugccauugugcgauagcguaugguggagaaaaugaguaaauccuuaggcgaaacuuauucaaaaucccaagaaaacagucggccuaaggccgacaagggagaggcagagguggacagccuacgcguuccccaaaacaugugcuuauaaacaaucgcaucguuucaggaugguggagaagcaccaaauaaaccuuaguaauacaaacagagaagcuguuugugucuguguuuuuaugcccaagacuguagaaaaagggaaaaagaggggacagcauggaaagaaaaaagguaccccacgacaggcgggaaaaaauccuggcggcuaagucggugggaggagacccauggcgagggaggaaaggagggcgggccgaggagcagcauggugacggcuaaagguggaaacgugugugaugggggaggggggcgauaagcaggcaaaggaagaaggaaaugaagguccggggaacccaacauagaaaaagggagaccagugcaaggaggcugcaugggggcccggagaacgggcugagagcgggaaccaggccuaauggcgggggaauaaagagggggagggggacuaguugggccugacuauccugggaugccccuuacucacccuucauccuccucguucuuacuggcgucaaucuucgcccccuccgacucggcgcugcccccuucggugccuccagacgcgguuccgcccccggucccggcuccgcuucccgccgccgccgcugcccccugugucgccgccaccauggcucccuccugcucgcccgccgagccgccuaccgccgccguugccgcugccgccgccccguccccgccgaacugcuccuccgacauagugcuagugucuccgccgcugccgccgagacuacacccgccgcugccgcgaaccgaaacuagcagcaaaguaauccccgccgcugccgcgcgcccgcucuaccucgcgaagcacacaagacagggaaggcgcgcgcguggcugcaaaggcuccugcgccucucccuggccugcccccuucgccucccacucucgcgcggcgcacacucccgcucucucccgcugcacuaaaaaagaauaagcaccagcggcggccgcucucgccuccuccucgcuuuaauggcgccgccgcggaccaccuaaaauggccgacggaagaacggcgcgucccggucacgugacgcgagagcgcgcccuucgcgcguccccccaccccuaucccccuaguuuuuuuuuuuucccuuuccuccucggu

SEQ ID NO: 14402 - RNA, 2927 nt, Homo sapiens
aucgacuaagaacuuaaccagagcccgcggagcaaaaccaauguaccaacaagaaacucggagcauuucaccagacccaauuuggucugcaugucaaaauguagggccuguaugaguaugccauugugcgauagcguaugguggagaaaaugaguaaauccuuaggcgaaacuuauucaaaaucccaagaaaacagucggccuaaggccgacaagggagaggcagagguggacagccuacgcguuccccaaaacaugugcuuauaaacaaucgcaucguuucaggaugguggagaagcaccaaauaaaccuuaguaauacaaacagagaagcuguuugugucuguguuuuuaugcccaagacuguagaaaaagggaaaaagaggggacagcauggaaagaaaaaagguaccccacgacaggcgggaaaaaauccuggcggcuaagucggugggaggagacccauggcgagggaggaaaggagggcgggccgaggagcagcauggugacggcuaaagguggaaacgugugugaugggggaggggggcgauaagcaggcaaaggaagaaggaaaugaagguccggggaacccaacauagaaaaagggagaccagugcaaggaggcugcaugggggcccggagaacgggcugagagcgggaaccaggccuaauggcgggggaauaaagagggggagggggacuaguugggccugacuauccugggaugccccuuacucacccuucauccuccucguucuuacuggcgucaaucuucgcccccuccgacucggcgcugcccccuucggugccuccagacgcgguuccgcccccggucccggcuccgcuucccgccgccgccgcugcccccugugucgccgccaccauggcucccuccugcucgcccgccgagccgccuaccgccgccguugccgcugccgccgccccguccccgccgaacugcuccuccgacauagugcuagugucuccgccgcugccgccgagacuacacccgccgcugccgcgaaccgaaacuagcagcaaaguaauccccgccgcugccgcgcgcccgcucuaccucgcgaagcacacaagacagggaaggcgcgcgcguggcugcaaaggcuccugcgccucucccuggccugcccccuucgccucccacucucgcgcggcgcacacucccgcucucucccgcugcacuaaaaaagaauaagcaccagcggcggccgcucucgccuccuccucgcuuuaauggcgccgccgcggaccaccuaaaauggccgacggaagaacggcgcgucccggucacgugacgcgagagcgcgcccuucgcgcguccccccaccccuaucccccuaguuuuuuuuuuuucccuuuccuccucggucccgcccucucgcuacccuuuauaccuuccucucacgcuccgcguugcacagccuugggggccuuuaaaaggaaccggaagugucgugagcuaagacagucgcgcggggaccaucgagaacaaggagugcuguuucgaaguagcggcuagaggggcccccugccuccgcccccgcccuuccgaggauuccuggaguccacucaccccuccccaccacuccaguagcggcgggagcagcagcguuaggccgggguguggcugcaccucugcgaaggcugucgugccccgugcagcugcggcguucgggugggggaggggaggcucacacccugcggcggcuuaagccuggauuuacgcacuggaggagggaauuagcccugagaugucagcccugugccccuggcgcuguccacccggacgcccgcggagcgccaggcgccgcagcggaccgcgcgcgcacugauugccgcagcuacucucccugccgucgccgcccgggaccgggugacauugagguuuucgucuaucgccgcugggccgauagggcuucuuuuuaagauuuggcuuuccaaguaagauuuuuguuugccugcuuuucuccuggaauuuuuuuguuuuuggucgaagaagcagguaacuugcauaucuuaaggaaaacauuguuuuugcuuugcuuuuguuguuuaaagauccuaaaacguaccgugauuccuuuacguuacuaauaauuggaaaguguguuaaaucaaggguucgcuuaauguucuuuagccuuuguacauagaauauauaaaugucgugagucaucuuuacgagguuuaugaguuuguguucggguuuggcuuuuuuguugugugugcgugguuuuuuuuuuucuuuucuuguaacaccguuaggcguuucauuaagguguauaaaaaguaauuuuauacaccuauuaaaaauucccgcugccucggcuggagacuggauuauucgggcuuugggauuugcugcuuccagcaguauccuuagaagaaaaugaagcuucuagguacuucuguagucaacaaauaauuauuugccuguuuaauuaaaguguucgggcacgggggaaacaaagacgaguuugcagacuccagcaaaaaucuuaagaguuuaaguauuugggccgggcgcgguggcucacgccuguaaucccagcacuuugggaggccgaggcgggcggaucacgaggucaggaguucgagacaagccugaccaacauggugaaacccccgugucuacuaaaaauacaaaaauuagccgggcgugguggccgguaccuguaaucucagguacucaggaggcugaggcaggagaaucgcuugaacccgggagguggagauugcagggagucgagaucaugccacuugcacuccagccugggcgacagagcgagacuccgucucaaaaaaaaaaaaaaaaaaaaaguuuagguauuuuccacugcaguuaaacgaauuuguauuaauuggacacuauccaaaaaucucaaaggaagauuauaaguaaguuuuauua

SEQ ID NO: 14403 - RNA, 3449 nt, Homo sapiens
ugauagauuugugaacuuuauugcaauauauguuuuaacagaaaaauauaauuauaguauuuuaaaauguaacucuuccucccucaguguaaauaaaaucacaaugacaagaguccugaaaccucuaacugaaaaucuuccuuuaaaaaugcaugguggucuuaauguuuaaaagaagucagccuauuuucgcaguguauauucauguuaucuaacguucuuuuuucuccaauuauuauacauacaguuuuauaagugaauauuuaagagucaagaauuuugugguauuuugccuagaaauagacuggaagaacacaaaaucuaaauaaagaauaaacaccaaaaggccaaagggaaagaacaaaaaaaguacauguacaugcauaugcacacacacacccccacauaggugcuuuguuuuuaauaauuuauuucaaaacguauuguacaaugcugucucaaauacuuuauuuggguuuaaaagaguuguagauguuaguauagguuguugauuucaaauggaaaaauuauuggcauugaaagauggcaacugaaaucuugaaccuaacaguuaauuaagguuacuucgugaggauuaaauauuagaauucugcuccgccccccaccaaaggauaccgguauuuuuacuaaaauauauuuuuagguuuguuuuggcauauucuuuucaaagagauuugaaacucuuaaauuguuauaauuacaaaaucuuauauuugaacuuucaaaacauuacucauuuugaaguagaaucuaaaacuacauuuaaaaacauuucugcccacauuuggucuguuuaagggacuaaccuuugaacacacuagucuuauuuugaaagggcaagguguuuuuuuuuuuuaauagccagugccccacagaagaaaaacugugacaccccccccccacaaagugcucauauauaucaccuguguuuguuagcaauguuaccuccaacuuuguuaucuuggaguaauugacgaguaaaucauuacaaauggguccaacucuaaaggcaaaaucgucaaaaagaagaaaacagcaaauccaacuugccuuauguuuauuagaggaaauccugaaacuucuguagauugcaguguuaggaaaaacaaguuugugauuacagcgauguuaugaccacuuccccacucuaacucuguuguuuaagggaguccacuccuaacugcugacucaguuugucuuuacugccagaacugaagcgugacccaaauugucugcuggguugaguaggaacaaacgggcaaaaugaugaucacuuggcaguucuagguuuacuaaaggauacuuauuuggucuaaacacuguuugugggacugcaaagguauaaauaaugccccucccaggaaggaaaaggaaaaucuaaaaucuuaggcaaccgacucaaggucacugacggaaggcaccauuugagaccgagcuccucaacuacagucccaucacggacgggagccacacaggagagcgugcaggaguuucgaagcugcguaguacaauagcuggcgugggcaguucuuuuauacucuggcuagaguaaaauuaacgcaccuuugcguuucuccaucgccucugacagcauccagcuaaaggguguaggguuaaggaaagcggaacccaguuguccuuucucagcugaguccuuucagaaacugggacugaggagggugagcgccgcggagaggggcaggggugggagaggagagaggggcgcggggcggggaagaggcgcgucuggaaggcaguggggagagggacugagaggagugggguugaaguccagcugggagcauccagcggcgcugucugcagacaggggcgaaggcagccgcugagagugaggcaagagcgggaagccgagggaagggaaggaaguaaggaaagaggaaggaaaggcaggaggggguagaagcugagcggcugcaauuucugcggccggcucaguaggaggagcaggaggggaaagaggaggauccagucagucagucagacagccagcgggagguggagaaagcaggaggaggaggaggauuaaagauggccaccaacagcugcgggaaacggcaacaaccccucacuuuccgggauggucccugcgggucggcccggccuugauggagagaagaaacccgaggagcgccgaggcugaggcggcggcggcggggacccagcgaggacgaggacgcggcggagcagggacgggggcaggagaagggaaaggcggcggcgucgcugccccugcugccuagcaccgcugccuggcccggcggaccgguucccauaccucgcggccgcagaaucgagcucgggccccggcccccggcccgcggcgcggggcucccgggccccgccgcggacgucgcgccggucgccccuuccccguagcccgugcgcccucggcgcggagccccggcccgccgcggucccgucuccugggccugucccgcccgcgcccuccgccggcccucaggugaguacccccgccauccuccccgccccccgcgcucccggagaggcggugcugccucggcccggcgcgccuggccgcuuuguucgugcggggcggaggcgcugcccacucgcggcccugcgcccgcucccccuagggacaggccgcggcccagcugcuguccuccccaggguccgccuuggccgggagccgccgccgccgccagggugggcggccuggcccuaguccuccgcugccuccuggggagggcgccgucgcggacgggucggggucggggucacgggcggcgagcggagcggagcggaaccgggauauuucgggggauaggggaggagagggcuggacguuaccugugggaagcagugggggcguaggcggcccuggcucgcagggguaggggaucaggcccuggcccccccccgcugcauccugcggggucucagcucccggagccacccggaccugagcgcagccgagcgcggccuccaucccucgggcgcugucuccagggcuucgggccucucccccuacgcccuacgcuggaagcccuucgauuauggaaggagccagagaugcuccaguucucuuguacuggggaugugguggcaucgcaaacauucacaguuacggcgggauuuaagaagcagaugagaccuuuccaaccaaaggccaucuggcuaguguuugagccucaggugcaguuuuucauugauuuuuaccauuuaauugugagaucugcaauaucaggucuuccuuucacagaaacaaugugauacaaccagauugaaaggauauuuacugcauaugugaacccuugcauggacuuccaguaccuuaaaaaugguuaaguguuuucuguuggaaaauggugcucaugcauacgaaaaacuauuuuuguucaguaaugguugccaacugguuuacuauguaguuugaacaccaaaca
